United States Patent 9,328,346 (POLYCOMB-ASSOCIATED NON-CODING RNAS) - sequence listing, part 32

SEQ ID NO: 5371 - RNA, 129467 nt, Mus musculus
cucucccuauauauuccucguguacugaggucgcccagcuccaccagggcccgcuauccacaggaaccuuucacaacagccauuacucgcagguaagaggauuccagagcucugguucacccuguaccucacgugggaaggguacacacuccuaugggucacaggggaagcuaucacaaugagaguaggaggugggaggacgcagaagagagagagaaagaacagucguuuauucugaucugggcaaagggaccuuugggaacauuccuccuaacgccccagguuugucugcuccaggaaagaccuuggauuuucauguuuggauaccuuuguuguuggagagagagaucgaugguguuguugguguuuccccuagucccaauuucuuuuucaauugauuggcaugacuuaaaaaugaguuuuuguggggcuucgcuccucccugaggauuuacauacaguuaaugguuaauggggaagagagauguugucuuuagucauguaaccauguagcacugcuaagaugcccgcacaccuggcaacagaaucucacucaugcuccuguaaggagcccuaaugaaacucaccagaucuuaaccucccccaaacccauggaaacagagggaaggccaauuaggaagugggggaauccuaggagcaggaaaagagagagagagggagagggagagggagagggagagggagagggagagggagagggagagggagagggagagggagagggagagggagagggagagggagagggagagggacagggagagggagagggagagggagagggagagggagagggagagggagagggagagggagagggagagaaaggcauggaguuacagacaguugugagcugcuauaugggugcugggauuugaacagagcagucagugcucuucaccacugagccaucauugcuccagccccgaaacaaaggcauggauaugacugaaauacauuauguacuugugcaaaaauguugcaacaaaagccaugauuauguacaaagaauauaugccaacaacaacaaaacauuuaaaaaggaguaaaguucaaaaagaaauauaagugaguuuuccuucucaucuggaaacagcugcuucccuuaaacacacagcuggauuuguaucggggugugcagccccgacggcuaaguccucaccuugagugaagucacguaaaugccucaucucacacagaagcuuucggaaauccugggagucuucagucuuugucugagagaaaaaguaaaagagaaaucgugugucgggggaaugaagcaaugcacuuggcuagaacauuaggaaaaaaguggagaaaagguuuugaacgcugugaacaaaacagggccacagccaggugcgcagaucugcuguuuggggaguauuuaggaugcggggcauugcuggugauuggaucucaaaauugcuccaaauuuauugaaaaguugcaagcaauauaaagaauuccaacuguaccuaguuuaugcaaaugcuaacacguuaccacguuugccugaucauucucucuauaugugcaagcacauacacccccacacccuccccagccgccugagacugagcgcacacacaguuaacaucagaaagcuaacacugagcauagcaugcuaaucugcuaucuaaucuagaggccucuuucccccuccuugguucaucagcacucucgcagccaguccaggcucacacacugcuuuuggcugucuugucucuauagauuccuuuaaccugugaaugugcccaggacaacuauucuccaacaaucuuguugguguguauguguguguguguguucaggugugugcuuuaugaauguaugcaugaguagacuuguguguacauguguagagguuagcagucaaugucacgugauuucaccuuaguuuuugagacaggguuccuguuauuugaccuaaacguguuugcuggaucugacugucucuguccgauggacacagaugcucaguucccaugccuggcugugggugcuggggaacugaacucggacccuacacuuugcacagcaaguacucugcccacugagccaucuccccuguuauaacauugguggcuuugaagcuguuacauuguugaaucuccuucaguguaugcuuggucugagugauguugauaggaagcugcuuuugaugggguuagauuggauaaugguuagaucaggcuccuaacaagcuacuuccucccacgguucuagcauuucucuccagcagagaccucacccuugcugggaaaccugcugaauccagaaucgccuauaguuugauggugcguucugugcuuauaggauuauggggcugggagcauagcuguguuggcaaugcuguuuagcaugcacagagcgccaggcucagucacugacccuggauaaacuguauaagcauagggcucauacccgugguuccagcgcuccggaagugaggccaggagggucagaaguucaaggucauccggggccacacagggagcuggaggccagccugggguaaagagcccguuucaaacaagaagcagauuguguguucuugugaugaaucguccagggguagaauacgaugggaucuaauucuuccuuuuucucagucaaacaacggaagaucaggguauagaagucucaggaggcagaggagcaugugggugaccugcugacaccugcuucuccugcugggcugggcuggggcuagguugaguguacccaugaaaauuuacacuugaauccgaucauggagaccuuucauucaggcucuguggaagagugacuaggauuuuaagggagcaccuaagauuucuauacaagggaauuagaagaaguaauaaacguguacaacugagccuucuuuugauaugaacgagcaucauggcugugcauccuugaccuugauagacaggcucagcaggcucaugaccaaagaucuccuauguguuccaacacccacuuccuccacagaccucucccuaggaggggaauuaaagcugcaagauguuucugagaugucuuaagacuucuuacucucaacaucugugagguguaaaauacuccuaugucccucccaagugagggaacagaaagaggccacccaaugaccaaagcuggccacaccacccaaugaccacagcuggccacaccacccaaugaccacagcuggccacaccacccaaugaccacagcuggccacaccauccaaugaccacagcuggccacaccacccaaugaccacagcuggccacaccacccuaugaccacacuugaucacaaugaauaaauccauuccugcuucacacuuacuagucucuuuaacuagccugugaagacagaaagccaggcccaaccuguuugagcugccaggguucagcucugguagagccugagguauucugguuguuguguuuggaacaucaaaguuacccuguggcuugacagaugcuuuuauuauuugauuuuagaugugugguguuuugccugcaugcguguaugugcaccacaugcaugucugaggucgaggagaggaccuugagcucccuggauuuggagcuaaggaugguggugacuaacaagguuguugcuggggaccaaacucagguccucugcuagagcagucagugcucuuaauuaaugagcgauuucuacaaucccugauaaagugcuuuauaauuaauuauauaucgcaugaugggccaucuugguguggaaaauggagaaacaaaaucuccuuuuucucagucaaaagaauuucagaucaggaggugugaaguccaggaggucaggggaguuuuguggucgacaguuaaccugcaucgacaaccuagaagguggccggacuccggggguuaguccaaucaucugggcuccaggaggggcugccuucugcuagcugagcagcuugcccugguucccgcucuuccggugguccuuaaacacacuugauaaaaauuccaaaguguuugaaaaaaauggugcagcuucugugcauaguggcacagguaccagucugcuuaaaaccagcucugcuaggaggaugcugugggauaacgagacaggguuaucacaguucccaggagcagggaaccacgggcucacaucccagggccucaagggaagcacaaauaaaacccagguguaaaagccucuauuauuguuguuguuguuguuaauuugaccuauauugugaaaagccccauguggggacagguaaaaggaggcauacagaaaagccgcuucuccauagucucagcacuauagugugcaguucccaccucagucagaaccuagaauuuaguggguuauucacuugugagacuguagucaccguaugcaaaacuaagucaucuugaagaaacccggauccuaaggggaagugaugcagucuuuucagugaacuugggcucagcuuguaccacauuuaguuucuauccauucauucacccacucaauuaacaaauauuugcugcgucccuguggccagcacugagccagcaccuggccaucagugugugugcaaagcucagacuuuacauuuuagugacaacaguguaagaaucucacaggagaaaaggugcgcgguuaaaaacuaauuucuguccucuaacagcuuccaggaaguucuucccugaccgaggccucugaccaaacucaggccagcaggccugcauagcagcuucacuaacugagcugucucccagcccugacccuguuacuuaaauuaaugagaugggugucauuuuuuucccuguagugaugagaugacuuacaaauuagcauaaaauauuaccaguguguccuuccucauccccagacuagcagacaacaucuuucuagacucauuuuagggcugugagagugagcuuccuugugaaacacaauuggcugaguugcaaccauguagcuaacucaccaacugaccagucugcgugcuaccaccucacuucuagggcaacaaagaaucaaaugagagcaagacaagcggagaccagaguucugguugccagaccggcacggaugaaaacccagguacggaucugcaucuaaguuguugcaugaaugauuacaaguacucagaacuucacagaagaauguaaaaccagcaggagacugagugaaauaacuuucacucuacuuucagcucucuuacucuuuccucccucccuccuuucuuuccuuccuuaacuuuugagaaggggucucacuaugaaacucuuucuauccuggaacucacuauguagaucaggcuggccucaaacucacaaagaucccccugccucugucuccugggugcugggaucaaaggugucugccaucaugcccagcagcuuaaacacuucuuauagcaugucaguuaucuccugguauucucagccugaaauagaacuaugaaaacaaacucuauguuggagagaccaugacccaagucaccaucugucugcuuacaaccccucguaccaugcacaguggccuuccuaugaaaagacucuuucucucucggacccuccagcuucauucaggggaccaucugggucuuugucuuagccucaucugucugucucucuguggggcuauuucgugcuucacaucccuccagagugaggccagugccaucuuucucuuuauaauuccuuugcucuccaguuaaaccagcauuugaagcuugugcugucccucugggguccgcagcuggucucucucacucacccuucucugcuaguggguuuuaagcaggucuccccuuucuuuccaccacaacuccauccaucaacucgacuucugaaaguuacaugaacaagggacccaacacucgguguauuagcccuucucucuucuuuguccauugccacauuguggaccuuguccauacuuuaccauaucaaagcugaaggucaaggguuuccucuagaccccgagagcugcugguucgauagagcgcuguucacacugcucccagauccccuucacccaauuaccucagaucuuucucuuucuucucagcugaugcuuugucuuccuguuucauggaaggaaguggacgagaacuucuuccagccccauucuccucaagagcuuuuaaucuccaagcuuugcucucccucugucucccccuucugcagagggcaggcguucagccucccccuuccccuguguuugguauucuagcgccuccuuuucccucaggaacguuauugacuuucuucugcuugugucuuccccucuguacaucuuuccacaaacacauuuacauauuuacauauucacaucucuuucaucacaccaacuaaacaaacaacagauccacaaccgccaaacaugagcaccuccccuaaaagguuucugugaacucucccagggcccacgcucugucccuccauucuucagugucuggcucuugcugcuuauuuuuccucuguccaaauccauaguugaaauucccucaacaaucugucagguguggcuccuguuucaaccacuccaaggaacaacgcuugcuguggucaccagucacuccugugcuucuacuaagcugcuccuggaguuauccaaggugacuauuuuugaagcccuccuugccucuggcucccaugaucucacagcccugagacucccucccacuccuucacuuaaccugaaaacccgaggcucaggcagaguuguuuuucacaagaccggaccaaagcaacuuaaggaaagauuguuuauuucggcucaugguucgagugucaguccaugacagcggagaaggcauggcaggcagcaggagccugagacagcuggucccaucacaucggcagcaggaagcacagagacacaugacuguugcugcucaacuugcuuucuucuuuuuauuaauuuugagcugccaguccaggagaugcugcuaccccaaaacaggguggagcuccucuccuuacuuaaaccucauuggaugucccugcugggcaugcccgugagguuuccuaggagguuuugaauccagaguaaccaucacaccaucucuucucuuuccacauuuagccacccaugcggccuuagucaccacauucaaacacuuuauccccagucauauuuuguugaacuaagagacacacccagcuggugccuucagcugccucagcugaccauggacccaggacaugauuaccugcucacuuuagguccccaggaagauuccaggguccaggggcuggagagucagcuggacauuuaagagcacuggcugaucucgcagaggaccuggguuugguucucagcacccacauggcagcucacaaccaccuauaauuccaguucuaggagaucuaaaacucucuucuagccuccauaggcacugcaugcacacacgcacacacacacacacacacacacacacacacacacacacacacaagcaaaacauuuauacacauaaaauaaaaauaaguuuuaagaauauuccuggguccauagacuauaacauguauacuucuaguuuugaaauguuguguuguuuauguaauguuuagauugccauacuucuucuacuuuugucuugcuccauuguaguaauaauguuuucacaccuaaacaugugccugguguauuugucuaugugcuugaguugccagucuugcguuauauauguuucucuccuuagagaugcuccaggcagagggauugcucagcaagaaggacucuugcuuagccugugagauagucgucugcggagcagcccacgcucauuugucuuuguuggcuaaaacaaagcgauacaauaagucauucaacauggcuuuguauucccaaauggacgacugccuccaggacacuggauacuggaacucucuuauucugucacgucucacauagucuccaaaucccuauuggguuuuggcaucuuguggcugucugcacaaaggcucccuaauucaaaguaaauauuuguaugguguuauucguuaccugacaccggcuugucaccaaugaucaacugcucaauuucauuguauuaauguguagcacacuccucauaaaggagacacaucccugggggaaaaaucccuagcaggcaugaauuacuagucaucagccaauggcaauauccuucucuuuuguguuucuguagcuguggauugaucagcacagaagcuguuguguuuacuguguaaaucuauacucagaggaaagcauuagucucuggcccaagagaagauuagcgaggguuaggaacugcuaauggucucucagggagcagguggauuuauucugcccuguugauccuuguuuucacaguggagacacuggcuccauagauaccagugccugcacucacuccuuccuugcaggaagacagggguucuuugacagcccagggcucccuaacuuaugauaguuccugguauaaguguaaacagcagucaguguucagcacauaccuuucccuugcacugcccagugucccuccccugcacugcccugcacuguuccccugcacugcccaugccccgccccugcacuguccugugacccgcccuucacuucucauuggcucuccacucuucucuuugcugaugucucguuuuccuuaucucugggcccaucaggaggguuaugacuugcuguuauuucuuuuucuuugaguacuacagucaagucgauauggagauaacuacccucugggcaaggaacaugaaugagugggggaaggggcuugucaccaaggcugguagcccgaccgagccuguggucugugggaugcuuguacuugggaggcagagaaccaacucggguaaauuguccucugaccuccacauacacagugauguguacaccccugaccuccacauacacacggacgugcacaccccaaauaaauagacacaauauauuuaaaagacuauuccuucucaacgauuugccuucuuuuaaaauuuguacucauaauagaauauuuuugauuuaaaauuccugauuauuaaacuaugauacuuugacauuagaacauuuucuucuacaucagaacaggauguugaacuuauaguuguaagucauuacauaaaucaaggugguggguucacaucuuagagagugugcaguggacagguucacaccucagagaguguaguggacagguucacaccucagagagugcaguggacagccucacaccucagagugugugcaguagacggguucacaucucagagagugcaguggauguguucacaccucagagagugugcaguggacggguucacaccucagagaguguaguggacagguucacaccucagagagugcaguggacagccucacaccucagagugugugcaguagacagguucacaucucagagagugcaguggauggguucacaccucagagagugcaguggauggguucacaccucagagagugcaguugauggguucacaccucagagagcacacugcuauaacaagcacaaucaaggcaugggagaauggaggaagacacagucaaggaaagcucuggagucaauuccaaagccacgcuguccuuaaacaagggaagcauggggauuuuauucagggagucugcagagccauacagggaggugccauugugcagcaugcucaguuaaggaacacauucaugaacacugugagugaaggaguacccucuuaagcacacucauguuaaaaucauggaacacaguauaaaaaaauuaaauggauggacaggaacaccucugggcccgaucugcaugcaccauguuguuuuagcugaaaauaagucaugguugcuuugaagguguccuuauacaggagucaccgcuugggugucugccuuccuuagggugacaacgucuuacagugauuucuuugucucaugaagcagcagucuucauaaucuaucuucuucuuccuucucugccccuuucuccuccucuuuuuccaguuuucuguguuagaaagaauauugugucagaguuaagaacauauucuagucuaugaacauauucuagucuaaauggggguccugacaccccauuuccuacuuagcccucaggugacuucucuguugucuuaggguuuuagugcugugaacagacaccaugaucaagucaacucuuauaaggaugacauuuaauuggggcaggcuuaccgggucagagguucaguccauuaucacuaucauggugggaagcauggcaguguccaggcaggcauggugcaggaggggcugagaguucuacaucuucaucugaagguugcuaggagaagacugacucccaugugguuaggaggagggucuuaaagcccaugcccacagugacacaccuacucuaacaaggccacaccuccaauagugccacucccuagaccaagcauagucacaccaucacaucuguaucucucauuugcaaacuggagugcuugagauaucaugaguacaaaagaacucaguacacggagcaccugccucugcauggcucaugcgucacagcaggugcuuguugucacccgcaaacuaggaugcuugccuugauuuuacuuaaguagucaucuuuccugguuuuauuuccuguugcugugauaaaacacccuggaaaaagugaauugaggggaaaugacuuacuuuagcccccaaauuccaaguuacaguccaucacaguggggaagucacaauggcaggugcgugggacauuuggucacaguauguucacagucaagagcacagagcaaugaauuaauucaugccugcuucugcccagcugauuuuuaccauuuucuucucucugucucucugucucugucucucucugucucugucucuuucucucucucuccuuucugagauagggucucacuauauauaguucuggcuguccuggaacuuucuauguagaccaggcuagccuccaacucauagaggacccccugccucugcuucccaagucccaggauuaaagaccugcacugccauugccagauuccuuuucauuucuuauacagucugugauguccugccuagggaguggugcugccuacagugggcgucuuuccauauuaauucguaugauccuacagugaguggaucuuuccacauugcuuaacauagucaagauaauccugacacagacaagcucagaugccaaacgcuaucuagaaaaucccucaucaagaucucgcccugguguucuaguuaaauuggugacuaaaacuaaccgccacgccaaucauugaucauuuaaaaauuucccucugcuauacaucauuccacuauacauauguggaucugcuacugaucucucaacccuguuugacagaucuaucaucuuucccuaagcuaauaugcugucaaugugcuucauagugacuguuggcauucugugugauauggauuucuuauucagugugugucuguguguggggucuauguuuugguguaguucauagugagugcuaauauuugaaaggacauggaucucacauugaaaacuaucuugguuguccuugggucuucaugcuuucaccagaacuaugggauagccuugucagcugcaugcaaaucugauauggaucagaguuaccuuauccguuuagauguacacaguggcauuaagcauacuaugguauuaaagacuucuuuuuaaguuuucagaaguuuuguagauuaaaacuuucuaaaauguauuuugugugucuguguuaguacuugcauguguguguguacugugugcaugucugguacugugugcgugucugguacuguguguguguguacugugugcaugucugguaccuguggaaacuggagaacaguguugugcucauugacauuggaguuacauguuguaagcugccugaagugggugcugggaauugaacccugguccuuugucuuuaaucgcugagccaucucuucaucccugguuauguacguuucuugcgguuguuauuuaauucgucugauguauuucuaccuguagauguucaguggucuuauggucagugugaauugcuucuuuuauuguauauauuauauccuugaauuguaaauguuuggauuuuguauauugaccuacauuaggaaucaaguuauuuauuuguuuguuuauuuauuuacuuauuauuuuuauguguaugggcauuuugugggcauguaugucuuaugcaccacggacaugccugguuccugcagaggucagaagaggcuacuaagugccacagagcuggaguuaccaagagaugacugugagcugccauguggguccugggaaucaaaccuggguccucuggaaggguggccaugcucuuaaccccugagcuaucucucuaguccaugucaggaaucuuguuggacuuucucugucuuucucuuucucucuuccuaucucuaauguuuguuuguagagucuugacagccucagaauauuuuugguauguauguuauguguacauguucaugugggcaugugugugccuaugugugugcauaugugcaugacugugggggugugcgguuguggagaccugaacccaaccuugaaucucuuuucucaggacaguguucacauugauauuuguggcagaaucuuuccugauugccuggaauucauuguuagggcaaguccuaggggaccccacugcugggauuacagacacaucccuacacugguuguuauuuauuuauuuaucuuuuaaaaauguggguccuaggggauuagccuuaggucuucagcucacaaggcgaguacuuuucuggcugagcuaacuccccagcccaguuuuuaaauuaaaacauuuuguacaggauuucaaacaaugcugggugacagcccuuccucaggagccugaauuaggauccauguuuuuaggacaccacauucuauucccacuacagcaagagguuggccaugaguggauacugaguuucacugagaaauuccuuuccaauuuaacuaauuuauuaauaauuaauuuguguauguaugauaugugugagugugggcaaacguggggucugagggcaaccucagguggcaguccuccaucccacccacuugagacagugucucuuucuucuucucugcuguguaccucaggcuagcuggcccagagccucccgggacucuccagucuccauuuccugcuuugcuguagcacuggucgcucuugccagcucugugggcucugggaucgagcuaugguccucaggcuauacagugagaggcauuuuaccugcugagccaucauuccauccccaguggacucuuccucaauacaccacuggcuacaucuuuccuuucauggguugauacaguacauuauacuugcaggguuuucaaauuuaaacuguucugaaauuuaauuuaacuuugccuaacuuguaucacaaaccccuucaccuacuagacagacaaaaacuggagaguuuccaggcgggagagaugguaguuaagagcauccgcuguucuacuguagggcuccaguuugauuccuaguguguccauauugugggucacaagucucuguaaucggaugcccucuccuggccucuccaggaacuaggcauguacauaugugcaggcaaaacauccacguaaaaaauuuaaaaagaaauuuuuuuuuauauuuuauauauguuguauuauucugguauugcuucuuuugaucauagauauagugucuuuugauguggaguagguuuugauuguuuuacuaacgucaacucauacuaauuacacacacaagcuuucuucaugaagaaccuucuccugacgugcauuuaguacaccuuugauaggcauuguguuuucuuguguaugugcauaucuguuuuugaauucuaguuuccuacucugagguuccauuugccuaacuucaggccauugcuacacuucuuuauguuaauuuuuuuuaauuaauuuguugugaauauagggucuuauguggacugagcuggacugaacuuguuauauagccaaggaugaccuuaaauuucugaccccaugcuuuccuggccugaguauuggcauuauagcaugucagauuauuuuaaacucuggcucucaggaauguguuuccauaugugguaugaaaucaguuguuacugcuuuuagacuuuaaaacauuuuuccuuucacuuuuaauguuuuuauuuauuuauuuuugggaaguucacacaauuuauuucgauaauauuccuucacuucucgcaacuccuuccugcacccaccagaaacauagacucuaguuugugugggccagcugcucugagcgugaggucugcucugagcaugcucgauguacccaacgccacuuccugcuacccucucuagcagccaccaaucgcaaacagccucuuguaugggggcgggacuuuguacgcuccuuccaguucuccauucugggauuugggauuuuccacucugugauuucugggcguuugcuccguugugagugcugcauggcuuuugcacuaccagagcgucucguccgcuccgucgguucagaccgaagcucuuuguuuaagaucuuugcugauguaguaagaagcgcauugcauucacgacuuccagaaagccuuguuucuuuauggcguagaucuuuucgauuacagucuuuuccuuuuaucaucuaugcagcuccaaauuucucccauagaaauuuugacauuuuaguuuucucuuuauuucuggguauuucaggauuuuguugcuguugugaauauauauuuuuuuccaguuauuuuaccccuaauacuucaucucucuggguguuugcacacuucaucugucuuuaaaucuucuuuaaauuagauuggaagucaggccacagggaaggaaagacuccgcaaagagccuuccuuuugagcagggucuccuugagggugggguggggugggugagcugugcaguuguugggcaggaagggaacaagcagaagcuauguggugagguccaaaaguuggaaauaauccuauuucuugggagcuagggacagguagauugaguuggguucauugucucugugggucugagccaugauucacaauaacugucacacccagaaauaaaucaugauuacaguuggugcacauaaugagaacaaaaaagcuuuacaguguacaauaauuuccuucucuugccaugauaaaacguucugaccaaaagcaacuuaagggaagggaagguuuauauucaguuucuaagucgcaguccaucauugaaggaagccauggaaagagcgcaagcaugaagcagacaccacagaggauugcugauuuauggcucccucucaagcucacgcuuggcuaguuuucucacauagcccaggagcaugugccuagggaauggugcuacccacaguggcuuuccuauauagcaucagucaacaaccagccccccccaccaccaccccagacaugccacaggcaaucugaucagggcaauccaucaguugagauucccuucuuagggacucuaucuagccugugucaaguuggcaguugacaguugaggcuaauuagaacacuagauaauugcaaacuguuuguagaaacaugaaauguuuuuuucuuuuuaaaucaaauauggaacucuaacaaauacuaacagacacuaggccuauuucaaagaguugaacauaugguuguucuucauaucugaugcguugaaaugacacaucaacuuaacaaaauaguuuauucauuuggauauugacaauagauaaaaaaaacuauugauaaacucaaaagcucacccauauuggaaaggaagugaagcugaaaagcugacauugacuuuugugguguacagcuggaguugugcuuugcaggaacauuaacacgggaugccuccuagucaaacauaagccagagcccacaguaaguccaccugggaauugcugggcugggaaaagcaaaacacagccaugacagcaaagagcucacuggugaagagaaaaaguccauguauaccucagugugguccccagaagaggcugggagaugcucagaaguucaggugcuugguucauaagacagggaccagaguucaagcccccagaacccauauuaaugacagguggauguggaggcaccuuauaauuccaucucuggaaggcagaggcaggagaucccagaucaagcugucuugaucaccagccaucaccugcaaguucuggguuugacugagugauccugccucagugaauaaagagggagagagugucagccuuggguuucuacacacaugcucacucacacacgcaugugcacccaccccacuuguguaaaacugcaggaagcuagcucgucauccaggguaaaccucggaaagcaucgaggugugguaucagcagcgaucaaaagcugugacuucuggcucuuuaauucuuucucgauggucugaggccaaaaggugauggcuucuggcaguuaacuccugcugauaacaacaggguguuaagaaaagaaacuugguuacuugggcucuuuacucuuuaacucaggggcggcuugcuggucaggcaagugucucagaguccguuauuuuugaggcagagaggaaggaaagaaagaaaaaaaaauuaggcacacaaacuggaugaaacagaaaaggguuauaucaccacguuauuuacuuauuuuaaaaaugauuauuuauuuguuuuaugugaauacacuguugcugucuucaaacacagcagaagagggcauuggaucccauuacagaugguugugagccaccacaugguuaugggaauugaacucagaaccucuggaagagcagucagugcucuuaaccugagccauuucuccagccccuugccacuucauuuuuguucuuaguuuuuauaucuuuugaaacaaaagaugaccucauagcaacuaucaguuagaaccauuacagcaguauaauuguucacaugguuuucuaaacauuuuuacauucacauguucauagcaaguuuaaagcaauaguucauguaauagguuaauaagguuuaaggaguuauagcagaaucauuuacauucuuuccauuagacuagugccugaauaagcauuaucuauuuucuagcuccauaaguucauuauaaguuaaaagcaauagauuuuuguuguuuuuuuuuuuuuuuucuuuucgagacaggguuucucuguauagccuuggcuguccuggaacucacuuuguagaccaggcugggauuaaaggcuaccacgccuggcuaaagcaacaguuuuuaugucacaagauagcaagguuuugucaagagacaaaucaucugccuugugccuuauuguuuugaagucuuguauagauuaacuagucaaucauuuauuuucuguccuugcaccuacaauaauuuguccauucccaauguaugaucuuuaguuacugagacaguggccucauuccuaacuagaaggaauguuuccuugaucaaaaauuuguuccaacccuguuuuauuuuccuaguggaauuagccugugacacaugaaggcucuauuugcagcuuuuauucuauagggggcauggauuuacuuuucuuaauucaggaguucuauaaaaucacuaucaggaauuaugaagucaucaauuuguuuaaacugcacuauuucaugaaaguucaucuucauauugguucuguagaagaucugcccaauagggugggcugauacacagaaaucauuaggcuauguaacagaggcaggaaaggcaggucagcagcgagaagcaauccuaggaucaagucucuuuggaucuugccucucagagugcacccacugcagccaugcaaaacggugggucaucuccaggaaacucacuuacuugccauagccguucccacauggcucuugucauaaaaccaugcauaacacacacacacacacacacacacacacacacacacagagagagagagagagagagagagagagagagagagagagagagagagagagaaccaagcucugcaccuuuguucugcagagcagugucaccuguggacgcugagcagaaggguuccucccucacaugcuguuuugugucuccccuccccuccccuucuucaucaaugguuuccagugagaugagucagaaaauggccaaggagggccccaggcucuccaagaaccagaaguucuccgagcacuucagcauccacugcugcccacccuucaccuuccucaacuccaagcgugagaucguggaccgcaaguacagcaucugcaagagcgguugcuuuuaccagaagaaggaggaggacuggaucugcugugccugccagaagacuaggugagugcgggcucugggccaggucuacaccacauucccuuugcuccauccaugacugucagcucccuguuaggaagguucuggagggcgagcagaaggugggagggagggccgggccuuccugcuguuuccaguuccugccagcaucccuuaagcgacgguggagagcccaggcugcagccuccagcuucuuuuggcccucucugcaccagccgccgugccacguccccucagaggcccaagcaccagccagcugcguccccagugguggucagagcgccgccagccaagccaaaguccccucugaugccagccaagccaagguccccaccgaggccagccaagccaagguccccuucaaggacugagcgccagccgcguccccgcccagagguccgaccaccaccagccaagcagaagcccccucagaagucuaagcagccagcacgcagcagcccccucagagggccaggcaccagccgcggggggucucccaccagagcuccuagguucugguaacaccaucucuugccuuuuguccccucuagccuaaggucaguagcugcucucugcaaguacuaacaugggggaucuguccacaguaccaagccuguguaauccacucccugcauuaaacccccucuguuugaaagaccuggcguggcuucuguuuuuccagauguuaccgguccucacuuuagauggcugugucugugccaauccauaggacuggaagucacuaauuuaccagcauaguauuggccacaguggcaggcugaguguaugagccuccuuaaccaccuugugccucagagagacauagugguaacugaugaguuguaucugugcaugugugaugggaggacccgaugcucgauuugcugacccuccugacgcaucucaucagauaucuguuugcucauacagccacucagcaaacucuacugcuuuauagauaauaagguucauaugcuguacuggggagaggaaaauaauuugugauuucugaguaccaaaaagagacaagcuggcccugauguacuguaaucacuccaguacugccaugcucaggguguuuaugcccaugggagccccaacugggaacuuuccagcucugccgugggaaccugaggcuucacagagaaaauuagguuggagugagcaaacuggagaaggauggccagagaggaacuuacccaucugcucuaccucggguagaccaguuuccuuucuucuuuuugagacagagacucacacuguaguucaggcuagcccagaucuuacuccguaucuaagguugacuucaaacuuauaaaaaucuuacugcuuuaaauucccaaaugcuuggauuaaaggugugaacugcaaugcuugguggugacuuccucuucuuucucuuccuccuccucucccuccuuccccccucugucucccccccucuucuucuuuauagacuuuauuuuuugguucaguuuuagguccacagagaaacugagggaaagauagaaacuucuauucccugccccgcacacagaguaggcagcauuuuacuccucggagguagaucuguguaguggguccacagcgagcacugguucacauccuuuucacucugccacucagccccugcgcagcuuuagagaacccccgugagaaucucacgcaugguucuuucagacagcaaagaugcaagaacaauugauuuacccagccaaggaacuaacuggcugcugcucacuagaccucaguaccuuagagagguguauccaggcugacugaucacuaagucccuccaagggacuggaguaaaaaagcuggcucagcuggcuaacuucugacauacagaagugcccagaaaauggagggggcugaggauauucauuuuguacagaagaggcaguccuucauaggaagcuaagcgaugccucugggugguuagguucaagcuguaacuggacguucucucagucacucuuuggguaucagcuaagguguuuccgcuggcugugcccuaugucccugggaacguaggaccagcuuccuaccagccugcaccucucaugcaccccgagucccacccaauacacaagcucccuucucagaaucucagagguccuaagguaauauacuagaauagauauuuuaccacugcaucguuuauuucguuuauugaucugacuauuucaaaucagaggcguaggaggcacauuaaugggagcaguuuaaucagggcagcuagucagacauuuagaaaggguuaaaaagguuuucagaagcugcccgaagucagaucugacgcuguuccucagguaguguguugacgaaucaaacgguucagacaaaggucuuuuuuuuggaucaauaauaacuccuuagaaaaggcccucuuccuggaccggagaauaucugucuuagaaaugaaugggcuugguuuucagcaucccaguggagggcagaagcaucucucuuuugaugggagguggucauggcaugucccucuggguuuauuacuuccggugucuuuaagauuugggauuugaugccaggauucuaagauuguggagcugcuaccguaagagaucagcuccacagcccggagaaaugaggccacguaacuaaaaaguaccuuuucucaacuucaauguccacuguuccuaugacugguaaaaccaaaaggauaauuuacuuuaguacguugauuuuaucuauggugauuuaacuuacucuagcuuuuuguggguggagucugggauuuuagacaucauacucaugucuuucaguacagacaguugugcguuuucuguuucaacccguuuaccuauguguguauguuuugaauugcuaucuugcuaaaagcacgucuugagauauggcuuagugucuucaggcuuuauugucaagcuagaggauggccccagauguguuuuagaagacucacagaagcuccaguggcugcuagcaucucuauggcagcgacugccaaccguuagauguuagaugaacaucacccugguguuccaugagaaauacgcacuggaguccuuggauucaauuuaugugauaaauccaacucugcugugcaggucgagccagccuguucuuggagggagccuacgcucccacagugaucuucugugaguggauuuagggcgcuugcuucuccagccucacacaguccuaggcuguucguuucuuccgaucuccuaggugggaaaucuuuguaacuucaaacuuucaaagcuacuuucaaagagugagaucaggguggauuacagaugauugacccucgugggcuuccauccuucaacccuccuguuugguuaggacaaugguguuugauaucuccuggaagccaaaccuucuucucuugcaucuaaggaguugccauuauccucaguuuagggaguucugcucccuaaacugugcuagcugaccccacauuucuuucugagcaggugcugcccucugcugggcacggauuuauagaccuguuugucuuccucccaggacugugcguaaauaaggcucaggcaaucucacacccaucucucuagcuuacacucagcucagggcuugacugauguugauggcugaaugggaccaaacaauuuaccucacagucugacucagcagaagguggacggcuucagcaucggguuugaguccacacuuuuugauaaacuuguaaccagugcgugucugggcccaccuauuaguaauacauuuacuaaauauugcuuaucuuuuuaaauguaguucauucccuaacaaauuagagacaugucaaccuggucaggauuuuauaagaguucauauauacagaugugcgcacgguugcauuuaagucugcgguaucagucacugcucucacugaugugacgggcuaucugggcaaacacguuaggaaggcucauucuguuuaauguauacaggagcucuguuuuuaugcauaccagacgagggaaucagauucuauuacagaugguugugagacaccauguggcuguugggaauugaacucaggaccucuggaagagcaguaggugucccuaaccacugagccaucucuccaguccuggaaggaucauuuugacucacaguuugaagggacacaggccaccauggugagcaaagagugguggcaagaaccugagguggcaggugauauggcacccgcagucaggcagcagagaggugaccgcuggugcucagcuagcuuucuccuuccuauucagucccuggcccugagaccagggucuguugucccucacauuccagccgagucuucuccgcucacuuaaaccuuucugcgaacuuguccacaaacacagagauguguuuccuuggugacccuaaauccaggcaaguugacaauaaagagcaagagaaagugagcugaacaccagcgcuuaccucucugcugccugacuguggauggcaugugaccugcagagccucagguccuugucacaaguaauaaaauguuuuuguuucuguucuaagagcaggauauacuuaugcuagcuuuguguucuucugggucccuuaccaccaguagccagaaaaccaaauauuauuaugcauggaaacagggauauauauauauauauaucuccuuuccuaugcucaguucaggaaaaaaagaaaucaacauaucaguuuugcccagagauuaaaagaguugagaaagcuggauuucuaaggagaaaaaacaaaacaaaaaaacaaaacaaaacaaaaaaaucaucucaagugguucacucagagcucagcaguuaaaagcccuucuugcucuuguaggaccugaguucaguucccagcaccuacaugguggcuuacaacucuauaacuuuaguuuuagcgcccucuucuggaaccugugagaacugcaugcacauggugcacauagacacacacagacacacagacacacacagacacacagacacacacagacacacagacacacacagacacagacacacacacacacacacacacacacacacacacacacacacacacagaguaaacacaucuuuuuaaaaugcccgugaagucacuguuguucuaagugcucugcaggaaguggacaccaccuaccaauucauaaaucuuucuuuuucucucuauaaaucagauugaggaggaggagcaggucaaccccaaggaagaagugaccgagaagggacuucuugugaauggacagccucugccuguggacucacugcuucccgcaacccaucugcucucagacgaauuaucugaccucaaguaugaugcaggaguggacgccugcugauguaacaaccacagaugcccucaguccccauggugugggagccuuagggcagccuuccuggaggugagaagggggcucuucgugucguacucuagccacggaguccuggaaggaucucuugugcuccagagcucagggaacgggucuuuugguuucaucuggagccccuuucucucuggcaggugcacgcuuccucagggucuuuggcaaaggugauugcagagcuaauccacacacauuccuccuucuuccucuccccucccucccugcaucuggucagcaaacaugacucuugauacuuuuuuuucucuuccuggcucucuguccggccucucuugcucgcacaccauuugcuucccauucaccucuuagccagcaguacucagagccagagucgagucuggugaagggccauggaauuguaagauacuaaguuguuguaugauccuuaaaugcggcgauguuccgauaaguaggggaucgcgcuaaauucccaugugaacuguagguaacuugugucagaaacagaggaaauggaggcauccuccuuccucccccuccgcgggcccagucuccagccucacacagggcuuugagagaaucaguuccugccccagucuggggagaaccacccucuaaagccuugccuuugagcuugucaccugcacaggcgcccggcgcagcucugacugcuuucaaaugauaucauuuaggaaggucauauggcuucagcccugucccccaacccucccaaucacuucccucgcagcauccuggacaaguccccaugcgcacuuguauaggucuagaaagagugccaggagcguuucugucuccaaaucaaaaccccucaaauuccugagaggccugaugcuccagugcuuccccuggcuggcccuccgcggcuaugucuguggcaaggagaggugaaggaaaacaggaagggaacuuggccuucuggaaaggaaggcaaagugcgugugugugugcguguguguguuugcgcgugcgcguacgcgugcgcgugugaugugugcguguguuagagaguuaucaguccaagaucccaucccugaguaggaggccuuccacgggaugaaggggucugugcucacuguggagguggaguagcgcggggcugaguuuccgucuccucgcucuggucugccuccacaguccguagccuccagacucccggggaagaaugagcccgagcaugggcucuuuuuguucuagaccacaggagccagcccucccccauggcguggcacuugcuuguacccaucuguacacuugcuguggggacagagauugggccagauggaagcgccucguacugccuuguacucguguggacugcuguguggguguuggccuugggaguagcuuggggagaauaugugccagcucucaguuuucuugcccaagugcaaaugcuagaggcccuuccaagucccagguucauucuugucccccaaaggccucaacugcaggaggucgucaugaacugcaggaggucgucaugaaaaggccacaacgguacaugcaacacuucagagucccaaagccuucucagcagggggcacauggugaucggcuugggccucuuuucccuagucagcccagaugggcgggggcggaggguggaaggagaggaguuggauagauccaucucuagucaggcuccaucugggucggccccacaacuucagcuugcuuugagcccaaacuuugguaaguuauaaacacaaagaauagagaaagagagauagagagagacacacacaaacacauacacacuacacagauacauacacacacacauauaccacacacacgcacgcacgcacgcacgcacacgcacacgcacacacacacacacaaaccuugucacuccucaccccuccuaacacuuuucuccuuaggaggccaguggacgggaaggaggccaugucucuauucacaaggaaaccaggcucagggccugacucagugguuaaaaaauucuugccuugcaagcaugagagcuagaguucaaauccccaugacccacacgaaugcuggguaggccugacaacguaccucuaaauccaaacugagaagcuggugacaggagaucccagagcaagcaagaguggccauaucagugagcuuugggacugacugggaaacccuuccucagugacuaugguagaagauauaggacugacucccaaugucaaacucagggacuccaugcacaugcaccccuguaugcuugugcacauacacuugcacacacacacacacacacacacacacacacacacacaccacaccacaccacaccacacaccacacauccacauggaaauggggaaaaaggaaacaagagaguaccagacucaugguucuucgaggaugggugcauccuagccaggacuuagaagccuuuccccacccaggaagaccucaccauuucuuccuccuguucccucucuuguacgugugagcugcuaauggggugcuucauucaccauggggcugugugcaugcuccucagagccugucacgcucuggccuacggcuccuacacaggugcccugagcgcagauaucuucucagagauuccuccacggucaccagacuccaucauugucuuccaggaucaucugcucacuuauuuguuuaauucucgccccaaugcuuugccuaauguaaaucccacggcggccccacugauuuauccugucuccaguuaucuggcacuaacaagaacucaauaaauacuugcugacugaaagaauguuuauuugcuuuuaagaauaguuuuaaaaauaauuuucaaaaaguuuggauccuuuugaggacucagaggcgucgauugcagcucacugggaauugcuugugaccuuggcaggaaauggaagugaggauggggaauccaugaauguaaauguaacacccucagcuuagccuggccuccaaggaagcagaggaugggucccaucagguuguuagcucgggagcuguugauuguaaugcaaugcucuugggacagggacagcaggaugucugaugaagagccacauggcaauuaacugauggagcuaagaaccuagguggugggcagggagcuuggggacaaaaggagggagacauauugaucacuugagggggcuucucacuggauggggaaagggggagggagaauuguagauuaagugaauuuucacauucaguggugaggugugggguagcucuugccugaacccuuguuuacuuuauauaggacacaaggcagccaguucacgcuggggugguagcgagcacaggacagaugaagucagagggcaggguuccaaagaagucacuccaaaucaccucugugaaguguccugaucccugccccccauauuugaaugaauuugcauuuucuuuuuaaaaaaugauuuguuuauuuauggugugugcacaugccaugugcacuuguggaggucagaggagaacuugagggugucagucuccuccuguguagguccuggggacagaaaggcggcuaaauaucuggccguucacuucauugcacgcccccuccccaguucugacuggccaaacucaggucucugugaaaacgaaagacaccuuuccuguaccuucauccuccuacaaugcuucucaggaggcuuaagcccccagaggaacaaggacacuauaggagacucucacugagugacucucucaugcagggaagguuguagcuagcuuguuuagcccagagcaguccuugcaaaugaguaaaaccaaagucauguuuguguaaauauguauucauaaauauauucauaaauauacaauucauuuucucucaagaugucagucccugauuuaaagcccuuuaggggugaagcaauuucugcuuccacucauaguuuauaggagcccaucugucauggaaccgagagugcuaaacaccgucauacgauacugaaaagaaaaaaaaaauagaagcauugacccucaaguucagacccaagucgacucacuucugugucacugguaaauggugcccauauugguugauaaaaugauaauuuaaauauauugacgauuguaagcuugacccaagagagucucagugagggguugucuagaucagauugggcugugggcaugucagcgggaaugugcuuugauuuucuuaauugaaaagggaagacccaaccugaaaguggcuggcaucauuccuggauuuggguuuuuggaagcuaucagaguagagcaagcuggaugagcacuaagcgugcacacagucacuucugucuguuccugacugggcuugcagugugacuuucugucuccagcuccugcagugagaauugugagcuaagagaaacauuuucucuccaagguuucuuuuuccaauuuguuuauuuuauguaugugaguacacuaucacuaucuucaaacauggcagagaggguauuggaucccauuacagaugguugugagccaucaugucguuguggggaagugaacucaggaccucuggaagagcagccaguguucuuaaccacugagccaucucucuaguccccuccccuaagguuuuuauuguuucuuuuuauuuuuaacaucaagacauguuaucacaucagcagaaaugaaaccaggauagaaauggccggacuuugaacacaucuuuuaaucaucccuuuccugacagaagcaaacgggugauaccugccuugcccauucuacagagauguuguguagaccaagaaagaacuuaagaucuaaagguugaguguauguagauggugacuagcuuuuacaagacuaucugggggcagcugggaugcucugggaaguaaacgugacuucaaaggugguagauccaggcuuuucccuaccgcggacacuaaccagugguguccugccaacagcucugccuguggcuuuugagucauucaccuguucagaacacagagaaccuuccagaaaacacccagcccugcaguucugugauuucaguggacuguguugucuuucagcucaaucaauagaucguacaugugcaagacaagggaguggaugucugugcaguuucugugcuugaggugggaauguacacagagaagcugagccccucuauuuccugggugggacaguugcuggucagugggucuaccagacucgaccccggaggagcagugcuguggucuacuguccuuugguggcugccugucuuuuauuucucacagugguugaguuaccaccacaucuguccucuagcaugccuacaacuccagucaguaaacugaaaguguguaccuagcuggaacuuguuguaugcaugugugugugcuggugugugugugugcuugugcgugcaugcaugugugugugugcaugugugugugcaugcauguguguguauguacaugugugugcauucguguguaugcccaaguguauaggucugaggauaacuuuugggagccaguucucuccuucuaccacaugggacccaauaucaaacugcggcuggcagaugagguagaaagcaccuuuauccucugcaccauuugccagcuuuauccaaaacugcuuaagccgcacgauuuuucucuuauuuucugaguccuuuuuggcaccucuucuucuguuuuuaucuuagaauaggcuucgucucuggaagcuagauacaugagucagacacaaacaagcuacauccgcagggcgggagagggggcccuuccagcuuacugaccggaguuguugguugagcugguuucagggguguggcguuccaugggucuugccccucucugcccucccuauccucagggccaagugugugaccagagcucgggugugugccucccuucacagauauguccuccucuucaugagagcgggguaccugcuucugaaggauguaggaggccaacgggaacgcagggguccaaccgccaggagaaccaggggaggaacagccccauuuaguucugauguuuuuucucuccccucagcauguggacgaugccauuccaucaccucccucuauaacugccagcgagauaucucugucaacugucucgacucuccgagguaagauucuuuuucacuuucuguuauuuuuuaacaagguuuuuccucucugucacugacauuccaaaugcuggcugugaugucacuaaguacagauuauaugugcuuguuccgcccaggauucggguucuucaggcugaagauucuugugucuucucggaugugcaaaacaaggucauggugcacaaccaugcaaaccgcaaaugcaaaagagaaauugucaagguuggcggugacgugagaaaaauccuagcagcuaccgaugggagucuauacauugucaccacugagcuguacucuggggacacugucaaggcaaaauaucuuaaaaccucuaaucaagugacugcaauuuuaggaauccauccuggagaaaacucacaccccuuuagagaaggagaaaugcgcagauuugucuaaaagaucgugguuuguaguuaagagaaguggaaugaaacuagccaaaaugucuguccaagggaaugagagaaucaauuuugggacguucacaaauaaaguccuaacagcgguuaaaagccaaucugucagauagaccaugucauguagguaaaucuagaaagcaaacugagaacuauaaaaaucaaguaccgggcaguaaaugcaguaugacguucugggccugaauauugacaucccacaguccuguauugguuauugcuuaauaaggagaagccacaagaucucacacuuuuucuauaaugcaauaggauuuaaaaaugacagcagaacacaaagacacuagaaauuguccugucagaaauaaaaguauaagaaauaauuccuggcuugaggaaauaacccagacuaaaagcuacauagaaacggcuuaacaguacuggcagggcauauauuuguuuggagagggucgaugugaagucugugaauagucugggauguuuacaaggucgcauaaauuuuaaacaccaaaaauauuuguuuugaaucaauuuugggucugggcuauagagucugccuugugaugguuccugacacgagagaaaagggaagaaauguaaauacagcucucgaauuuuccuuuaaagaccagguagguaggaaaggacaacaggauguuggggaauguggagggauguaaaacagacaguauuacgguggcgaaaacucaguguagggcgauaagaacaucagauggccuugugcugggagccgggguggccaagcacaggcggaugcuugaagaccccaaaggucaccauggcguccucacagccagacccggcaaaguucagaucaagugcacggaugggggccauguuaguggaaacuguccaaggugugcggagggggugaggaagacagccaggaggaagagauggcucagaaugcugcacuacagcaaagaagaagcaggccaaauaucguccuaaggcagccgaggggucccggcuuccucucccgagggcacuguggcuccguggaagugccgaggcagaggcaggggaauuuaacugcacaaaaacuacacgcagaaacucaggugcuaaaauggacauguaugugaccaccuuucugaggaccagguuccagugagugcccagggauguuuccuucucgacuacgguaacugagcugagaagaaugggaacggguuaggagcacacaguagcccauuggugagacaaauuuccaggcuagcuucauccaauccauuaaggagacuuuaugcuuuuucaucuuguuuucauuuuggcaaagcaaagccuauccugagugcucguuugucuccgcccuccacgccaccccugagacaccgagcaugcgcauuaacccagagcgcgcuaacccaugcgcagcguuggacguuagcucauuaaugugauuaaccagaaaccacuaaauuuuguuuguuguagaaauaaaaccuggggauggaucaaaccuaucuggagauugcuugaagcugauggguuacuaagcaaaaugugcuuuggaauucgucacugagucgcguuguaaucaccacguacuguuuuucuacuuaacaucgacucucaggaacauucccaaguaaauaccggagacauuucauaaaacuccaaaagcuguucuucauacauuucuugaguagcaauucaaagccacaaugucugacauuauuccgaauguuaauuaaucuuacauuuugggauaaacggaggcaugugccuggaguuguuggggucuccagguagaaaucaucauagcauuuacuaauucccaugagguaaauauucccgcggugacgauacucagcgguaugacugggaagagcuggccgcauuggcucccacgcauaguuuauugcucucucguguccuacccuucacuaucuucauccacaugcacaggcuggugcaaggcagauagcugcuuaccugcgggccucuauacaagcagaguuuaauacacaaagucaugggcuggagagaugcucagugguuagagcacuggcuacucuuccagagaaucuggguucaguucccagcucccccaugcuggcucacaaccauccauaaguucagguccuuggcaucugaugccccuucugggcuccgugggcacugacauggugcacauacauauauguagacaaaccacucacaagcauaaaauaaacaaaauuuaaaaauguguaucuagccgggcagugguggcgcacaccuuuaaucccagcacuugugagguagaggcagguggauuucugaguuugaggccagccuggucuauagagugaguuccaggacagccagggcuacagagaaauccugucucgcaaaaccaaaaaaaaaaaaaaaaaaaaaaaagguguaucuaauacacaguaucacuaccaaagaaaagcuauguaggauauauaagauagauucaguuuauggagcuucaauggggaaaucugacaggauuaaaagauuacguuuauugacaggguuucacuaugcagcccuggcuagcccagaauucccuguauagaccagguuggccuccaacuugcagauaccugccugccucaacacggaauuuuuuuuuucaauuugagaaaugauauuuuuauucuauuuuacauuugaccacuguuauucuuuuuuuuuaauuuuguuuaaagaaucuuuuucuuuuuaaaaaaagauauuuauguauuuauuuauuuauuuacuuauuuauuuuucgagacagaguuucuuuguauagcccugucuguccuggaacucacuuuguauaccauuuggccucaaacucagaaaucugcuugccucugucuccugagugcugggauuaaaggcgugcgccaccacaccuggcuuuauuuuuuuuauuuauaucaguacacugaagcugucuucagacacacacuagaagagggcaucagaucucauuacagaugguuguagccaccaugugauugcugggaauugaacucaggaccucugggagagcagucagugcucuuaaccacugugccaucucuccagcccuuuuuaauuguuuuaaaaguaagcacacaaaguaauaauuuccuagugauguuuucauguauguauggaauacagcaggcauccugacacuuuguucuuaccccccuccccccacagugccagucccuucccuagacugacucucuuccuccuggcaucacaugauggucacacacagcucacuaugguaugcugcccucuucauuaucuuuaucauuagucaagaaaugaucugaucaucccgccccaggcucuagugcuuagccuuaaaguuauuaaauacauuuauuuauuuguuuacuguguuuguaugugaguaugagugugauggucuguguguguuugugugugaauguuauuguguuuauguguguguuugugaguguauguuaguguguuuguguuaguguaagcauuaauguguuuauguguguguguuuguguguaugaguauguuaauguguuugugugcgaaugugaguguguuugugugucugaguguuaguguguguguguuuguguguguuuguaugagagaguguuaguguguuuguguguuuguauguguguguuuguguaugugugaauguaugugaauguuagcauguuuguguaucugugugugaguauuguauuugcauguuaguguguuuguuuucgugugacugaguguuguguucguuaguguguguguuaguaugugugagugugugugcacacaugcacacacauguagcagucagaggacaacuugcacagcugauuccuucuccccugugaguccugggcauggaacauaggucaucugacuuggcagcaagaacuuagcccacggaaccauccaacacuccagcccugagcauucagcuuuugggggauucccuaugaaacuggggcuucuuuccuuucagaaauugguguugaagugacaggguccuaagacuuguagaaccuggaugcuguggagcaagguuagggauggcugagaguggaaguguuaugagcuauggguggaguggggcaguggucagcucugagacguagaccugagguuugguaggauggcagcagcucuuugcgguccucaacaauugagaaaaucagauaaaagcucugaagcugaaaaauuagauuaauaaacuucuuuacuaaagucgaggccaagggacuaaaacagagaucaagagaaaugcccagaagaaucugugaaccaggaucuugauaaacagucuaggcuggcuuugaacucaucaucuuccugucugguccaccugagugcugggaugacaggcccacacuuuugacucagcguugccauggaagugguuuuuagagguuuuaucugcucugucccuagaaugccuuucaucacuguguauuuuugcacaaaucuauuuggaacacgaaccaaagauguuugugccccuggauucuaaaaugauucucugacaagagggaccagggcugcccaugggggacaauugccauaucucagggauauuccggaaucagaaucagccugugaucccagacgcuggaagaagggaaggcugguuagagcgccaaagugggaagucgguggugugaaaacugacaacccagcagggcugcccagaaagcgcucgcucgccugaacugcuuacugggaagccugcauagccaugaacccgacuaggcgaggucuacaccaaagauuuguuuuuaauaaucgacugguuacaaaugcagaaucuuguuguucugauaaagcaacaagccuagcauggccagaagggggcaucgugggaccuuagcuuggucccagagauggcugugaggcguggcuuauuugcuggaaaagaacaugcgcggguggaucggagagaacuggguucuccaggcauccuggagauacucugugagcgguuucucuuuccauggugggucaagcccuuccuggguucccagccccaggcgccagggugaguuuuaucagugguauuaggauuuccuuguauagucugagauagaugcccaucgugccuaagaccccagccauggcucccacacagagggacugaguacuuucucccaggaagcacaaccugucuuggguucaugcgacucuggauuccuaaggcaggcauugggaauucaggauguggucacaagcagacaucugguguggaggaugaggcgucccguggcugagggugucucucuugggaccgcaggaacaaugacauaggacaggaguaccuaaaagaaacauuagggcaggagggcucugaggacagcggaauggcagaauggagaacacuugcuuauucgcucuuaaagguacuuuacauacaguagccaacugcucucucuccccauaggacaucauuuggugcuuaaugaaacccaagaacagguccauagaauuaacugaauauuuuccauguucagcccagcuaccaaaaccagucaugacagacuauacugaugucauuucccucccccacugacauaaguccaagguuuacugugguccaccgugauacuguuucauaagaaaacauacugucuuagucagucauggugcccuucuuuaacauuuuuuaaagauuauuuuauuuuaugcauaugagaguuugugggcauguaugccugugcuucacacgugugcagugcccauggaggucagaggagggcauuagaaggccugcagcugucguuacagauggcugugagccaccaugugggugcugggaaucaaacccucauccccuggaagggcagccggugcuuccacugagccauggcuccagucccaguucuugaagucuuccauggaagguauugggagagaaggaaagcagacgguggggaagucgaaaugcaaugugaaauggcugccgucucuucaacacauguacaagaacaccaggcugcuaagccuuuaggaaagaacacacguuugagugacauuugccaacaacacguaggccauaagauucccuccccccucccccggauauuguucacugucgugugaguguuccucugggagaagugacacccuuguugccucuaggcaccuuucagaugucuguaucugagggauguuaacauaccugcuugcuggaacucgagccugcauggccuuuccuggagccaggacaaaagaaacgcagggcauuugcaagcagaucagaugauuaaaucaguaaaucagauaaugcagugccucugauuuacuuuuaaauguuauucgucaccaauaaauguauguagucugugcugucuucagacuugaauaaagauuuuugccugcaaguucaugaauaaaacuggcgagauuacuggcaaucacuccaguagaaaaacacugggaaaacguuguugauacugaguaaucuucaugagagagggacggaaggccccgggaagugagggcuauggaauucuaguuuaaagcaaagaacaaugcccagccauuuucuaaugaugggaagcgguguggguggaagauguguauuguuuuuaauaccuuucagagauaaagccaucucuuucaugagaaccuuguaauugaguuucaacccaaggguuucugggaaagaacacaucuagaauuauaagauaaaaauguuuuccugagacgaaaaccaucuuuuccucacuccguaugucauaagugcacgagggaaaucuauuaaacaucauuuuuagggaaacaaacaaacaaacaaacaaaaaaucagauagggccgggcgugguggcgcacgccuuuaaucccagcacucgggaggcagaggcaggcggauuucugaguucgaggccagccuggucuacagaguaaguuccaggacagccagggcuauacagagaaacccugucuccaaaaacaaaaacaaaaacaaaacaaaacaaacaaaaaaaaaaccaaaaacccaaaaaacaaacaaaaaaacaaaaacagauagggguccaggcuuccaaacaaaauaaaacaaaacaaacccaacccaacgguaugauggccugccagagcaauuaaaauaaggccggaaacugcuggggugggccggggcaugagcagaaaaguggccuccaggcaggggagcacaggauagcccuccugaagagaccugcuuagugauaagcaggcagaauccccagcauuuaucaagagcccaaggggaugaugggaggagaggcugcccccuacuggggcuucccggaauuuacaguuuaggaggaaugaguuucugccucguuugcuuauuuuagucuuucccaaccuuuacuuuuuuauacaauauauuuugaucaugucuuccuccccccccccccaacuccuugcagauccucccaccuccccauccaucuaacuuugucucucuuucuuaaaaacaauucacaaaaugaaacucaaaaaccaacaagccaaagaccaacuagaacaaaagguucgcggacaccacagaguucacuccgugccggcgaacgccuccugggcaagggacuugcucuggggugugacggagaagccagcgacacucauggacaaagccgguggguggaaaaugaaaagaugguacauuuacagaauggaauauuauucuuaaauguuuuaagaaaaauugugauggaacccgaaaagagagcacccgagugagguaaccucgacccaagaggacguuuuguugaguuacuagucaaagggcuccacagagauccccgaacaucaagcgcuacugccaaggcuauuggcugccuugcacaaccugacuguaaggcuccgaagcugaagauaccacuuaucugugccauugaacgcaaagaaguugagcuggugcccaacugugggugcuucauccccaccaaguagcuggcagucauggugcuggaagaugcuccgcagacuaccaaaggggacagguggucaucccgaucaccuggcugagaccagccuguaggauagacuggcucaacacaaacguuacaggaguagccaaccacuuuuuugauuggcuuuaaggccgaccccaugagaaggaacccauuccugacauugcugaagugcccgagaacccuagaggagguuuucccccagcccugggaccugcuauuagucugguaaagaaacguagcagugaguugacucuuccuuacguacugcugugcucauagaucagaaagcccgacccacauccaaggagcuuuaaagaagaugggaauccacacggagagcuacaacuggacaguguuuagagagugagagacuuuggagcacucagucccaaaugggcugucuccaucaaaccccuccccaccaggcuuggggagcuaugcagagaggaguggaaagcuuguuagagccagaggugaccaugacuccaaggaaacagcgacucccaagcacaacagggcugagauaagcucacagagcagccagcagugugccuaagacccucacagguuccagacagaugagccccagcauggagagagggaaguagacauggagucccacuccuaaccaagaagcuaucugcgauggaucuccacuggaaaagggaaaaaucuaaauauaagggcaaauauacaguauuugcucuuugggucuagguuaccccucucgggaugccucuuuucuggcuccgucauaauuucauuuuuaacaccuaaauaauauuccauuguauaaggucauuaucuguucaucaguuaaugcccaccuaggcuguuuccaguuucuggugauuaugaauagagcagcuauaagcauaguugggugagugucucuagaguaggcuguagguccuuuggguagaugcccaagacuggucuagcuggaccuugagguagauuuauucucagucuccugaggaacugguuuccacaguggccauacaagguguacuuccuccagcaaugaaggaguguccccuuaccuuacauccuggccuggaguguccccuuacccuacauccucgacuguacacauugucauuuguuguauugauauuaaucaucugacucuuucaaaugauggugucuuuugccauauggaagcuguucaucuucauaaggucucauucauugguuguuguucuuagugccugugcuauugacguuccguucagaaagucuucuucugugccaaugaguucaagccuauucccaacuuucucuuuaaucaguuucaggguaucuggccuuacacugagguccuugauccagcacuauuuguugaaggugauguauuuuauccaguguauguuuuuggcuauuuauuuauuuuaaaaacuaggugaccauagguauguaaaauuaugucuggguuuucaaucugauaccaucaaucaauauguucauuuuuaugccaaugcugugugguuauuacuauaucucuauaguacaacuugauauugaagauaguguuaccucaauugguuccuucauuauucaggauuguuuuagcuauuguggguguuuuguguuuccauaugaggcuugaaacuguguuuucagguucuguggagaauuauguuggaauuuugauagguauugcauguaauuuguagguuguuuuugguagguauccguuucacaaucuuaguuccacugauccaugagcaugggagaucuuuccaucuucugaugucuucuucaguuucuuucuuugaauucuuaagauuuuuauugugcaagucuuucacuucuuugguuaucccucaaacucuuuugaggcuuuugaaagguaugguuuccuugauuucuuucucaauuuucuccacccuacuuuguuagcuggagucagugucuccagauuaccacuuucuuguuguuuuucuccaaauuccuugaagucaagcucguuugucaaacuucucaggaaauagaaacaaucuguguaugcacggggauguucguuaucaagaacuggcuugugagcccaaaggcagagcaguucuaauauccaugcuuacaaacugaggauccagaauaugagagcugauggugagucugaggaaacccaagagccugaggccagggagaccuauuggggucuguacuggcugguuuugugugccaaguugacacaggcuggaguuaucacagagaaaggagccuccuuugaggaaaugcccccaugggauccagcuguaaggcauuuucuaaauuagugaucaagugggaaaggaccccuuguugguggugccaucccugggcuggcagucuuggguucuauaagaaagcaggcuaagcaagccaaggaagcaagccagaaaggaacaucccuccauggccucugcaucagcuccugcuuccugaccugcuugaguuccaguccugacugacuuuggugaugaacagcaauguggaaguauaagcugaauaaacccuuuccuccccaacuugugucuuggucaugauguuuugugcagaaauagaaacccuggguaagacagugucagcuccaauccagaggcugagagccugugaacauaaacagguucaaguccaguggcagccagugucacagcuugucggggcuaugugggccauacacugacuggauggggcccaugcugugucuccacccuuuaacucucuacgccaccacaucagucuacacuuagauuuucacguuauccagaaacauccuccguaggaacagacccagucaaacugccgcccaucccgcaucaccccaaacaaguuuuguguccacuuacacugaaaagguuauuuucagaagugggucuucagaauuucuaaaacucauagaauaagggggauuaaaaguugucuaguuacacacacaaaaaaugacucauuaagcaauaauaaaaguaggacuuucucuuuuuucccccucaauuccucuuaguucuuugagaauuuuguacaaaguuauaucugccccguccccagccucucccauucucuucauccccucuucccucuccaccuaauuuugccccccuuuuaguccaccaagucacugcaguuggcacacccacauaaucuggugggugcccacuggaccggggugcuuucacuuagcagggcccacacccuuaaagaagacggacucuuccgcuccuagcagccauuaaccgccaauggcuccuccucagguguggggcucacacuuauccccuuuccacacuggcguucggugggcuuagguuugugcaaugcuugagaccgcugccacagccacgggugagcucauaugugcagcuguccugcuguauccggaugggucucuuucccuuucguuauccacugccucuggaucuuacagucucucugccuuuucuccagcagcgguuccggagaugucgcuuuucagcugagcacacacacacacacacacucucucucucucucucucucucucucucucucucucucucucucucucucucucucucucucucucucucucucucucgcucgcucuccucacagccuggaggcucugugggucucgguguuaaucgccgccgucuauuguaaaagaagcuucucuguugagggcugacggacgcauugaucuguggguauacgucauuaggagcugguuuaauacugugaccauuucgcacugcccgcuccucccuagccccugcaucgucuccccccaccccaccaccuccauagccuuucucaauuucaagcccauuuuccaaagacaccugaauaaacggccacuagagggcagcaccggcugcaguuucuccugaaaccucugaacuuuucaguggggccaaggcugacaaagguuggcuucuaauuaccaccauacucaugguauacagagagauuuuucucuucuucaggaauaguaggcaauugagagcuuugucauagaggcagcuuuugagucagaauucgucuugacuuugauuugauggaaaugcccgcagaagggggacuggauaugcuuacugcuuccuuccucgggcugaugacacagagcagccgugcguagcucucaagagcaagcugcaugccaguguagguguggccagagccccagcucaggagaguucucauuccagaggaguauggagccaucaucgacaggacagacaagcuaaccccaaggcugagguuaccgcagacagaaacagccaggcaaagccaaggcuuggucagauccuacguuugugguaucagcuuuacacagcgacaggagcuggggugcugaucaggaugcucacguuaauuuggaccuugaagucucauuguuuggugccugguaacaacagccaugguaaaagaagaaaauauuugugauaccagugacucagcauguuguaaaauauugaggcuggcuggccaacaagcaaacagaacaaacgaaccccccacaaauacuccuccucaugaggccagcguugaugcuguagggcuuagugggcaaaggcuugguaugcaagugugagacccucaguuuggaccccagggacccauggaaagccccacacgguaagacaauccaguaaucccucugcuccuguggauggaggcagauggcagcgaauccccagaaauucacaggccagcuagccuguuguguguagcgggaaacaacaugagacuuggauucagucaaggugaggcaguuaccugcagcucuccucugauugucaccugugcacugggcacacgugugccugcacucacucaugagcacacaagcauggggauaaaaacacaaaaauccuuagggaagcggugucauaauuacauuggauauguucccuucuguggcagguuccauccugccucgaauuggacagcgugcgauuaccaagugggaggggucgcccaauguuuccaagccccagucucuauguagccugcccagaguccacuuggcuuggcuucugaggccucacccugugcucgaagcauccugucagcuucuucgugaaccuggaaccugcuaggcagaaagacaaaaggaaauccugaggucagcagaacaagccugcagagugguugauccacuuucagaacacguggauggcuggcgcuaugcuaacuccgcauuccgcuauuuuuugccaaagcccaugacucuguagacugcagcugaggguguuuugcaggcagauauagcuuugagcucuuuugugagcuuggcucugacuccaggaggucuugaugcacacgaagaucugaagaagaggauaugccaagaggaguuaugcaagccuugcagaaagagugagacuuccuacuuggagaguagaagggagaggaggaagcacaguaggacuacagcuuccuggacucccccaggagcggccauuuuaggaagaacaaaccucucugucuccacuacuuuuauuuuuucccauaaaaaauauuccaugcauccauccauacauguauguauacagguauguauguaugcaugcauguauauauguauauaugcagguaugcgugcauagcuauauguauguucauagguaugcaugugugcaugucuguauguauauauguagauaugauauguaugugugcagguaugaaugcauauauacauguauauauguaugucuauauguauguaugcaaguaugugugagcacaugucuguauguaugcaugcaucucucucucucuccacauauauauuuauauaugcagguaugcaugcaugucuaucuguauguaugcagguaugcaugcauguaaauauguguauauacacagauauguaugcaugcauacaugucuauauguauauauacagauauguacgcauacacaucuauauguauguauacagguaugcauguaugccuauauguauguaugcacuuggagguagcaguucauguguggaggaguagggucugaggauaacuuggggcagucauuuuuucuccauuuugaguuugcaauagugguuuuccuugagcuuccagaguuuuguucgaugagggcagaucccuuugucaaguaaaucagagauuuuuauauguccccuucucuccauucacacugagauggagaagaaagcaagaaugacagguggccccugucuuaauuucccacagaggcaaacgcguggcugggcacacucuguugcauggcuuuggucagaugaagucugauuccucaguagcgguacucagccaggugcaacuccucgagaucucgcuagggaaauuagguagcguccugcccucugaccuggaagagaucagcaguugugauucuccuucauggaagcacagcccacuuggguuguuuuugaggcuuggcuugaucucaccugcugucuucaugcuuguuugcgugggcugagcacggcccuuacaaaagagucagcucggaguuuccuccaaaggcacgaaucccccacuugcagggugguggcccuguccugugaucuuagugcucaggaagugaaggcaggaaaauccagagcucaaggcuacccuuggucacacagagaguucaaagcaagccugggcuaccugaaccuugucucaaaacaaacaaacaaacuaaaaagggcugggaauacagcucagugguaacacacuugucccagcacacaaggggccauagguucaauccccagcaccacaaaaccacaaacaaaacaaagcaaagugaaacaaaaggcccuccucguuuuuauguguguguacguacguguguguguguguguguguguauguguguguguguguauguguguguguaugugugugguguguggugugugggguguguguguguauguguguguacacgugugguguguguauguguguguauguguguguguauguguguguauauguguguguguauguguguaugugugaaugugugagugugagcgugugugugugugugugugugugaaagagagagagagagagagagagagagagagagagagagagauuuaauuucuuagggaugauggcuacuucugcaugaauucauuauucaauauauauaacucuaguuuaauuuaucuaacuuuccacauuaacuagaagaacaaaaaaagaacacacuaacauaaaauuuucaagugucuuuuucuuuuuuugagucagcaucuuguguagcucagccuacccucaaacuuauaauugaggauaaccuugaacgcugcucuuccuuccucuaccuacugcguccugugccaccacaccauguuuuguguaguguuguaggauucauaaaugacacuuaaguguucuacccauggaguuaggccucuagucucuagagugccuauucguguugcuaggguuggguucauuguccucggaugaauaauuuguauuggaaaucuacaaggguaggaaauauccaucaacucuugugugucugugugugcaaaugcaaguccaggugaacauauaugcucggguagaggccacgggccaaccucaggcauuauuccuaaggaggcugugggguagccucaggcauuguuccuuaggaggccaugggcuagccucagacauuauuccuuaggaggccaugggcuagccucaggcauuguuccuuaggaggccaugggcuagccucaggcauuguuccuuaggaggccuugagcuagccucaggcauuguuccuuaggaggccaugggcuagccuuaggcauuguuccuuagaaggccaggggucaaccucagguguugcuccuuagucaucaucucuggcguuucuugagacagaguuucucacaggaacuuaaagcuugucgauuugacuagacugacuggccagagaauccauuccagggaugcuccugccuccacaguccagaguugggauuauaagcacaccccaccacacuuagcuuuuuauaugggugcuaggaauugaacucaggcccucauucuugaguggcaagcacuuuaccgagcaggcucugacuccauaacucagacuagucuggacuuuguggcagcccuuaugucugcaccuuugucuuaguuuccaggcuacuccugaacgugugugguuagagcugugaucuuguuuccucaggccccugggaagcuggggaacagacauucaaaaugucgccguaucuaucagaggaacaagacaguuuuaaugacuuuuuuuuuuuuuuuuuuuuuuuuuuuuggcuaaaccugcauguauguggccccguccuauggugggggucuuggccugaauauaaaggaggaagcaagcuggaggccagcgucaucucucugcucccugccugcaggaaggugagcaguuggcuugugcuccugaugcugugaccucccucccucccucccugcacccucaagccaugaacucuuccuugagucccuguagccggguauuuagucauugcgaagggagaaauaacuagagcaggggcugugguuuucccaggguaccgagguguuaaggaagggaggcgcggcucagaucaaacccagaugaguuggcuaacuuuggcuccacagccaauggagcggcuuguucaguugcacagagggaagcucacccuucugaaaggagcuuuggugaagggcacugcaggugagccgagcugaaugccagccuccaagcuccaucaugagacagaggagcgagcccaagacuccuccuggccucgcugcucucaguagucaaggcugucucuuccagagcgcuguggggaaugagaaguaaucuuugcugugucccuaguuucugugagugcaacugcuagggaugcagaaacacaguugccaagaaccacuuggccacagcagaaaauuuagaauugugagcaauuaccggaagcagagaaagaauugcugcagucagcacugaagcugggaaaagggguugagagugcgugcgcacagugggaugagugaaugggaccaugugaccugagcaccagcgcuggucugguccuccuuuguuaaccuugaguaccagcucugagguaggcgcccuucaccuauuagccuuuugugucuguaacaaaauaccugagacuggauacuuuauaaagaacagggggcugguuguguagcgauuuccuuggaacuagaaagcugcccccgggagaaugauggggccguuugcgaaucaagaagcuucccaaguucaaggaaggugaaagaaaauucucuagcacucagcucgcaaaauuagagcagcagaaaacagcugcuggggagaacggcuguccagcucagguuuuccagucuauuuagcugccuucaagucaggcaaugagcuccaggguuccggcuuuccaggaucaucacccaugcugguguggguguuccgaugcagcucucugugagucgugcaagcuccuguaagugacuccucacacccugacuccuguucuauugccgcgauaaagcaccaagaccaaggcaacuuauagaagaaagaguuuauuuaaggcuuaugguucuagagggugaguccaucacugacauggcaggagcuugcaaaagucaggcuggagcgggagcugauugcuuaugucuugagacacaggcaugaagcagagagagcuaacugggaagggugcuauuuuuuuuuuaaucucaaaaggccaccccuugugacacacgucuuccaucaaggccacaccuaaccuuucagguuugugcugugagaacagaggaauaaauuugcugaaagauacucuccacucuguauggcaaagcaaaaaggccuuugcaggaggccagcagcaagcuuuuuagaccccucugggacugggagaaauaaaagccugcuugcuuccccaacugaggacuaaguauccaaauauaugaaugaacccaugggagcaguucucauucaaaccuccucauggcuaucuggaguaaguagacauuuguucauuucucuccaggaaaaugucacucaucugggcuggagagagagcucagccaggcgucuguuagagcacagaacucaugcacacagucuaagagcaguguugucugcuuguaaucccagcucugggaggagaggcaggcaugucccugaggcucacaggccagcuagcuuccuuagugcauuuuaggccagagagagcucacuuaaaaaacaaguaacaagcaaacaagcaaaacaagcaaacaacguggauuaggguaugcugaggaacaauuccagagcuugacuucaagccuguaugcacaaacaccucauauacacgugcgcgugugcucgcgcgcacgcgcgcgcgcacacauacacacacacacacgcuuuacaaacauacaaacauaugcacacauacaucacucacaugcacaaaauauagcuugcacacaagcacauacucacaguguauacacacauguauacacacaugcacacauguauacauauuucacacacucacauauacacacuuacacauacacagcggaagggggaagaaaagcuugcuuuugagagacacguuuaaggcagagcucaucacuauaggaagcgucacuucuuacugacauuucuucuccuggauuugccucauuacggaguaaaccuugcucaccugauuuucacaauugauugcuuugucaaauucugguuucucugcaguuguguuucugagguuggggacuauugacaaguggggagacuccugaguguuucuaaccagauuucuccacaaauggaaauacaaggucaauaggacguucucaguuguagcugccaugucuaacccaaagaccacagaauacauuguguucuggcuucucugcacacaacuuuaggcaagcgaaguucggacacacagcccugguuccuugagaccauuucacaaaaagggcucuuaggacaucagcuguuuuggugacuuuugaauaucuggugaccauugguuuaacucuuguaauuuuagaaacagucguuugguauuaguaauucaaagucaagcuaucucagagaaagcaaagaauaaaauguuaaaggcaaauguuugcugagagccccuugggagggcaacagcuuugguguauuuuguccucggggcucucucuagcuuugguuugagagacacugggaaggaguggcuuagaacugguucgauccagucuggggaggcuggaaaacugauuuuccuucucuuugaacuuccuguuguuaacugugaagauguguguggugaugucaggacuggaggcuuagcguaagagaauugucagcaaacgucuauucucuuucagaaucucgguccccaucauccugacucacauuccauguuaaaugcuucagucuuugaccucguaucucucuccaggaugcauuugugguucacccgggauccucaacauaagaagguuccuuaugagaggacaguugaucauugguguccuguauugacagccuucaacuauuuucugguuugguaaagagacagcgggccauuuaagcaucuuuguuguacaggucugaagcuacccuuccuguaacccaauucugugcacuuggcagucagaggacaauugugagugcugguuggguuuuuuccuuccccucuguguuucccagggauggaacugaagccaucagucuugcuggcuagcaccuuuaucuacggagcugucuuggcagacuuaucuuagauuuuggggcaggaugucucaguggacauggagaugaccacuuuuacauaucggcuggccgcugaguuccagggucugcuucucggaauccaauccccagugcugggcuuccaggcgugcuagguccuguccagauuucuauguagguguuggggauccccuucccccaugcuugugcagcaagccccuuauguaucgauccaucuucccagccgcauggaauguggcucuuuaaucuuuuccauguacacacuuaucauccugucauuucauuuacucugacacuugacaccauucuggcugugaucucaucucuuaaauuuuauuuuaaauuaauaccugucuggguguacaggcacacguuguggcuugcgaguggaggccagaggauagauagcuuuuauaguuagcgcucuccuuugugagucucgguauugaacucaguggugagguuugaaagcaagugccuucaccccugaaucaccucacacacagcuccuccuugaggaaacugagucacgcggcacaggacggugucuuaccuguggaauguuagacguucuagaaccaaacaggaguggauaccagugaagggcucugcuacuuuaaaaaaaaaaguuuauuauuaguuuauuauuauaaauaaguacacuguagcugucuucagacauaccaaaagagggcaucagaucucauuauggugguugugagccaccaugcgguugcugggauuugaacucaggaccuuugggaaaccagucagugcucuuaccagccccucugcuacuuuuaauaaauacacaugguucugugugauucucugcacagcauggugcugcagcacaacagcucaccaauauguguuaguugucuucuguuuguuuuuaaaaucaauuuacaauguaaccauuucaguacaaauggacuagagacccuguuagaaucacuucuacccauacucacugaauucacagcuguacugcccuuaacuccgagcaccacugugacuggcuucugggacccuuggcuuuauaaaucacguucagagcggagaaaccuuccaggcucgucaauacggauugucucuccacccugcccaacuccacccugggcucuaaugcccaucuucagucagcucggucaacaacaacauauccagagaacuggggauggagccaugucccccaccuacaauaagaaggauaacuggucuacccaggccaggcauagaguggcuugaauccucauuagaacaaugcugcagagaugcugcgugcucuugguucaguggucuccagggggauuugacuuccuuuggaaucuagcgaagccugggacgagcaucgugucuuggucagucaugaagacaaagacagaaggaaggauaugggucuaaucucaucuccacuuuuaucucuguuguuuuccuugguguagucccacguaagcuugacauuccuagggcaaauuccccaugaaacguggaggugccaaaggcagcucuuggcagccccagccugcuagcccuuccuggagaacucuuugaaaggauaaacaguaucagauucagagugugguagacgugagaaggcacuguggguggcugcugcgaauugcugugugagggggagcaggagacuugaucagaaggaugaagcaggcacagucuaaccuguaauuccagcacuuggggaaguagaggcaggaggauugggacccaaagucagccuagacuacacuagacccuguuuccaaacaaacaaaaacaacagaaguuuaguuagaaggaaucuuuuuaaaaauuuuauuuuguuuuaaaauucuguuugucugccucucuuugacugucugucucuguuugucugucucucugucuccgucucucugucucugucucugucucugugugugugugugugugugugugugugaauuugugaggccaggggcaucagggggcaacucccuggaguugaaguuagaggcaucaucccaacucaggaccuuuggaaguguagugcucuuaauucuugagccaucugucugacucugagggucugauuaagucugggcauuuuguggugaaccacaucacaagcuaaguuaaccaugucuuugcaagccugucucaauguggcaccuguaauagccaaagacagccguuguaaauagggcaccagccuuauggccuauuguagaccaaugguaugaccuugguuagagccccaaaugaaucugcacuuuaaacucccuccccuguguaaaccguggugugguguguggccuguugcuagguuggcaggauccuugcuuacagagagcagcacaggagagacaaagaugcuguuccguuaucaacaccuccaguguguccuggcugagagcuugagccaucauaacauuucuacaccagcuaugcaaggcauucugugcccaaagaccauuuuguacugacagcacauuuugcuguuggcagaggcagagaggacauggccagcugucacguguuuucugccuguguguaagugugccagugugcuuagagaggcacccgagucacagucagccuuccgacauucuccugcugggacuacacggugagaaucggacagucaagggcaggugagacuggucaguggguagagacgccugcugccaagcuugguggucugagugugauuacugggacacacaguaggaggagaaaguugucccaugaacuucacauguccgacauuaugagucagacuuucgagcuccaagaagcagaucccucuuagccagggauuggagacaaacagcugagauccucaaagaguccaaagagcuggggucacuuacuggcuccuccaguggcagaacguucuagaaccagguccuuucccacguuccaagcugccucuuugugaagauaggaaagggugagcuuggaagaugcugagucuagggaucacccacauucugaaacucgcuuauucuguaaaacgauuuggccgcaguuagagacauguagguagacuacacggaagaaugaaagcuccuuaaagaagaaggaauaaaaaccaaaagagacagaagaaagugggaugguaauaggagagaugugaaaagacccaugagacuccuguucccuugggggggggggggcuuucaggcgcuguccauggucucagggucaugucauggucucuuuacugugagacagauucucucggggaccccagggauugccagagcguaguucucuguugcacgugcgucugcuucgccgcuucccccuuucaagcuuccugaugccaguggguaacuggguuacuaccuacuauccgaaggaugaugcccgagcuggguucagauuccagcauccgcaaugaauggcgcacaaacugccagugauuccagcucccgggggaagcuggcgcccucuucuggccuccaugggcacugcuccacucccacaaaucuuagggggaaaaaaaccaaaacccaaaaaccaaacaaacaaaaaaaccaaguaguuaugucaguaaacuauuguaauuggcuagugauguagaggugugguagaacuagcuguuuuaggaugaaguguguucagaauggauguugccuucucucauaucaaugaaaaugaacaaauaucugcaacaaacaaggauaaaacuagagaauuucagcaacccagcagauagcaagaaagacuaugaagaauucagugcauauaauucacauaaagauacauaaaaauguaacuggguuucuauuuaaaugcaaaggaagaaauaacuuaaauaagaaaaaauagaccccccagacuggcuacucccuagccacaugacccucagucaagcauggguuucuucaaauguaaaguggggcggggagauagcucaaugguuaaauccuugcuuuucucagaaagucuaaggauggggcuuuguauccccagaacccaugucgccgaguugcagagguggccuagacucuagccguguaaugcuagagucgauggcaaagacagggauccagagcugacugugagcuagucacauuggugagcucuggguuugauugagagauccugaaugaauaaggcagaaagcaaaggaggacgguuccugacaugaccuuggucucuacaugcucccaugcucacacacgagugcaccugcacacaugcaaagaccggacacacaccagcgggcugcagugacuugggggagcauauuugcagcuaauuuuugugaacaguguuuagccugccuucuggggggguggggguucaguccagaauaaaacugacacaagguugcuaggcaagagcugugcgcuacugcugguguuggguugggagagggucuugauggcucuuguggagacggugacugggaucuagaggaaaggccacuuagaaauaccggaguguuuuuagguauuuccucccucgagugcuccuccaggagccaggccugguauccauucagaccccgacgguccuccuuggaaugcccuuucugauagcgcucagcagccaacauuacauuuuuaaauagucuauugauuuuuccaucucuuggccauagaguccucccggcucuguugacacagcagagggcucacacugcccuuucucugagcucuuuacaugcagugcacagagccagcguggcacacccugggugggagaaacauaucauagccuggaggaugccuguagaggaccugucccuuccuagccagccugcgcgagucgugaguggaccggcucacugaugggacuggagacauccuuagggugcuagagaaagacagagaagugguacccaccugggagcucugguucauuugucuuugucccucagaucugccuugcuggccacacuuauucugcuuggagagagcaaguggcugcugucaucuccugcagagacaaagcccaggaauccagaggcugagccucaccuugguucacgugacucagccacagcccauccagguggauggcagcguggccccugccugcaucuguguauacuggaucccugcacagcgucacccccaacagauaccuggugccccacacuccuuacccgccacccccaaucccaacccuuucuccacuccccaggcaucucugucuuuuaagaauacaaauguagucagaggauaaaagaauguuuguugugaccacaguuggaagaguucuaggcccaguuagugugcguauguuuuccccuucuuuuaaugcuuguguuuacuuaugggcaugugcacaugugugugugugcacaugugagugugacaugagugugugugcacaugugaguguguucacauggaaguccguggacaauucugaguacuaaccuuaggaacaugaccuaugucccuugaggcagggcucucuuuggccuuguaugaguuacauuuuuuuuguuguucucauuaaacaccacggcccaagaagaaccuaaggaagaaagaguuuauuuuggcuuauggcucuaaagagauaagaguccuugcagguagaggaacagagguguggccacaagcggcaggcuugauggcugaagcagaaguugggagcucacaucuuuaaccacaagcgugaagcagagagagcaaccugcauauagggugaaguccuuaaacucucaaagcccgcgucuaauggcauacuuccuccuggaaggcugcaccuugcaaaccuccccaaacagcaccagcaacuggggaccacguaguuaaacauucgagccuauggggacauuuugcaguuaaacugcuacaggccuagagaucaggaauuaggcuaugcugccuggucagggagcccaagggguucucuugugucuaacucuuagaucuggggcuacacagauguaauccacaugcucagcuucuucauguaagcucuggagaucaaaccuaggucuuaacgguugcaaggcaauugauucacugcugagccaucuguccagcugcaacucauacauuacaaacuguuguguucuuacugccucuccacugcaugugaggaucaaucagaucacuguauccuuggauuguauugcauccgaauguuuguuuuuaggauuuguuguuucaguuuccgauuugaguuucaguaaagaaccguuuagugggcuuuggcuugggaucagugcagcgccuucaaccauuuuguuucugucuccccagugugagcagggaugggggugggugggaccauaggggggggguugcaagcacugccacacccaucaccugccucacuucagccagcauuugcuggcauugccugggcaaagugcacccgucuuguauuccaaccggggcugcaguggugucaugugacacaggacaccucagguucauucugcauuugacucuguauucauguuugauuguugaauauucagaaaugucaccacugucugucuguuuguuaauuaauuaauuaauuaauuaauuaauuaauuugacaggguuucucuguguagcccugguuggccuggaacuuacucuguagaccaggcugaccucgauucagagauucgccugccucugccuccugagugcugagauuaaaggcaugcgccaccaugccuggcuggcagaaucuuaugacccccguauauucaguugugugagaucgucugagaugaaggaaccucaauugggaaauugcugaccuguggacaagucugugggggcauuuucuuaauuagugauugaugucagagggcccagaucacuguggguggugccacuccugggcagaugguccuagguugaauaagaaagcaaacugggcaagccaugggagcaagccaggaagcaguuccuccacggguccugcuucaguuccugcccugagaucugagauccuggcuccccccagugaugaagugugaccugagagguguaagcugagaacaucuccaaguuccuuuuguuccugauguuuuaucacggcuauagaaaccaaacugagacagguugggagccacggcuuuauuaucuuucucugugugcgugcauguuacagaacccuguggaaguaagaggacaacucguggggggucggcucucucauuccaccacaaggaucaacaucucagaucaucagguucuggggcaggcgccucugcccaccgagccaucccaccagccuuaaugaacucuuuggugaugucugucuuuuuaggguuuauggaggguggugugcuggugaugucagagcuucuaaggccacccuggaaggauaucucccuggcucuguuaugguugacuuuuacagaggaucagggaacaggagaggucuugugaauagaaggagcuugggagagggacaaaaaagggcugugaucuuuuccugaaagggcuguugagagaacuggggucggggaggggggagccagagcaaacagcucucuacccuccggcccucuccccucaccucggcuccacaaaccaagagagacugcugcugacgaagcagaccgccgcugccagcuuuucucagaugagcacacugggauccaauucacaucgaucuccccuucguggcccauuuauuuugggcgcaugcauccaucugcucgugggaccacccagucgcuccucaguacguugccucagcuuaaacuuuccaggcccagaaccguuucucauauuucaugaucucgagguuuugccaaaacauuccaaguuagaggggugggucagaaccgcguugggcaacagugucaggcguuuguaguggguagacacuaaucugcaucaguuaggcuggugggcaucucuggaucccucaaagcguuuugcaucaagcucauuauuaaaugucugcagaggaaacgucaugcauccagcgaaguucugauguccuuccagguccuacuguagguacuggagacagagugaggagugacaggagcagacccguccccccaaaggagcuuauauuuuggcgggcaaggcaggaaauagaaaacaccccccccccauccugguuuggcugccacugccuucgucuauaacuauggaagcugauacauauuucauacacacauaguggauggggaggauuuacaggaagaggggaaauucuaauuguugggcugugcacugugauaaccucuagccacagacuggcugcuuuaauauacauucaagaggcuggagccauggcucaguggaagggggaccuggguugagucgcucccguacacacggugggucacaaucaccuguaacuccaauuucaggccaucugacaccucuucugaccucugcuggcuucugcacucacguggugcacacaccuacacucaagcacacaggaaagcauauaaaaucaaauaauagaaaauuaacauacgauuagauugagaugauuaaaacccuuaguuuaucaaugucaccagccauuucagugauuacuguugccaccaucuauggcggcgaacggccacccaacugagcaaugcaaacagaauacacuucuacagucccagggagucugcuggacagcgcagcucucugcagcgguugcucccacuccccuuuaguauugaagcucuagaacaaccuuguuaugguguauuguguuucacguccacauauuuaucgcaagcaauggcucacaucacuauggacugcgaugagcauuaguaucugagggcgacuagcaagcugucgaucaggagagaugaugaagugguuguggcuggaguuuggaggaugagaacaugggagacuccguggagcaguuccuggaggaggcugaagguacaggaagagcaggugucuccacagagaggcaggaaggggccaggguucuagucccaaggucaacgugcaguuuucaggguaaggcuucuuuucgugucagauuuaacagcugggugagucucgguguuagcuuuaugucaccgugaccaagcacccgagacuaucaaccugaaaggaggaaaaaaaaaucuauuuugacucaugguuuaagcacagcuauuuaaaaaaaaggauuuauuuuacuuuuuauucaugugucuaugugugucugugugcgcaucuguacacaugagugugccuguggacgcuacaaauggauacugggucucuuggaguuagaguuacaggcacuugugagcugccugacaugaguuugaggaccugaauucaguccucaauaguguguguucuuaaccucugagcgucugcgcagccacaauuucagaguuuuuuggcccaugaguccaggcuggcucugggccugcguugaggaagaguaaugugugaguauccaggguggagcacaggcccucaccugaaggcagccuggaggcagagacagagugacagggacacagagacagugagagagacagaggggauggggcggacugagggccugccacugagccuggcugaugcccccuacgguggugccucgggcagcgggccaagcgaguggcuuuugugucauuuaaagcccagcacugaccugaugagccucaucuacguuggaggcaacacauuuugcuccuugcuucaggaaugcuaaccuugggcuguggagacggcacagagcuuaagugccucccucacaaacuggaggaccggaguuuagguccccagaaaccaggggauguugggugugugggccugucugugauuccagcauuggacugagcugacugucaagauagccauauggguaggcucugguuuaaaugagagaccucaaugaauaccuacauauucaugugugcucacauaugugcaaaccagcaugcuuguaugcacacugcacacaugccacacacacacacacagcacacacccaguacacacauguacuucacauaccacauacacauacuggacacauacaguguacacacacaccacacauacacacugcacacauacacuacacaaacacagugcacacacuuuacauaccacacacacagugcauacacacuucacacauacuacacacacauacaccacacauacacacugcacacacacagugcaaacaugcacuucacauaccacacacacauacugaacacacacagugcauacaccacacacacacacacacacugcacacacaugcugcacacacacugcgcacacacacacauacucacaaacauggaaaauauuagaccauaugcccucucugugggucauaccccaacaccuccacggcaucaccaacccagagucucacuaaaccuugcugugcaaaagucuacaagcggugugggugcacauauguaacaccggccuugaggcagguggggaucauaauagcaaggucaaucuugaauacaguccucaucucagaaagggcucguuugggagcugaagcagcugguccgucaaacagcaguagucaggagcagagagaaaucugcacacccguuuggucugcuugcuuacugcucaugcccccccuggccuuccucacucuuuuaaaagaguauuuaugggaggcagaggcaggcggaucucugaguucgaggccagccuggucuacagagugaguuccaggacagccaggguuacacagagaaacccugucucaaaaaacaaaaacaaaacaaaacaaaacacaacacaacaacaacaacaacaaccacaacaaaaaagaguauuuauuuuggguguaugaguguuccuccucucgguauguacaugcaccaugugcaugcuguacccccagaggccagaagagggcgauguugucccauugccugaaauuggaguucuggccagcaaucuaguguacaaacccacacagauacgcagacacacauaauuacaaauaaaacacgucucuacaaaagaggguucuuuaugaauaccaaaagguaugagcaucucucuggaaauccagcaggucuuagggacucuacuaggaaccagggacaaagccaaaauaggugaugcauuaugcuauagugugucaacauguucccagguagauccuggaaucugaaauucaagaggaaagaggugguccacaggcguucuuaacugggcaucagagcacuuucuaaagcacgagacucuuaggcuuuuuuuuuuuuuuuuuuuuuuuuuuugagucauuauccucacuguggcagagauucaaaucacauuuaauaucuuucuauuauuuccacaucauccauccacauucccagaccaauaacucagccacgauggcagucgucagaccucacuggggaggaaaauaauuugauucugcucagaaaggacacguuggucugugucaccccucuaagaucagcaaucaaagcaauugugauuuucuccuuuuccccuggcuugauaagaccuuucuccauaaugaauaaauguguauucaugcacugaccccgaguguuuucccucuagaaauaauugugugccucucugaagagacuccuuauuauccccacagagaaaagauggcugugucaccaguggcccgugguucacugacguaggccugugagucagcuggacccuggacagugaucauagcugugacaagaggggacagacuucugcucugggaguugcuaauuagagaacagggagggagucaugauagggaacauuccagaaaggagucucugcugaguuauaauuauggcugggucaacucacagucacuuaugaaaguaaaagaguuuccauuggaacaaccaaaggcugaggguuuuaaacuugacaccaagacaucgcuguaaaaauggcuccuagcuugcucccuacugcugaguaaacaccaugaccaaacacuuggagagggaaggguuaacuacaccuuaacccuuguaguccauccuucagggaagugggggcggggaggggggggggacucagggaagaugggaacugaagacaugagggaacuuugccuacuggccuguuucccauggcugguccauccugcuuucuuauacaacccaggacccccugcccagggaggucacacccacagugggcuggacccucccacacucaucaagaaaauaucuguggacuugcauacaaucugaugaagguguuuucucagucgagagucccucuucccugacuugugucaaguuggacacacacacacacuagccaacacacacacacaguauagccaacacacacacacacacacacacacacacacacacacacacacacacacacgucagcacaccaagggagcaguugagacaaugcagauguagaagagaggccagauucugggauaacccuacaccucucuaagaaguacccacuguggcugagccugcuugguagagaacuugucuagcaugcacuaggucccaggugugauacacagcaucacacaaacuaggagugguggcucacaccugugauccgagcacucuggagguggaggcaggaguaucacugucuugcuaggggucauugcuucuggguuacuuagaacuaaguccaggaagcucauacguaaauggggacaguggcucuguggucaaccgcagagggauuucagggaagaugucaacacauggucccgaauccgaaaugguuuauuuguugguuauguuuagaauuguuaaauucccuugcuccacgcccgcaucuuccaguucuuauaauuaaaauuaggauggcuuggagguucuuuccucccucccucccucccucccucccucccucccucccucccucccucccucccucccucccuuccuccuuccuucccuccuucucucccucccucccuccuuccuuucuuccuacagaaggaagagagacaggaucuucuguaucuuggggcagcauccaauucuauguaacuaagaauggcuuagaacuccugaaccuucugccuguacauccgaaaugguuggauuacaggcauaagccaccacauuugguucaauaauuaaauuaacuaauuaacugauugcucgaucaaauacaggauuucaugcagcccaggcuagucucaaacucagcauguagcugaggauacucugacugcucccuccauccgagugcugggauuacaggcgugugcauccaugaccugcuuacguggagcugucaaccaaauccaggccuuugugugugcuaggcaagcacucuaccaacugagccacacauccagcccuggaauugucuuuuaaccagagcaugugagagaggucuuuauagacacuauuauugcacauauuuuuuuuuuuuguggcuguuguuguuugaggaacuggggaauugaacccuugaauccaggacccuuuucauguuaggcgagcauucgaccacugaccuacauccucagugaagagggaagcuuucuagaagcagcagaaguaucaucagucagacaugggccugaugugggaucagcaaccaaagccauggcauaagaaagcaguaacaauguaacauuuggaaagacagggcuauuguuuccuagcagaauaaagcaaggaaucuaauugaguuggaggaagcaagcagccgguucagugcucacugugugggcacugcguacaccauucuauuuacacuugcacacuccugggaauggccgacagcaggagcugaggaaaugauacugccugcuuuagugcucagcagagugccauccaacuguacaaaugggagaccuguuuccaagcaggaagggauuccucuuguccuuucacagacacagcuuggggagugcaaaugggcucagcguuucuagagcguaauucagcagucuuacgcaaaucuguucaggcuggcugcagaguguaaaugugaaagggauauagcaauagcauuuucuaucaucgucguugucaucaucuucaucaccacaaucaucaucaccaccaccaucaucaucaucgugcaaguaugcucauggcgugcacauguacacguucacaugugugggaggugugaagcaugcaagcauagggaguuguuguguaaccuaggacuccacuugguuuggcuuacgcacacaguccucuuuugagaauggaauuggcagccuagcuccuuugcccaugugugcugcacacaccccaccuaacagugcaccuagcaaccucuggcaaccuccagcccccucccucucugaacaaugugagaaguuucucuuuccccgaguggcuguuagaacaguuucuauuuaauuuuuuagaugauuauuuauuuauuuuauguuccugaguguuuuuccugcauuugugaaugugcacugugcccauuuacaaaugagacauuucuccaacucugaccaucucuauuuaaauguauuccuguauuaaacaguaucuuggucugggaggggaggaggggcuaauauagccugaguugauuugggguguauggguggguguguugguuaauuuuuaucgucuaccagacacacaggggagaaagggugccuccaucaaaggacggccuggaccagacuacccaaguuggguuuggucauggugcuucucacagccacagauauaaaccaggggucuggagcaaggguucagcaggcuaagagaacuggcugcucuuccagaggacccagguuugaucccuagcaccuacacuguaguucacaacuccaguuaccauguccucuuaucaccucugaggguaccagacgccuguguggugcccauagacacacaugcaggcaaaacacucacguacaagaauacuuuaaaaaaaaaaaaaacuaaaaagaaagcaaauaaugacgauaugcaacaaagcaaaacuguccuuaagugaauuuucaggaugaauccccuauugaucauuuugcgccuaagcauauaagauaauuggucaugcauaugauuaaaaucaggugcauugugggaagagacacguccaggagagaaaugguuauacaagcuaauuuaucauucaggccacagaaccaagacuggagacauggcucagcggguucagagccuggcagcuucugcagaggaucugcgcaugucucugguggucuggguuggcgucgggugcuuccggguucuuggccucuuauccaggaacugaacagaagcccacgcagaugugcaaaaccucacuacccgccagguuacaacuggaggguugccaugugugggaaauccugcaguaaguaguuuugcuccauuuuauuugcccaagucuuaacagugaauuauuauuuaguugaaacaccauugauuguuuagcagauaauugagagagguaauuaaaagguagucauuuaagacaaacugaguuuucggauaauugacccaggcugggcugacggccagcuauuuacugcuguugcuggugaggauauuuuaccugacgguggauuauugacaugcacgccccgaaucaugugagcgccuaguauguuugaaauuuaaaacaaacccuuuucuugaccuugggacucuguguccagagaggaggaaggcagauauggcagcuauccaacucuauuuucauaaaaaagccaguaguggauuuuauuuuuaguuuggacuagacuggcaaaauggaccucuuguaacagacagaauggggcuggcuuuauuugcucccucccuccacccucucuucugaagaccucuagaccguccagcuucucuucaucaccuuguugucauaucacuucgcucgacacgcccugugguccgcuuuucauuaccaggagacauaggaggaagccaucagcucaggacggagcagagcugugcucaguguuucaggaaggguucaggauaucgcgggagcaaggaccgagaaacuggucucacuuccugcgcaggaagugaaggagggaagcagaagugaagggaaaagcggaagugaaggggaagcagaacuaagggggaaguagaagccuaaguguuuauuuggcuuaaagcucaacuucacugagagaagucagggcaggacccuguaggcagaagcugaugcagaggccaugaagggaugcugcuugcugguuugcucagccugcucucuuauagcauccuuaacaccagggcuggccccacccacaaugggcugggcccucccccaucaaaucaugaaucaagaaaaugcccccaggcuuguucauaggccaaucugcugaaagcauuuucucuacugagguuuuaucuuccgaaauggcccugcuugugucaaguugauaaaaacugaccagcacaccccuggggaccugagaaugucccccauggcugucucagaaauggccuccugaugacucccacugggaagggccaucccaggcccacacuacagcacacaguccgcucugauccggccuuuggccauuauccaagaacauaaauaccuuuaucccuuaggcagucucuaaagcaaucuuccagcucugucucgcguucuauccucaccccacccauccucaacacugcaaggucuaguaagaaggugaacgcagugucgcugucccuuucauuucggcuccgcugccugcacaggcuccugcuaccuuaaaaauaaaguccaaaugaaaauguauagcggccaaacacuucccagucagauacuuuucccgcagacggcagagccagggcagacacagcccccuuguuaccucuggaaaucugucuauucccugcccuuuguuugggaugcucuuuuuuguucacugucugugguggcuugaugccuucucuacaggagacauguuuggucccucguuggugaagcuguuugugggaugcagggugguacggaccguuuaggaggggcagccuuguuagaggacgugcaucagaggaaauagcugggccccacuuucugcucgcucuugagugcucucucucucucucucucucucucucucucucucucucucucucucucuuccuccuucccucucccucucuuuccaccccucccuuccccuucaucucccucucucucucucucuuccuccuucccucucccucucuuuccaccccucccuuccccuucaucucccucucucccccccuccucccccuccuccccucccccucuccuucucaguccuccuucccucccucucuuucucucucacuuccucccucucucucccucuuugucuuuccauuccucccucucuucuucucccucucucccucccuucucucucugucucccuuuccuucuccaucucucccuuccccucccucuccucccucucucuguuucccacuuaugaaugcaaugugauuaaucugcuuucugauguccauguucccgcuaccgugccuuucccgccaugauggauugggucccucugggacuguaagcuaaacccuuuuccccugaguugcuuuucgucaggguacuccaucaaaccacagaaaaguaacaaaggcacucuccgccugacuucuuacuaaugugcuucuugagggcuccaucacagagccaccccaggcaggggccaucaguggccccucucuuccucuaccauaaaacugcugauucguuagggacaagcgcaccgaacaggccaaauaaguauauguuuaagaaacaagagaguaaauugcugacacuuuaaaaaagauuuauuuuuaauuauguaugugugugugugugucuguacaugaguacagguuccauggaggcugggauugggggguucaguucccuggaacuggaguuacaggagguugugagccaccagcuaugggugccaggaccaaacucuggugccuuacagagcaguacucgcucugagccacugagcugacucucaccaauacccuugaccguggaggacuggauaacagcccucagaugauaagcagaaacccggauaagggaggcacagaggagcuagaaggcauugagaagaucuugggccguagcgguggauacaccggacaguuuccaugaggucaauauagcuuugaugugcagaccaaugcacacauuaugagaaaagucagauauaagcuuacucuuccguagggacauaaauaucuaaauaucagcaaaccaaaucccgcaguaacgcacaccgaccaagugcuauucuaaagagacacgguugauuuaauuaaaauuuaauucgauuucauuucaaacugacaccuucaacauuaacagaauguagccgaacaaaaaacugguuuucuccugucaccuugugggcucugggguucaaagguugucagccuugcaugcaagcaccuguaccuccagaaccacuugcuggcccccagagcauuuaaaauauaauucauuuaaacauucacuuguaugugguaugcgugguguauggaguguguauguuaugugugugugguguauguguguuucgaguguguguaugugguguaugugaguauguauggugugugugugugugugguauauguggguauguacuuguguguguguguauguguguguaguauaugugugugugugugguauacgugaaguaugugauauaugugaguauagauguuuugcgguugugugcgugggauauguacuauaugugaguguauauguugugugugugugguguaugugaguguauacguguguguguguguguguauguguguguguucaggugcacauggagacuaaaggaagacacggggucuuucucuuccacucucugccuuagacaggcucuaucacugaacauggagcuugccaucuaucuaaauagacuggcagcuagccauccuagcuggccuccugucuugccccgcauugccccauguggagcuguggggucacagggaugcucagccauggcuggggacaaguucaggcccucagggugcuugagccauggagcuuccccacagccucuccaccuuuccuacagaggugucuuggaaacuaggacugaauagaggugcugugcugggguagaaggcaucuccaaaugcucucagcaaacaaagcacuugaggauaaaguggaaggagcgcucucacagagcgcagcaaaucaaagacccucguuaucacugauuuaacaaucgacuuguuuuggaaggcuuuguaggucacagaaaggugauggagaugagauaugauuaagcaaaaauaauacuauucaccagugauguaauuuauauaaaauuaauaagacuuuaagagcucagaauauaugcccauuucuuuuuccucuuaacaaaugaccacaaaccaauacacauuuaugaucucacagcuuuacuggccaggauuccaggcagagcccauggggcucaggcucggugaucuguggcauuaaucaaggucaccuuccaaguuuaggcagcaaaauuaauuuccuuauagcuguagaaggaaacaacagggcacagguguaugugugugcauguaugagcauaugugaauguguguaugugugugugugugaugucucuguguauguaaugucucuguguguucaugcacauucguguguuuguguguguguaaugucuauauguguguggaauaucugugugugaauguguaaaaugucuuugugugugucugugugcauguguguaagaguguguuuauguguaugagugugugugcauguacauguguguguguauauauguaagaguguaugagugcauguguguauguuugcaugugugugcguugucuaugaguguguguauguauacaugcaugaaugugagucuauauguaugaguguguuugaguguguauaugugaguguauaugcaugauuguauguguguguguauguaugucucuaugugugcaugcauguguaugucugugugugacuguuugaguaugugcaugcauguguaugucugugugugugaguguguaugaguaugugugugugagagugcaugauuguaugugugcauguguguaugugucugugugucucugugugugcaugcauguguaugccugugugugaauguaugaguaugugcaugcauguguaugucugugugugaguguauguuugugaguaugcgugugcuagggcccuugagggaccuccccagcauggaaagaagaguuggcagagggucaggaggucacugcugacagggagugagugugucaggugauggucaggggacucuuccaacggaccuguuagcaaucagguggccucuguggcucuguccaacuggcaaccaagugcuucuuuauuuauggacuuucacagacaaagacagacuaaugaccauccaagugguacagguucucuguuuggcuuuucguuacauguccaggguuacaaguucaguuacaauuagaauacaaacagguuuuacuuuuauuaucagcucucuaaagagucuaaagacucuaaagaaucuaaugaaugucucccccaaagccaacacaguuauucuaugacagccugcuucuaggcuggcagcguuugcuguuggaaaguacuccagacaaacagaaaauaagucaggcaaucuugucuuacugaguucuauuccuccagggguauuccucaacgaccccuaucuuuaaaccacacuacagaaagcuccaagccuauaauaaaaagagaccuugagucuguaaccuuuucugcuggucagucagaguuuguugucucaguuugcccuguaucaaguauacugucugaauuugcuccagaagacuucuggaguaacggccugccucaucuagcuuugugcuuagugauuacuagagcguaaggaagacuuucagauaguggccacagaaagcuaagguuaggguuuucuaaaaagacucagaugauauuuucuaaggagaagacauaaaaugauucagaauguagaaaaguccccaagaacgcaacacgcagagaccaaaacccaacaguuagacagaggacaggaaagcaaguguagcaaccugcucgcucagcuuugcuggaacugugucaggcagcugugcugguuucauaacuccugccacuugcaguggauaugcuguguguguguguguguuugucugugugugugagagagaguaugaguguauaugugaaugugugugcuugugugagagagugaguauaugcauguguguguuaauguauaugugaaugugagugugcacguguguauguguaugaguguguauguaugugaaugugagugugcauguguguguaugaguguauggauguaugugaacgugugcguguguaaguguguguggauguauauaagugugugugcgugcacucguguguuugugugugcaggucagaggaccgcauaggugcuccucacucuccucucacuuuuuguuugacauaaaguacucugguuacaucucuguggcuaugacaacaugugacuaaaaucaucuuaagaacaggaaaggcucuaucuggcuuacacuuucaggucaugguccaucacugagggaaucagggcaggaacucacucaggagcuugaagcagaaacuauggaggaacacugcugacugggguccucacagacccaugcuuggcuaucuucuuuauacagcccagggccaccugccuaggaauggugcugcccgcagugggcugaacccuccuguaucuauuaauuaggcaaccucccacagacagacaagucugauccaggcaguuccuugguugacucuccuguccgaugacuguagcggugucaaguugacaaagcgagguaggauacaaggucucucauuggcuuugaucuuugcuguaaucaccaaucgcugggaaaccugccaagugagcuucaggacuuccucgucucucucuuccaucucaccaccacugagauuaugagcacaugccgccacacuaugcuccuuacaugugaucugggaauugaacucugguccuuauuauacacacgagcaggcacauugcccucugagccacucccagccucggcucccuuucucucucucuccuuuccccaccccaucccagcaaauaggagauucugaacucagagcaggacccuagcccaucuuuuaaaugguucccuugauagggauuaucuuuuugaugaauuuaaugucaguuaauuaggaacggugugcauuugugguuuacaugcaaauuguccccaucucuaucuaggcuuaucuccuacacccuuggucuccagcuggugaugaugguuuagauggcaguggguuguggagccuuugagaagagggacacagcuggaggaagugagucuuuggggggggggagccuucagaguuauagcgcagccucauuuuuguuuacagucucagcuucucccucuguugagaugagagcaagccaugccagaggcuucugcugucaugagccccaccauaacuuccuuccaugccauggaauuaugaacuaaaauaaaaacuuucuucugccauguguuuggucgugaugauaagagaaauaacgagcaccaacacuauaaccaacagcucuaugauccagcacccaaauucagggacauuuguuagcaaucaagacaagucccacagacaugaugacagaccagccugauccaggcaacccuuuaucacagaaccuuuggaaaguagggagagacuaggaccgggagagacuagggaaguugcuggcagguuuguagcauucugccuuccgaugaauaagaugacuacaugcguauuucucuaugauacacggugcuccgcaugccucucaccuacauggcaccucaggugagugaaugaaugaaccuccaggguucuugcugaucuaaagaaacgucucucuccauuucuagacaagagggacagaagagauaagagcucucuccucuuucugggcuuucccuccagcugguccaucauugggucagacuauuacccugccaccuccuccuucucugaggagcugccaaauugguuugcagaggggcugugaccagaggcuuggagagugucugauggcacuucaagggcaccuagcaguggccucuuugcaucacucugucacucagucaggucaucaagugacagccaggcauuuuuagaaaccaugaugagggagguggugucacgucagaugcccaguguugcuccucacagcaugucugagucgagcucaucuucuaagggucugggcucuggcugagucagagcaccgaggugaggcucagccucuggauuccugggcuuugucucagcaggagaugacagcagccaccugcucucuccaggcagaguacagguagccaacaaggcaggucugagggacaaagacaaaugaacuggagcucuggugccaucugucugcuuuucuccagcaccauaaugagccuacaaacaucuccaguccuggagucacuucuaacuacccaguccagcuaggaagggaccagugcucugcagacacucuagccuucaugguucaguucuaaccaggacacgaacccacccugcaugagaagagagacuggaaaaagcugugcaggugcucugcucugcacacagagcccagaggacucugcucauugagggaaggaaaaaaaaaaucaauauggcuguuuagaauugcaaaguuagccacugagcaggaucagaaaguguucugaggaggacugccacgccuccggcuccggggagcaaggaggaagaguuucaguggggauuuuaagcuuuggugcuucacugccuuagagccuccuuccaaaccggcucuauuuccugagcccacccagcaauggccauagcugcucuuucugaguguugcaaauccgccuggagcuucgcacacagucuguagcaauauuaacucuuccuaaggauuccgcuaucaacacugcagcugcuugguucuuucucccucucccucuuccccucccccucuccuucucccccucuccuucucucccucccccuccccuuccccuucucucccucucucuccccucucucucccccuccuuauguguccuggaagagauuucuagaaauacaauugcuuguaccacgaugacaggccaguuaggacaaaggagcuaaaacuggggcaguaccccauuuuggaucccgugugugaccucaggaugcuagcggauggaggcugguggagggguggagggggaucgucccggggaaccucugugaagguuuguguaugcucggcccagagaguggcacuauuagaagguguggccuuguuggaguaggugugucacugugggugugggcuuuaagacccucauccucgcugccuggaagccaaucuucuacuagcagccuucagaugaagaugaggaacucucagcuccuccuguacuugccugccuggaugauggaauguucccgccuagaugauaauggacugaaucucugaaccuauaagccagccccaguuaaauguugccuuuuauaagacuugcccuugucauggugucuguuuacagcaguaaaacccuuacuaagauaaccucauuuucauuuucugggcaguuaccaugaugucccagcuccaccuccaaaugaccccugccaucaucuccaggacugagugugguagcaugugcuucuaaccccagcagcaugcacacauggaacugcauuguaaaagacacucagaccagguuacaccaaaaggaccaccauguaccaggcaccagagucaccagugcccugagauauaccacuguguaccaggcaccagaauuaccugagauaauauaccaccgugaaucacagguuuaucugaauaaucucuaccuauucuugcuaucaucuaguccauauuaagaugcauacauuuccacauuugacacuccgguucagacuugaugaaauaugguaaugcaggagucccacugacuuacauccacacagcuagugggauacugaugcugcaaucucugccucaucauuacuggaucagauuuccagguugcccgcaggucagacaagggagggaaauucacucaucccaaaggcuggacaaacuggauacuagcucacuguccuggugugugguccaucgauguuauuuucugcauuuuguggucaggcaggauuuaaauguucaacugcuguagguuucagaguggccauggaccugcugaaggguguaccauagcuggcccuguucugucuccaggaaaagaugacucuauuuugugguuguuuuagaguauaggagagaguagccagagccugugguguuaguaugugucuccuucaaacagccuuuggauauuagauuucccaucuguaccauagugucugguugccaggguuacgaugcuauccuugaacaggaaaaucaaacagccuccugaauccugcagguagaggucacacuuggcgcagcacacauccuuucuaguauacaaaggggaagauucagccagagggcgaaugaguucuccauguucuucaucugacuccaggcuggugaagacacuguggacagagacuucacugagaacucagugcagcaagagcucccacggggccauggggaucguuuggggacacuagauggcacacugucuucuagggagagacaccccacguucucugcucacaucgagccccugacuucacugauagaauccguuuaauggaagaacaggaaacucacaaaaauaauuacuacaaaaacaaugacucugucaaaagaaauguguuuuccggacccuacuggggacuugguaauaguuuauucuucugucuuuccgagccccgggcagauuuaggggcaacagaacugggagggaaguuuucuccagccagguaauuuaauucuucaggcacuucugucaggagacagagaagcgaccagcaucucccaaacccuuaggaaaacgggaagagacucucuggaugccugugcugcuugcucuuuucucauccuaggacucacggccacucgcucucauuaaacaggaggcaaugaaacguuaggaaaguuauagaugccagcggcaaaaauauaacugaaugaaagccaggaaccaggcucccugcagaaguaaccaaucuaaagugugacuuuagacauucuauacuuaugugaaugcauaaauuaaaauuuaacagaugcaggauauauauguauguauauuuauacaccauuaugcaacauauuuuuauuacuuaagaccgugucuugaagauauuuccuuauuagcaccuuuaaaagcuccauauacggagaaauacuugcuuggcaacguggcgugcuggaaggaaccuggacugaaauuaaagauauggggaaagacuuggcuuaaagaaagcaauaaugacuucagagacagcgcaguacuugcugcucuuguggaggauccaaguucaguuccuaucacccaugcuaguggcucacaaaugccuguaaugccagcuccaggggauaagaacccccuucuggccucuguaagcacugcacucacaugcaugcacaugcacacacacacacacacacacacacacacacacacaaaacaaccuuaaagaaugcaguucuaccuugcacagaauggcugcucuuuuguaacaaccuaaauguuaauuagauaaaaucaauuaauccauugacgacuucaugguuaaaagggacauuaaggaggaaguaggucacaucuccuguccagcuucuuccugucacucuccacuuccuggaugcuaugaggugaguggcucuacuucaccacagucugccugccucuucaccucaucgaugcccagaaaggagggagccagccaggaagggccaacaccgcugaaauguuuguccuagcaaacaguucuuucuuuugagucauuuuccuuaaccuuuuuuggcacagcaacaaugacuaacauaggaaguuucacaagcgggcacuggaaacaguccugggagaugaacacaaugcaugaugucauuuagagaggcucacgugggagccaccugcguucuccacucccagcaugccccacaggagccaccugcauucucacuuccagcaugccuuucgcuucauccagcaucuagaagggagccaguccauaaggcugaagaauugagaaagcacaaccuugauuagcacaaacauaaacuuucccuaaacuccagggacuggcaaaaaccuuggcuuuuucuugcaagaccaugcucucucuuuccucugagagaagcauuuguaacauaguagaaacaaaggggcuccucccaguucucuuucugaggaaaauggggucaaagacuccaacauucugcaagggaagcccuaacuagaccuagcuucugcucuuuaaguccccucccccuucacagguucacagcuuuccaucuacaaaguauuuacaucaauagcaaaccaagcccugugcgguccacagagcccucugaaacuucaagguugagcuccggcuuccugucuuuggagaaugaggacaguccgcccagcucccacucuggagagagagagagagagggaaagggagagagagagggaaagggagagagggagggggagggggaggaggaggggaaagggaagggggaaagggagggaaagggggaggggaagggggaggggaggaaaggagggagggagggaaggagggagagagaaagagagagagagagagagagagagagagagagagagagagagagagagagagagagagagagaaagagaggaggcauuuauucccaccaucaacauguuugccagaucuggaaaggcaggagccaaggucaucuggucuguaucuagaacccaugggcccucuccguagagaaaccacacaccaggaaaacagaauuuuagauuuuuguaaaaacucugggagugccaggcagugguggcacaugccuuuaauuccagaacuugggaggcagaggcaggcagaucuaugaguuugaggccagccuggucuacagagugaguuccaggacagccaggccuauauagagaaacccugucucgaaaaaaaaaaaaaaacccaaaaccaaccaacaaacaaacaaaaaaaacccaaaaacaaacaaacaaacaacucugggaguuuuuaguuuuagugaaaaguaucuaaauaguucaauuugaccucuuggcaagaaaccagaaaccagaacaaaacauguaaaagaaccuggggacauuggcagacgaaugacaagguguucuaauuuuguuucugaugcugugacauacaccuugacaaacagagaggggaaggguucauuggcuuagggucccagguuagaguccaucuguugggaaagucagcuguucacacugcuucccuggcugcucacaccaccuccauacucaaaagcagagagaggagaaauguucauuugcucucagcuggccuccuuuucccuuacacuguuuaggcccucuugccuagggauuggugccacccacagugggcugaguuugccuauauuaauuaccaguuaagauaaucccauacaaacaugaccaacucuauguagauaauuccuaaccaagacuuucuucccagcucgcuucaggcuaugugaggucaacaguugaaaguaaccagcacagaugguuacuggucuaaaagaaccuagacaggaucuaggaagagagcaaguguagugcaguaaaccaagcccuuagggcgauuuuuccuggaagaggggggucaucacagaggaggugcugugcuccaacaaagagcaacaggaggaagcugguuagccugcagcuuucucauccaucucucuucuacuuuugaaggaacuuucuaucuaguuuauguccaaccaacagucauucuaucuauggcucccaaguaggacccaacugagaguaaugaaaacauaccaaccaacacacgggccauuggauugaggugagacaggcucugaaacaugaagaauucucaucuuuaggggguggcuagggcaaggagccagacagaggcaguggaauuaguguaggaggugucuuggaaucuaaaaaaaaaaaaaaaaaaaaaaaaaaaaaaaccaaaaaaccaaaaaaacaaaacaggcauauaaccaaacaaacagaaggagaggaaucagauguacugaaggugaggauggcaacugaaauguaugcaguuuaaguagccauguggagguugcugcucauuguguguauauguguguguacacacaugcuuauguauggugaggccagaaguugauuuccagcaucuuuuucaacugcucuccaccuguguucugagacaaggucucacauggaccuggagcucacugaguagacagccuggcuguccagugaaccccggugacuaaucugucuccacuuuggugcugggauugcaagccacuaagacuggcguguuuacauguguucuggugggucagacuccgcaguccccacccuuacacagcacacacguuauuggcccagacaucucccaagccucagccaucuccccaggcucugucgcucauuucgaccuggagaaguuccaggaaaguuguggagucuggcugaugugggaaggaggaaaaucacacagugaguaacuggaccaacuggcuaaauaauccuugugugguuuugcuuugaaaggucauaucuagucgcuuauacugagucaaagagguuuuguuuugugcgcucgaguggauauucagacaaaucucuguggucuguggucucucucaaguagaacccaguuagacaagcagccccagucuuuauucuaguuguaaauucuguuugcuguucuuaauuacuaccgucuuuaaauuuuuauuauguguauguguauauaugccuauguggauuuaugugcaccauguguagucaggugcucacagaggccagaagaaggugcuaaaucccuuggggcuggaauuacagguagcugugaguggcccaaugugagugcugggaacugaacuccagaccuccggcagagcagcucauacucuuuaguauggagucaucucccaagucccugucugccuuucuuccuuucuuccuuucuuccuuucuuucuuccuuccuuccuuccuuccuuccuuccuuccuuccuuccuuccuuccucccucccucccccugucccucccucccucccucccuucccccucuuucuuucucccccccacucucucuuccuuuucuucuucuuuuuuuucucgagacaggguuucucuguguagcccuggcuguccuggaacucacucuguagaccaggcuggccucgaacucagagauccgccugcuccugccucccaagugcugggauuaaaggcgugcgccaccacugcccugugucccuguauuucuuaucuagacagcuggagcaauacaacaagaaccucuucaugcuguuauuuccaagucagacuuaagcaaugcugagggugaauuugucaggauaugauguuuauuuaagaauuauguuuuuaccagggcuauacagagaaacccugucucaaaaacaaaaacaaaaacaaaaaacaaacaaacaaacaaaaggauuuauguuuuuagcuggggggggggcagcaaauaaagagcagauaaagaagaauaaaauaugugauaagaaaagaaauacuacaaagagauuuaagagagaauauccaaaguauuugggacuuuaaaaugaauucuuuuuaauuaaaauuauuuuuauuuauguguguguguaccugcuuggcugugugugcaucacuacaugcagguucccauggaagucagaagagggcaucagauucccuggaauuggagcuuacaggggccugagcugccugacauggaugcuggaaaucaaauccagguccucuguaagagcagccggugcucucacccacugagccagccccuauuuauuuguuuuucaagaugaagucucacuugauaaaccaggcuggcuugaggcucagcauguagccuaggcuaaccucaaacucacagcuguacuccugccucaguaucccaacuguugggauuauaagugugaaucagcaaguccagcuaaaugcuugaaacauuucuccuguaaaagagcaaaugaaugacuauauaaagccagagcuaagccucggugucuccagauguuuaaacagauuaaaaaaaaaaaaagacgaccuuaaacuuaauuaucccucuggaaacccacuaucuccuuggaauccugcaucccugccauggcugacaaacucuccauauauagaccugcuugccauaggcuggugcucucagcugcagccacagccgcagccgcaccaccugugcaagcacagcuaaagucucugccgagacaaaugaccucuucagugggaugcaaagcaccaggcuuuagauucuaagacagcacuaggugcuauuucuggaagcggcaggcuccugacuucauuaggcaugugagcugugagaugggaaaaggauuacauuguauuucagcaaagugucucuuauaaugagcaacuuuuuuuuagaacuuucuguuuucuauugauuucccagguucuuaaauuuuucuuaaaaauaccuuaguuggggcuggagaguuggcuccaggguaaagagcacuagcugcccuuacaggggaccuggguuuaguucccaguacccacauguaguucacagaagccugugacuccgguuuuagaguguccaacgcccucuucuggcuaagguauagcauauguauguugugcgcgugcgcgcgugcgcgcgcacacacacacacacacacacacacacacacacacacgagaaaauacucacacacauaaaauaaaaacaaaauuuacaaagacaaccugacugaagugagauggggcucagcgguuaacacuguugucaguaagacuggugaccugaguuugaucucggaauuuacaggagaaaaccaauucccaaaaauuguccuuuggccucuauaccccucaugcauccacagaaaaccaaacaaaguaauaauaaauucaaaaauaccugcacuggaggaaaaccacagauauacaugugcgcaugcauacacacagagaauuuauuucuucuggaaugaucccaaugugcauuuugaugaggggcugguaaguucucaugugagcuacaggacgcugaauagcauuggauuucuucauggaggugacuuuuuccucuuugaaauggguuuuuauucagagaacaaauuuaccuuuucuaccagacccagccuuggauuuaccuaaugccccacagccagcacggcucccaaccaagggaucugcuucauggagaagaacagcauuuacuucuuggccuggggguccccuagacuggccaaaugccccagcauggccaaggagcugguuuaaaauccccaaaggucuguguguugcccuugggaacguuguagcaucaguuagcauuaguugauacuccgaggacccagggauggacagcugccaguuagcaucagcugauacacugaagaccaagggauggguagcugucaguucucuucaugguuauauuucacagaaacccacugacaaagcucuuuuccucaguccucaacccugacuguuuugacauaaaggccuuuguuguuagggacagaacacaugagagaugagcccauuaaacugaagacagaggcuggccgggcuuaguucuuuaugucuuuggcacacgaggcaaagggagaaucacugcuugggguaaaggagacucacagugaggggaaaugaggcuuuugcugugagaugguuuggaggcauucugcggagacuaauuuccggguuuccuugagaucuccuguuuggugacucagguuuucccaucacccguguuugccaauuuauaugaauuaaauuuccuuuaaguacuuggagugauuccaucagacuucgguugaugacgugugggcucauggauuagugacugcagggguccuuuuaaggugggauucuaaguuggaguugucaucagucugagcacuguuucagagguaucacaguuaaaggguacaaaaugggauguccaccccuugguaaacucugcuuucuucaugguaaaacuucugcacaucagcugcccuuuggagcccuaaauaucaaacaacccaaggccagccuggcuucaaugggagggccaugcccaguucaagcuaauggcaucugcacagauguguguagcuuccuggaguuguccuugaagaggccacccuuccccauucuuuccucccagugcuuggaauguggaccuaaauacuggaacuccagcagacuuuucagguugcugcuaagaucacagaggagggcucuuuaaggggccuuggucucugacagacagcauccucacagcucaaaggccgcugauccaucagcaguggaagccaggugaucuugucuagagauaucaacacuucagccagagaacacacaaaggcccaacauaaaggauacaauuuacguauuuauaauuagcaugccuuucuauugguuacuuuauuauuuaaggacauucuuuguuucuggagacaaauuuuggguuauauauagucuuuaucuuaucuuuuuuuuuuuuuuuuuuuaagauagagucucaccauguuacccaguccggcucugaacuugucuauccuccuacaccagccuguccuugcugaggacuuccccagcauuagcuggugagccacccacaagcaucuagaaaccccagcagcaagccuaugcuggaaguuugcucuaaguuguaacuucagcugaaccugcugaugagucauagguccguucucucucugucuucucucagccuuaauucgguuugaagucaaauaauaccauugcauagacuucagaucccagagaggacucuuccugucuccuucccagggcaugcucuguagccacuaguguuuugcaugagacagacaggcagugugguggcuagccuuugcugucaaccugcagggauuuagaaucaccauaggagauaucugugcgcgucugugagggauucccuaggucagguuggaagacccacccuaaguaugcucugagauccuggacugaguaaaagggagagagcagagcaccagcguacaucucucucugcuuccugaaugcagacucagugugaccaguugccccaaacucucaccacaggcuccucccgccauaacagacugcucccugccgcugugaaccuggagucaccgguccuucuucugcuugcuuuuagcaggaguuuagcacagcgaugagagcgguaacuaacacacagggaugaagcaggaguccgggcuccugugugaccgucucccgugcucaguugggagcaaugcucccgcagugaugaacucuugccuuccuaggaugaugcuggggcgccuggggcgaggcuguggauccuguugacuagacccugcuagcucugcauccaaaccgccaacaaaucccccauauauccuucagcucacagacucgccccacuccaguguggccggguccagugugccuuggauccuguggucacaguuuacucuuucucgguugucacccucagaagcuucgggcuuucccugguuagcuaagcgguuacccgguaaccacucacucucagcccuucagagcuuguggacacgcacgcauaaucuguuuuguuugaccaauuucccauuccuuuuaauucuuuuuaagaauuaacgaacucuuuuuuaaaaauaauuuaaaucucauuuuaaccaggugugugugugggauguguguguguguguguguguguguguguguguguguguguguguguggcgguggugggggaggggguaguaugcuuggauucagccugccaugcuauccugguucagccuuuucagauuuugagaaucugaggugaguuacagaaaagacaugauauuuaaaauucuguccucaaacacagcccugaagagaacagagcacuuuccacgguuucccugcccagccuagcaucucucccuggugugcuggagagauugccaaggcuggcagugcccuacuucuuggugcuggguaccaggcuaaaucugauccaccccaggcccuagcccccaggaguggggcuuuccgccauuguggacuuucuuguuucagucagacaauaaaagggcuuugcuaugugugcagugaguauuguugacaucaucuuucaguuagcuagagaucugucacuucuugagagagagagagagagagagagagagagagagagagagagagagagagagagaucaagcgagcuugggcccauuuuugacuacaaccuuucuuaaacauuugauucuauuuucuuuucuuauuuuuuuuuuaaaaagauuuuuauuuauuuauuuuaugcuugaggucucuaucugcauguaugccugcaugccagaagagggcaucagaucccauuacagaugguugugagccaccaugugguugcugggaguugaacugaggacccguggaagagcagucagugcucuuacccacugagccaccucuccaaccccaaugacucuauuuucaauucaguuaauucuacuuuuucucuucuuuuauuugucucuccuuucuuccuuuccccuccucucucuuaccuccccuuucucuccucuucccccuugucucucuucuauccucccuuccucuccauuauuuauuguuuucagugcuagguaccagagugucacacaggccagacaaaggcuagucaaguccaaacaccugauuuucuguuugcaaaggguuaguccaagcaugaccacuuggggugcaggcacuguaaccacagaagcggcccccagagggcaccacuggaauauuuacauuuaaugggcaaaguggacauuuuuuuuuuuuuuuuuuuuuuugagacaggguuucucuguguagcccuggcuguccuggaacucacuuuguagaccagguuggccucgaacucagaaacccgccugccucugccucccgagugcugggaagauauuuuucuuacgaguuuuagaaaaucuuacaaaccagcaaacauuuaaaucuuuuauguugguaaucaaauucaaucaaagaaaggaauaagggaaacaccuacugagcggcaagauagcuggucuguuuuaauuuugaaccaauccgugcaucaauucgacaaauauuaaguagcugcuauacaucacagcuucagcaggggcuggugauucgguaauagccaugugcucauguauguuuccuaaaugcccuuuguccaaauucauucagcuggcucacaugugacaccuggagccuuacaaucauuggcuaaggagagaagaggaaccauucuuguuaauaaaggaaccaaaagaguuccuuugaacaaauccugugaggaaggcucaggucuuuagacacauccaguaaacgcaguuuuagaugaaauuccacuuuuuucuacuuagauucuacuggauaaaaauuugagguuaaaccucauuuauuuuaaggaaaagcaucuguucuuuaguuauuccaacugacaucacauggcaccaccauucccccagaccuagaagucaugaauucacucaccgcauggcagcagugguacaaacuggccauuccuucucccucagagugcucacacccugcgaugugcuggagaaaugauuucaaugucaaauuccaacaucucccuuuuaucugaagucuuaugcagcagacaaggcaguggguaagaagacagaucaugcugaggugccaggacuuugcauuuaauuuuucucccauuauuguaaccuagagugaucacaaagaauggggaaucuaggcccuguuggacuugcugacgguuuaacagguggaagcagcuucacugcaggugacuaggauuugucucccacacuagcaggggcaugauuuugccagcagcagauaguuggauucuggggacucuggagaaaguauaaaugggagagcccugagaaggugcuccaaggugacuguugcucccccuacugcuccugguugcuguuguugcaguuugucaaguggugaugaacaaaaagacaagaagaagaaguugaagauauccuggugacaaagauuggacuugccccaagaacccaacaucccuagucaccaggaaguagccugaagagauauaugcccccuuccccuucuaaccuucuuuaucuccuuccuagggauuguuaugccaaggucguggaguccccagagaccaccagagaccaccagaaguccaacucauaugcaaaagcaaagagucuuuauucaagcucaugcucagacccucuggucucuccaguggacugaaagguccugagcagguaaaaccuugccuauuuauuauaguuucagcagggggaggggcuuuccaacuuggcaguuacaugauugguuaacauuugagaaauuacagcuuggugcauucuuauuggcuagcaaugacuucaggaugguuaugcacacuuguggcuaacucgagcaauguauuuugagacaucuggagcauuaguuauuuuccuccuaagagcugauugacugucaccaaggauggaguaguuguuauuaggaaaguuguggcuguugcuagugggugucuuuguuuccuggagcaaguugugguuuuuuccauuucccgaauucagccugaggagaagcucaacauaagauggaaucuggauacagaauggaguuuguaauguuaggcugggcccuucgguguuggggaguuagaagggacuagggugaaagggacuaggguagaguaaagguuggaaggguagagauauaaaaaccugacaaggcagcccuucuuaaaauagcaccgacacgugagcaugugguacauguggucaaggagucugcugcacccgaaagggaggugugcucgagcaggaacaugaguucauccuugucaggacaaugauaggggccauucguuccuguguagcuuccaauccuucuaucaauguugaacccucaguccuaguacaaagccaacugcaaguguagaagggggaggggagagacgagaaggggaggggaaagauaggagaggagcaauagagagaggaggaggagaugagguagacagaggggggggaggagaagagaugaggauagagagaagagaugggaauagaaggagagagaggagauggaagacagguggaaaugggaaaaaggagagggagagaaagagaaaaagaggaagagaagaggagagaugugguauagaaagagagaagaggagaugggggagagugggagagaagggaaaaugcagaugauggagagaagaaaguaggaaagagaggcaagaaaaggagaggagaggcuugacuugaguuagaugcucaucuuggaauaaguuguugugaacagaggauggauggauggauggauggguggauggauggguggauggguggauggguggauggguggauggauggauggauggauggguggguggauggguggauggguggauggguggauggguggauggauggauggauggauggauggguggauggguggauggguggauagauggauggauggguggauggauggauggauggauggauggauggguggauggguggauggauggauggauggguggauggauggauggauggauggauggauggauggauggauggauggauggauggauggauggauggauggauggauagauggauggauggauggauggauggauggauggauggauggauggauggauggauggauggauggauggguggguggauggauggauggauggauggguggauggauggauggauggauggauggguggauggauggguggauggguggauggauggauggauggauggguggauggauggauggauggguggauggauggguggauggauggauggauggauggauggauggauaggaacugguggcaaagguguaggaggaugucuuaggguuuuacugcugugaguggacaccaugaccaaggcaauucuuauaaggacaacauuuaauugagguuggcuuacagguucagagguucguccauuaucaucaaagcaggaacauggcagcaaccaggcaggcaugguacaggaggagcugagaguucuacaucuucaccugaaggcugcuagcagaagacuagcuucuaggcaguuagggugagggucuuaaugcccaugcccacagugauacaccuacuccagcagggcuacaccuucaaaugguguuauucucuaggcugagcauauacaaaccaccacagaggaguuaacacaaggaaggccacacuugaagaccauaggcucugauggagaagcaggugcccacagugguccuugucacuaaggaaccagucccuucuggcuuugacuacuguuugacuuagaugggaaaacacuuuaaguuuccuuucugugccugagaaauccuucaagcauggauacuauuuaaaaaccacaccaagacaucucuggaaccauugcagagaguacauggucacugcgucaaauggcaccaaccauugcugauuccugguguucugaaacauccaacaucagcaaagcucagcacagcuacuggcaaaagcugaauuuuucuauaaccccaugagaagucucauuucucauguccuuaaguucucaguuugauaucucagagcgagcaccaacagaguccagguuuauuuuugaucaccucaucucuagaaagaagcugauuucaagagaaaugugguuagaaaugacugaauuuagcaccuuugaguuaucaauggcaaacagcagaaccuacauccugcaggagaaaggggcucaaguauaacacagaauuuggcucuuggagccccaaaaacuguaauauaaaacuccagagaggcauaagaacucugaguagcugauuugcccaaaggauuuuuuguccaguuuggaagaauagauucguguuuuaauuaacaauaguaaauuuuaaaacauuuucauuuccaauucaaaauuaaauuacacugguuuaauuuuuauuuccaaagauuagaauucuucucaaggauuauuauaaaacuuuuuuuuuucagaagcaauuuugguuaagguucagaauaauuuuaaguauggcuuuccaaaugagugugucuccauaugaacaacaaagccaaggauacacauuucugggccucaggagaccucaccaggcuucuuaugucaagucuuucccugcucaccaccucucuaccuccuuuccccucccucucuucuucauuuucuccucccuuccucccuccuucccucaccuucccucuuccuucuuuccucuccuucuccucauucuccucccucccucccucccucccucccucccucccucccucccucuguuucuugccuuccuccauuuaucccucuccuucccucuccucccucucucaugcuucaucaggucuuuugucacaguacugagaaaaguaauuaguucacauauauacauccacauagcacuuuuacuguauguaauagaugucaaacugccacugcaugugacaauacacucaguggcuugaaauacaauacccauauaucagcucacaguucuauaggccaggugucugcuucgcugugaccguguuguccgcgaagcacguugcaaagcugauguuaggauggcaggaagcugaauuauuucuuagaggcuuggaggugcaggagucagaguccaggccacguggcuauacagaguuugcuuccucagcucgugacugugggauacaugcucccuguccuugcuaguugcugguuauggugggaacccucagcuccuaggguccauuccuugccauguggcccucaccaucuucacagccuuucucuccaaucacagaaucccugucaugccuugagucuuuugauuucucauacccagauucagagaacucaugugauuggucagaucucucacauucccacaauuccugagaacuauauaaagugugaauaccaggaagggaggaaucuuggggauuguaauggcuaguuuacuuaggaagagggucucugggaacagagggcuugucuacauuugguuggcccauggacaugucuauggggaaauugcccuaaguuaauuaauaugggaagcccacugugggcggcgcuguucucuaggcggggaauccugaguuguguaagaauggagaaaaugagcugauuaccagcaagcaagugaacaugcaucuauuccucccugcucuugacuguggguguaauguaagcagcugguucaagcccaucuucaccauggaccuggaauuguaagcuggaaugagucccuuucuccccuaagcugguuuuugucacuguauuuuaucucagcaauggaaacauaacuaggauaaaagucauuucaaaaccguuuccacuguaauguccaucugucucggcagcuuagauagccauguagccagcaagacacacagaauguuuauuccuggacuagguguguguucaaacaugucucuuggaaaucaacagaucccaguuuaagccagcagccuucacaagucagagagugggacagccuuauuccuguuuccuuggacacucccucccucauguugacauuuuugugcacagagccaccucuaaggacacaggacggugcagcauagagugacgggugugcagagacagggguacugaguggcggugggcagaggcaggggagcugccaaacuauaagcagucacugggagggacagagagugcacaggaccacacuuuggagccacuagaacugcugccaggcacagggagggcagaggggaacccggucucuugagauaagcaaauagguuucuacugccuucacuuuugggguuucuacuuacacuagacaacauuuucaaaauauuuggacagacguagaaugaaugcauuuggcagacauauguugccaguugauggcagacucugccaucacugugaggcugggcgagccuggcucucagggcaggaauacugggcacaucaccauauucucaacagaggaagacuuguucuguaaauaacauaaaaagugacugucccacuacuaaaugagccagcauucauuucuucaccuggaacuugaauauggacaaucaugauagucaccuuaggggucaaggugacccgaaccuagagucaccucagaagagggaaccucaacuggaaaaauugccuagucaagacuggcuuuggcaugucuguggggcaucuuauuaacugguccucgauauaggagggcacaggccccugugggagagagccagagccagagauagagcuggagccagggacagggacagagauagagacaaagagaggcaaaggcagaaagagccagagccagagccagggacagggacaaacagagacagaggcagagacagugacagugacagugacagagccagagucagggauagagccagagccaaagaaagccagaggcagaggcagaggcagaggcagaggcagaggcagaggcagaggcagaggcagaggcagaggcagaggcagaggcagaggcagaggcagaggcagaggcagagauacacacagaaagagauggacagacagagacagagggaugagggagagaggaagagaggaagagagggagagaggauucuguguauuaauauaagcuauuaagauggacucagaguggggaauagagcagaugguccauggagugacuuaagggaccaagccagaggauagcuuggugaagugucuccaauuccaccuggcuggaguaaguguucuugucugccuuuuccaucugcccggagaacaagugucacaugaaacaauguuuccaccaggcacccugaugcuccucuuucucauucuccccuucccugucucccucccugugcuuacaaucuuuaucuuuaagccaaagaacccauacccguaguauuuugucuagaggaauaggacuugagaagggaagagguuccaaauccuugcuuuggacaggaggugccaucaagaugacauagaugcguuguccuugccucauuuacucucagcucaugcuggaaacugcugucccagaaaagagcccagagagcagcuggaauucucucagagcagcagcagaggcaugaaugagcccccugggggaacgugaagucagcgacuuguggcugacucccccuguacuguaaccucugcuuccuagaaccccugcaucccagggucucccaccuaaggaagacuggaccacuaguagcacauaguagguuagcauacacaacuguauuuguuucuuucacaccugcaucuuuuuucauugucaguauagcaguucacgcugccuuuggucuguuauaguuuaggagugauuucuagaaucuucuaguccuucacauacuguaauuaccucaggucuauccgauaauccaaaguucuagaaauaccacauuuucuuuuuccucuucaugaguguauaugcaaguucaugugugugugugugaguguauguucauguauguuugcguaguucauagguguguguacauucauauaugcaugugcaguucacauguguaugccugugcauauucaugugugugugcauauacuuauguguguguguacacauucauaugugugugcacauucauaugugugugcgcauucauguauguguacacguucaugugugugugugcauguguguagaccagaguuggaugucuucacugauuacccucuaccuuaugauugagauuggaucucucacuugaacacagaaaucccuguuucagcuagucuggccagccagcuagcuugggaggauccuguccuucccucccgagcacugacugugcaguugggccacuuaagccugccacgguacuguguaggagcuggauaugugcacucaggugcccaggcucacacaacgcuuuauuacccgagccaucuccccaacccacggaaagauuuuuugcuagaucugagcaagcaaaggauucauuuuugaacauccaacuguuuuaaagacugagauauggagaacaaugauccagcagggagccuguuaauccaggcaucuauucaggcuugggagaagcccaggcuuuguaggcaagcacaccugaagucugcagagagacacaucuguucucauggaaaccccuuugcuggagacgcuuccucagcaauguggugaggaggccacagaagcucguccgucaccgcuaugcaucuguguaagccacggggagaccagcaaggcuggaauccauugucuggcuuaacccagagacugagagacucaagaccuuugcagaaccucaaacuggaggggcagagaagucggugugcuaucugcgucaaagauacuuuguauuguauuguauugcauugcauuguauugcauugcauuguauuguauugcauugcauugcauugcauugcauugcauugcauugcauugcauuguauuguauuguauuguauuguaugugcauaguuguuuugccugcggguauaucuauucaucaagugcaugcagugcccacggaggccagaagggggaguuggaucacccagaacuggagucacaggaaguugugagcugccaugugggugcuggaaauugaaccaagguuuucugcaagagcagccaguucucuugauugcuaaaccaucucccaggccccucaaauacuuuaaaacugaauauuuuucuuugaaaauuucaugcauguguuaauguaucuugauuaucuuuaacccucuccaguuccucugacagcucaacauguuuuccucccaauuucauguccuuucucuuuagaaucucccugucuauacuaacuaguucuguccauaugcacgcagguguguguagcuguccagcagccauggagaacuggguaccuaaaaugggggcuggaaaugaaaaaggacagaugggugagagaaggaugaagccaagacaaagguuuucugaucaaggcucagaguuuaauuuuuagcucuguguuuauauagggaaaaaccccacagccccauccuuuguuucagcuggacaauguuguaaagcaagcucagcaggcagagugcuccugcaggaaacugcagguacggcaaggcugaagaucuccaccuaagucaaaagaugucccccuaggugggcuagguugaggaagaccgacuguggcaaacaauuaaagucucuuuagcuuccucaaggcugggggaagggcacagguguggggccauccacggcagcauggcaaccuaccagugaccacgccccuaaaagacaagugacuaucucuccauuaguggcugucaacugaauaaacagcuccuuagcuaggagcggguucucaaaggccccuuccuuauccauaauggaaucuuaaaugacuugaucacgugcaggugacgccaggugccguguccauccaucagggauccacaauauacgguggaccagaacguaaacaucugucacaugggucagcauuuggcucucccuuucugucaacaugcgcccccuuuucaagauuuguacagaaguccaguggaagaggagaaaccuucuagcaccuggcucuugccguucacaaucucuccaacccucucagcaccucacccucuauguuuuuccuucucagcaaauuaugugaggaucccagcuaugugacugugauuauccugaggcuagugcauuucuagaggaacagcuaccacagaaaagcacguuggcuuguuuccagcuguucugagcccaaacauuggcccuugucuuccgcuaguccuugggugggcagaaaggagcaggcaugaugaacagcuuucucuagcccaagauaauaccugccuguccccaaacuguguaacuaauuuuauguaaauuaaaauucgacagcugcuuugauacaggaaagaucaugggcaaagcugggcacaggagaacauguugggaagacugaggaguguguuagaacgugggaaccaggccgguguggcaggcugggaggucucguaagagagccgggagaagugggcucaagugguggcucaccuguuaagagcacccacacuggguggcucauagcuaccucuaauccagcuccaaggcaucuaaugcccucuuguggccuacuucaguaauugcacucauugcaugcacacaggcagguacacguacacacauaaacacacuuaauuaaaaauaauucuuuugaucuuagccauucugacuguugugagguagaaucucaagguuguuuugauuugcauuucccugaugacuaaggauguugaacauuuuuucaggugcuucucagccauucgguauuccuuaguuaagaauucuuuguuuagcucuguagcacauuuuuuaaugggguuauuugaauuucuggaguccagcuucuugagcucuuuguaauauauuggauauuaauccccuaucagaucuaggauugguaaaaauccuuucccaaucuguugguggccuuuuugucuuauugacagugucuuuugcuuuacagaagcuuugcaguuuuaugagguuccauuuaucaauucuugaucuuauaguaccagccauugcuguucuguuuaggaauuuuuuccccugugcccauaucguugaggcuuuucgauuuugcugaagggacccugguauagcugucuuauaugaggcuaugccagugccuggcaaaugcagaaguggaugcucacagucaucuauaagauggaacacaaggcccccaauggagaagcuagagaaagcacccaaggagcugaaggggucugcaacccuauagguggaacaacaauaugaacuaaccaguacccccagagcucgugucucuagcugcauauguaucagaagauggccgacuagucggccaucacugggaagagaggcccuugguauugcaaacuuuauaugcccaguacaggggaaugccagggccaagaagugggaguggguggguagggaagcagggcggggggaggguauagggaacuuucuggauaguauuugaaauguauauaaagaaaauaucuaauaaaaaagaaaaauaauaauaauucuuuuuaaaaaauaaaacgaguagcuaucugugaugggccucaugccuggguggcagcugugguuauugguggugcucacccuggugcuggcacugacccuggugcccauagcugggucacagcaggcacugugcccuucagagugccccucccaugccggcucacuguagcaaugaagaggagaaucaguucaucuauuuaauggcagagggaguagugucugaugucaguuugggaaaggacuuucauaagaauagcagccucauacagucccuugacugugaaggacuccaccuaaggcguggccaagaugucccuggauucugcaggcgucacccaugauucuacaggacucauggccaaggaguuggagucccugggugacaucuguagcaggauguccaaagccaaacacccuauuguuggcuacguggcccacaggacccuuaaggaggauggcagcccuaaccuggacuccaagccugaagaucagcuccauuuaucugaucugcaaggucuggcacuugggugagguggggagacagguguuacacaugcuguggaacaagcugccgaagccucggggccccugcacugaauaaagcaaugcuuaacccggaaaaaguaacaauagacgaagcugaggaagacaggcuuuggcagugacccuaucauuauccccccucauccuuaauuacaguugauacauacuuggcagccuuggccaagucugcugcccuccccccacccgcacuucagaacugcagaggugacucugccugaagccuguugacaagagcuggugauauauugcaauuaacauuugucauuugucuccagguacaaucuggguggccuugcuggagcagacuuuacacacuuguagcuucuucauuaucucuugcaccugguguagucugcaccugccuggaguaucaagagaccuucacccggugcccuccgguucccaugccaucuguuaaucucucuguuuuuuugugacucagcugagggcagagcagaggucaggucuccaaacacacucugcccauuccaucuuuagugcuccauggggagcacgguuuagagugagcuucuuuuugacuuugauaagucucaccgagcccacuuaccuggagguccugagacuucuuuucuaggaagaaagaaacugacagauaauagaggcaguuggcgagcuccuuagaccugugccugagucaggauuaggggggcuagagcauaaccccugagaccagagcagugaaauccagaccuggaugcuacagggaaaugaggcguaguuggcuuuaauggucaacacagccuggagccaucugagaagggagccucaacugagggaguucacaggucgaauugguagcuaguacaucuguccgggauuguccugauuguuaacugauguaggaaaguucaguccaccauggguggcaccauuucuagucaagugaucuggacuguauaagaaagcuugcuaagagggauccuggagcaagugagaguccaagaucuuccuuucaaaugaaugcuuaucuaauccuuaauugucagucuguguuagucugucccaccgcagggcacuguugcuuggagaggcggaauacagggaaauuugacugugacaggcuguaggguagcaccaagauucuguuccagggauggaaaagugcagucugagaugugugaaagcuggaggugguuugggggucucugggccuugggcagggccaugggguccucagacucuggacauccaggugcugcugagagucuugggagagcugagaauggaguggcggccagcaggcuggggacagcaacuagcccggggcugagagaagugggagcucuggcuugucccagugggugauuguccuuagcuuggcagaggcagacuugguggcaguuguggcugggaacacagagaggagaggccuucuacuggagaauuaagcuacggcucuaggcgaaugccuucuccauggcuccccacggaggaucuugaugaaagagacaguccacgguucuaagcaguuuauuaguuguucauggcugaauauggaugcacaauguaccauacccaccucucagcauagaccugagauuaaauaccuuuugcaaggaggaaugucugggaagagaagcuuauugguuaagcccuccgggccucuacguaccucauuagcauagagagcucugcugugagccuaugugacagggcaacuuucuuuuaugugaggaacauggcauuuguuccaggccaggagucuggcagggagcugggaguugccuaagccucaggugugugcccaccaagucuccaggucucaaccugcucuaccuuaccaaacuuccuggcacgguuuuccaucccacaccuaaugauuuaugaacaauggauacauagagaaggguagagaaauaaaccauggaaggagagcugcaggcucuuauaugacccaggcuggacugauaccauuacccacacuacccuucacuugcuucaacuucaucuuuaaugaguacugggauggaccaggugcuggggaugggauguuucccuguggugcggaguucacagugaucucugaugcauaagcaagugagugccuauggcauaguacaagacaccuuagucaggacuuuauugccuugaugaaacaccaugaccaaaaggcaaguuggggaggaaagaguuuauuuggccuacauuuccagauaauaauccaucauuggaggaagccaggauaggaacacaagcagggauggaacccggagacaggaacuaguacagaggccauggaggggugcugcuuacagacuugcuuccugagcuuacucagccugcuucuuauagaacccagaaccaccagcccagggauggcaccacccuccaugggcuguguccuuccccauuaaucacuaauugagaaaaugcccuacagcuagacuucauggaggcauuucugcaauggaggcuccuuccucucugaugacuuuagcgucugucaaguagacacaaagccagccagcacaacaccauuaccaaugaugucauaccuguucuuggaagcggacugauucuuacccaucauucccaggcuugggugugccacuuuauaaacuuccaagccaacuguucugaaguagugcucucuguaaauguucauuucagacuacagcgauuggguguguuuuucauugucuuucauuucuauccccaggcccuuccauuacucucauaaccacauggccaaucuucacugacaucuuuuuuuuucuuuuuuuuaaagauguauuuauuauauauauauauauauaccauugcuaucuucagacacaccagaagagggcaucaggucccauuacagaugguugugaacuaccaugugguugcugggaauugaacucaggaccucuggaagagcagucgguggucuuaaccacugagccaucucuccagcccccugacaucucuuucuaauauauugacucccuagcaggacagauugaaaugcccuuuagacuuaagggcccucaauaaaauguuauuaucuuccuaguacuaauuggcuuaacccauauaaaauacguaugcacuuucuuguccauuggaagauuuucucgcuguccuuaagauuccuugucagcacuauaaugaguuaaacagaguccuuugcuuugcugucaauaggugacuuuccccuaaucuugccugcaggcugauaaaagcuacaggcuaaaaacugugccuucuggggacugacagcacagaaggacaguucugaguguuggcagcaaggauugcaccugcuacucuaauuacugcucugcaaggagcaugcucccggcugccugcuuucuggagaugcuaacccaccucugugaguggagaccugucagacugaaugaaaaagcaucaggcagccuccuagcucucuugucacccagaaguggaaaacuuucuuaaaaguagacaggcaaucccaggucuggaaacacaagaacugguuaugccgagagagugugacagagagaaacauuguuucuggcuguaacgguauuuguugacacugucuuuagcggacucuuauuauucacuauuguuugcuggacugggagcacucuuucucugaacucugucuccagcccuggguuuuugagacacaugcuuucucuguauagugaggcugccuuggaaaaugucauguggggcugauaggcaggugccaccaaguccagcuaaugcucugauuugaaggucauaaaagaaagcccuuuguauuaguuuucuguugcuguaacaaaaauaccacaaucaaaaacaacuuaggaaagaaaauguguguuuuggcuucugaguccugagggauugcaguggggaaggcauagcaacaggugacagaagcagaaagcuggcugcucacauuccuccuccacacacaaagcaaagagcaaggauaggaaguguggaaaagcaauaaacccuuaagucccgcccccagugacacacuuccuccagcaagccuccaucucccaaagguucuauaaccuccccaaaccaugccaacaacugggaaccaaguguucauauucuugaaccugagguucaaugauuaaaaaugacguuuuucguucaaaccaccacauccuuuuccuguauuugaggguaccuuucauccgccauugugcaagcuggauuguggcacucgaugcggccuucauugcacagcaggauccaugagagacauggcacaggaaauccuaaugcaaaugaggauguccgaauauaaaauuucccccauaggcuugugggccuccguuggugguacaguuugagaaggugguggaaucuuuaguagguggaaccuuguuggaagaaguacaucacuggggauggguugggguuuuauagccagcccacauuauugguuuaguguuuccuggguguaggugcauaugaccagucaugucacaacccugcaugucaagugcaugucugauguccucuaccuggauuguccugagauccuuaaaaauggagaaggcuguaauccaggcugucuggaagaaugaccacaggcauuaccagcgcagccacgcugacauugucuucugcuugcaauugagcuucacugggccuucugcacccacagugccccgcucucaccaucacagcuuucagcgccugcccuugcaggaggcacugcuacucacgcucagcagacucuugacuuaaaucuucuuaaggaagccaccucaaggugacugcauguccucucgaguuucaccuuucuagacuuccaguguuccacagacuguuuucaucuugggguauuaaucucccagguccugcuacacagacccagguccucauuauaaaccagcgacaaauggcacacucacucacuuccauguauuuauaucuugaccaaauaauauccucugugugugucucuuccaugaucuaaaacuuccuuuuuggggguggagagguggcucaguggugaaggacacuugcugcucucucagagaacccagguucuguuccagcacccaccuauaaccagcccccaggggaccggacagcuucuucaggccuccaggaccaccugcgcauacgcacacacauuggcuaaguaauaaaucuuuaaaacugaaauaagacacuuuucuucaagacuaaacauaaaaccuuaauuaaaauguaggaggcaauaaaauaaaauucuaauccuuuuauauacucaaugaaaugaaauugaaagauuuuuuuaaugguucuauccaaucuuuaaaaaaauuucauuaucuucccuaaaauaaaugaucuuggguaauguuucuccuuuauggaagcuaaaauuucccaauaaaguuauuauucacucagucaacauuagaauaaucuaauccacaaaggaaaggcugccucugcagugaaugucuugcuaaaaaacgcaugccccucugugggacacaaucacuacuuauuucuguuccauuuaacuucauacaucucugucucaucucaacacgcacuauggaaucagggaaauauuucuaauuuuaucaaaugcagauaugccagcaggggcaaugagaguccagcugugcggcauccucugcagugucccagcaucaccguuuaaaucucuccaacccacugacacaguuguuacaucccaguuguuguccaagauuugugugaguguaaugugagcaugaguguauauacagacacacacucauacucaaugcauuuauacauaauacuuacacauacacaacucauacacacacacaacucauuaacauauacacucauacucaagcaaagaagcauacacgaauguacacacauacacuccuacacacauauacaaacauauucaagugaacaaaugaauacacacccauaggcucacacauauacaucuacauacacacacauauauauguauauacacacuuacagucccacucauauacacacauacacaaacauagucaagugcacacaugaauacacacauauagacacacauauacauguacacacacauauauguauacacacuaacaugaacauaaauauacgauauggccuccuuucagccuccauagcugcaccuccugcauccugcacccuacauccugagaauaauguguccaacucuucuacuaucuucauccuuugccaagcuguuaacuuggcccuuuuuaaggacgaggaaguuauauuuuuagauguauuuauuuuauuuaguguguguguguuuacauggauauaugccuauacacuacauuuaugccugguacccuuggagguuagaagaagggcgucagauccccagaagcuggaguuauagaugguugugaaucaccaugugggugcuggaaacugaacccagguccucugcaauggcaaccgugcucuaaccacugagccgugucuccaguccuacaaauacuuucuguuuucuuuuuuaaaggguucacauuuugcuaugaaauuuuaacuggagaaucauuaccuuggagcucagaaggcuguuguuuuggaaagauggcuugcuguagagauguaaacaaaguuucacgaguaaaaagaagccagagauaauguugucauauucucaaaucuguauuauggugcuuucuacacaucacucacuuaaucaauacuugucauuagauaguugaaggaaaaauuucugaguucaaauuaauaauaccauuauuauuaauaccaucagcaccuucagagaaugagagacaagguccugugguggcugaucaugucagcuuggcacagcugaacagagggagucuugacugaagaauuaccuucaucagacuggccuucucgaugucugaggggcauuuucuugguugcuaguugauggaggagggcccagcccacugugggcgguguuacuccuaggcagguaguccugagcuguuaaagcuccugagcacaagcaggaagacacuggcaagcaauguuccucugagggcuucgauuccuuuccugccaugacuucucucagugaugggccaugauggacauguaaguccuuucccacaacaggacacuuuuggucacaaccaaaggcaaaccagaacagaaauuaauaccagggaauuagaauauuucuguggcagaccuguguuguuuuacaaaggaauguggaaacauuuggaacuuugaguuaaaaaggcaucuuaguuacuuuucuguuacugugaagagagaccaggaccaagguaacucauaaaagaaagcauuuaauuaagggauggcuuacaguuuuagagggcgaguccauggccgucaugauggggagcacagcaacaggcauggcacuggagcaguaacugagacccauguucuacucacaaguugggggcagagauagauagauagauagauagauagauagauagauagauagauagauagacagacagauagagagagauagggaggagggagaagaggaggggaggagagacugggccugguaugggcuuuugaaaccacgaagcccacccccagugacacagcuccuccgaaaaggccauaccuucuaauccuucccaacucuaccaaguagggaccaaacacucacacacaugagccuguguaggccauucuuauucaaaucaccaugaaaagcccauggugcuuaggacuuaacaagguguucucugggaucuugaaagagaauggggagagaaacacagacaauaagaucugacuggugaaguuucagagcaaaaccaagacuccagcagggacguuugugaauuacuuuugauuacaaaucaauggaacgaagccuucugugcucuacugggucacucaacaaugcucagcuagaguagagaaaucacagcaucauugagauaaaucuucugcgaaguguuuccucagggucagcacacagaagcuguggcccaacaggcaugaggggugggaguggugguggugguagcagcgguggcgguggcaguggugguaguaucguggcaaaaucucaugcuggcagcagaacuugguggugugaaagucucccaggugauuuuuaaugacaugaaaccucuggauucaaagaagccauggugagaagcugagacuuggcacaguguggcaggagcagagccucugaagacagagaaggagaagccaucagugaagguguagccuccgaggcaguggagaccccaggauauuggagaucuaggacuacaggacaucuaccaagaacaguggcaguuguggaguggagcuggucugagcuugccagccaagcuauguguauuguggauggcagaucucaagagguaggguagcuagauagaaagaugaaagacaaacauacagagagccugccaucucucuccuuuccaagcuuguguauaacaguauccuuuccugcuugacaaaggaagacccauuucauccccagccagaaagugaacaucacacaggaucucauucgacaucaacaaauucugaaaugauccagaacaauagagucagaauggagcaagugagugacccuacaucuuagaagaaaaauaaggccauggggagagaacguguugcuuuaaauaaaacaaauaguagggggaugugagguggaaguuucuggauaugucaugugaugcagacucacgugauguucugcugaggcaagacccguggagggacacgggauguuuggagagagcauacauaggacucaauggacagugacugggcgcuugcauagcuagucuugcaacacguuguggaucccaagucuucgauuuagccgaucuucacuuuguugagauaugcaugacugagaacuucugguucugguugcuccagcugacaagggccaauucggcagagccuggugguuucugcuggaucaugucaccacugcugacucauguuugauauccugacacuacugaacucuacugcugguauccugacaaauggagauuggaaucaccucaaaaaacuacuucuaaacagguccacauccccuuguccuauuuaccaucuuuccccccuuccuuuggacaguaggcaagaaggggguugaagcacuugugaauccucauuaaaaguagguuuaaaaaaaaaccuaagccugcagagaugggccaugggcugaugcacaaacccaaagccaguggcuuucuuaggaauucucuuuaucucagucuacuccaacagcaguuugcacuuacuaagauuucauauaaauguauacuuuaaaagaagguuuucaaauguuuaguguuuuaguaugaguguguguguguguguguguguguguguguguauguguguguaugaguguguguguguauguguguguaugagugugugugugugucugaguguguguguuauguguguguguguguaugaguguguguguguguguguguauuauguguguguguguguguguguguguguguuauguguauguguauuggugcuugcaugccauggugcacauguggagagucagggacaaaucaugagaaucugcuuucuuuccagcaugugggacccgagggaucaaacucagcauuagcagcaagaauggccaccgacccauugugcuggcucuaaauguauccuuuauagucugaguucuuuagucagggcaauaccuuugaaguucagauucacugcagcaucagaaaacaauuuauuuuuaaaauaaugcuuaucuuauuuuuauguauauggaugucuuaccugcaugcaugucugugcaccacacgugugccaggugccugcagaggucagaagagccuacaguugguuaugaggugcuaugcgggugcugggaacugaaccuggguucuuuagaagagcagcuuguauuaaaaacaaugacuucaugaaauucgcaggcaaauggauggaacuuaaaaauaucauccugagugaggcgacucagucacaaaagaacacacacaguaugcacucacuguuaaguggauauuagcccagaaguucggaauacccaagauucaauucacagaccauaugaaaccuaagaaaaaggaaggccaaaaugugggugcuuuagugcuuuuuagaaggggaaacaaaauacucacaggaggaaauauggggauaaaguguggagcagagacuaaaggaaagaccauccagagacugccccaccuguggauccaucccacauagagucaacaaacccagaugcuauuguggaugccaggaagugcuugcuggugggagccugauauggcugucuccuaagaagcugucacugccugacaaauacagaggaggaagcucgcagccaaccauugggcugagcgcagggucucagaucgaggaguuggagaagggacugaaggagcugaggggguuuguagccccauggggggggggagaaacagugucaaccggccagaccccccagauuuccuggggucuggaccaucaaccaaagaguauacauggagggaccccuggcuccagccgcauaugugucagaggauggccuuguugggcauuagugggaggagcagcccuugggccugaggauguucgaugucccaguguaggggaaugcuggggcaggaacacaggaauggguggguggguggggagcacuuucauagagacagagggagaggggaugauauaggggguuucugaaggggagaccugaaaaggggaaaacauuugacauguaaauaaagaaaauauccaauaaaaaaaauacaacuaacuaacuaacuaacuaaccaacuaacuaacuaacuaacuaagaagagcagcuugugcuuguaaccaccaagccaaccacuaaccacucuucagcccucuuuucuucucuuuaguggcugagacucaaucguauggauacccugcacuuuaccaguuuguuugcaagcauugucaccaguccaaauucauuucuaaauuuaaaaaccaaacaaacaaacaauauugauuugcuucugucacaaggccugggaugaaccaucccuggugguucuagcuauguccugugcaguugcgaccuuggggucacuacuuguccagugucauguucauuguugacuaguuuucucagacugaccagcuagcuuagaauaaagacaauguugcagcgucuuccaagaaauccucauauuuuucuguaucucugcaaggugcucaguuauuggcaaacaugauaaucugauuauuaaagucauuucugaccaggcacuuggcucgaugguaguaauccgcacagggagucuaugcggugugugguagagacgcucuguucuguuguguguucaucuguguucuucucauucuuugccaguugagaccauagaucuagguagagauagugaggcuggcaugcccagccaaucaccaugcugguagcucagcugcaugaccucaaguuguuagacuauggcugugugacaaggauaagaaaaugaaugaugucagucauguuucuucucucagccuaacggucugucuaaguaauuaauuaauuaauaaucaauucccaggcacacuaaauacaacucaauguccugacacagcuguaauggagacagcgauaucuaauagugaucuuccaagcuacaguagcucucaugaugucaccuuuguccugucgauuaaacacacccaaacugugaggagccaacaggucacucugugaccaaggauaauaauuccaucacuuagaauaacccauccuaagugucacccugggucugccuuuccacuuucugcagucuuguagcccacagggucuucacucauuugcacugguggcuauggaaugugggaugcuuacauaucucagauuuccuuuagggugugaguggaucuaguuccaaacuccugugagugcuggcugcuaacagguaagguaagguuucucagcauucuuacuuugggacaaggggaucuguccccuugaagcucucugcccugcuggggaagcuccuggaagcuaacggacucagauuguuaaacucguguauuguugaaacuagugggaaauaaccaauggcucguuacuuuccaggugccaucuuggauagcuugacuggaugaccuaugaugcauccuaaaggagugaggcguaaggucugggcgaccuucccacuauaaguagguugaaggcucuacuuaucaggagccaugacaucaaagugcugaaaaucucugaaaaugauaggaaagccauuuugggaggacccuggagauggcacagagggcacaguccacuuuaggaagggcaaggauggacaguguuccaguuuguuucucuuuugaggugauaaaacaccauggaugagagaacucggggauaaagagguuuguuuuccuuguggguacaguuaucacaggggaagccgugaggcaggagcugaagcagaggccauggugggguguugucuguuggcuugcuccgcauggcuugcucaguucggcuuuuuuauacaacucaggaccaccccacacagucacagggugggcugggcuauccugcaucaaucaaucaagaaaacgccccacagauuugccugcaggccaaucugaugggggacaauuuucaguugacauuugcucuuucccgaugaaccuggcugugucaaccagcccaaagucaguacuuaaaaauaagcuuggagcaaucacugaggcaggaguagaauuagcugcaauugcuaacaagaccaaacguuaaaagaaucauaaaaaccaacaauagcuccugcugauugaguggccgccaagcgcgaggcuccgugccaaguuccucauguuaauguguugcgcaucucaugaugaaucugugggacuacccugaggcuuuacucaaagccaugcuaccccucccccuccguuaccagacaaaccccacaggaaggagcaguguguaagaagacagcccaggggagacacaaccuacagagucaacuuccuucuccccagcaaugagcccagugccuggcgagaugaagucacucacaauugucugcagaaagaauguaaaguaagauguugagagagaaaauuucaauacgguucacucugcacaguggccccaaacuuguucucgcuuugugcccccugcaagcuuuugguguauaaauuauacuuuuguaacuuggagaaaauauacacgaccacgguguccaaaguaccuagagagcaauuuagaggagaaaauauuuauuuauuuuaucugcggaccccugagaggucaguccauggucaugugaccccaugcacuuuacagggcuuccuggaagcagaacccuguaggagaggguccaccacaagucuuuuucaggagauguuaagaccaaugucugucccaaagucaugcagcaguugccaccugcucagggacccugacggucucagcaggugcucuucagcccguaggaagcgugguugucuuucugaaagcucggauguagacugaacggugaaagcugaaugcugcuugaggugagauggaaucccucuggccugaggugugguaaagcaagagaaggucucagggggccaccugguuuaaaucaggaaugauguuucccuugaaaacucuuauuucccacagcugccagagacgcacguugaaaagacaacgagcccguccgaacagacugccgguuuuauaaccgcaaggcccauguuguccucguuuauauguuguugcuguucucacgugaguccaagauuuacagaaugugaugcuccagugaaagcugcccacccaccaaaaaacacuuucagagaaaucucaacugcaaagccauccuacaaggcaagacaaggcagacgggagggagaauacacacagagaaugaaaaaccuuccuauguggagcuggcuaguuuuaugucagcuugacaaaagcuaaaguaacuggagaggagggagggagccucaaaugagaaaaugccuaggucagauugcuguaggcaauccuggaggguguuuucuuagccagugauugacaugagagggcccagcccauugugggugggacuggguuguauaaggaagcaggcugagaaagccauggugaacaaaccuauaagcagcaccccuccauggcuucugcaucagcuccugccuccagguucuuacucuguuucacuuccugcccugacgucuuugaugauguaaacagugucguggaagucuaaguugaaugaaccccuuccucuccaacuugauauuggucauggugucucauugaagcaacagcgacccuaagacacaugcuaagccuccaacugcuacuuaggauacagaggcaucucuuucucucaagaauucuaagauagagaauaaaacagcugcuuuccccuggagagagagagagaaagagagagagaaagagagagauagacagagacagagagacagacagacagagagacagagacaggugauaaauagauaauuagagaggugauagauaauagguagaugauagauaauagaugauagaugauagaggauagauagaugauauuuagauaauagauaggugauaaaugauagauaacagaugauagauaauaaauagaugauagauaauaggugauagauaaugaucaauaauagauagagauacauaauagaugauagguaauugguagauauauaguagauagaugauaaauagguaaacgauagauugauagauaaacagauagaugaaugauaguguucccacccccuaaaucuucuagaacuuucccaaauaacacugccaauuaugaaccaaaguuuugagacauaggccaguagagaacauuuuauacucaaacuaaaauaguaucuauguccaauaauauuuagauaguuuaaaaauuaugaucauauuaguuccuaauuaaaauacucuuucuaugaacaccaggcccgucccuguuccuuacacccuaacuuauucauauacauacgucguagguuggcuaagugucuccuagaagucugguuuggggacugguguggcaugugcgguuugccucugugaagaugcuggugagucccacguucagggcugcugugccuuucucgaggcagaggaggcugcuggcaaggcacccgguguuccugucuccacuuugaguaaagaaaaucgguguuccuuuguggcuguucauauaucuuuaagacagagaggaggcaggagagagagagagacagagacagaaacagagagaucuaaaacaucccuuaaaucauguguuugcauggguaacauuuuaagccaauccagaagaagucccaggaaauucaauaguaagcuugacccaaacaugagaaaucuaagaugacccaucuauuuaauauuaaaucuuggggccugaagacuuccaauggagggacuggaacaccaacccagccacaaaacuuucagcccacaguguguccugccuaugagaugugcagggguaaaagauggugcaggauuuaaaggaaaggcaaccaaugccugguccagcuugagacccccgccaugagagggagcccacccugacacuauuuaugauacucugcuguacuugcagacaggagccuagcauaacuguuaucagagaggcuucacccagcaacugauggaaacagaugcugagagccacagccagacauuacguggagcuugggggaaucugggggagagggggaggaaggacuguaggagccagaggggucaaggacaccacaagaaaacguauagaaucagcuaaccugggcacaauagcggcucauugagacugaacagccagccagucaucaugcaggggauggaccuaggaccuuugcacauuuguaacaguugugcagcugggucuucuugugggacuccuaaaucgggagcaggggcugucucugacaauauugccugccuuuggggcccuuuccucuugcuggguuaccucaucuugccucaauagguggagaugaaccuacucuuucugcaaguugauaugccauggcuagcugauaucuauaggaggcccgccccuuucugaagagaagggaaggauugggguaggugggggaagguggagaaagggacuggggggagagaagagaggggaagccuccaccagauauagaguacauauauaacuuaucaguaaaaaauaaaauaaacaaacuuggggccugacaugacucggccuguaaaggcaccugcaagcaagucugaagaacugaguucaagccccaggacuggaaggguggaaggagagacgcaacaucugcaauugccacuugaccuccauccuccauguguauacuguagugcaugugugcacgcacgcacgcauguaauaacauauagagauaaaauauaauuuaaaauuuuuaaaagaaaaagauuaaaguuugaguguggcuuggcuuucuguaacuuacccuaagauuccauccuaaggauggguauaaaaaugcucagagauguagcauuuccuaauaauccacucuaugcuaagcuaugguuccucuggcaggcgaucuugaccuagacacugagcugugcucccauuuuauagaugaaggcauugaagcuugggaacuccuaacccggagcauagcuaugggugauuucuagccacagauggaagcauccuuuuguauauauauuuuuuaauuagauauuuuauuuauuuacauuuaaaauguuauccccuuucccaguuuccccucuggaaacccccucccccacccccuucuuccuccuccuaugagggugcucuccccccacacuucuggguuugcuuggaugccugcuucagugaugacccuuucaaauagacuguaaggguggccaagguccuaaguccacaccccuaacagauguggaggaugccugcuuccagcuguaucuuuaaugagaaaacuagccagauccacacgucuggauguccccaaagugggcacaccacugcgagucugcagcggcccugguucccugccaaggaggcagcugagcuucugaaaggaggagccagcgcugaucugcuugggaaagcuuuggcuucaucaccagaggcaucaaagugggcuggagcaauuugcaauuagacagucucauuugcauuuuucuuucuaacagcucuucagagccagugcuuaggcuugguggcugcugacuccaggaacaggaguucacauacauaguggcagcaguauucaagcggggccaucuccagacuuuggaaacacacaggcagcuucuccauaccaucucuuguucauuuuguggcaguucuccugacuggauacuguagcagauauuggccccuccccaugcuguucagccuaaguugucaguuauacauaauauuccaugucauuaugacuuuucauacuuaaauaauguugaucacauucaucccauugaccuccuccucucaccccuuaucugcagacgccuucuucuccgcagcucgagacaacacagcaaacaaagauuucauguccagcuagggaagcacagaggagacuuggaagccccccgccccccacugccuuuccccuuuugcuaaaggacgugaacgggaucuuguggauguugugugauaccuuccaaugcucgugugguguuuuuaaauguguucaacucugcaaacuuugaggaugugagugagcagaaggccaccacauacagugcaggacucgguggugacaucgugcacacuuggagccagagaugcugcaaaagggaaugaaugcuuuacauagugugagcuauucagccacaccccugcucucuacucauuguuugaucaaaaauguuuccagagcuagagagauggcuucugcugucugucuguccauccguccaucugucugucuuucuuucuguuugugccuuugaaagacuccgaaaggagccccucgcucaggccucaggacaauaguggacacccaagaacucacgauagaucgagcuuguugcaaaccacaugaggcuuuauucgggggcaggcgugggggggggagccagagcucuggggacgacucauaucccaugcagggguagaggaguugaccuccaggggaaagaggucccaguuuuuauaggcccucaggggggaaaggagaagggggagaguaggggauuuccagauuuaaacaaugucuauucucaagaaauggguguaguggcuauuccugguugucaacuugacaauauuuggaaugaacuacaauccggaauuggaaggcucaccagugacccuuaucuggaggcuuggagauccuuaucuggaucuugguuugaagaucuuaagccauaguggcuauggauuccagaagauugaaucuccgaguuaaggaacacaccuuuaaucuggcuaugccuuucaucugggauuaaaggugugguggaacacaccuuuaaucugggcuacaccuuuugcuggagacaauauaaggacauuggaagaagggagucuagcucuugcucuugcuccuucgccugcuugcugcgugagacugaguaacugcuagauccuuggacuuccauucacagcugcgacugaaccauuguugggaauugggcugccgacuguaagucaucaauaaauuccuuuacuauuuagaaauuauccauaaguucugugacucuagagaacccugacuaauacagaaguugguaccaggagugguucuagaguaacagaaguacaaggaugaaucuuuuaaaauacuggaauuggcuuguugauccaccagcacuuucaaauauugaaaccucuccagauucucucccuccugggagcucagagaauuuugaagacccaugguugaaacuauauuccgaacuuaaagaagcuaaugcccuugauuuucuuaaugaauuaggugauucagugcacaaagcuuucuacaagauggggaaaaaaucgaaaaaugauuuuacuggcuggcugcucuuaguaucuguggaaaaaaugaugaaugaaaggaaggaguugugugauaaaaucgaaaggcuccagacacaaguaaacgaucuaaaaguugcuaaguguguccuugaggagaaucuucucucuuguagcaauagagcucaaguugcagaaaaucaaacagaaacucucauuguaagguuggcugaacuacagagaaaauucaagucucagccucagagugugucgacaguuaaaguaagggcucuaauuggcaaagaaugggauccuacaacaugggacggggaugugugggaagaccauguugaagcugagaauuuugaauccucagauucucaaggguuugccccaccugaggaaguaguacccucagccccaccucuugaaauaaugccuuccccacaugaggaaauuaauuuugcagagucugcucacggcccaccaauaguuucuucuagaccuguaaccagacucaaagcaaaacaggcuccuagaggggagguagaaaguauaguccaugaggaaauucgcuacacuacuaaggagcuuaaugaguuugcuaauucauucaagcagaaaccuggugaauaugugugggaauggauuuuaagggugugggauaaggguggaaggaacauaaaacuagagcaggcugaguuuauugacauggguccucugaguagagauucuagguuuaauacggaagcucgcauaguuaaaaaaggugucaaaaguuuguuugaaugguuggcugagguguuuaucaaaagauggccuacuggaaaugacuuggagaugccugauauuccguggcuuaguguugaugaagggauuuuaagacuuagggaaauugcaaugcuagaguggauauauuguguaaagcauaauuguccacaaugggaagguccagaagauaugccuuucaccagcucuauaagacgcaaauuggugagaggggcaccagcacauuugaaggguuuuguucuuucccuuuuccuugugccagaucuuagcauuggagaugcuucugcucaauuagaugaauuaaauucacuggguuuaguuggaucccgagguaacaagggccagguggcagcauugaaucgccggagacaaggugauccuaguuauuauaauggacagcguagacaaaagaauguuuauaauaacauacccaguaauggucagcacaggagaggugaaauuuauaauggcaugacucgcuuggaccuuugguacuggcuaaucaaucaugguguuuccaggaaugaaauacauaggaagccuacugcauauuuguuugaucuguauaagcagaaaaauucucaaacaaaugaaagaaaggcuacauuagaucgugguaaacagcaaucucggccagugaaucaauuuccagacuugagacaguuugcagauccggaaccccuugaaugaagggguggccagguuccucugaggaaggaucuugauaagacacucaaagguuuugcuguuacccuuucuccaguucuuccccagagggaccuacggccuuuuacaaggguaacuguacacuggggaaaaggaaauaaucagacuuuucggggucugcuggauacugguucugaguugacacugaucccaggggaucccaagaaacauuguggcccuccaguuaaaguaggggcuuauggagggcaggugauuaauggaguuuugacugauguccgacucacaguagguccaguagguccccggacacauccuguggugauuuccccaguuccagaauguauaauugggauagauauacucagaaauuggcagaauucucauauugguucccugaacuguagagugagggcuauuaugguuggaaaggccaaauggaagccuuuagaguugccucugccaaagaaaauagugaaucaaaaacaguaucguauuccuggaggaauugcagaaauuacugccacuaucaaggacuugaaagaugcagggguggugguucccaccacaucuccauuuaacucuccuaucuggccagugcagaaaacagauggaucauggagaaugacaguugauuaccgaaaacuaaaucagguaguaacuccaauugcagcugcuguaccagauguaguuuccuuacuugagcaaauuaacacaucuccuggcaccugguaugcggcuauugaucuggcaaaugccuucuucucaguaccuguccauaaggaccaccagaagcaauuugcuuucaguuggcaaggccaacaguauaccuucacaguuuugccucaaggauauauuaacucuccugcccugugucauaauuuaguuagaagggaucuugaucguuuggaucuuccacaaaauaucacauuggugcacuauauugaugacauuaugcugauuggaccaagugagcaggaaguagcaaccacuuuggacucauugguaacacauaugcguaucagaggaugggaaauaaauccaaccaaaauucaaggaccaucuaccucagugaaauucuuaggaguccagugguguggggcaugcagagauauuccuucuaaggugaaagauaaguuauugcaccuggccccuccuacaaccaagaaagaagcacaacguuuagugggccuauuuggauucuggagacaacacaucccucacuuggguguguuacuuaggccuauuuaccaagugacucggaaagcugcuagcuuuguguggggccuggaacaggagaaggcccuucaacagguccaggcugcugugcaggcugcucuaccacuuggaccauaugacccagcagacccgaugguacuugaggugucuguggcugauagagaugcuguuuggagccucuggcaggccccuguaggugaaucacagaaaaggccuuugggauuuuggagcaaagcucuaccaucaucugcagacaacuauucucccuuugaaaaacagcucuuggccugcuauugggccuuaguggaaacugaacgucugacaauaggacaccaagucacuaugggaccugaacuacccaucaugagcuggguacuaucagacccugcaagucauaaagugggacgugcacagcagcagucuauuaucaaauggaagugguauauacgugaucgggccagagcagguccugaaggcacaagcaaguuacaugaagaaguugcucaaaugccuaugguuucuacuccuguuacaaugccaucugcugccaagcaugcaccuauagccucaugggguguucccuaugaucaacugaccgaagaggagaagacuagagccugguuuacugauggcucugcucguuaugcaggcaccacccagaaguggacagcugcagcauuacaaccccuuucugggacaaccuugaaagacacaggugaagggaaaucuucacagugggcagaacuucgggcaguacacaugguauuacaguuuguuugcaagaagaaauggccagauguacgauuauacacugacucaugggcuguagccaauggauuggcuggauggucagggacuuggaaagaucacaauuggaaaauuggugagaaagacaucuggggaagaaguauguggauagaucucuccaaaugggcaaaggaugugaagauauuugugucccauguaaaugcucaccaaaaggugacuucagcugaggaggaguucaauaaucaaguggauaagaugacccguucuguggacaaucagccucucuccccagccaucccugucauugcucaaugggcacaugaacaaaguggccaugguggucgagauggagguuaugcuugggcucagcaacaugggcuuccacucaccaaggcugaccuggcuacagcugcugcugauugccagaucugccaacagcagaaaccaacacugagccccagauauggcaccauuccucgaggugaccagccagcaaccugguggcagguugacuacauuggaccacuuccuucguggaaaggacagcguuuuguucuuacuggaguagauacuuauucugguuauggauuugccuuuccugcacguaaugccucugcuaaaaccaccauucacggacugacagaaugccucaucuaucgucaugguauuccacacaguauugcuucugaccaaggaacucauuucacagccagagaaguaugacagugggcucacgaucauggaauucacuggucuuaccacauuccccaucauccugaagcagcugggcugauagaaagauggaauggccuuuugaagacgcaguuacagcgccaauuaggugguaacagcuuggaaggcuggggcagaguucuucagaaggcaguauaugcuuugaaucagcgcucgauauaugguacaguuucacccauagccaggauucauggguccaggaaucaagggguggaaaacggaauaguuccacuuacuaucacuccuagugacccucuaggaaaauuuuugcuuccuguccccauaacucuagguucugcuggcuuagaaguuuuggcuccagagaggggagugcuccuaccaggagcuacaacaaacauuucauugaacuggaagcucagacuucccccuggucauuuugggcuucuaaugcccuuaaaccaacaggcuaaaaaaggaauaacaguguuaggaggggugauagauccagauuaccauggggaaauuggauuaccucuucacaauggugguaagcaagauuaugucuggagugcaggagaucccuuagggcgucucuuaguacuaccauguccugugauuaaagucaaugggaaacuacaacagccuaauccaagcaggaugacaaaggacgcagacccaucaggaaugaagguaugggucaauccuccaggaaaagagccaagaccugcugaggugcuggcugaaggugaaggaaauacagaauggguaguagaggaagguaguuauaaauaccaauuaaggccacguaaccaguugcagaaacgaggauuauaaaguaauaugaaugcccauuguaaauuuacuaaugcguuugcgauuguacgagggauaguuauaucauguuaggcguauuuacaaccuuguuauuguuucaugugaacaugagauauuauuugugucaaguugacaagggguggauuguaguggcuauuccugguugucaacuugacaauauuuggaaugaacuacaauccggaauuggaaggcucaccagugacccuuaucuggaggcuuggagauccuuaucuggaucuugguuugaagaucuuaagccauaguggcuauggauuccagaagauugaaucuccgaguuaaggaacacaccuuuaaucuggcuaugccuuucaucugggauuaaaggugugguggaacacaccuuuaaucugggcuacaccuuuugcuggagacaauauaaggacauuggaagaagggagucuagcucuugcucuugcuccuucgccugcuugcugcgugagacugaguaacugcuagauccuuggacuuccauucacagcugcgacugaaccauuguugggaauugggcugccgacuguaagucaucaauaaauuccuuuacuauuuagaaauuauccauaaguucugugacucuagagaacccugacuaauacaauggguaugggagggguacaaggaaagagucuggugcagguguagcaacuuaggauuggccccggcugugguugcuggggagauuuucugacucuuucucagcaaccaauaucacaaacaccuggcaguggacuucagcagugggcacacacauggguucaaggaacggucagaacauuggcagacacacagguucaaggaguggccagagcauugugcaccucuauuuuucuaaaucagugaagcuaguucugcuaacagugacaucuauuuugccaauuucaggguuucugugaccuuuuacauucugucaggaucuuucaccuucucucucucuuuguguuuucucuaucacacacacagcacacacacaguaugcacacagcucacacacuacauacacacagcacacacacaguaugcacacaguacacacucuacacacacacacacagccccucagcacacaauacuacauacaguauaaagacacacuacaaacacaggacacacauacuauacaaagcacacacacacuauacacauagcauacauaaacacuacacacagcacaaagcacauauacacacagagcaaacagagcacacacaaacacaugacacacacagcacacaccacuguuugugagcgcgcacacacacacacacacacacacguaguacacauucugcccacuguuggaaaaagccacuguaggaugagcaucccuauucuagugagcugaccuuaaaagcucacagcaucuagguugaagaaagcacagcggauaaaaaaauaaaaaauaauaaaaucaaagccaaccgugcugugccagaaugguccucaggcauucugcauccugacagcuaauugaaugggagccaugcuguccagcauccccauugcuagaugguucuaggugggacuggucaaaacagaaaucugcacaaguucugagaugaccauuacaccaauaggcucugugguguaguggagggauggacccaggcagaggggcacacaguccccucuagaacauguucuuuucuucuccuuggcuaucuuuuguucucaaccccuggucccauuggccacccacagccccagccugcugacuugaccuugggcuugcagugagguggaggucaggcaaccuuccucagguuacaguguuuucuucagggucaccauuuuguaccuggacacacuuaucauguucccgcagcaagcuccaacagccucugggagcucacugcuuuuggggucugccuaccacucacucuuuucccuugugacucucugcucuguguccucaccgcucagcucagcuucccugugacuaggagauauuaaguuuccauuccucauaucccuuacuccauaacacugauugaaaucugauggcugucuucucugccucggccuacuccagaacgagcauuucagaagccacuccugucucagacacugugagucauguccgucccaagggaggacauuugggauaugaaucuccacucagagucugcugaacgaacagggcaagcggucaacuuccuuccuaauucaauagucgguaauacacuuacccgacccugagagagggcaugccuguucgaggagucaauuugucuggcuuacaacagaggagaguagacuggagaaaaugaacucuuuccaggccaaaaaagccagucuugggaacucaugagcaccagauuuaagacugucugggauggugacuucagcaguguggagcccaaccaugcccucacaggcuuggcacucccugggucuuaguucaaccccccagcacugaccaagggcagcagauuccucaagauggguuuuuccuguaagagaugaugaagggaggaacagagcaaggggaaggcagagaggcagaguaaagagaccgggaguuguguauugagcacacgagugucaggugauccgagcucaauucuuggggagcccugggcagcuucucacugggguggcugagucuccccguauuuucacaugcaacuugagccugcucugugcacagugggagaccagagccucauggaugcagaugauggcuguggggagagguucagcacggauuaagaugcccugacccaggggaucaggcugauaggugcugacacaccugaugcucucugggccaccagaguuuuucuuacugacccaggaguaaaacagaaaccagaucuuagaaggagagcacuaaaaacuauaaaacaaaacaaaacaaaacaaaaccccugaugugucuuguuucuugucuuuggucucugaggaagcgacaguuacugcuguuccuggauccuucauucuucacccugaagcacuccccacucacauucuucugguugcaugugcucacuaaagcauguguuguauugcuuccuccguuuauuucuuauuguacuuugcuucagacuugaugagccucuuucucucucccucucccucucccucuuccucuuccuucccuccccccuccccgccuuccucucucucuccucuugaucagaaauguacuaccaggccagagaaaagugguuguuauugggaaaugccagaauacaaagaugucuucauuuguuguaugauguuguaacagaauacccgaggcugggcaauguguuaagcaaagaggaacuugcucaaaaaaaaaaaucuaaacagcauggcuucuagcaucugguagggggacccccccccccagcuuuguggaagcacagcagaaaaguagagggaaaauagucacaagcaaagaaacuauacccacugccugaucaauuuucucccuugaggggcuuugccuagcaaagggagaguggcuaaagccacggaagcuccgucuugcuccuguggccugguggucagccgcauugagauucuagaugccugccugccugccugccugccugccucucuuucuuccccucccucucccccucccacuucucccucacugucacaucccuggaugucuggccccagggauuucuugaaaugcugagcuguccugguguccacuggcauuacuguguacucuccggcaccagggcugugaccuccaguguuagacuaggcugcgaauaucucaagcuuccucuggacugugagauguaacagugcccuccccaucccugcuauccaacaucagcucuuaggaaacacgcauuuaucuauuugugguuuugccucuuuauuuucugugaaggugggcacgugugucacagcacacaggagccaggggacagcuccacguuacucggguaggugcauuguguuguguuuguuuguuuugcuuuuuuuugguuuuuguuuuguuuuguuuuuuucuucagggcugcugcauacuccagccuggcgugggcuuccaggcccccuucuguguccaccucccacacaguuguagaaauccugagauugacagaggcucacagucaccuccagcuuuacaugcaggucuuggggguugacuucugguccucaggcuuccauuuccccucucccccucaaccucucacuggacccuuugcucuuuuuccccuuuucagucucaguagucagccuaaccuugccugaacucucuauuucagccgaauuucaacucaugaccuuccugcugcuucuugccaagugcugggacugugggcaggcgccgcuguguccagccuugcaggacagugagaaaaccaaaccaggauccacucuaaaucaauugcaugaagcgucucaggguuggaacacagcauugacguauuuaacauguccccagccaauugcagucagcagcaagagucagaacuaucccgaagaacaaggcucccagaggucggugcucuaugaugcccagaugcuuaguaaaagcacaucugggcuucggagaauucaggauucuacugaucuagggagguggccaccauuuuuauucccaugggguuuccaagugaggugaaggcuguuugaagggguccucagugugagcacaguuuugaggguggugugaucaugagccccaccuuacacauaagucaacggagucacaaccgugacccagucagagcugacaacggugacccucagacuucagaccucagcaguaacugcuucaucuuacaccaggcgaccaugcagcuguagccacguggaagcuugcccggugggcugcgcaaacucagucccaaauuccugcuggcagaaaggaagaugcaucaaagauuacaaagcuaauuuagguucauuaaucaagauaacguuaauuguuccagucuucucagugaaggaccacuaaugcauacagaaauacuucauccaagacaacucagauguuaucuccuccggggaauucaugaggaaagcuguuuugggggauggacucggagcucugugcaucuugccuggguggccagggugucgugggaaggcagagcuccaguuccaggagacuccaggcuauuccucagugcccuagcaaaggaaggccucauuuaaauuauguguaaaagucagaagucagaccugagugugggggcacaugucagccugucacccagugcuugggagacagaagcaguaagaugguaagccagcuugggcuacauagcaagacucuugacucaaaagaaaauuagaagucaggggcaauacugccauaacuauauuauauuaauuauauuauauagaauuauguggcugcaugugugccugugcgcacgcacacgcaugcaggugcucucaugucacaucauguauaugguggucagaggagagcgaccucgguguugauccaaagccucuugucuguugccguguaguccaggcuagcuuggcagcuagcuuccagggauugguucucccagcccucccucuccucucucuacagcaguguugagauuguagacauguacuuccauguccccguguuacauggcuucuggggaucagaucccagacccucacauuguacaguaacaaccccuauguaaucugucaagucggcggcucccugagcagaugaguggcuaguucaguucccccaccccggcauguuucuuacuagugcagauaucuguuugacuuccauacugaggaccaagagaggacuuuccagacuccuggaggaagcgggcuuucccccauuuaugaacucgccucccaagcucccuucuccaugugucucuccguggaacagugguccuugcauuggaagaggguuaugaaacagagaccaugcaguaaaguuaggcucugauucugcaucccaucuuccuccuccugcaugggggucuguuucucagaacggaaccaaagaggcaagagaaacuucaguaaaccacccagugcagaugcuacuccaaguguguccaaccugggcucauggccuccugccaccaaagauguuuaugaguauggcccaacacaauggugugugugugugugugagagagagagagagaaagagaaugugaauguguguauauguaugaaugagugugugacuguguguaugugaguguguaugaauuuuugugagacucugugaaugaguguguguauguuuaugugagucuguaugaauuuugugagacucuguguaugaguguguauguguguaugaaugugggugugugacucuauguuugagugugugugaguaugaaugugugucugugacuguaugaguguguguaagugugcaugaaugugugacucugugugcaugaguguguauguaugaaugugugugacucuguguuugaauguauguguguaugaauaagugacucuguaugaguguguguauguauaugaaugugugugugacuguguaugaguguauguauguguauguguguaugacugugaaugugugacucuguguguaugaguguguguguguaugaaugugugugugaccauguguaugagugugugugacuauguguaugaguguguguguauguguauauguguaugaaugugugugaguauggcuguguguguguguguauguauguaugugugugugcauauaagugcagguacccacaaaggcuagaagauggcaucagaucuucucagagcuggaguuccaagcgguuguaagccccuuggcaugguuugugugaacuaagcuucaucuucuucaagaaccgcagaucugucuagucacaggugucuuuccuuuguuuccuuguuuguauuuugugacccacccugcccauggggaucaguccacaagggcaaaggaagcagagaagauggacuggauuggugggguacagaagccccgugagcagagaguaugguaaaugaugacacugggaccagcuuuggggaggaagaucgacuguacuuggggugauucgaggcuuauaugauuuggaggacuugaggauagaaacauucagaaugggcaaaggucauuggcuaaagucuuagggaccaaagugccucauuugcauggggaaguauuccaggaaucucaggugcuagcugaaaaggucuuauugggagaaaggaaguugaaccuguacuguaacauucugcagguagaggcguauggggguuugaacuucacaaacaagaucagaaaagcccugccauagagucuuccauauugugucaagcugagaaugcuauccugacaacggaagacuuugaccuuaauuagcagggcaacaguaugguucuuggguaugaacuuuguaguauggcuggacacaacuggccuguguggacuguucuguccaugaugaugggaguccucuagucugagagaaugugaaaggcaagugggacagaggccacaugaggaaaagugugggcuuaguugcauguggccuccacgugacccccaaggggcaccuuggauguaaauaucagcggggucuguugucugcugaaucagucacugguggaaggccaggucaucacagguguucuagaacuggagcccagcaggcccaggccagcugucuaacucucagagaagaugcagauguggugugggcagaguguucuagagaacugaagaaucaaggaaccucuucccagggugugugugaagccagugugcaugggcaguacuccugaucuccuccuagaucuuuucugcaagcuuuccagggcccuuccucucugcuaagcacuuacgaauaucacuaagauguagugagaguuuugguuucuuaaaaaaacccagcuauguuguguauguguuuuuguucuaauuccagguguaggacaagaggcugcuucacagcaggugauuaugauuugccucgugauccagcagaggugugguuuugccagcugcagauaguuucugcaagugugugacuuuuggaauucagugaaguuuugagaaguauaaaugucugaaugccagaagagggaacgggcacagaggaugcuga

SEQ ID NO: 5372 - RNA, 3217 nt, Mus musculus
guucaucaaaaugaaggaauuccacccguuggugggaaauuuauuuguuaggguuaacgacacuguuguacugucaugguacccccuguauaaaggaucaguuugacucuggcuguaugcuaaguacuaaggccuggguagaaugaguuuaaguagcccauccuaucuacaaucccaccagucuauuucccacuuggcgacaagcuuagaguccacacaugagauuuaccaccgucaaaaagaaccuuuauuauucuguguagccucacgcuuucuugccagccgccuuuggagcaggugcuuucugggcuggggucuucugacccuucugaccuuuagcaggaggugcugccuucuggccugcagccuucugagcaggagccuucuggccugcagccuucuugccugguccuguggccuucuuggcugggacuuuagcuuuagcagcagcagcagcugcagccgccgcaauggcagcuuuggccacagcugcuuuuuugggagaagcuuucaggauagcagcucuuugaaguuucuuuacuucagucuugauuauucuguuccucugaaaaaacacagaagagcacuugcuacacucacacaacaauacgccuuauguccauuguuagaaauuaaacugcuuccacacacauaaacuauagagagauuauuuccaagacucauuuggucauuaagccagcuacuuuuacccugagcaaucuugcuggcccuaaccuaucaagagcuauaaacaucaauuacacacaacaccacaaaauagggacuggcuacucuucccucauuacccuacagccaauauaaauguacaucugaagacuuaccauuuucuuugccuucaugaccuugaaacgaucaaagucugucaucuuggcuuucuguuaaaagaaaaacaaaacucaacugaucuccccugacaucucaagcacaucccgcccuccagaacucaaagcuuugugccuuuacccuuucucuggcaucaauuuucuuggcccaucuuguggcugcccauuucguauugauauccgccuucucccaagcuuuucggacauacuucuggcgggcacuaugaagaucaagucacauauuacucaaucagcuuuaugguaggucaugucaaaaaaauauuucaaaguacacuuaccacugcucacacgugugcauaaaaccaugucccuuuguaaauaacaaaagcugcuccuuacaccugcuauauuuugcacauuaacuuggcuaaguuucuuaaccacuaaaaacuucugcgcuucggugaacccuagauucaccuguagucacuccgguacauggugaccauaaccacuccaccagcaccccucaguuggcaucugucucagagaccacccagguuaaauccacucugugguggcucauuacagcaggugcuucauuguaccaaucauugcugaugacaaccacacagugcugcaggacagucuuaaucugcaccccucuaaaacacaacaaaccccaucacuaaggugacucagaccagaagacugcaaauuuggggccaauuuggauauaugagagcagacauuuucacggaacuuauugugugugugugugugugggggggggggagacacgggacccaaacaggaacuucauaauggcaaaacgaccugggcaauuuuaagucaguaagucuguuuguuagauauaggccccuuuccuugguuggcuccaaaccaucuguauuauccguguauauauagacuguggcaccaaacugaaaagcaacuuagaacaagguguuaccugugugggaacuugaggaugaagucagugagcugcaugcauuugaagggcauggccugccuccucacccgaguacaggguccauccacuaaagccuaggauacaaaaucaaggaccucagacaggcaucuaaaguucaagauggcuguaaccucuacguaauuucuagcccuuucuggacgaaauguacauuaccauucaaaugaagaaaaugcacguuugugaacccaguauccuaaaagccuccacugugguauuuucagacaaggucaagcagcccaggcuaguggcaaacuccugcuucuccuaccuuauccucccagagccugagguagcaggagccacaucuaucuuuagaauccagggacucuagcaagcacucuaccaacagagccgcaccuccagcucacugaagucuucucaguuaccucauuuaaacucaccugcauuugccugccucguuuacccggugaauuagugcuguaagaugagcuaacucuacccagugcuucaaacuccguggccaguguuuccucaaugguaaaccuguaaucuaaagaacuccacccaaggaccacucuagcuacccugaguaacaucuacggugcugucgaucuuacggccacguuaaauaaagauuguaaaauacuccgucccacacguacccuguucugaucaaugacaucuacaauugcgaccagcuuuccagcauggggcccgaaggaaauguaggccacccggccaaccuccacguaacgccugaacaccuaaaacaggaaaagaaacaaggguuggcuuuaaauauuccaaguccgcugcuuaccggcaacacagggcucggggccgcccugggagacgaguuugaacuuaguagccagcauuuuuuaacuucaaguaucccguggccacuuucccagcacacgagcucccuggauccgcucuuacccauguuugauacuccuuuaguucucauacaauuaauucaucguucaauccacugaaccacuccccgguucgcuuuuuccggagaaaaagaacugaagggagcucaugaggagccaggccgccgggcagguccgaggccgcagcagcgccgccauccccggaccucaggcccagccacucccgccacugcgcacgcguggccccgguagugcgguccacgcgagccgcgcucccugcgggcuggguuccacgccccgcugccuccccacgcgcuggccgggucgcgcagagccacuccacgccggggcucccccgcccggggcagaagacgggcgucgcgacggccgcacucggagcucucggcacacacacucaccauguuggcggcgcucagcgagaagagagagggcccgcccugccgugcgcaugugucggcagaagccccgcccccgacguccagcgugcccaccgauug

SEQ ID NO: 5373 - RNA, 877 nt, Mus musculus
acacguuuuaguuuguuuuaauggaugaauguggucaauguccgccacacaaacucagguacucccagagaucccuggaagaaccuggagugauaggagguugugaaauacuccgcagggacucugggaaccaaacuuuguuccucuggaagagcagaagguacuccaacacaagguguaacccaggcuggccucaacuccugauauuccugcuucugccucuucagcauauccuacuagcaacggacaccagaaccagcucaauaaugaacuuccuaacuucagcaggugacucucguuugcagacacucacgggauguucuggcaugguucuccuuucuuccacuagcaucugcaacguaagccucaccacucccaauauagccuccuguggugcguggguuccguaucucccacugugacaccccaaccuccucggacauccccauccaaagucuuccugccucccacgcaggucuccacucugcagacugcgcgcuuacaaggcacgagugucugacggcgaggggacagaaaugaugcuccgcgccccggggacgccuccuggggcccaaugcgucccugggcacggaggggggggcaacaucggauuguccacucguggcaggcugggaacgcugaaggaagguugcacuucugacccagcaccgggcgcaguaagucaacguccgacucgcccgaacuaucuacagggccaagccccgacccggaagcgcgagcgcacuccggccgcucuaggaguuccggaggccucaucucggugauaacaccgccccaccacuugucgguccagcggaguaggagggguuugauguggcucagggcgccugcgcacuugcgcagacucccgcgcauc

SEQ ID NO: 5374 - RNA, 5873 nt, Mus musculus
augaggggcagaaggaaaucucuuuaauagcauagcaacauuaggucugggagucacugaaggaaacacugccuuccgaccacacagcuaggcugagauguggcugcauugcacacucuggacagauuucacauuggggacuuaauaaauagauacucaaaacgucagacauuagaggcgaggggucguaugugugguuguuuccucauuccaccuccuccaagcagggccaagacgcuggcccacuacgauggguauucguaguccucggcacugcgccggccaaaauccauccagcccauguagucccggucacuuauucuauggcugggguccaggcucugcagguucuuaagaacggacaugcggccagaaggagcugcagggagaagagaaggagaggagagccuuagaucugagaauaugaccaguguaagucaggacuaaagcagugggggaaagcuagggcucucaugugugccugugugcaugcauguaugcgcauaaaagcauauacauaggcauaugaacauuuguguguaccucagucucuuucccaucuugccgagacagagccucuuaauguaccuggagcucacuggcugggcuacuccagcugcaagccucugugauccuaucugccuccccaucccuggguuguaggaacagaccacacccagcuuuuucgugugguuucuuggguaucaaacucaggucuuugugcugagaugaaagguggagacaggagaauccccuagaagcucaugggucaaguagccuggaguacaaaguauaucagcaaguaacaaaaaggacccggccucaaaccagggggagguaaggaccaaccaacacccaggguugaccucugaccuccaccgugcacugugccaaguacacaccuugugauacacacacacacacacacacacacacacgagacacacacacacauacacacacacacacacacacacacagagagagagagagagagagagagagagagagagagagagagaagaaaaaacuuuuagaaugaggaccagucagacagcucaguggguaaagaugcuuaguguuuagcuugacagcgagaguuugaguccuuggacccucacaguggaagaugagagcagacuccugaguccgagucuucugagcuccacaggauuacccuggcacagcuccuccucaugaauaaauauuuaaaauguaauaggagccaagagagucaacuaaucuggauucuggggcucucagagucugaaccaccaaccaaagaauaugcauggacuggaccaaggccuccaugcucauauggagcagaugugcagcuugaccuucauguggucugaacaacuggagcagggacuaucccaaaagcuuuugucugucugugggauauguucuaccagugggacugccuugucuggccucagugggagaguguugaagcgacuugaugugccaggguguguguguguguguguguguguguguguguguguguguaggguacucaggggucuccacccauucagaggagaaggggaaggggaauggagggaggauuaugggaggaggugacugggaggggggcagugagcaggguguaaagugaauaaguaaaaaaaaaauuuuuuuaaaguaauagaaucaaggucucucucuauauaugaauauuguuuauaaaugauuagaaagcuacauucuuuuaaaaauaauaaccagaagaauaaauccugucagauuaaaauacuggcauuuugacaacauuaaaaaaaaaaaaccggaaugaaaagucacaaaagacgaaacuuaaaucagccauuuugaccaaagcacaaugcuauaaccaacaauguguuccagcaacuguguggcaacugugugaucugggcaaggagggguguggugacaagacuccucccucugaaggcagauggcauggucccaccccacacuguuugucaauggccuccugggcuuguaaccaguauagcaccuucuaugcugacuaaggguaaagaguggucccucgggaccuccguggaaaaguggaaaccucuccauggcucccacugagcuagggcuacaauguuucuaccuuuugggugcuuugcaggcagcuucccggccagcuccugcccacaggcgagcacagccagaaggauuacuuacugauacaucuuugcccaugcuccaguaagcagcccuaaugagaccucuugggucauugaaaagaauguagagaaguagaggagagguuacuuggcaagaggcucgggagcaggggcgggggagagaauagaugaagguuguaggguauugauuugaaugugauauacgguguacuaaacgucaucaugaaacucaccguuauggcauaauuaauacacauuaauaaaacuuuuuuuuucaaaagacaccacagagucaguuauccagacuaacuguauaaugaauuuaaccagauaaucuuaagaaaaccaccacaaugaucagcaacuguguuuccucucuggccccaugccuucccucccuguuugggaacugagaauccauucagugagguuuuggggguagauagccuggcccgugcaaagaagcuucagcuauguaacuguucaucaccuuucggauuaaaaauaaccagcauguaugcagccugggucccuguacagucacauggaaacacagccuaucguccugccugcugagggauuaguauucacuuugagggcucugagcuaccagcuucugucaagccagcagccuggccagugcauggccaugcaaccagucauggaugcuguguuuggaacaugccucgguucucauaagcuacacagaucuguccucagguguggcgcuaccaccuuuccuggcauccuuccccagcacugcauagugaaggacuuagaaccaagucauagggugagguaaggaauccaacucuuuccugaguggucaaagaagagagcucagaggagcuuucagcuaggaccucggcuggaaaacaaaaacacccccucuccacugucauguguggguucuaggcaauaauucagcaaccaggcuuucuguugcuagaacuguuuggaauaguccuaaacuuaggcaaaugggcucuagacugacugcucagugaagucuagaauacuucagaaggggcugcugguggucuacaccagagaguggauccuacaugagugaucagagggaauggagaggggcaucccauguuuccagguuuucucauuauucaauuaucuaucuguccaucuaucuauuuguccauccaucucugucugucugucuaucuaucugucuaucuaaucucccuccuuuccuuccucccucuaucccuccauccuccucuuucuccucucuguugaauuagcaagaaaauaaccuagaaaggggaagcuguagugggaguuccuaaacaggaagaaaaguaagaaaucguuugauuuccucugguauuaucuucaugugaaauucuaggagacucaaccaggagguccaguuuucccucaccagucaagccaaaugcagacaggucgacaagccaugggcuguucaaaugcgggcaggaaaaauuggguucgugagcuccacagaaaggaugcccaccuccuguguuuuaauccagcucuacugguccagguuaacacccaaccagaggucaccauccaugccacugcgaauaaagucagagaugaaagcugucucaggggccagccacgagccacgacuccugaaggcuacccucggaauuccagagcugggaggggaucugguucgcucugcucucaucuuuucucuacaaugagagguuugggcacagaaagaaacauucaaagggcaaggcgcagaaucgcccaugggauucaugggaaaggccuuccaaagcggagaagcucagcguuccaacagcuacagaaagguaagauagaacucucccugugaggucagcccccugcuugcagucaaggggacgcucuuggcccuuugacccuuuccuccugcucuguacugggggagaggugcacaaggccuccggcucuuuucagaucucaggcugucucagcgccgacccacuuccugccugagggguucccaaggucagagccugguggcccccagcagaagcgauagggcggaucuaaggaaucuuaccagcacuugauuauuauuauuuuuuaauguuguccuaaaacgguuuuauauuucauccgaagacagugucaaaaucaguucagaaaagggucuguuagccggcuucccuuaccaacgagguaagcccuccgcccaccuccccugugaacaccgccugucuacugcucagcgcugugcagcguaccucagggaagaaaagugaaaauuuugcuccuugugcguccucuguuuccuccucccugccagugcugaaaggaucaagauuggagccgcagcagaagccugacggggagcggacacccuuaccuuugcggaccugcuggauguaucgcgcuagcagugcgcccaggcgcgcucggggcucgccguccguccggagcacagcccgcagcugccuucggggcgccucuugcgcccgcugcuccacgggguccguagcuucugcagggacuaccggcugcgccagggcgccagcagcuaggacugccaucaccacgcacagacauacgccgcucuucauggcuaugggaagcaaaggcgaggagagugaaccaaagacuggccucagcgugcuccagcccaaagucccgcacacagaagucggcugaggcugaacaugggggcugcagccgggucagacuggcucaaccguagccaagcgaaguuccuagaugcgcccuggccaccgcgauaauuucugccuggcuuuuguguuauccacaccugggaccugggaaucccgcagagucccgauuuuucugcccugaucagaagcagcguuuccucuugcuuuccugaaguuccaggacgccuuuguagcucaucucucuucuaaccagaaaagcagaaugaagcgugugugugugugugugugugugugugugugugugugugugugugagagagagagagagagagagagagagagagagagagagagucagagagacagagagagacacagaaagacaaacggacagacaaacacggggaggauacuucuggagagaaaugugagagauuaaauuuauucacuacauuaaaaaugucaggacacugggaaacgccguuuuaagugugggcccauaaaaagaagcuguauuuauauagauucuucugcguuuuacgggaagucacuauacaaagcaaaagccagaaaucugugcccaguccucagauguggccaaagcccugcuacacuugagaacugagcagaugggugcuguaucauaaugauguguuuuuauuccccaaagccuuaaaauuuuuuuaaugcagcauuuagaaaaugggcauaaaucuuuaaaccucuagguaguuucuuuuaaaugauugcaaagugcuccgaacagcagagaaacccuaagaguggcuauucccagccuugcuguaaacagaacauacaacaagucucuccgcagcaguacccacccagaugcauuuuaaggcuauuucugacuucaggaaaucuuucuagcugucaagggagggaaggcacagaaaaaggaaagacuaaacagcaagaggugcaaagcugcaggccaauauucuucacacucaagauuguuggaucagccagcuacuuaccuuuggauggggaaaucagcuggcuuggcgaguuccagcggagaaggcugcaguccagcuaaguugagggcaggcgggagggugacugcucuuaaaua

SEQ ID NO: 5375 - RNA, 5873 nt, Mus musculus
uauuuaagagcagucacccucccgccugcccucaacuuagcuggacugcagccuucuccgcuggaacucgccaagccagcugauuuccccauccaaagguaaguagcuggcugauccaacaaucuugagugugaagaauauuggccugcagcuuugcaccucuugcuguuuagucuuuccuuuuucugugccuucccucccuugacagcuagaaagauuuccugaagucagaaauagccuuaaaaugcaucuggguggguacugcugcggagagacuuguuguauguucuguuuacagcaaggcugggaauagccacucuuaggguuucucugcuguucggagcacuuugcaaucauuuaaaagaaacuaccuagagguuuaaagauuuaugcccauuuucuaaaugcugcauuaaaaaaauuuuaaggcuuuggggaauaaaaacacaucauuaugauacagcacccaucugcucaguucucaaguguagcagggcuuuggccacaucugaggacugggcacagauuucuggcuuuugcuuuguauagugacuucccguaaaacgcagaagaaucuauauaaauacagcuucuuuuuaugggcccacacuuaaaacggcguuucccaguguccugacauuuuuaauguagugaauaaauuuaaucucucacauuucucuccagaaguauccuccccguguuugucuguccguuugucuuucugugucucucucugucucucugacucucucucucucucucucucucucucucucucucucucucacacacacacacacacacacacacacacacacacacacacacacgcuucauucugcuuuucugguuagaagagagaugagcuacaaaggcguccuggaacuucaggaaagcaagaggaaacgcugcuucugaucagggcagaaaaaucgggacucugcgggauucccaggucccagguguggauaacacaaaagccaggcagaaauuaucgcgguggccagggcgcaucuaggaacuucgcuuggcuacgguugagccagucugacccggcugcagcccccauguucagccucagccgacuucugugugcgggacuuugggcuggagcacgcugaggccagucuuugguucacucuccucgccuuugcuucccauagccaugaagagcggcguaugucugugcguggugauggcaguccuagcugcuggcgcccuggcgcagccgguagucccugcagaagcuacggaccccguggagcagcgggcgcaagaggcgccccgaaggcagcugcgggcugugcuccggacggacggcgagccccgagcgcgccugggcgcacugcuagcgcgauacauccagcagguccgcaaagguaaggguguccgcuccccgucaggcuucugcugcggcuccaaucuugauccuuucagcacuggcagggaggaggaaacagaggacgcacaaggagcaaaauuuucacuuuucuucccugagguacgcugcacagcgcugagcaguagacaggcgguguucacaggggaggugggcggagggcuuaccucguugguaagggaagccggcuaacagacccuuuucugaacugauuuugacacugucuucggaugaaauauaaaaccguuuuaggacaacauuaaaaaauaauaauaaucaagugcugguaagauuccuuagauccgcccuaucgcuucugcugggggccaccaggcucugaccuugggaaccccucaggcaggaagugggucggcgcugagacagccugagaucugaaaagagccggaggccuugugcaccucucccccaguacagagcaggaggaaagggucaaagggccaagagcguccccuugacugcaagcagggggcugaccucacagggagaguucuaucuuaccuuucuguagcuguuggaacgcugagcuucuccgcuuuggaaggccuuucccaugaaucccaugggcgauucugcgccuugcccuuugaauguuucuuucugugcccaaaccucucauuguagagaaaagaugagagcagagcgaaccagauccccucccagcucuggaauuccgaggguagccuucaggagucguggcucguggcuggccccugagacagcuuucaucucugacuuuauucgcaguggcauggauggugaccucugguuggguguuaaccuggaccaguagagcuggauuaaaacacaggaggugggcauccuuucuguggagcucacgaacccaauuuuuccugcccgcauuugaacagcccauggcuugucgaccugucugcauuuggcuugacuggugagggaaaacuggaccuccugguugagucuccuagaauuucacaugaagauaauaccagaggaaaucaaacgauuucuuacuuuucuuccuguuuaggaacucccacuacagcuuccccuuucuagguuauuuucuugcuaauucaacagagaggagaaagaggaggauggagggauagagggaggaaggaaaggagggagauuagauagacagauagauagacagacagacagagauggauggacaaauagauagauggacagauagauaauugaauaaugagaaaaccuggaaacaugggaugccccucuccauucccucugaucacucauguaggauccacucucugguguagaccaccagcagccccuucugaaguauucuagacuucacugagcagucagucuagagcccauuugccuaaguuuaggacuauuccaaacaguucuagcaacagaaagccugguugcugaauuauugccuagaacccacacaugacaguggagaggggguguuuuuguuuuccagccgagguccuagcugaaagcuccucugagcucucuucuuugaccacucaggaaagaguuggauuccuuaccucacccuaugacuugguucuaaguccuucacuaugcagugcuggggaaggaugccaggaaaggugguagcgccacaccugaggacagaucuguguagcuuaugagaaccgaggcauguuccaaacacagcauccaugacugguugcauggccaugcacuggccaggcugcuggcuugacagaagcugguagcucagagcccucaaagugaauacuaaucccucagcaggcaggacgauaggcuguguuuccaugugacuguacagggacccaggcugcauacaugcugguuauuuuuaauccgaaaggugaugaacaguuacauagcugaagcuucuuugcacgggccaggcuaucuacccccaaaaccucacugaauggauucucaguucccaaacagggagggaaggcauggggccagagaggaaacacaguugcugaucauuguggugguuuucuuaagauuaucugguuaaauucauuauacaguuagucuggauaacugacucuguggugucuuuugaaaaaaaaaguuuuauuaauguguauuaauuaugccauaacggugaguuucaugaugacguuuaguacaccguauaucacauucaaaucaauacccuacaaccuucaucuauucucucccccgccccugcucccgagccucuugccaaguaaccucuccucuacuucucuacauucuuuucaaugacccaagaggucucauuagggcugcuuacuggagcaugggcaaagauguaucaguaaguaauccuucuggcugugcucgccugugggcaggagcuggccgggaagcugccugcaaagcacccaaaagguagaaacauuguagcccuagcucagugggagccauggagagguuuccacuuuuccacggaggucccgagggaccacucuuuacccuuagucagcauagaaggugcuauacugguuacaagcccaggaggccauugacaaacaguguggggugggaccaugccaucugccuucagagggaggagucuugucaccacaccccuccuugcccagaucacacaguugccacacaguugcuggaacacauuguugguuauagcauugugcuuuggucaaaauggcugauuuaaguuucgucuuuugugacuuuucauuccgguuuuuuuuuuuuaauguugucaaaaugccaguauuuuaaucugacaggauuuauucuucugguuauuauuuuuaaaagaauguagcuuucuaaucauuuauaaacaauauucauauauagagagagaccuugauucuauuacuuuaaaaaaauuuuuuuuuuacuuauucacuuuacacccugcucacugccccccucccagucaccuccucccauaauccucccuccauuccccuuccccuucuccucugaauggguggagaccccugaguacccuacacacacacacacacacacacacacacacacacacacacccuggcacaucaagucgcuucaacacucucccacugaggccagacaaggcagucccacugguagaacauaucccacagacagacaaaagcuuuugggauagucccugcuccaguuguucagaccacaugaaggucaagcugcacaucugcuccauaugagcauggaggccuugguccaguccaugcauauucuuugguuggugguucagacucugagagccccagaauccagauuaguugacucucuuggcuccuauuacauuuuaaauauuuauucaugaggaggagcugugccaggguaauccuguggagcucagaagacucggacucaggagucugcucucaucuuccacugugaggguccaaggacucaaacucucgcugucaagcuaaacacuaagcaucuuuacccacugagcugucugacugguccucauucuaaaaguuuuuucuucucucucucucucucucucucucucucucucucucucucucuguguguguguguguguguguguguaugugugugugugucucguguguguguguguguguguguguguguaucacaagguguguacuuggcacagugcacgguggaggucagaggucaacccuggguguugguugguccuuaccucccccugguuugaggccggguccuuuuuguuacuugcugauauacuuuguacuccaggcuacuugacccaugagcuucuaggggauucuccugucuccaccuuucaucucagcacaaagaccugaguuugauacccaagaaaccacacgaaaaagcuggguguggucuguuccuacaacccagggauggggaggcagauaggaucacagaggcuugcagcuggaguagcccagccagugagcuccagguacauuaagaggcucugucucggcaagaugggaaagagacugagguacacacaaauguucauaugccuauguauaugcuuuuaugcgcauacaugcaugcacacaggcacacaugagagcccuagcuuucccccacugcuuuaguccugacuuacacuggucauauucucagaucuaaggcucuccucuccuucucuucucccugcagcuccuucuggccgcauguccguucuuaagaaccugcagagccuggaccccagccauagaauaagugaccgggacuacaugggcuggauggauuuuggccggcgcagugccgaggacuacgaauacccaucguagugggccagcgucuuggcccugcuuggaggagguggaaugaggaaacaaccacacauacgaccccucgccucuaaugucugacguuuugaguaucuauuuauuaaguccccaaugugaaaucuguccagagugugcaaugcagccacaucucagccuagcuguguggucggaaggcaguguuuccuucagugacucccagaccuaauguugcuaugcuauuaaagagauuuccuucugccccucau

SEQ ID NO: 5376 - RNA, 1807 nt, Mus musculus
ucuccuucauguuuuucuccuuugugaauguuaugaacuagccuuguugggacuuguuacagacaagcccugacuuggugugggagggaaccauggcaugacuugaauaccagaacacaauaaugcccaaaggcuaucuuaggcugucacaagucuuccuguguucguuuuguaauuugucugugguuacauaagcccugcuuccauuuccacccaccagagaagugucguuuagaagucuucacucagcucaggucucuccauguaccgugucuauccagcugcuagguuggcacccacuguaggcuucuccgcagagauggaauggauaggcucucucugacuauauggugguuuaugaggggaacaugcucauguggugacagaggcugagaaccaggggagccaguucugggguucacugacuugcacuuggccucagaaucaggggagcugggacuggggauguggcccaguggguagugcucuugucuagaaggcaggaagcccugggguugagcuccagagccacacaaccuugcuguggaagcacacacacaucgguaaucccagcgcccagcaaauggaguuuguaggauagccuucagagucagccugcuacacagugaauucaaggucagcuugggauacacaagacccugucucaagggauaaaaaugaaguauccgugaagcugaugauguaacauuagugagaagcugagguccugagaaccagagccgggacguuccaaggaaagccuggaguucugauguaugaagagggugacaggccugacccgggguuuuguaguucaguuauucuaucaacagagauacauccucagccccacagaguucugugcacaagcaaaugucucugaaacacacaaacucucccuugcccaauggccugagacuuggagaagcuuuuccugagccccaacuccaagacaacuguuccuguaaauucucuuuggaacccaugcuucugugaagcauaacucguguuuaaacaccagaauuccugccuggugcccuacccccuucucuugauuugguuucuguguucacacuuccuguguacgcagugcgcggcaaacagcggugcucagcacuugucaaaacaguaagggccuaacugugcuacccaaucucccuccagccucauagcgagguguguguggcucagggaucggacuuuggcaccuccuccaggcuggcagaaggcugugcucuucggauccucuaucucgggccucuugcccagcugcguagccugcaagaacccacgcccagggagugucacuccagucacacggggccuagacgccucuggagaacagcccuguccgcuccaggccaggcaucguggggacgucggagccucuucucaccgcucgaggugagacucgcacgugggccuggggaccugcggaagagacgcgggcugaggggagcaaacccgggccagcccugguagauucacucaauucccgggucugaacaacuggacagcagagacgccccacgauuggucuguuuggcgucgcuuagcagcagcgaaugggagcucacggugugcgcaugagcaccacauccugccuccuacagccgggccgcggguaaccugcaccccgccggccgccggggugggcugcgguggccgaggcggaggucggccgcgggggcgaggugagguuagcgggccaggcgggcguggagagguggggucggggucuaggccaccgggcugcagcccgggccggugggacuccgccgaggcccggcccccugcacggugcgua

SEQ ID NO: 5377 - RNA, 44054 nt, Mus musculus
cccagcagccccugcuccauccuccacacgcacagaguagggaucggggcccucccgggcauagaucuuugggaggccuggggcaucugccuccugcuugaugucacaguaguagggugguggaggcaccggagcacagcugguggcaggcugugccagggccacagggcccgagggcgccaaggaucgagcguccagcagcuccuggcaggaggccgcgaugucagccaucugcagcagcgaggccgcgcugagcaccucgugcacguuggccgcguucacgagcagcuuggacguguagaugaaguugaggaucugcugcaggccgcugggcgcgagugccuccagagauagcucgacccgcugcagcugcuuguucugugugaagagcgaguggaagaacuggcuguaggcggccagcacacccuugugugcggggaacacgcuaugcugaggcaccagcacuagguccacaucgcacaggucuggcuggaagaggcgcugcucauugaggcggcccaucaagcaggcgaagugcagggccacguccuccaccagcgagaacucugccgccggggagucugucgucuucucaaccagcaacuguggggccaagagacaggagaggugagggccaaccacugcccaccccugcccacaaugugggaggugccaccaccagaaaugaucugauccauccaucaagcugggggaaggacagacgcacagacgugcgcacgggcacgcagggcagggacagcugcugcuagggcuacgauguccugggaccugugcccagguagcugcucugggcacucccuucgcucuuccucugugcacacacuaggggccaccccaggaucccucuucacugugccccaacuggacuuccagcuaugccucaguccguccugaccuucccaccaugcugagacaggagccugcccaacugugagcacgugaacagcagaagacacagcuuccgcuauugcaccuaggcuguagcauccaggggccguuucacuuggacaguggccaacaaaggccuuuaaggggccacagaagacagcaggcuaaagacagccaggcccacucaagcuacagcagcuuuuuguacacaggguccugggggaagacgggcuguuuucucuguuugccacacuccggcaccccagcccagacgcagaagcuccaggcugguccugucuuggaggucgcaccuccuggagagcccccuagggaccuuagugacugacagaucagacugccaggccuuuaggcccugccccacucccagaacaguccuguuuagucgggugguagagaugggccugucuuaucccucacauagggccuggggcucagcagacacuggccaguccggcccuacaacggcuggcuuuggaugcuccaugggcucugccuguggagacgaaagcuuccagugugugaaugccgaugcaucccaaugggggacacaaccccaccuuccuuaggggucccaggaugaagcuguccccucuaaguccucucuccugucagcagugggugggccagacagagagcauggacucugagcucccuugucauucugcuaaaggagaagcugcgggugagccccaaggagcuucgaaccugugcccucggccagcagcccaagacaugcccacucuuugcccuccgcuccaccaacagacguugccuuccugaagcucccuccaccccucacacccccaccagccacccauucuugaaucuaucccagaacugcugggccguccagcagggacguggcacggggccccgcccaucccucucugacucacucugauucauuuucugggaccaauuccucuuucuuagagaaacugaggcccagagaggcuuuacucauggagcuguggccauccugccacuccagcacccuucccuucugccugguacacuucagacaggcaguuggagaguccuggaagugagguggguggaagcaugaggugugagaaccaccuaagcauccagacacagucaccacacccucugguccugccuccuucccagucauugcaccugcagguccuggugucuguacuacugggggguggacgguggcagggaaaggcccccccauggcaccacuuauuccaggcuugggguccccguuuuucccuuuacaaagcuuccccagggaccuccugcuugggcagggccacuugagccuggcagaaacccaggcaucccuaaagucacauugcagccuccccagccauggaccagagaugcugccagccaguggcagggccccuuccggaucagugcccaccagcuguguagccucuggccagaugcuuccggcuccuugaagcugaggaggcuucucaacaccuggguacaccagcugcaucgcagcccucccccagagggacaccugcagaggccaccaagcuuuugccucccaaaggccaucuggugaaaccccggcggcagggguacaggcucaugacuucuggaugcuuucuuuggagaggccugggaaacaggcucagagacggcaggggaccggcccaaggucacacaggaguuuccacuccagcugugggcgccccccgccuauggagcgauccauccuagucuccggcagagcggcugcagcgcccacguggcccaaggcccgggcgggaauccgacucccccuuuuccccccauuaccagccccggggcggcgccguccggacgcagagaagcuccccccuccgcccgugcgcagcaagaccucggccuuucgcguuugcaccccccaccccaggaauuucaccccugagccgcgccgccgcgccgcacucugggcccugcacaccggacagauagggucgaggaccccgggggaggggccaggucuuccagacccugcaccgggucccaaggggccgugcgcucugaaaggaggcgcucgcaggugggcggauaagcggggggacaggcagggcccugcguaccauggugccgcggcgcugggagcucacagggccccgcaggaucgcgcugcccccgagggccgggcccgggccgcuccaugaagcgccgcgcugggggccgccccugcgcagggccccgcgaccauggccccgggggcgcggccggccgggcgggcggaggcgcagggccgcggcaagucccggccgagcagcugcggcccgggagccucgggcgcggcgggcggggggcgcggggcgccgauuggagcccgcgcgucagcuggggccgccgucuggacgcuuaaagggccaggccgcccugcgugcuggcugggggcgcggacgcgcgccgucucgaugcagcugcccucgggagagccucgggguccccggaccgacccggcuggugacgugggagcguuuggaccgcucgaucccacccucccgcgcgaagucccucucugcccuucuuugcugggaaguucguccgggagucuaacccggguguccucccgcugcucugcaugggcggggccaggguaggcgugaggucgcugagcagagcgcgccgccccccgacccaccugcuccccugagccaggcgacucugauggacccguaccccagccgcgcucaucucccgcccccugugacuccggcugcuccgacuugggggugagucuggggucuguagcugcuccggccucccacgcguuuugcucugagucucccgaaccuaccugggggccucuggcugcagaaccuccgagcaaccgccgcaacgacggaagccuuucagaugaccuaccuggaacagccgggugggggccagaggcccaggcccggccgaggggcccuccgcgcagccucggcgcugggaagaugcagcucggcuugcggaacgcugcucuggcaccggcuccgugggggcagggggcuggcugugcuggcaggaggcugcgaaggaacgcugccaggccgagcgacagcagggcgggacuacggacuaccaccguggucucuccuucggacgccccgcaccccuacccacuguucagccuagucacucucccaacacugcuccagccgggccauuccacuccagccauagcagucuccuugggugugcgccuuccucauggugugcuguagcucuuucucuggagccaagcaggugucaucaaauagucgaaggucuguccccucagaaugcaaggaucucucacuggacaugggcugacuaccccugagcaaggaagcugaguaggugaagaaagguagggacagugaggagagccccuuccuucacaugcgcagggcaugccccuaccuggguucccgaaucugaggcucuaggcugaagcugugaaccugucaauuaccgaugaugucuccuacacuucccaaaacccaaguuucucgucugacccaguugauugcugcacugaccugggaggugggaagggcagggcugucuaccuacuggguggacaaggagagucccgcagagagagaaaacauguagacgcugugcugggagguuggaagaagcugguacuggccuuggcuaagguaaaggagugacaccccuaccccacccccugcugucucauuuggguucucugaacuccgacugagggcaagagggcacacugggcuugucacuggcaacagcugcaaaagccagaagccccguuguguucauggcugcagaacugaguggucuggacaugggguacagccaacuggagggacaagaugggagcagaggaaggauucuaggccacaaccucaaguucuguugguugguuuaggggccagagcacucauuaccaugauagaggugggugcuuuagaccccuaaagcugagugacuccaggccaaacuucacuuuggagaacaaggagacaaccccagacugcuugggguuccugcacuuggcuggggaaacuacgcucaccagguaacagaaaugcaaguuaggcaguccaaaaaguggguggugcaggcuggaaggggaggguguacaguacguggccuccaucucccucaguuuuggcugcugaguccagcacuaaugggccacagcugcacaagggugggagccuaaugcaaaccagcagguucccuuucccacaccaaguccagggccuuacaggagagccucccuguuaacuuccaaaaggcucccagagacccuaguccuccacaaccuugggccgugguacuucuugcggaagcccccaucccuuuaacucagaugugaccagcagcagugucaaggccuacguccaucacugcugugcagagaccaucggguccuacaugucugcccaguaguggggguucuagaggucuucugagcccuaaguguuuccagacauagucuucagggaggcagacuccucuuaaaguuagggcagagacaaugguccucagaaucugcaugugggcagcagggaucaggguuagggcucaguggacauagguguaguucuggcccuuuuaaaacccacauucugccuugguaucucccaggugccucagccucaggaguuuggucuuacugcuuguaugagguuugguauugaagaagacaacaccgggcugcuguaaaccacagggaggaagcagcuauggcaagaggcccaggccucagaaugcagccugugcugugguguacugauuccugaaugcagagcucuaacuccucccucgaggugcccgagagacuacagcaaccaguaaucugucucagcuagacauucugaccugucuuuuuaacaaguuauggguauuuugccugugccaccacgcccggcuuuuaauuaauuaauuaauuaauauuuuuuuuuuuuuuuuuuuuuuuuugguuuuucgagacaggguuucucuguauagcccuggcuguccugccaccacaccacaagaguaaagagucuuacuaugcaguucugucuggccuugaacucaagagauccacccucuucugcugggguuaaagaugugcacuacccuaccacaccuggcauuuucuuuaaauaaaaaauaaaacacccacauucgacaauuuucaguuucccaaguuggggaaacacuguuuagcaaacccaguucucugcaaacaagcuagcagguucacucugcuuagccagcagguccucaccuguauguucaaaugucacauggucugucuuaggaggugagugaugaugggugccacagucagaugacuugcagaggacagcgggaggagaccuggaguugcaucccaccagaggguauguuucugccaggcucucccaggucacuccugcaccccaguaaccugccaauggacaagucucuucgcuuggcuguaucagaaacugacuggaguuugagcaaagaaagaccaagcaggcaggcucaaacucagcauguauuuucauuucuacaagauccuuuucaaguuguagagaaauuucauagaaguauauacaaauuagacauugcuaguauguacaaaaguauuuucuacauuuuugaacaauaucaacuaugccacuugcaguaaacaggauguuacaaaaucauccaauaaagaaagcauuuucuauuaagcacauuacacaacauaauucaauuuuauuaaaaaaauaacuucaaaauacagaaugaucguggauaagaagaaaagccauuucuguauucagucgaguauaaacagcaagguugacauuacugaacaugagugccugcugguacagguuaagcccuguccaugcagcaguaggugguagguggaugcccuuccucuugcuaugcuaauccccagaacccgacaaugucuguaauuccucuggccacgggacuucgaguagagauuuaucucuggagucugaucuacuuacauggacccuuaaagcaggaggagggcagagguuuugaaaaaaagacaagacucaaagggucccugcugguugaagcuggcaaggccuacagcaggcgaugugggcauccaccgagggcucuagaggggcccagcuacaagucacgucuucccagagucuucugagaaaugagcucuuccagaccuuaccuugagacccugagcagaugagucaacccuaccauugccuguuugucaaugacacauaggcacucuuaggcugagaaauuugggauaacuuguuacacagcaaccaaauaagaauauauggcccaauagugaccuuuucuuacuaauuacauuugccaguuuauuugggcucugaaugcauucuuccuacugaauacuagauucaaacacccuucuuuguaggcaacuuuaaaggggggggggguagaaggacccacucacuauaaaccacaugucuaacccgccaagcacugaguuccgauguuauccuucuaauuaacuaauuuacagacauggugaacaauagcuggcuggccaccaaaaugcugcuuacauacaucacagaguaacaccauuauuuauuuguggggugcugaccucugaucccagagcuacuuacaugcuaagcacaugcuauauaucacugagccacauggcccuggaagacuacuuucauauauccaguacuuccccuccaucuggccagggcuuuaguaauuuccuccagcccaaggccuuuacucuucccaaaugcacuagcaaggccugggugggauaggagaguacagacuucuacaccauauaccugacaggaagucugugaacuggauuuaaccggcacuaaggugauuaaguacacuuggggaaagaaugcaaacuaaagaguaaaacaaaacaaagaaacaaacccacacuaguuuuuacagguuagauucuuccuggaggagccacacaaagccguaagaaccccuuucugugcagcagagccugugacccugcugcccccaacuuuuguccuggguuuccuccaucaggcagggcuucauggagucagggggcagcguggggguggggguggggggugucucgacacaaacagggaauaggaugguuggggcagggcugcuacuauugccacagugagagugaagcuuggcuggagugucuguggagcugcuucugaaggacauucuucagcuggcacuuuagcacacaugugcagaacaagaugaccagccauacagguucuguuccaagggaccuccaccacauaucuguguuuggaagaagccccuacacucacagugaacccagcucagaagaaauuauuuuuggugccagugaauuuaaaaaaaaaaaaucacaauucauuuucuggcaucaggaaaugcaguaugugacaauaugacauaggguauacgaggaaccaaaggcaccaagcaccaaagcaggagcugggguggcugggcuggcauucccugugaagugugggugcucacagcugggacacagaggaaugagcuaccacccugcacaccuggccauggucaauauggauguggacagccucaucugacagcacacaccaagacgacaaccagcauggggacauggggacauggagaacacgugucuugugacagcucuccauaauuguguuuggcagcauggaugcuaaaaccugaaacaaaaagaaaccugaauucuacagacaaugugaucuacagaaaacccuaucuacagugacacugcaaauuauacuuacaucaaauuuaccauuucuugauucaagaaaaugaaaauuccauaguugccuacuguaaaaugggucauagaaauauuucuagggacaucugcacuuuaaauucuuuugcgcacauguaaauaagugacaagaaauauccacuauaggauugaggucuaauacuaaaacacaacagacugccauccaguuucuuaagcuuuaaguuaccagguauuuacacuuaagacacaaucuguacagagacaucucagcuguaucugcugcucucgcugggacuccggugaugagaguaacuucugucacuuucacugucugagccauaggaucuaccacuccuguauaagagaacaaaacaacgccaucaacucccauuuucuguucuaacuauugcaacacuauggguuuuucgaggauguuuuaaaugguaguaaaaucaagguuaagauagcaauaaagaaaccuuuuaagagugggaaauuuacuugaaauccauucauaaaaaugagcaaacuauuuuucuacuauauccaguaaaugucaaugcuagacuagacugaagcaggaagggguuaaagggacagagucucacuaaaguggguguaggcuugguuaugguggucuuuaagcucauuuaaaaagcuuuucugagagcgaggcaacuugucaugguaagugucguccaucccaccacaaguacaccuagaacaagggcucaagggcagcuccagacaguggacaggcaaguuuguucacugaaacccccaggguucuaggguuagugugauggagaugggguauucccugggcaaugggcugcagugaagaauaugagacgugggggcugaggggugggaggugacugaucacuucaggacacaaagacuagugacagagcugucacuuggauuucugagcagaagggaagcucuagaacacuggaggagagaagucagagagagcugaagcuggagcuagcagguggaggggcucaugcacuggcaugcccagcuggccaccccgaaacaguucagucaagggguacccaugugcacggucuguaccaaguuuucuggacuugcaauggauaaggaaaggugacagcauccaucagcaaaggacaauucaagaguuaugauaagguuacaucuuacucauuaaauaacaagauauaggacucaacccuguggccgagacaaucacaguuuaauaaaacagcagacuggccugauuugcagaugugagccgugauuuggucuucuccuuacuccucuuccaaaagaaauguuuaauuaaagcuacaugaauaaaacucauuuuagugucaacuauaaaacaguaacugacaaccuucaccugccaacucucaguaccaaggccacguuuaauagcugucuguaggccaaucaaacuccaggggagguguuccucugauggcccacucacaccaagugccuagucucucccagugcucuaacccagggacccaccuggaccgccuguuguaacuucuaccccgaugguaacugucacuccucuggcugcggcugcggcuacgacuccggcuguaguagcuaucguagguguaggaucugcuuaaauagcaaugacacacaguguuccauucaaauacagaaaggcucuuuuuuagggccaucagagggugcuggcucacacggguacucuccggaggugugaggacaguugcauaagaaguucuaggaacauccagcaauugcacccaauuggacuuaccauguuaaagagagaaauguuaauuucuuuucugcauugaaaaauaucacaaaauuaacauggaguuagugugauugaaucuugguuuuauuggauaauuauauucacaagaaaugacagauauugucauuucugacuggaguacaaugaaccaacagauaaaaauuacaagaucuuuuuguguauguguaauuuuagaaaaaauaugcauuaaaguuacuuaauuagaaaugcaucauuuaggcuaaagaauaagauccauggcaguagaugugcuguauuuugugccagaggcccugggaucaauccccagcagcacaagccaaccccuacccagcacucugggccucccagcagcacuuaccuggagcggcuauggaggucauaagagcugcuccuggaccggcuccugcuggacguccuaguauggaccauagagggcuaucaccuugugcauuagggcacaggccacaguaacaaucuagacauuuuugcccaucaaagugaaaauacaaugaaaugcaauaaguauuuuguguuuaucucaagugugcugggauuucuuuuuaaaaccuuuguauuccauuagaagacuaagcuuuagguaguuuucugaggagacucucaguugggugggaagggagaaggcccacuuauaugaguggucacagcagaaaauaccacaaggccaaagagagcagcagcagggaaauagaaaacuuugcacccagcacucacuuuccucuugguuuccuugcuauagccugucguaaccccuaaguaggucaaaaagaggugacucuacuugugaccucagugacaucuaugcacagagcagguaaggaguggcauggccucucaauccgacugcuucuauugccuuacgcugcuaagaucuuaucuacaaacagccaggcagaguuccagagcucucagagagcuggaugagaaacaguucagggugguauuugacaaggacagaucaacagcuguccugcugugucccagaagugguccacugcaaaugacuggacaccacucaucagggugagacuacaagcucaccugugacuauggaaacuuccauaggaacugcuccggcugcggguucggccucugcuauaccagucccugcuccggcuucuagaguagcuucuugaucuacaauggagugagugagaaagcauauacuaugugcacuccccacacuguugggaugaacagagcaggaggggaacacaagcaggaaaaggucucuuacaaacucugcucacuggacacugucauggauugcaaaagaagcaauccagaaggcaccaugguuuaaccaauaaaauaaagucacaaaagacugcaacaggccuauguacauguucgugaacacaacuacuuauuuggcuuccuguuacugugaauaccuuuucuuagcuuucacucucagucuuugaacucuucaagaugacaaaugcuggauaggucuccaacaaaaauuccaccaugaucaccaaggucgacuuagcaacucugccuccaugcauggcaucuaccuuuuacagguguaacagaguaguaaguucaauaaucuguaagaauucuacagaaucugcucaaaggauucuauccaaaggcauggcaaccugcacaagaaggccagguacuucacaucuuugaauauaaagaacucaccaccagucauggcaagagguuucauugcccaagugauaaaacuacaggucucuucagcugaguccuuuuccuguccugaaaugcccucucccuacuuauguccucuaucagugguuuuggucauguggaacgcuucuuauucucuugucagauaucuggaaacagugaucacacuucuaaugcuaauguuuuucugagcugacagcagacucuccuuagggguaaacaaaacaaaacaaagggauuauuucuuaccgguaagaugacguagagcuucuagaucgacuucgugagugacuguaugagacagaccuuguucugugucgagauuugguuucggauuugcuucgagaucuguguggacuccuggacuggcuaucaccaucccgacuaggugucugaucaucacuggaacucucuugauuccguggccuucgauuuaggcgugccgucuuucuuacuucaucaaagagagacccaggccgaaccuuauuuuugcuuuugauuucuauccucaagccuugugguuucacuucaggcacaguagauaaugccuucacauccagagcacuggaugugguugcaguagacacugacagauucccuacaccuugcaauggcuuccacuuaucugugagguucauuuggcucuucucagcccccuccuucuuuccagaaguuucuacaggacuggucacacugguagagcuguccuguuuaaccccacuuucacccaaggucuugcuuucagacaugcuacucucuuguucuccuccugcucuaggaugugccauacacucauccugcucuggaauaauguucaccucugggcugucuagccugugguuugcuaaaggggacaccaccucucccuuugcaggggaaguccuaucaggcgugcaaaucuccauguugucaucugucugaagcacguccuccccuccaccugggccaugcucuucaaggugcugggcgcuagguggagagcuggccguguuguccuccacuuucagaggugcaggacaagagcugggaucauguccacccucugcaaguggguccugcucuaaaguacccuucuuggguuuacuuggagaacugccuucaucacagguuuucucgacguuuggaaugccgucuuucacagcuucacacuucucagagacaugccuuuucucuuuuggguccuguguaacuugcuucccauucaucuccuccuccucaucgucaccaaacucgaguggagguugccaguggaaagcuugcuuccguuuuggagccuuguguuuuuugucuuuuuuagcuuuugacuucucucuugcccuuuuugugugaucccccuuaagaucauccuuugaguguuuuugcuucuggggcucuccucuaauguuccccaaguuggagcaggagcucucugacucagaggcugaagacuguggucuccuagacuuccaggcaccgucgcugccgggcagaaaagugcuuguuggaggcuuugcuggggguuuggcuuugaugugacucugaccaacuucugacucggagucugaagaggcuucacccuccuccuuuucugaaccucuccggggaucacuuuuccugcucuuagucacaucuuguucugaguuugauuccgaaucccauuuacuccccgcacaauucuucccuuuggacacacugucaucucuagagugaucuuucggaguucucuuuuuagaacgaggacauucccauucaggcuuggguuuuccuucuucucugccuuuccccugcuuaucauucaaugcuuccacuuuucccugcuucuccuucucuggggcugaguauacuugaacaugugacuggucacugucugaagaguaaucuaaagaugaucuacuuucacuauacuuucugugacgugaggauuucucucugccucugacauauuuacugugaagugucuuuucagaguugcugcgaugucuuuuaugugaagugacacuuuuuuuccuguuggaucuaaacauggcucgucuuccaucaucacugcuaacagaaguauaugaagaugaccuacugugcugggaaccaucacuguacuuauuuggugagugagaccuagaugauggagaccuagagagugagcgugaaguagggagacuucuugaccuugaccuuguguaggaccuggaggaugaccugcuccuagaagacuugcuccccgaccuuccugagcuuccagaacuucuaucacuguacuuugaauaagcacucccaucacuuucugaagguuuuucucuuuugugauaagaugaugaacucacgguugcuuuaauauuuguuaagcuguaugugcuuuggacaggcagcaaguggguuguuuuagcuuucaucuccugaauucgcucguaagagggcuuccagggcuucugcccaggcuuccaccuagaagggggagggcugucacucaaugguauuacaggaauguuuucugcugccacugguugcacuagcacauuuccauucuguggcacugacggccuuaaagguucugucuuaacuggcuuauuuucacucagcugagcagguuuuuugggggauauugauguucuucgggguccugaccuggaacuagaucuagauuuugaucuguugagagaacgagaugaggacuuugacacagcccuugaucuagagcucccucuagaaucugaucgugaaugagacuuggaucuguaggagucucugcuggaauggguugaagcacucccgucauccuggucugauuuagaccagucgcgcuuggaugagugaugagaggaggaggaggaggcacgagaucuccuuucucuaacacaagaggacuucauucggugggugggagaucuugaggguuccaaaucaggcauaacuauucuccucuuuuuugucugucugugucuucugcaauguuucugcuuuuuagcuuuuuuuuuaugcuuaaacuucuuuuccuuucuguguuucuuauggugaccaucagagugucucgcuguacuaagaucugaauaguauccauuauaggaccaugaucuggaucucugggacaggcuucuuucaucccaucggcuugaacaggggucacucagccuguaagaagaggagcauaacgugcaugagguuaucugugaacacuuucugugucuuagaaacauacuucugaugaagaguacccaauuccaccaacacuuuaacauaaaucagagcgaugacaacuauuagcagacucacaaaaaaagacccuuuuuuugggugauuuuuuuuucuuucuaauuuauuuucauuucauguacauugguguuuugccugcauguaugucuguguaagggugucagacccucuguuacuggaguuacggacaguucugaacugccaugugggugcugggaaucgaacccagauccucuagaagagcagccaaggcucuuaaccacucagccaucucuccacucccacgauccuuguuuuuaagugaagcagacugaguguuugugaaaaucauaccaacuaaccagaaguucuguggagacacacagcucgcaauaugaucuacuaacaaccuucuuccucuaagagcaauuucucaaagagugugaaacccaggccccaagcagucuuguggcugaguuacuuguuucugugguacugggcaucacacucaggaccuuaugcaagcacucuacuacagagcuagaugcccaaccuggacucaacuuuguuuucuuauuucuucuuuuuuaaaaauucacguacacacgaauguuuguaugcgugcaggcgcacacaugugcacaugugcagagagcaccucagguaucauucuuaagaacacuaauuucuuugaaaaaaaucucucauuggccuaagguucaucaguagacugcugcacagcaugccgcaaggacgccccagcccugggauuaugaagugcuugcugcuacaccuagcuuuccauguacauuugggguccucaugcuugcaacgcagacacuuuaccaacuacuaucuuccuaaucccuaucuuuuugugaagacaauauccuguuauguggccuaggauggccugaaacucauuguguauccagccuggccuccaccucccaaauacugggauuacagugccauuaggucuggauaaagcugaauuuucuuuauucuggagccugugcacuuuagaaacagacacuguacacuguagggaaucacuguuaucugaacauauugcagacacaauagucuuuggagucagaaaugaacucccaugcuuugcagucucuccuauuuaccaauccacgcaccugugaguagguaucugucaagucagacaucuaguaugcagugccugaggccuuaucacuucuacaguuaagaguccacucacacucucagcaaaaggaagcagcaccugacugaagagccuucgucucagcggcagcagugcugcuccuauuagagacugccaggcagugacucuccagcacugagcucugcuccaggccgugcucccacuccaggugcuuaggugcuuacuugucuccuuugcuccacuucucuccgcucgggggccuguaggcucucagucucugcaucuccuccuuccagugaggagggguuucacugcugucaucaucuuuggacucagagugggaucuugaccuuggaggugugugauagcgcuuuaaacacagaaagcauaguaacuguucuaaaaaugccucuuguaggacagagucaggcaaaagaucuaaugcaggcaucaauuuaaguaucaacugaggaaaguaggaaguuauuucaaauauaagacaucaagaagcaaaagaggcaagacauucaucugaaauccucaaguucccuuugcaguccuaacacauucauuagccuccauuacucagagaccaaaaugucucaauaaaauacuauuucauggauuauaucacugaauaauuaaauccauccacagccguaucuaccaauagcaguaccuuugcaaaacuuugggaaauaaaaacaauuccuugaaugagaagaauguuccaucuaaaacuaaaccucugacuuuuaaaauaaaauguuaaaaaaguuaguauuuagguaaauaauuugaaauuagaaaguuuuaacauacguacaaucgugccucuuccuuugauuuuccguccagacuuugauacagaggguuucugaucacuuacaacaggugcaacaucuggaauguuccugaaagaguucauaaugacaauuaaagguguacaagagacagaacauccucucaauguucaagugcacagcuacagucuuuaaaauaccaaauuucccacuucaugacaugaaauucaaaugucaacaugcauagaguuucaugggcacagccacaucauccacacacuaacacaucaccacauagagacacgacuaucaccugcuacacacacauggauggcccugcaaagaagaggugugugaacuuuuacugcagacuucagaugacagcucugacaacuauucuaacagagaacacuuaacuugaacucuagaguuauucugaguucugaguuauuauggaguuauuuugccccaggaaaauuacauucaucccauuaauaaauauguauuuggaagaaaaauaaggguuuuuuuuauuacuuuauuuugcauuuuuuuaaaugaagacgucuagagggagccaggcgcauuaacacacaccugcaaucccagcaugugaagaagcuacaguaccagucuagguuagacagcaagacccugucucaaaaguaaacaagcaaagaaaaaacaaaaaacaaagaaaccguugaaaggccgggcacagcucacuugauuccuuugcuuucuaaguaacuccucacaggaauguacgacuuauaccacccacugaagcacuuuugcucaacuaccauucuucucuccucccucucuaccuccuucuuuugagacuagaccuuguuaugggguuuaugacagacaucaauccuacagucaaauaauccuauccaucgccagggcuacaugcauaugucaccaugccuggcuuguguccuuuuaauauuucuaaauuuaagucuaauauacaaaguacauuaaaugguauuuucugauauuaaaucucaagccacaauucagggaaacuacaguaauauuuaugauacuaaauuguaucucucaucaccauguaauuaacuuugcacuauugaaauugaaacugaugucaccacucaguuggauccacagagcucaaugaacuugauaauccauucugaaaagacucacccccuuuaacacauggccaaugcagcaagaucaguaauauaaccuucccugaccucuaauaagcacuucccucccugccagguguggcagcauauacauaccugcaacccuaauccucuaaaagauaaagcagaaggauuccaaguucaaggcuaacccugaggcaugauaagaugcugucuugaaaaguaagcagacaaaaaacacaaaccaaaacaacaaaacacacccucuucacuaacuugcccaauuucuuuuaccuauuuagguauucaaguguggauucugaaagggagguccaggcuauuccuuggacuagugacugacuacccauaacaucauuuuguguacucugagcaugagucauggggagggaguguaaagcugcaaggagcugaugaacuuauccaucagagauagaacacacagugcuaucgauagcuaaccaucacugucaaccugacuggauauccaaccccuacaagacugugcauacuaacuaccccauguucagauuaaaagaggaaggagaaagccagcugaguggcagcgcucccaccuucugcuuccuguccugugcugugggcugcuccgugguaucccgucugaaaugaaccaugagcaaggugcuucugugagguacuggacacagugcagagaagaggaacacgcccaccugccuacuuacuguucaggcuccacagugauagcaggcauaucucuucuaaguaaaaaucgguucucgggaacuggaggaaucucuucugggcggacaacaggcuuuucucuuuuaguguuugagucaacugaucuuuuuucauucacaucacuccucucagaauaacuaaaauaaaucaagucaccaauuuauacauuaaugcuaguauuuuauaaaauaaaacaagagcaaaacuuacacucacccucaguguugauuugauuuucacaaauauauaaaacaacacaguaaaaaauccagagcuaagaaauuuuuuaaaagaaaaauuugaaagagaaaaaaaucaagcgcuaaaaauucugaaauggaaguugucaaugaucuuaauguuuuccuucuuuaaaaacauguucaucugucuauuuccugugugugcuacugugcacauaccaugauauagaugugagacaacuacuuguggaagaugacugucucuucacaauguguaucccaggaaucaauucaacuugucaggcuuggugagaagccucugagccagcucaauggcccaaguuuugcuuuagggagaaucauuugucuucaggggugcagucugugucuuauguucuacaggguggcccugugccccugcacauuaaguaggcucaguagguuauugaaagaaaagcaaacaaagaggagggagauguaguggguaggagaauucaaaggaagaauuagaagguggaggaccaaauuacuuuguagacaugcaugaaauucucaaaguaaaaaauacuguauuuuaagagaaagacuuuucaggguuuggagagauggcucaucaguuaagagcauuggcuguucuucuagaggaccuggguucccagcacccacacaguaucuuauaacuaacucucucuaacuccaagaucugacacccucacacagcauacaugcaggcaaaacauuaaugcacauaagauuuaaaaaauuaguaaaaaagauaaacacacauaugagagagagggagaauuuucaggcauuagggcuggcaagauaguucagcaagcagaggccuuugucgaaaggaccuaucuagaagagagagagaaacugcaagcugucuucugauugccacacauaucuuugaauauacaaaauuaaaaacuuuaaaauuuaaaaacaaacaaaaagaauuucaagaauuaucuucaccugaaaaaucacaccaacugaugccuacaccacuccucgauuguuacagggaucaguuuaaaacccagugcuccucaccucuacgaguauaguacgagcauggagcucacuggagucugugcccgggcugcaggcugggugcucuuacccuucagggcuuacugugcgcuuccuccucgguucuucugaacugcucauuucuuuccgucucuuuuuagcaugucugacuuuuggccuccucuuaugucuucuccuucugauugucucucgcucaacuucacucucugaggaggacucugaagaggaagaggaacgggaagaagaguccgagccuucugaacagguugguuucuuccuuuuuuucucaaaaacuuaauagauauuaaaaaauaaauaaauaaaaaaucaguacuugagcccaguacacaccauccagagugaaaaacugugacugcugacuaucauauaauugcuucaugaacagcaaacuaaaaauagacucaacuaaacuguuccccaguuauguauaaugcccaagcccuuacccaucaugaagccuguauuuuaagcaaacgugacaaguaaugagagcuaagacagaauaaacaaaugucaagggaacagagagauacauauagauauagguagcuuaagauuacccuggaacagagaccuaaaguauacaugagggcaggcacaaagucccuagugucugaauaaacaucaguguagcuggaaggcaaugaguauggaaaaauguugaaaagacaacagaaagcugcggcucugugcugagaguaccacuguagugucugugcgggguggggauggggaguggggggugagggauguggauuaccugucccuuaagaggaucacucugguagcugcugaauacaaaccaaaguaaaccaagggcaugagcaaagaaauuagugaggacaugccugcugacaaacgaccauagggaaacagggagagagguaagguaggcagcugugaggguacuacaauaauccaggcaugagaggucuuaucagcugacagcuggguaguagcaggaggaggagcuggaaacaucugcugguggagaggaugcagcacagcacagaggcaucaacacucccacuacccacacacaugcuuuacaccucucuguuccagacuccccccauccuccaaaggcucuuaccaucuuuugucaacuuuguggccagcaccccacagucaauaacucggacaucugcauaaggucugcuugcagcaucuguuuucagauuuucaaucuguucaauuacuucaaaaccagauauuaccaguccaaaaacaacaugaacccugucauaauauaaauccaaggaaugaauuagucugguaauaauuacaguaugaacauaauugggacaacggguaucaaaaacuauccacacaacuacaaacaaaccaaaguguuaugaaccaauuauaagggaaugacaacuugaaaucuacuuccuaacaggaaguagugacagcucaucucaagacaaggugggacgcagucucugcugucaacagcugcuggccauuuuaggguuaagaaucugcuaagagaggacacuucauacugagaauucaucucaacaaguauaugcaaaacucaugggcaaaaaugagucaggcucucaaacuccuauacccugugccccuuugggaagagcuuggcuacaaaagacuaacccaggccagcaagucuuucgggcucaucaaacaauucucugagauuuuaacaaaccgaugcuuacccauccagguguggagcaggcuuuguaguucuguacaauaaacaucaacacaaagaugguaucaaaaaugacguauucagaugaagaaagcagaggguuuaaacacagcauguagugaacaaagaaauaaagauaaaaagacagaaaaauguuaagaauaauuaauauacauccaacuauaaagacccccaaacaccaauaguagccauuuuacuaauuaaaaaaacuagacuacaaugaauuauaaaaccaacucuguuagaauguauguaauaaauuugaguuauagaaagaaauauaaagcauacacacugaaauuaaauuuacucucaaaccaaaaacaauaauggcaaugaaaacaaacauuaaaaaaaaaauucccagcaggauuaugugaggaggaagccgcggccucggugaagaagugacagcacugggcucacgcccacugacacccacugggcucauauuugcuccugagacugagacagucugcguauuccuuuuuaaggcaagcaaaggaggagccucggaguccuaucucuggaguuuccugcucuucuuucacucaaagugaagcuuuugcaacucauauucugaaaaugcaauagggaggggcuuucagauugcugaugcccuucacaacaagaugaaaaaugaaggucuaugcauuaucgacaucuucgauuuccaugguccagaaaacaccccucuggcugcccuguggaugccccacugucgcuguugggacucugugagguacacuugguuaagguauuuugaacccaaguugguuuucccauaacauuuucaaaaaucuuuauaugugaauuguaaugcaaaaauucaaaaguggauagcuagaucaguauuagaauaccagaaccuuaauuacuaaggaugaaaaacagaugauacagacaaggcuacuaggcuuucaggccauauuaaaauagucaauuguauaaagaaaaacccauaugcaguuuaaugccacucuaagacacaugaacaauuuaaccuuuacaacaugucaaaaacauuauuguacaagagacuauaauguuuauacuuacuuuaagaauauccaguucuguaugaagacuauauagauaguauuuaacuuaaaacuuuuaaugucaacuuaagucucagaacuuuaaaugaagauuugaguuuuaaaaucacaacucucaaauauuucuuauaaaauugaguagaaauucaaaccaguguaauuuaaaaaauaaaaacagguuuauaauaagggggagauggggugggaagaaacgaagaaaaucuaaugaaccggugagcuaaagacacuaugaagcaagcauccagaagucaugguagacaacaauugcaaacaaaaccgcuuccugcauuguacaugagcuagacagaagccccuucugagagggguaaaggugcuuccagcgagacacaacuguccugccaagcacaagacgaagccacacagcuguuuacugucugcguguguucuuccuuucuccggccuuguucagaagagccuacaguuguuucuagcacacaauuccaauucagcugccaccuuagcuaacagaugcuguaaccaccagguauggcaacccuagggcaaauagagauagucuaucuggcugcagcaacacauacucagaucaccagaggauggaagaaugcucuugggacauucaagcuugagacaagauaacuugucucaaguugagaaugaacgcagaagcagguuccucaugugugcuaagcacacacucaaccacugagucacacuguacagucagucccuaguacuucuuucaagucuaaugaaaacuuaccaauaaacaauguaccuagggcacugaguacuaaagaagcacacgacuagaggacaaucugcucauagcauccaaaccaaaaucaaucauuuaaguuacuggcaccugcaacuuagguacagaaauaucaacuuucaccuucacugggauaaaguacaugggaaauauuucacaaaaaaaaggaacucucuggaccuaagccuacaaaucccaggauucacuguagcacaggcucacuggaacuaugcugacaguacacacaaacaacaguaacaacaacaaaggguaacagaaaggcaggagagaccaugugcucagccaagucuacuaaaacagagaaaccuugcccaccaacucuuugcuauauucaacauucucaauagugccauuagaggcagcgauagagaugcaguaaauuaagacuuagaagaccagagcaaaggagaaacaaacaccaaaaaaacccacaaaaaaauuuauaaagcuucagugcucagacauuaauuuuucucccacagucuuucccacccccauaucuaccuaagacacuuacugcaaggguuacuuaaaccacaaacccuacaaucuaaaaacuuuacuguuguuccaaagaaugaacuauacguaugccaucaucagagcagcuucaggaccuuaccaacuccuaaaaucccaauguaaaacagugucaugaagcauacaagaguuacugaaaugaaacucuauuuucaagguuaaccauaagcaaugaacaugcuuguuuuacauauauugcagaaaauuuuuuuuuucuuaagauguuucaauacauguaacauuaggauuaaagaaacaaaggcagagagagaaagagaaagagagagagaaagagagccuuagaguaaugagacauuaccuuuggagcgcacgguguaacacuguuucugcaaauuuuacacaaaaauggcaagaaauaaauuguaauacacuuuuaagacaagacugaauuuauguuuuaauaucaauauaacuuugaaauuaaaauuuuaagaguuuuauagaaagcaagaaagcuucuuuaaagagggcucuaaauuuucuuucauaagauauuuaugaagagaugaauuuuguuuugaaaaagccuuguagaggucuuccuagacucaugguauuuuaauacaggguugguaacagcucauaaaacauuagagcuccuuuuauaaucucagagaucaacuaugccaucuuucucaguaagauaauacaccaugaguauggacagauauacaaaucuaaauacugagaaauugggacuucugguagaaggcaaauaauuucuccccaaaacuaaguuuagauaguucaaaacaaaacuugaggaacuuaaccaaugcacuucguuuucaugccucugcucuucagaccuuuccugguugugcaaaacagagcccuggguaaugauuuggucugaaucugaacugugcucagugcuucaugcaugcuucaagcuguuaugucacuggacagaauaaacacaaacaguaauaauggcaaaagcagaacuuuaagaaucuucucugcagcuuuagccuuagagaaaaaagucaaauccuggucagaggauuuucaugucuaaucugauuuccucuuaugugaauuuuaaacaauaaacacuggauuuuaacaaaugaaaauuaaaaaaaaucagugacuacacaaaccaaaaacccuuacaccugaacaaaaaauuugauaggauuugagauaugucaaauauuaaaauguuguaaaagugacuuaaaaucucucauacaggcaugaguauaaaaaaaaaguuugaaaucauaguuuucacaguguaaaacuccaggccuaaagaaagagggcacuaaaagcaacuauucuaaugucaucuuuaucacacaacucuuuucaucgcggcuuaaaacuaagcuaucaugaaguggggaauccaaacuaugaguaacacagauugucuuuaaggcagcggacauccaaugcuguguuaccaagaucacucagaaagaaaagcuuucuaaauuucaauauuaacauaaaggaaauauacacaaauuauaauauaaauuauauauaaauauacaaauuauaaaugucuuuccugacugauaucauguauaucacauaaacacauaaauuguaaacauggguguuagaugacaucugaaauucgggaaaagugguauuaagguccaaauaucacaaacuccuuuccuuucaaaaaaaauuuaugaaaucagcaugaaguuauuaccuuccauaaaaacaaaacaaaacaaaauccaaagcaacaacaaacaaauaaaaacacagugacuaaggucacaacauuuaauaccaucuucucucacacaaauuuauaaaugugugggugagacauuucucucccaaaccuacuucugcuugccaaagugucaacacagauuuauaaacuccuaaacauccuagucuuuccucugcuugcuuccuaccuuggaaugaauguuccucucucauagaugaagaguugcuuguaaguugggucuuuaaaugauauaaagcaaucuuagagccuuuucccauuuaugacuuacugcucuuccaggaccagaguucauuucauuuccuagcacccacauggcagcucacaaccaguuauguaauccagccucaggggaccuguccuccagaggcauuguauccaggugguacacagucauacaugcagguaaagcacccauacacauaaaauaaaaauaaaugaaggaaaaaaagaagacccucauauguauauaaucaauaaucucgguaugguagcacaugucuuuaaugucuuuaaugccagcagcugggaggaagaggcagguagguggaucugagagaaauguugguuagcauuuacaaggucaugagucugauuaccagcacugagaaaaacagaacaaauuuuguuuaaauauuaaguugggauuuucuauauuaucuuuguuauaaaagauaacauaaaaauuaucaugacuagaccuguggccaaugacagucuauucaccaaagcuuugaagccauaaauggucuacagugaggcuggagagaugauugcucuuccagaagacucagguucaaugcccaguaccugagugacacccaccgcccuguuucuggccuuuaacggcacugcaugcacaugguaaacacacaugcaggcaaaacacucauaagcagaauauuauuuuuaaaaaggcccguacugacaaauauuucaguagcaacugagggagggauugcugcugccucugguguagacaaaaaugagucccaagccuuuuugaggugcuuuucagacaugaaaauuaggcugcuagagaauaauuuuauacaggaauguuuguauacaaaucauuugauuuauucagaaauuuaggaucuuucuauaagacgugcucuuucuuccacauuuuugaggguagguauaguucaguggguauuuccuguguuaagcaugagggacccuaguuugauagccagcauccauuuaacagucaaguguaggagcuaucuuaggggaggacagggaaaggaaggucagccaccagggcuuccuagccagcuagccuaggagaaucaagagagguccacauucauugacagacugucuaaaaacauaaagggaaugggguugacaaaggaaaacaauugaugccaaauucuaacuucuguucucaugugcucuggagaaugaacacacacacacacacacacacacacacacuuuuuuuuuuuuuaaacaaaaacucaggguacagaaaaacaguuaaaaacaagauuucuuugguguguguacauauauguguggcuuuuuuuuuuuuuuuuuuuuuugagacagggucuucugcuuuugugugugcccuacaaugacuguacucaaaaucguuaugguucguagugcugggaucgcaggcaugaaccaccacaccuggcuaaaaccaaggcuuccugaugauagcuagcuacacauuccaucucaggaaaguaauaacaaaaguuacaaacuaaucuuucuaauauuguuuuauaaaauacauuccuaucuucucaauaacuacagacaauaaaaauuaguaccagaauuaucauuaacuaugauagcuuucaaaaaaccaccaccaacaaaaaaauuuccuuaacugccauuuucucagcagaaugccccugccuuggauacuuaacuacggugauucagaacacagugcuuauaacccugcagcaugcagccagcagcuugcuuuuccuccagaaugugagauaagauucuagagcaaccuggacagggugugcuuuuucuuccuuacuuagcauucauucucuauugaacaugaaucuaauucuauagcuuuuaccugauucauucuuuaacuuguuuuuugcagagcuagugacuaagccuauagccuuacacacaaggcaagcucuccaucacuaaacuacacuuccugcccuauagcuuuuauuguguuuuuuuucuuuuuuucauacuugaccuaaaaaaauaaacaaaaugucauaaugaucaaacacuaauguacuuuggcuuggucacaugcacugcuuagugagcguggugccagaagucugagcuccuuuaaaaguauuuuagugugagcaaacccucauguccuuaguaguuuguaaggauggagcuccuuuccaauucccaagcaguaauauuccaaagacugucuuuuuuucuauauaagcucccaaaacagaagcaccacaguugaugccauagucaauauaagcaguuaaugguaaaaauuacaauuaguuguaaagaaaaccucaucuccccuauauacauaauaauaaaaaaauauauauauacauauauauauauauucuuuuuucacacacaaagacacacaguuauagccaaagaaaacaauaugugcacuauuauauugaagaaaacaguguccaacuuggaagggaaguugcuacgugugagacuaaagacaacaguuagaacacacaucacaaaauuuccugagggacugccacauauuacacuaacagcaccaaauuacuggccaggaacuguagaagguuuguaggacacaaacuaauuaccauuuugugcagauguuuuacagguccuugcaaggccaaugaaacaaucccuaacacacauccgaagcugcucuuacaucauccuuucugcucagaacugcugcccaaggugccacaugcagugugugguggugacaggacaaacccaaagcuuacugggaagccacuggguaggucucagcugugauuauauacauaagccaaaggcaguacaauauucuuuuaccucuuccagugacaaaaggacaugggcuuacaagauguagaauuucaaagaucucucccuuuauuggcugccauuucuguuguaucuauccuuuccauaguaaugauacauuuuguuuagaaaugugaacacuaguuugauuuaaucuugcaauacaugggaacuugaacuuuuagccaccauaaaacaacacauagacauauaaguuacuuuuuuaaaaauuaggacaaauuuuuguggauguaaaauguuaccucuaagacugcaaacuccuuucaaauaaauuuuaaccaaacuaaagauugaaauuuuucucuuaucaugccuuuagugguuuuagagcugucuauagcuaauuauagaaacugcuuaacauuuuuauuccuaaucuauugauguaaauuuuuucauuugguguuccucuaucaacagcaguccaaugcaaaacgaggccacacagaaagcacuaauagacuuuacuaaauguuccuagagauuuaaguaacuauuaaauaauaccaaaggauagaagauuucauauccuagauucuaacagaggucuacauaaauaagcuaacuauauguaauaauggcaagaaacuacaacuaccugaauaaggacauuuuaaauguaauaauauaaaaagaaacuuuagaacccucagauggccccauccugaccaaugaauuguuaguuuuucauguucacaguucagauaagcuuaaaaauggaaacaaagaggcuuugacauggaguuaccacaaaauuuuugaaaauuuacuucuuuguacugccccacccccaacaaaggugaagcauaagaaaaguacuccagugaaaacguguguaacuaaucaucugugggcucaaaacagggcacgggcacuccugucucagguucccuccccguguaacuccagcaccagccccuucuccacaggcauuccugucucagguucccuucccguguaacuccagcaccagccccuucuccuaacucuccauuuuuaggacauccuuaggaacagaaugccccuuaucugaacuucuucagaucauguugaaaaucuuucagacaaacuuaaaaugugaguuuuuuuauacgaguaacugacuccuuuaaagacagggaagcgccauucauauuuauccauucagaaagauguaaaagaaaacuugugauaaaucacaaauaagauauuucuccaauauacauagaacagcagggauuauuauuaaaaguaccaagcugcacgcuggacaauuauauuucauauuguacaugaugagacaauauaaaaauaaguuuagauaaaagaauguaauuaaaaguaugccaaagguuuucuuuagaauucucacaugagaauuuaguuuuugguugugcauauacauauacaaacaagauauauucuuuaaaaaauauauuuauuauuuuguaugacauuugugguguggggagcacauguaaagguuagaagauaccuggggagucgguucucuccgucuaccuuuauguagguugugaggaucacacucaggcugccaggcuuuugugucaagugcucuacccacugaaccuuauagccagcccaaaagguauuuggcucuuugaaaauuuaguacuuuaaaauuuacuaauauuuacaaaguuuggcaaaaagacagccaauguuguauuacuucauuaugcacagagaccuuacaaauuuucaguaguuaaaaaugcugacuaaauagcaaaucacuuuucuacaccucaucagaaaauguuaccucucacaaaacuggcuaauaguaagagagaaaacaaaaacauucacaugauguuuacucaaaccaacuccuucuuaugccuaggauccaucuggacuuacaucaugaccaguuuuuuucuuucuuuuuuuaagacaggaucucucucucuggcuguccugaaaucacucuguagcccaagcugaccucaaacucaaaagaucugcccgccucugcuucccacguguuagauuuaaaggcgugcaccacaccacacccagugacaucauggacaaucuuuacauguucaucaugaguucauauuccagucuagguaaacugagccuucaaaugaggaagaagcuaaagccugauucuuuccucaugacagcauauucugaaaacacuauguaccuucagguuauauuuuuaaguucaauucuucaaauuuagauaugugcugagugaguauugaagcagccaguagagacuacaguuacuauguaauaccagaaacacaaaagucaaaccaaagcugucagaguuugagcaguaaaaugagguuggcuaucucaucuuucucaugaacagcgcuucucuguaggaaaaguucaucucugcauuacgccuacucacaugaaaaacugggaaccauugguauguuucccucgauuugccauugacaaaaggaacgcucugucauguuugagaauaaaguuuucaucuguuugaagaaaacacaaauuuguuagucuccaauuauaagaagcuuuuaaaguaaugcucaaguacuaaauugaaagcaaaggaugaaacuccucuucuggucaguaagauauuuggcaauauguagaaaaaaaaauuaacuaauugaauaacaaaagcacaaaaaaggccgaaaagauacuaauuaaagccuugaggaaagagcagguauuuaacacuuuguacaaacagccuuagaacagucacuuccagcagcaacacacuuggcuaaaugauacacaaacuacugacucuccaggaagucuugccaagaaacuuuuagaaaaaucucuacaguaaaauguauugccuucaaguuuccaauuagccugacacaugaacuauauacauaggugaguuuuaauaagucuaaucuugaaugcuuaauguuuguaugggaaauuauuccacugaagucaagcuggucuaugagaaaaaaauauuacauauauuuaguuucaggaaaacauuaaauuaaaucaaguaucaguaggaucacaaaauuacccaaggaagaauauuguauaauuaacauuuuaaaaaauauuuuaagauuaaaaaagcaucugccacagagaauagcaacauuaaagcgacccaccgcacuaagugcaaguugcuacacgccaucacaaccagcuagaaaggcggaaaaccaucaucacuaucacuuagugauggcucuaauccagcagaaauaucuuuaagacuggacagccauaucauccaaugugccugaucuccucuaauaccagaagcuaagcagggucaggccugguaaauauuuggaagagagaaguaucuuuaaagccaaauuuccuucuacauucauacaaacaaaucuuucuuuagaacagaaacauagaacuuaaaaaaaaaaaaaaaagaugauuaccuuggggacaggcuucugaaaaauagugauccaguuuccccaaaggaaauauaaaagaccauuauacacuaaagcuuugauggcauucaagcccagcaaugcuggagcccaccauaaauuccugcaacugacuuuucuaaggcuuuuuggggaagugcaauaguuagacuuaaugaaauguuacuacuguaggaauaaaauauaaccguauaguucuaguacacaaaagaaaauauacaaaccuuugagaaaggaaaaaaauaccaauuuguauucaaagaaauugcuugguuuaagggaacaaaaaccacaacuagcuucuuuuuucucugagguagaacuaaggacccauuguaaagaaacaaaggcacaaaugcauguaugaaaucacagagauuuuccaagucuucaaacaacacagaaauccaggcacaaccugaccagacuguccauggauuuauuaggagggcacaagggagcagaguggaguuuguguuacugagcuucguucucuuaccuuuucauuuugcaaaagaccacauucucuauaaacaaaagaauauguugacaguuuuaggcaggaagauaggaguuuucauguauauaguugccuaaccuccaugcugaaagucauguuuaaccuuaaaguuagccuuaauuaaucuugucaauuaaaaguuauauauuacaauauaauuuauccccaagcucaugcaaauaaaguauuuucaugcagcauuaguuucaugcaaacgugaacuacaaguaaaccucuucucauuaaaguaugcgaccaaacuugcuuuauaucagaacugaaacaaaaacaaaaacaaaagaacacaaaauacuaggccuuaccuuuaaaguauccaccauaaauugauucuccaccuuuuccauuaccugaaaacaaugaguuauaauaaauuuuuaaauauucaaugcaugguaguaauucuauuuuuaacaugauuuugugugugugugcacaugcaugcacacgugugagggugcgugugugcaacagugugaaugaauguggagcucagaggaccaucugcaggagcugguucucgccuuccaccaugugagucccagggacugaacucagguuaugaggcuuggucacaagugccuuuaccuacugaguaugaguaccuugcuggcucacgugcuuuggauuuaagacacagucuuaccauuguaggucaggaugaccucaaaauccuuaaacucaaaaucccuggccucugccucccaaguguugggaucacagcugugugccaucacacccaccucuauuacuaucauuacuguuauugcaguacuugaaagugaaaccaaggccuaggacacaccaagcaaauguuccaccauucagcuucauuuucagcccaauaaauuauuuuugauggcuucaauauguugaaggaacucugaaaccuuuuaauugcuacaaauaaaacaaaaacccaaaaagcucugugacucuaggaacauucacuuaaucuuuaacauaucaugaaaaauacuaucagaaaaaugaccccuaugacaaaacuguuucaaguaacagauagucacaccaagaaauuucuagaauagauguaauuggacaguacugugguguacacuguaagguaaucucucugauaauuauguuacuaaauuacauaaaauaaaauauuacagucuuuacuuuuucacaaauucuagaucugcaacauuuguucauccaacaaggaugcacuguggauacauguucucauuauucugugacaugauauuuacaauuaaagcaauauugagauucugauggauggauuuauuaggaauauaacuuuuaucucuaccuucacugaaguccccacccugaaucauaaaguuuuuaaccacacgguggaauguagaaccuuuauaacauaacuucuucccaguuguuuucccaaggccuuucuccccugggggaaaaaaaaaagaaguuuagcuacaaacccagcacuccccgggaauaaccaaccaacuaauuugcggugaaaucccucccaugugcugauacuaugagagauguaagacacagacagaugacacaauguauguagcauauauacauaauacacacaccaaaauaaauuaugcaaagcaguguauguuuuaaauugauccagaaacaauucuaugugcuacuggagguaagaaugaagagaauuauuucacuaaagaaugaaaacaagaaaauugguucaaacauagguuuuuaaaaauuaaacuugcuauuuuaaauguuuagcauuaaacccguuuuauucuucuuggcaagggaguaagcaaugauacauaaugaaaagcaauuuuuaaaaagugcuaaauguauuuaaagaauuaaaauuuggauaacaacauuuucccgggccaaauuaauuuugaaaugucuuauuugacgaauuaauacauaaagauuuuauuauauaaaauagauccuuaucauuuuaaagauuauuucuuuuucauacuguccucuuuuaagaaauguuuccuucauucauauuucauaucauauucaaguuuuagcuauauaacucacuuaacagaucauuguauguauucuuuuaauguuuucuuuuuauuagauauuuucuucauuuacauuucaaaugcuaucucgaaaguccccuacacccucccuccaccuugcuccccaacccacaaacuccugccuccuggcccuggcauuccccuguacuggggcauauaaucuucgcaagaccaagggccucucuucccgaagauggccuaauauucugcuacauaugcagcuagagucaagagcuccgggguacugguuaguucauauuguuguuccuccuauagaguugcagaccccuucagcuccuugggugcuuucucuagcuccuccauugggggcccuguguuccauccaauaaauaaaugacugugagcauccacuucuguuauuugccaggcacuggcauagccucacaagagacaguuauaucaggguccugucagcaaaaucuugcuggcauucauuauauauuuaugaagguucucauucuccugccuuaaaacagauacaucuguaaguagccagucauucuuauugaaaacaaguuaaaaacucacucaccugagcacaggcauaggaaguuuuugcauguuuuuggacauaugucugagaagagcugaaacauaauucgaccaacugaaacaaaauaugaggggaaaaaacagugagcaaguugauaauauaacaauauuucauauaagagaacuuaacuagaagguacccaacaacaguaugguuuuuuuuucuuuguuucuuuuuuuaauuacaguacuggagaucaaucccauacaauaaaaguguuuaaacuuauggcucuagaacaaaaauuguaggaucugaaauuuuguuguuguuguuuuuuuaaauuuuucuuuuuaucucugugaguauacugucagugucuucagacacaccagaagagggcaucagaucccaagaugguugugagccaccaugugguugcugggaauugaacucaggaccucuggaagagcagcuggugaucuuaaccucugagccaucucuccagcccugaaguguucuuuuaaaacaggguuuugguuuuguuuuuuuuuagacaggguuucucuguguagcccuggcuauccuggaacucacucuguagaccaggcuggccucaaacucagaaauccgccugccucugccuccugagugcugggauaaaaggcgugugccacaaaacagggucuucuuauacauuagaucccuuuaauacuaaugaccuuuuaaaaaauguuugguuuugcuaggcuaaagaucaaacuuaguaccucacagguaugcacagcaaguacucuauacacauucccaacuccaagcauucuuuuuuuaauaaagauuuauauauuucauuuauaggaguacacugucacugucuucagacacaccagaagagggcaucagagcccacuacagaugguugugagcuaccaugugguugcugggaauugaauucauaaccuuuggaagagcaguaagggacucuuaaccgcugaaccgucucuccagcccccaaguauucuuaauaguguguggccuguuaggcccugucagggacgaaugagcacaacccucuugagagucuuuucugaucaguaguuagaaggaaagcuuucccauacucuuuggugcuuucuuuccugagauaacuugaagccaaucaccuaaacucaaugcucauguucuacucccugaaaucuaggggauaacaauuugcucugaagaaucgaugccacuuacaauaaacagcaaugagaaggaacaagucugcaacugaucucacuacacacuggaaaacaguucucaaauucugguuucaagauucuuucgaacuguuaaaaguuacuaagcuguuguuuauggguuacacuuguuaauugcauauauaaaucgaaacuuaagacauuuuuuuaugacacaauacucaagcacccauuccauuagugcucaggucagugaagugagauuucccugugagagcaaauccuauuuuaguauuauaaaaacaguucugacuguauaaaccugcuucaagaauuauuuagguuuauuacauuuccuuuuccuugggguagguggcuccccauguacuacagaauauguguugaauucagaagacaacuugccagaaugaguuuuccccucccacuaugugguaccagggaucacauucagagggucagcucagcaacaaguaccuucucccacugagccauuucaccugccccgaagaaaugaaguuucaguuuccaauucucuccuaacuccauuuccuccuucagucuacaaaacccuuucccuuuuagacauuuuccuuaaagagucagaauaagcgccuggcauggaggcucaugccuuuaaucuuuaaucccagcagagacagacugaucucaauguguucaacuccagccuguuuacacaguaagaccaggacagucaaggcugucacacagagaaacccugcuugaaaaaccaaaaccaaagagagaaggggguuggaggggauaaaucaaaauuauuguagaccaagcaugagccacguuuagaacaaacacaaaccaaguucuacuguuaucacuaaaguuuuguuuuuguuuuuguuguuguuguuguuuuuucgagacaggguuucucuguacagcccuggagcucacuuuguagaccaggcuggccucgaacucagaaauccaccugccucugccucccaagugcugggauuaaaggcgugcgccaccaugcccggcuuaaaguuuuaauauauuucuagcuauccuacugucuucuuggcugcacuacagauaacuaucaugaauaagagugggaucauuacugcccaucauggaaggaaacuuccuuaugucaacacucuaagucuaaucuccaacuaaaucaauuucuaaaacaaauucaaagcuguagcuguuuuuugaagaaaaggauggagaaagaaaacaaaaaagaaaaacuuuuagguaauaaaugaccaaugugcauaaauacaugucagaauauuucaagaauaccuauaacaucggaaacauggaaauaccagugcaauaaaaauaucggcaucaaucuuuauaaacuccugaaauggcugaggugggcuucaaggucacaaucauaugcuuuucuauaaacaaacacacaaaauacaaaaacaauaaaaaguucuucauuagccuuuaagacuagccaauuagcuccugcccucuauacuuuuugagauguggucuccauuaaguugcucagacuggccaugaacucaauuuguaguucaggaaaaccuuaaaccuacaaucuucuaguccaggcuaacuucuucuucuucuuuuuuuuuuuuuuaauuuuuauuuuuuugguuuuuugagacaagguuucucuguauagcccuggcuguccuggaacucacuuuguagaccaggcuggccucgaacucagaaauccgccugccucugccucccgagugcugggauuaaaggugugcgccaccaugcccggcuuccaggcuaacuucuuaagaaacuaaaagaggggcuguugagaugucucagcaagucaaagugcuugcugccaaaccugauagucugaguuugaucuccagguuccacacugucaaaggagaacccacuccccuacuuauuuuuucuucugaucuccacaugcauguacucauacacauuaaauaaguaaacguaauagaaaauccuucuucaauaacugcuaggacaguaaacaugggauguuuacucccccauugguuucccuggcugacuauguuauaacaagucugccuaauugugcuguuauuaauacaucccacuaaauucaugauacaaaaccauacucuauucucaaaguuauauuacuuaguaacucucuucaacacaguuucuacuucauauuuaauucacgagcaguuaaagaguggagaucauauaugucuaguaauaaggcugagaugcgagggacauuucuguucuccuaguacaaaucugguccgacacaucuacccugagugagucuaacgcuuagaguagauacgaaggugaacaaacuaccacacuacugucucuagagccacagaaagaccgaugucaugacgaaggucacaagcaacacacacacaugccugacauaauuaccccuuaauuucuuaauaaaaauuuaaaauacuuccacuguuuucuacagacagauuuuaauuaguauuuugugaaucuuaaauagaaaaguagaacaucccuuuuaaucauauccccauuuuuauccauccugauaaacugccaaggauuuaugauacuucucuuggguccacaaaaaacaaaaaaaaaaaaccuaaagcaaaaaaacucguuaaaaaaaucaucuuggggcuaggauuguagcugguagaaugcuaaaccaguaugcacaaggccagaguaggaacaauugcucugagcucugguccucguccucucagcuauuaggguuguaggacacacaccuggcagaauagucccagacuuagacaugcacacuaaaguacuucaaaguaaagagucaugauguaaugcccuuggacauacaucaggaaaaaaaaagauguauauuaagagaacaacacauuggccuuaagaaauuuaaggcuagccugagaaacagcgagaccugaucucacaacaaaaugaaaaggcaauuccaaacacagaaauaaugucuaaaguaguuaaaccuaaaggacagaggugguccaaaaaaaaaaaaaaaaaaagucauuugugaucuuaaaguaccuuauuuuaaaauuugcuuucggcacucaaaaggcagaggaucucugugaauucaaggccagccuagucuacauauugaguuccuggacagccagaacuucauagaaagacccuaucucaaaaaagaaaaaaaggauaggaguggaauaaaaaguuaaguauccuauucaaaagaguccaguucuuucauuuucacaugauaccacaagugaaaaauuucuaccugauacaguagcagucacaacaccccccaccaccacccccucccacagaauuuuugcauuggugguuaccaauacaaaaauuacccucaugucauaugcauauucuccaaaacaucuuuauuuaauauaugcaaagguuuccaaaauuuaaaauaaaaugugaucucugaauucuuuuucauuuugagcauucuggauaaaaaauguuuaaucuguacuuagaaauaaaaauauuuguaaauucaugaguuaaagacaaucuugagaaaaguuagauauuuugaacuugaagaaaaugaguaucaaaauuuauaggauacauuuaaacuucccauguaaacauauaauuaauccuuuauauuagaaaaggaaucauggaacuggagauauuucucagugguuaagaacacuggcugugcugggcgugguggcgcacgccuuuaaucccagcacucgggaggcagaggcagguggauuucugaguucgaggccagccuggucuacuaagugaguuccaggacagccagggcuacacagagaaacccugucucgaaaaaccaaaaaaaaaaaaaaaagaacacuggcugcucuuccagaggaccugaguucaauucccagcaguaacaugguggcucucaacuaucucuaauuucaguccuagaagacucaacucuuucacacauacauucaggcaaaacacuaaugcacauaacauuuaaaaaagaaauuauaauaaaaaaauaaaaccaaaucaaacauuagaaggaaaugauaaaaacuaacaaacagacaaacaaacaaacaaaaaucccugaaauugauaaagcugaaaagaggacaauaacagucuaagacacuaaaaucugguucuuaaaaaaaugauagauuaaugguagauuaagaggaauaaaagacaacaggcacacauuguccaaauagugaaagaacagagggaauuaugaaugcuugugagaaaaauccaagaaaacaagaguccugugaccucaguuucuucaaaagcauggacuuguuccuggaaugugcuuuccuggcccucccagcuguggcagucggacaguuuacuuuagcucauucauuacaacuggcuguugucuauaugccucucugaaaaaaauguuuuugccauguucugcuugucauugugacuuuaagcaggugacucuucuuaauccuugggaguuuaaauugucugauguguugaauaaaucaggagucaacagccgggggugguggcgcacgccuuuaaucccagcacuugggaggcagagguaaguggauuucugaguucgaggccagccuggucuacagagugaguuccaggacagccagggcuacacagagaaacccugucucgaaauaaauaaauaaauaaauaaaugcaggagucuuggcccacucuauuuuuaggcccugcucucccaaguucaugcuaccauuagagcgauaaacaacauauuuuccaucaggggugaaagaucagcuaucacuacauacuaggaaaacaauccuagcacauaaaccugacaaguuagauaaauaaauacaucagcuucuuaaaagccacaaaccaccaauaauaaaucaauuaaauaacauacaugugaaugaauaauccuguauuaaucaaagaaauuagagccuauguuaagaaccuuaauaaccaccaaauauuacaggauaacaacagaaugacuuccaauaggaacaauuuacuggauucauacaggaaaccuguuauacaauguaaagguugucccccuuuuaaaucugcauuugcagucauccaacaguuuuauaauucaaaagaaaaucuguuuuguauuuguacucaugguaacugaaaguacauacuuaauccuuaacaguacaucuugauuucugcaucaccucugcuuaucaaaguaaaucuaaaucagauacuuuuauuugugacgcuggaaauugaacuuggagccaacaauacaacaggcaagcacucuucccagacaagcacucucccacugcuucuggcugauucuuaaaaauaaguggggcaauagugguggacaccuuuuaucccagcacucgguucucuuugaguucuacgacagccuggucuacacagaaaaacccugucuugaaauacaaaaacaaaacaaaauuuaaaagguuaaaaauagaagacgccugaaaaaaaaaagacauuaaacgaagauguauagccauguuaaguacauucuuuucaagacugacauccaucugugguguuggggaucaaagucagguccuugguuauucgaggaaaauacuucccaguuauauuccuauuacuuucugaguauguuaauacauuaguuuugcaaaaaaaaaaaaaaaauccgugaaaaaucuccagaguaaguuugguaaaugcuaaauaaacugcagcuacagucagggucgaaauguuagaugagaaaaacagaacguuuaagaucgcuccaauccuuuguucagaaccgucaccgucuuccuuuuauccuagagccugaguuuuccuuauucuguucccucuacuccagccagaccgggaccuucgcuuucccucaagaaacacaagcgcugucucagaacccaagcuaaccguuggcugccacuaccaagcacaguucucaaaggcgucccuccacagguucggcuucgcaccuacucaaaugucaucuucucaagauggccuuucucgcucaccgccugacuaaaacagcacuacuggagggaaugcgguuuuuaccccuucacuuccugccucuuucccccaggacgucaacauaaaagaagcagcagcccugcuuuagucacugcugcccuuccagagcccaggacaagcagcucuccugcgaguccacugcgaccuaagacguggcgcacaccacacaccuccaguuaagaucccugucgguugagaaccgcgcauccguacacauguuccugcucgauacacacgcgaccuuuacaugugugcgcaccgaugugugcagcagccaccucucugcacacagagacgucgacgccucgggauuaaugaauggcugcacacuggacuuccaaaaaaaaaaaaaaaaaaaccaaacaucgcggccgcagccuaggagcaaucccggggcuacagaacccgcacaagcccuucagucucuccucuccagccacgucucccggagccaguacauucucgggaaggcucccgagggacagcggagggcagcuggccggcucgugaccgcggcggcuccgcagcucuggccggccgagcccgccccgccccgcccccgcccggcuccggcuccggcuccgccgcguccacuuccaccccgacccgggcccacagaggggcccgccccgcucacccgguucccgguugaucucgaugucgaagugacacugcggccgguccugggcgcccaucgcgagcgcagcagcgggacggcggcgagcugcggacagggaggagggcgcugagggcaggcgggcggccgggcggggcggggcccggcccgccugacagggacgcggccgacgagaggccgccccacccugcccacccgcccgcccgcccaccccagccgcggcuacccgcgcucccgucgagcuucucaccuggccgcacagcuccggagaacgcccugccggcgccgccggagccuaacgucaccaacggaacgccaccucuuccccgugagggccagccggcgagcgccacgccagagcucgcgaggccggacgca

SEQ ID NO: 5378 - RNA, 2584 nt, Mus musculus
uaaagaaaaugccaggugugguaggguagugcacaucuuuaaccccagcagaagaggguggaucucuugaguucaaggccagacagaacugcauaguaagacucuuuacucuuguggugugguggcaggacagccagggcuauacagagaaacccugucucgaaaaaccaaaaaaaaaaaaaaaaaaaaaaaaauauuaauuaauuaauuaauuaaaagccgggcgugguggcacaggcaaaauacccauaacuuguuaaaaagacaggucagaaugucuagcugagacagauuacugguugcuguagucucucgggcaccucgagggaggaguuagagcucugcauucaggaaucaguacaccacagcacaggcugcauucugaggccugggccucuugccauagcugcuuccucccugugguuuacagcagcccgguguugucuucuucaauaccaaaccucauacaagcaguaagaccaaacuccugaggcugaggcaccugggagauaccaaggcagaauguggguuuuaaaagggccagaacuacaccuauguccacugagcccuaacccugaucccugcugcccacaugcagauucugaggaccauugucucugcccuaacuuuaagaggagucugccucccugaagacuaugucuggaaacacuuagggcucagaagaccucuagaacccccacuacugggcagacauguaggacccgauggucucugcacagcagugauggacguaggccuugacacugcugcuggucacaucugaguuaaagggaugggggcuuccgcaagaaguaccacggcccaagguuguggaggacuagggucucugggagccuuuuggaaguuaacagggaggcucuccuguaaggcccuggacuuggugugggaaagggaaccugcugguuugcauuaggcucccacccuugugcagcuguggcccauuagugcuggacucagcagccaaaacugagggagauggaggccacguacuguacacccuccccuuccagccugcaccacccacuuuuuggacugccuaacuugcauuucuguuaccuggugagcguaguuuccccagccaagugcaggaaccccaagcagucugggguugucuccuuguucuccaaagugaaguuuggccuggagucacucagcuuuaggggucuaaagcacccaccucuaucaugguaaugagugcucuggccccuaaaccaaccaacagaacuugagguuguggccuagaauccuuccucugcucccaucuugucccuccaguuggcuguaccccauguccagaccacucaguucugcagccaugaacacaacggggcuucuggcuuuugcagcuguugccagugacaagcccagugugcccucuugcccucagucggaguucagagaacccaaaugagacagcagggggugggguaggggugucacuccuuuaccuuagccaaggccaguaccagcuucuuccaaccucccagcacagcgucuacauguuuucucucucugcgggacucuccuuguccacccaguagguagacagcccugcccuucccaccucccaggucagugcagcaaucaacugggucagacgagaaacuuggguuuugggaaguguaggagacaucaucgguaauugacagguucacagcuucagccuagagccucagauucgggaacccagguaggggcaugcccugcgcaugugaaggaaggggcucuccucacugucccuaccuuucuucaccuacucagcuuccuugcucagggguagucagcccauguccagugagagauccuugcauucugaggggacagaccuucgacuauuugaugacaccugcuuggcuccagagaaagagcuacagcacaccaugaggaaggcgcacacccaaggagacugcuauggcuggaguggaauggcccggcuggagcaguguugggagagugacuaggcugaacaguggguaggggugcggggcguccgaaggagagaccacggugguaguccguagucccgcccugcugucgcucggccuggcagcguuccuucgcagccuccugccagcacagccagcccccugcccccacggagccggugccagagcagcguuccgcaagccgagcugcaucuucccagcgccgaggcugcgcggagggccccucggccgggccugggccucuggcccccacccggcuguuccagguaggucaucugaaaggcuuccgucguugcggcgguugcucggagguucugcagccagaggcccccagguagguucgggagacucagagcaaaacgcgugggaggccggagcagcuacagaccccagacucacccccaagucggagcagccggagucacagggggcgggagaugagcgcggcugggguacggguccaucagagucgccuggcucaggggagcaggugggucggggggcggcgcgcucugcucagcgaccucacgccuacccuggccccgcccaugcagagcagcgggaggacacccggguuagacucccggacgaacuucccagcaaagaagggcagagag

SEQ ID NO: 5379 - RNA, 2584 nt, Mus musculus
cucucugcccuucuuugcugggaaguucguccgggagucuaacccggguguccucccgcugcucugcaugggcggggccaggguaggcgugaggucgcugagcagagcgcgccgccccccgacccaccugcuccccugagccaggcgacucugauggacccguaccccagccgcgcucaucucccgcccccugugacuccggcugcuccgacuugggggugagucuggggucuguagcugcuccggccucccacgcguuuugcucugagucucccgaaccuaccugggggccucuggcugcagaaccuccgagcaaccgccgcaacgacggaagccuuucagaugaccuaccuggaacagccgggugggggccagaggcccaggcccggccgaggggcccuccgcgcagccucggcgcugggaagaugcagcucggcuugcggaacgcugcucuggcaccggcuccgugggggcagggggcuggcugugcuggcaggaggcugcgaaggaacgcugccaggccgagcgacagcagggcgggacuacggacuaccaccguggucucuccuucggacgccccgcaccccuacccacuguucagccuagucacucucccaacacugcuccagccgggccauuccacuccagccauagcagucuccuugggugugcgccuuccucauggugugcuguagcucuuucucuggagccaagcaggugucaucaaauagucgaaggucuguccccucagaaugcaaggaucucucacuggacaugggcugacuaccccugagcaaggaagcugaguaggugaagaaagguagggacagugaggagagccccuuccuucacaugcgcagggcaugccccuaccuggguucccgaaucugaggcucuaggcugaagcugugaaccugucaauuaccgaugaugucuccuacacuucccaaaacccaaguuucucgucugacccaguugauugcugcacugaccugggaggugggaagggcagggcugucuaccuacuggguggacaaggagagucccgcagagagagaaaacauguagacgcugugcugggagguuggaagaagcugguacuggccuuggcuaagguaaaggagugacaccccuaccccacccccugcugucucauuuggguucucugaacuccgacugagggcaagagggcacacugggcuugucacuggcaacagcugcaaaagccagaagccccguuguguucauggcugcagaacugaguggucuggacaugggguacagccaacuggagggacaagaugggagcagaggaaggauucuaggccacaaccucaaguucuguugguugguuuaggggccagagcacucauuaccaugauagaggugggugcuuuagaccccuaaagcugagugacuccaggccaaacuucacuuuggagaacaaggagacaaccccagacugcuugggguuccugcacuuggcuggggaaacuacgcucaccagguaacagaaaugcaaguuaggcaguccaaaaaguggguggugcaggcuggaaggggaggguguacaguacguggccuccaucucccucaguuuuggcugcugaguccagcacuaaugggccacagcugcacaagggugggagccuaaugcaaaccagcagguucccuuucccacaccaaguccagggccuuacaggagagccucccuguuaacuuccaaaaggcucccagagacccuaguccuccacaaccuugggccgugguacuucuugcggaagcccccaucccuuuaacucagaugugaccagcagcagugucaaggccuacguccaucacugcugugcagagaccaucggguccuacaugucugcccaguaguggggguucuagaggucuucugagcccuaaguguuuccagacauagucuucagggaggcagacuccucuuaaaguuagggcagagacaaugguccucagaaucugcaugugggcagcagggaucaggguuagggcucaguggacauagguguaguucuggcccuuuuaaaacccacauucugccuugguaucucccaggugccucagccucaggaguuuggucuuacugcuuguaugagguuugguauugaagaagacaacaccgggcugcuguaaaccacagggaggaagcagcuauggcaagaggcccaggccucagaaugcagccugugcugugguguacugauuccugaaugcagagcucuaacuccucccucgaggugcccgagagacuacagcaaccaguaaucugucucagcuagacauucugaccugucuuuuuaacaaguuauggguauuuugccugugccaccacgcccggcuuuuaauuaauuaauuaauuaauauuuuuuuuuuuuuuuuuuuuuuuuugguuuuucgagacaggguuucucuguauagcccuggcuguccugccaccacaccacaagaguaaagagucuuacuaugcaguucugucuggccuugaacucaagagauccacccucuucugcugggguuaaagaugugcacuacccuaccacaccuggcauuuucuuua

SEQ ID NO: 5380 - RNA, 6217 nt, Mus musculus
ucugugcgucaugugcaggaggccagcagcuccucuuacagguucugggcauccucuauauauagcccagggcagacagcugcgcagucagugcacagccccacaagacagcagaggugugcagggcugcccucgauacacagacuugcugaguuccagggagccgcaccaugacgcugggcuuggagcaggcggaggaacagcgucuguaccagcagacgcuccugcaagacggccucaaggacaugcuggaccacggcaaguuccuagacuguguagugcgcgugggugagcgcgaguucccgugccaccgccuggugcuagccgccuguagccccuacuuccgcgcgcgcuuccuggcugagccagauagcgcgggagagguacgccuggaggaggugucgccagacguagugucccaggugcugcacuaccuguacacaucagagaucgcgcuggaugaggcaagcgugcaagaccuguuugccgcggcgcaucgauuccagaucccguccaucuucaccaucugcgugucguuucugcagaagcgccugugcuuggccaauugccuggcugucuuccgccucggccuccugcuggacugcgcgcgucuggcuguggccgcgcgcgacuucaucugcgcgcgcuucccgcugguggcgcgggacaacgacuuccugggacucucggcugacgagcugaucgccaucaucuccagcgacggccucaacguagagaaggaggaggcaguguuugaggcugugaugcgcugggccagcagcggagaugcugaggcgcaggcggagcgccagcgcgcgcugcccacggucuucgagagcguucgcugccgccugcugccucgugcuuuccuggagacucgcguggagcgccacccacuugugcgcucccagcccgagcuguugcgcaaggugcagauggugaaggaugcacaugagggccgccucacuacacugcgcaagaagaagaaggaaaagggugagcagacagcucgggccaaggaggccaaccagggcacagaagacaccaaggcugaggacgaugaggaacgaguacugcccgggauccucaaugacacucugcgcuucggcauguuccuucaggaucucaucuucaugaucagcgaggaaggcgccguggcuuacgacccagccgccaacgagugcuacugugcaucccuguccacccagauccccaagaaccaugucagucuggugaccaaggagaaccaagucuucguggccgguggccucuucuacaaugaggacaacaaggaggacccuaugagugcuuacuuccugcaggugccuggccagucuugagaggaagggacuggugcuggguucuggguacuaggaggcaacuuagggccugggaagggccugugucuaccugggacugucauuggaucuaggaccuuugauuggcagccacuugcuugaagugggaagaguuacagccaguuuccaaagagucugguaucuguguuaggcucaguguacaacaagcuggggagcuggaggcccccuggcccagcacagggguugggggcagagacauggagaagaaucauaagcagagcuuugacagaagugccaggucaggggugggagacagauuauuacacagaaagcaccuugccuucucguuuccagggaaggaaacugagucucagcagggucugggagacaggcaagcaggcccagguugaggaugugacugugggaccucagagggagggagaaucuacagccuggucccaugguuuugagccuugucggcugggugaaaucuggagauaugaagggggggggggggagggaguuaguaacccaggcuggcgauccugugacagagcagagccaggugagcaguuauaggcaggcaggagcaaaugggcagcuggaggccaaggucaaguccacaggccucacagcuggaggaggagaggggcagcucucccaagcuggcugggggaaguuucagagguugcauaguaucaaguguccauccacacaaugcagcuguuggacaacucuccaaggugggcucuuugugccuauaaccacucgguuaggcagauaaaaaggguggcauggaaggcuauagauuuuaagggacuugggggggggcuggcgggggggggaagccuugaacaguuggucaccaaagauccaaagccacagggggaccucccucucagagggggaaacuuggcugaucugggccaggaggugagcacaggaggugagcacaggaggcucaugguggcugacccaaggauacugccugcccacaguuugaccacuuggacucugaguggcuggggaugccgccucucccuucaccucgcugccucuucggccugggggaggcucucaacgccaucuacguggucggcggccgggaacucaaggacagcgaagacagccuggacucaguccugugcuacgacaggcugugagugggcaggacggggccaccuuaggggacaggauggucuggggcaggggcccuaggguggugcugggaccacagcagcaaccaggaggccugcaagggugcacagccauugggugaagaccugaaaauaauccuugagcagagggggagaugggcuggcucaaaggcaggagagcucaggggagggguuccaggaguguauugaaugcagucugcaugugucuuguggguaugagugcagagagccggacuugacacaagcuugagcuaugcuuguuccuccaggucauucaaauggggugagucagacccgcugcccuacgccguguacggccacacaguccuuucccacauggaccuggucuaugucauugguggcaaaggcaaagacaggugagguucagccugguaaggaggagguucuguguggcugaggggcaggcaguugucugggucucucaucacucaccccauucaccccacaggaaaugucugaacaagaugugugucuacgaccccaagaaguuugaguggaaggagcuagcacccaugcagacagcccgaucgcucuuuggggccacgguccaugacggccgcaucuuuguggccgcaggggugacagacacaggacuuaccagcucuucagagguguacagcauugcagacaacaaguaugaucuuugcccugcccccaccccacccccaccccguggcagugcaccugucucaccccuguuugcccugcugagggucacaggcccagguccccauguugauuugggacauuggcauagaaguagccccuccugucauccaaggcuuuccugcaggauacucugcagaagggcucccaguguaggaucugggguugacggguuccucaucugggggcugcuaccaggcaacggauuggcucugaugcuguagcaaugagucagcucuggaaacagaagccagugggacccacccagcaaagauggugguuagugggugcccaacaccaaaagguggggcuccucagaagaaaggccaugcucaggaugaaggucugugggugaagggcuaugggaagguccugggaugggagagaugaaggguuaguuaaggcccaugaaauggcuuccauggguugaagcuccaugccucacuggcugucacgggacagaagacucagaaauuucucagagaaagaggggucugguuauagcugugacaaggggugacagaguccuaaagcuggugcuguauuaagucaaggggaagcacuggagcauggcuucuuaggaauggguggggaagaggagcugcauuaucaacaggcauucuuugagcuuaguggugggaccuuaguugggccuaguuguagguugguguugggccuaguugugggucuuuuggggggcuuauuggugguuugggugugggaccuaguugugggucauuuguugagcuuaguuguggguuggguguugggcuuagugguagguuggguguugggcuuaguggucgguuggguguugggcuuaguaguggguuggguguugggcuuaguuguggguuggguguugggcuuaguuguagguuggguguugggcuuaguuguagauuggguguugggcuuagugguaaguuggguauugggcuuaguuguggguuggguguugggcuuaguuguggguugaggguugggcuuagugguagguuggguguugggcuuaguuguggguugaguguugggcuuaguuauggguugaguguugggcuuaguuguggguuagguguugggcuuaguuguggguuggguguugggcuuaguuguggguuggguguugggcuuaguuguggguuggguguugggcuuaguggugguuggguguuacaugggaaagagggugacauggauguuuuuaaguaagucucagaggcuaguuguuaggaaaaccuuuggcaucaggcagcaaauugagagccuauugaggaaauguagacucagaguaucuggggguguguaggaggagcuccccauagcagaaugccagggacugaagacaccaggagagccaucaggaugccuuggaaaagagggacggaggguaugcaaaggaauggggcuauuggagguaacuacagccugagccaggguccagcaauaccaggucacagguguagugagagagacagugugggggugggggcuccauucacgaugcagauuggauggaauagcaaggugaugaggaagggguggggaggggaaggagcaugggaagggaauuaaaggucaaagggaaaguggggagccaagcauuguagaugauuaaagguuaguaaacuggagauugcccagaguugguugcaaccuagaauucggauucccagggggugggaacagagguuuucugaagcccuggacugcuuacuucuacucccaccccauccccagguggaccuccuuugaggccuucccacaggaacgaagcucgcucagccuggucagccuagcuggcacucuuuaugccuuggguggcuuugccacucuggagacggagucuggagagcugguccccacggagcucaaugacaucuggaggugagcccagcccugaggaccugaggggggaauccuggguagucucagagcaaggucaucaaauagucuuccugcaccccagauucucaccaauccauggggcaggugaugugguggcccaccccacugcagagcacccccaggucacagacaggagccaguccucagcuuaggcccagagucuguucuccccauuuucugaggugcuuugucuagaagagugagucugggagagggggaggaggcuggauccagcuccaagagcuguuuuccacuugcucccccugguguggccaugucaggggacuucuugcagagaggagaagaggacugaguugggaacuggaagucuuccagagagcagugaacuucgaggaauguggggacccgggagauggcuuuuccugggagggagcugcuuuagaccacaaggugucuuuucuuagggggucuguauggggauuccacauuuaagcacaugaaagccauuuagaaacagauguacucggagguggccuaggacgccagccaccagcggcauacuguggggucccugccugguuucagcugaugaagcucccaccccuguccccaccuucccuuccccucagauacaacgaggaugagaaaaagugggaggggguccuacgggagaucgccuacgcagcuggcgccaccuuccucccugugcgccucaaugugcuucgccugaccaagaugugaccgaugugacuggugcaggacccucacugagccuccuuccuguccuguggcuucagaaaaaaaaaaaaaaaaaaaaaaaggagcaucaugagauccagggaggagcugggagaggccagagcccuuuggguucccaggaugagucagaaaggguacuucagucagggaagggacauugcugccugcuucucaaugucccucuggggacaccaugucuucccaaggacugcaaagcuauaggccggcaucccagguuguguccuggcccuacccuggcuggcugugugugccauagggucucccaagggacucaguacccgugcugaucagaugggagugucuccgucgauggcaccuucuugugcuaacccagaucucccguaggaaucucaggaacaauaaagugcuuuccgagcaucuagc

SEQ ID NO: 5381 - RNA, 3118 nt, Mus musculus
uuuuugugucaguggugagcauguguggacuuccuuuuccuguggggguuccucagaguguuguguacaacuguuacacagcguuguguugcaguaggcagugugagugagauugagagacugaaagacugcggcagaacccucacccucuuguuaggagaccugagcgcccaugcagguuuggguccuuccugggggcucuggaacaacuggggaugcugugucugagcaacggugacaucuaguguccagaguuggguaugacuagauuuacaagcucccugaucuuggugcucauggaaaccaugccuccugucccacagcuguccagagucccuaggauucacaguuaagguuccaucccuguguaauuccucagcccauucccucgcagccgcaaagccaaaauaaagcggaaugaucugaagugaaggcuaccgugugucaagcagcagagcugccaggaccuauguacuccgcccuguugagacccaggccauuagauacaaugcacgugaccagugauggcuuuaccuggguacguucaggaagaaccaguuccuggcucaagaaauuugcucucccuuagccaccugcacugggcagagacaaaagaggagaguuacccgggucaagcugaggccauuguugggcuccaccuuuagcagaggcugcuauccacuucccugguuugcuuuucugucagcaacaccaccuucuaccuccucuugcucugaaucuuacaggagucuuuccugccucuuaucuaauggaccaauaaccaagccccgucagcuugucucacaucuguccccuccucucccuguucccucuacuuuuuaccuaggccuguuucuucucccaggugcuagugaggaagaggcugaagagacccacacacaaacuguucacucuacaaaggaugucuauuacuaguaagcauauaaggucaaggggcuaggcagcaggagagacuggcaauuccugagaucagacggccuccaccugcagcuggggauguggcucaaugguaaagcauuugucuagcauauuugaagccuuggguucgauguccagcaccagaaagagagagagagagaaagaaagagaaaaccagcuagauuacaaauaucagacaacaaaaaccugugagaugggcugagaauagaauagagaaaucuugguaggaaaaucacaguguauucccacaguccguugcgcugcugacuuggugcagggcugggucagaucgcauccauuuggguggucaccuggaacagagagccacaggaucuugucagaacacugggcuuucugagaaagucaacaggggucuccaguaugagauccccauauauaccaacgcaucuucaguauuagcuuaguugguagacgcagacuugccuggagccaagugacaauccacaaggacaauguuccaggguuacaggaauggggccagcaaaacccagggccaucacaagcugaagaggcagaacuaacgccaaaaaaucuugaaucugaagaaacugaacauuuuaauccucuggggcuccugaguagggagcugaauaaucagaaaggcuuaaauuaaaacccugggcugagcuggccugugguggcgugugccauuagccccagcacuugguaugcaggcagaucucugaaugcaaggccagccugggcuaccaaaggaguuccaggacuacacagagaaacccugucucaaaagccaaaccugcccuuaugaagcaggacagcuggguguguagguacuacugacauacaaggccauuucacauguuacagaccucugccacgccuguuagacuccuacaacaauggaaacccuucugcuuaugaagaaggaaaccggagagccagcucagugguuaagagcauuggcugcucuuccagaggacagaauucucagguucaauucaaagcacccauauggccccucacagcuguccuguaauuccagguccaaggcaucuaguggccucuucuggucuugggcaccaaguacacacauggugaacagacacacaugcugggaaauauuauucacauaaaauaauuuuuacaaaagaaaauggaagucuggcuuggcucaugucagagucacuuuccuguucaauuucguuucucauggaguagaacgacuuaauguucaucauuuguaggaggaauauaauuucagugaggggagucuaccugacgacccuguucaagaagauaaauaugcaugggcugggacgauggcucagcguuaccuugcaaaccugacaaccucaauuaggcaagaacucauauauaaaacgacaaguauaaccaggcagugguguaacaugccauuaaccccagcacggaucucugaauuugagggcagccuggucuacagagcaaguuccaggacagccagggcuacacagagaagcccugucucaaaaaaguaaauaaauaaaaaauaaaaauaaaaaggcuaguauagaguuacuuacacuugugauuccagugccagagaaacaagcaggcagccaggcuagccaaauuagugauccuggggccagagaaaggcccuguguucaagagcacuuucuguugguauggaaaaguacucuaacaaaagccaauuaggaggaaaaguugauuuuagagcacaguuccaucaccucagggaagugaaacagccagcuacgucaccgucaggagcagaaagaagugaaugcauucuucucuacuacccagcuuacucgacccuuacacaauucacagcccaaccagggugccacccuuaaacaguuaaagaagacaguagcccuccggcuggccugguccagacaaucucaccaaaacucucccaggucagucucaagugugucagcugacaaaugugaccauaucccaucucaaaaacuggaucagugaggggcuggagacauggcucaguggcuaagagcgcugauugcucucccagaggacucagguucaaucuccagcacccacauggcagcucacaacugucuguaacuccaguuccaggagaugugacacccucacacagacauacaggcaugcaaaacaccggugcaaauaaaauuuaaaaguaaacacu

SEQ ID NO: 5382 - RNA, 9446 nt, Mus musculus
cugauauguucagaguuauuuuaauaacaauacauaugacaccuugucucuauggaauauuaguuuggguuggacauggauuucaaagugcacuuaacauucuguauguccaaguauguguguaaugucucaaaacaccagcccacccacugcugaccucucacuuuugguaccuggauagacacggcucuuacgaaguagacacacugccuguacuaggccauguauuuccuuuauccuuguguuacaacauacaguaccuacugcugccgggguucaacuccaugguacagcacuugcuuggccuaugugagacccugcacguaaugccuaguaccacaaaaaagaaacaaaaaccuauaguuuaagauguuuaagaauuauccuacuaccaagcagcaaaaauagaacuuugcaauuauaaaagagcuuaaccagaacccacaaccaguuucuaagugugauuuuaauaaacacugccuuucugcagcucuuaucagcuuuccaaguugcuguacgugcacgcacgcacgcaugcacacacgcacacacacacacacacacaaucucuuucucucucucccuccuacuuaguuauaggggauuuauaagcuaguuauauuuuguggacucuuuggaaaguguuuucagaagccaacaaaccuuaaaaccugaaguucugaagucagcccacaagcagacaaaauaaacgaaccagagcaaacaggauucuuuccugacacccucccaaagcauggccuagucugcacauauuguguguguaucugcauugucagcugcccuucuuacaaugacuuucaucacaagggugugaggaaaacacuguacccaacuacuuucaggugacagauuucuucuguguuaccuuaacccccaugagugaccuaguuagcgaaucagucacuaacaauuuggcaaaucaagcuggcaagaaaguaaaccaauauucaauaccguguuuugucuaaacccacauguuauuuauuguagauacaaacacguaaccucaauaugagacgucuaacuaaagcaagcacuucccaugccaccagcucuucuaaggcuuaggcuuaggguuggcccagaauuccugauacauggaguagcccauaccuaaagaaaaagaagagaagcauuaaaacaucuccuucaacauucagaaaacacagcagucuacaggaccaggccagugugagcagcucaccgugcgugucacaccguuuuaaugagcaaucacuauuuaccaggaaauuuuaaaaacacccacuacauuggacaagaucaagucaauaaaccgugaugccaguaaaagcaagcacguuuaggauccuuucuacccucccaaacucaaucccgucauauccuucucagaaaacuuacuauuacccugugcucagaaucugagcaaugaaauugaagacuuacagaauaaggauuucccauuacaggaggcaaagcuuuuucacugcucuaacuaauuauucuuucauaagaaaaugaaucaaagguauuuucaaacuguuuuaaggucagcagaaaguauuuacguugcuuuguaaggaaaagcaucaaugagaaacagaaauuuaagaaauguccugaugaaccuaccaagagucauggcccccacaacaaagcccugggcugcuacacgcauguggaucaagugaauggacaucuuuguauuuccucugcucuucagcuuguacaacccauaggcaacaaucgcugcaaagcccgccauuccugcaacacaaagaauugugacuguguuagcugcacgggagaggagccaagacaacgugagcguuagccaauguacuuucugcuauuuuuguaaggauacuuuaucagaccauucauuaaguaacacaugaacuaaauuuucaaucauuuuugcuuuacaagccaagucuagaauucacagugaacaguaagcuggccuugaacuccacuuggcucugccucuuaagcacugggucuuauguaucccaggcuggccucaaaucugcaaugagcaguagaugagcuugacucccugauucuccugccccuaccuucccagugcuggguuagagcacaagccacaaugcucagcuaaugauuacuucugaacaaauguggguuuauggaguaaguagucagauuuaagaaugccaggguuagugaguugucucagcagguaaacaugcugccaagcuggacaaugagcccaauuccuggaauccaacuuuuuuuuuuuaaagcuagacgugguaauuaucuguaaucccagcagcacuccuaugggcagaugaaagguggagacaggaggccauaggccagcuagccugugguauauagugaagagaaaggaagagagagcugccucaacacagaggaaggagagaaccaacuccugacggucauccucagaccuccacaugagcgcuguggcacaugcacauagcacacauagacaauaauaaagaaaugacauauuaauuuuaaaacagaccauauggucucucaaacguuuaggaaauuuugacaaaauauaaucacacauuaggccacaaugaacauugacuuucaaaaaggcuaauaauacuuagacugcauaaccuaaaacuaaaauuagcagucaauauacaauaggcaauacauacacacuaaagaggcuaagcuuguaauugagcuuggauguuaaaacagagcaaaggagauuaggaaauaacugaguuagcacugaaaaggaagaaacaaaggacaacaggacuacucuugaguaaauacaauuugucagacccaaaccagaaagcuguaggagaacggagaaaauggaaagccagcuagacguuccccugguguuuucugcugcaccaaugacgucauuuccuacuuggguucagugugaacgggacucucuggagcacugguucuuaacccuccuaaugcugccguccuuuaauauaguccucauguuauggugacccccaaccauaaaaucguauuuguugcuacuuaauaaccauaacuaugcuacuguuaugaauuguaaugugaauguguguuuucccaugguucuaggugaccccugugagagggucaaaacucacagguugagaagcacuguuaaaagagucaaguaaaggagucugaacgguggcaccuaacuggucuaguugcuucucauuagacugucuuguauucccugugcagagaauuacauugcccauagaccaacagaguuucuuccuaaaguauguacacagcuccugcccugaauuugcaaagugucagucucuccaggcaacaacagcagaguccgcacagaucccugaucaauucccaacuuuaaagggaauguuucuacugcuuuaauacuaauuauaacuccuauaugcuuuaagugaaugaacuaucccaauuuacugacuuuagaauuuccauuguugaucauauugcuguuuccugggaaguagggccuucauggccgcugcaugccucugagucuggcagucugcgucugccaguguugcugcccaucacuggcggaagaaugcaguguccucugggaagcaccuguaggcuugugcuugucucuccugauuucauccuagaugucuuugcugacuuucaccucuauccuuucaaugcuagaaaccuuaacaggguuuuucugucuugaguccugguaagucucugggucagaagguggucuggggauccccauagagcauggggcccugaaauaacagccaaaaaccugaauauacauagaacuuuugugaugaaauuuauauauugaucuuaccauauuucaacaaaaugagaaaaaagguauuucaggaucuacucaauauacaaauuuaucaugcauccauagcuccaagcucacagcaggcugcauaucagagcaucagccaacuuaccaauggggacaaacggugucuccuuagcuuuccgaauaaacuuagaccccugaccuucaucguaugaagagagagaaaggucuguguugguugacauugugauuucuugaagagucuuccugaaagagaauuuuuuuuugagguuauguaauuaaaagcaccuagaauauuauucaauacugaaugaacuacuaugguuagugagaaauuugguuucuuuaaaaacagaaauagagauaugcuuucguuuuaaucucaggagugagauguggggcugcuuccgaugucugcagcagcugacuaugauuugccucaugcucuagcagaggcauggguuugcagcugcagguaguuucugugauuaugugacauuuggaauucugggaacuuuuuagaggguauauaaggcuagggucccaggaggugguaugguucgucaaguagucacaugcaaagaaaugagaagaaaucagaucuccugacagcgaagaucaaacuuguccccaaggaacuugacaccccuagucagcaggaaguagucuaacaauaaugucacacuuccccaccccccucacuuuuuucucuauuuaguguuaggggguugaaaagguaggagaaagaagccacaaaguagacaaaguccggcuacaacuaugccuaguuuccaugguaucuguuaucugugaacuugaaaaauacuuuuagaauugaacuuucacaauuaaagagaauuguauauauuuauucuuccaucacuuugccuuuucucucauguaacaauuuuucuuuuaacacacugggaaaauagcaauauucuuuuaaaagaauguguagaugucuguuuguguaucugcuugcaaaugccugaggaggccagaagacgcugaucccugaaccuggacaagaucgaaauagcuacuuacagacaugcuuccauguuccacugcauagcuuuugggguuuucuuuuuuguuuugaauagcccuggcugcccuggaacucaauauauagaccaggcuagcguugaauucagagaucugccugccucugccucaugggagauggaaucaaaggcguacaccaccaugcugcugguuuauuuuuuuuuccuuccuuccuuccuuccuuccuuccuuccuuccuuccuuccuuccugcuuucuuucuaucugagguuaucaguguuaacaucaguacaaacaacgaaaaacaaguccuucagggcggucuuauuugacaucuacuaugcuucucuucugauccgccuucuuuuacacaccuuccuaauguucccccagcuuccucuuuauaacauccuuuuaaguggcacucaaacaaggccaagaugagcaaaugguuauaugaguaaaggagcaaaagaauucauucugccaucacagagagcaagggcucucucucccuacaaucacuaaucucaugcaaguucaucaaggugcaggagugacaaauccaugucaucuuuacugugugucuccugucgaacugccuguaauccugacccacagauuaaauaaaggaggcaaacacagcauacaguacaugaaucuucaaguggugacaacugcuauccacucauuagcaugcaauccuggacucuucauaugcggcaaagcccucaaagaaaagccaacucuaauggggcaauguuuaguuugaaaagugagcucaccucuccaagccguacacucccuaaggaguaaauacuauccuuaacagagaagaagacuuagcuagcuagaauauucagauuagggcuaagacuuucccuuuucuuguacucccaauacuuccuaacacauuacaucuuacuaagcuuuguacauacaaagcuugguaagcucaagguucaggaugugauuacauuuacaaaauaaaacaaauacugacuaggugcggugcacauggcuguaaaaccagcacucagagucugaaggagaaggaucuugaguuccaggccagcucaaagcauuuacagagcugagugcucugucgcaacagcuccccuuugccucucuacuucaauuuuccccaguuaacucuugguuuugcaggucugugccugaauuggccuccucugggagguccucuuugguuacgcccuccuacagaacacugacaaacaccugugugaguuccugaagcuggggugcagaccugcccucuugcauacauccccauggccugcacauagugaguagaguacuuucagaguuugaucaggcaaugugagaccaccaagcugcacacaccuaugcccauuuccuuuuauuguucuuacacagcaucuaugaaaaugagaaaauauccugagugggucuugauuccuugaaguuacaagugacaaaaauuaucagacuacaaucuacuuuaaaaacaucccuuugugguuggggaggguaauacacaucuuuaaucccagcacucaagagguagaggcagauggaucucuguguuccaggacagccagagcuacauaauagagggacucuaucucgaaaauauaaaacaaaacaaaucucccuuuguguuuaugccuccugaacucaucaugagagaggcaccucuauugugcuggggacacagcucagugacagagcacuugcuaagcuugcuugaggucacagguuagauccccagcauugucaacaaacacaccauaaauaaggaaacaaaccauggcuggcaucuuuuccccauuuccuaggugguuauguguauuguccaguggguucauggagcaaaagggggagggggagggggagggagagagaacuauuucuuuacuguauauaaaagaacagaagacacccaucccuucccuucaucacgaguaugugauauagauuaucaagcuggaauggguggggcauuugaccucacuuucagaauguuguuaauuucauaaugcgguuaagaauuggggcgcaucauguagccauuauuucuuuuaggggacuaaugauagccagaguggugauaugugccuauaauuucagcccucaagaggggagaggaucaggagugcaaagcuagccuaggcugcaaagcaacacucugucucaagacaacaacaaaaauaaugaaaucaaauuuacaaaagacgcccaucaggcaugacagggcagaugucaggcaagaagcugaagaugagucuggagcacaaagaaagccacauggauagaacuguaauuauaugacccaguggauaaggcauuuacuccaaugcaaagguacgaauuuguaccaauuauauaugcauuuggcuaccagaaagggcuacaaaaagaugaggaaacugaagagugugcugugguggaaauugcauguaaugucaguaucagacuacgggaagcaggagaucucaaguuugaagcuagccugggcuacacagcaaaaccaugcuggaagaggaggaggaagaagaagagaaggaagaggugguaguggugguaguauuuaugaaauauagccacuuaggugaaaaggaaaggacaugcuuuaaaacucacggucaauaagcucaaaucauaacuuaaguguaagaaauuaaguaagagaugaugaucaauauccuuauuuuacagguggauaaaugaguuugaauuauaugaccauaauauaagggucauguggauuguuccacaccaggaauauauuucuggaagguaggauuacaaucugacuccccacauacaguccacaguuuuguuugacaauuuauuuauuguuaaaugaacauuuuuauguuacagguguaaaucugaacugaaaauauaaaaauucauacugucuuugaacuguaaaaacuguguacauuacaccuauaguuaaaugggcuauucucucuucaguuaaauuaucuaacaauuucaauuccaaguuaaaaagauuuuuucccacuagauuuuuuuuuauuaucucacucacccaaugacugaccuauaucugucagaaaguagaacauauuuuuauuuuuaagucagcaauaaccagauauucaaacuuaguuugcugagcacauuauucuguaaggccaggcauaacuacugacacacuuuuccaaaggcauggcaaccuagaagagguaaauaagaaaaugguugggcaucaggugauauaacagcugaagacucuucccagcaugucccuuugguccuaagaacuauuaccuaaaauaguaaauuuuaaauucugauuuugccuaaguuaccugucagcuugugcaaaauggcuucucugagauugugauucaaacggccaggggcacaacacuaggauuuguaucuuaagaagcccuuucaaguuauacugugcagagaagaccuucuagcacauuccaggagcaccgagaaccuuuugaaccugucaagaauuugcauccaaacugucaauuugcagggggccucaguaguccgggaagcagauucccggguagggaucacccccucaaagagaggacugcuuuccaccccaggaauaaacgagggaagcagagaacagaaucgagucacccggacggcuggcacaccugaaccuuagucgugcuuuugugaucucugcaccccguucccuugucaggggcauucgcauuccgccacagccuucccuccuccauccggugacacagggucacguaaggucugcgcaaaccccggguggcgcccgggaaggccaggccgaggugcccgagcgcugcgcccugccucaccucccaccuucuugugaccuuguccagacuccuagacccgugcgaucgcgcucccucucccucuccucccacugcucccgggauccccgaagcuggcaccagcccgguccccguuugccaucguugccuccuccgcgacucucguucccucggccacgauccgcuccagaagcuccggccuccuuccuccggcuccacaugcacuggccgacggggaccccaaguccuccgcccacccgagggaccccccgccccgcagcccucgccucccgcccggcucccgcuucacucaccgagacgcggggucccuuccaguccugccgguuucuggccgccacccgagugcgagaacaccggcuucgccugcugcggccacugcucgccccagccaaucagaagccagcagccggcgaggccgggccagagacucccuuuacgugcgaggggcggugggcguggucacuuguagcgcggcgcccauuggcuggggggccggcccgguucguggcggcgcgcgcuguucgugucagacgugaggccugggcggcagugcuggcgcggugccgccuggcggccgcugccucccaaccccaauugccucgagguucucgcgaccgguucgcugggcuccgcgaacgccacgcacgcaggcuagaccggcuuaggugagccgagcggcccgcccgagcgggagcaugcgccgucggggcgccuuugggucccuccccggagcuggugguggccggagagcagugaccucacacaugccuggggaggagucug

SEQ ID NO: 5383 - RNA, 9446 nt, Mus musculus
cagacuccuccccaggcaugugugaggucacugcucuccggccaccaccagcuccggggagggacccaaaggcgccccgacggcgcaugcucccgcucgggcgggccgcucggcucaccuaagccggucuagccugcgugcguggcguucgcggagcccagcgaaccggucgcgagaaccucgaggcaauugggguugggaggcagcggccgccaggcggcaccgcgccagcacugccgcccaggccucacgucugacacgaacagcgcgcgccgccacgaaccgggccggccccccagccaaugggcgccgcgcuacaagugaccacgcccaccgccccucgcacguaaagggagucucuggcccggccucgccggcugcuggcuucugauuggcuggggcgagcaguggccgcagcaggcgaagccgguguucucgcacucggguggcggccagaaaccggcaggacuggaagggaccccgcgucucggugagugaagcgggagccgggcgggaggcgagggcugcggggcggggggucccucgggugggcggaggacuugggguccccgucggccagugcauguggagccggaggaaggaggccggagcuucuggagcggaucguggccgagggaacgagagucgcggaggaggcaacgauggcaaacggggaccgggcuggugccagcuucggggaucccgggagcagugggaggagagggagagggagcgcgaucgcacgggucuaggagucuggacaaggucacaagaaggugggaggugaggcagggcgcagcgcucgggcaccucggccuggccuucccgggcgccacccgggguuugcgcagaccuuacgugacccugugucaccggauggaggagggaaggcuguggcggaaugcgaaugccccugacaagggaacggggugcagagaucacaaaagcacgacuaagguucaggugugccagccguccgggugacucgauucuguucucugcuucccucguuuauuccugggguggaaagcaguccucucuuugagggggugaucccuacccgggaaucugcuucccggacuacugaggcccccugcaaauugacaguuuggaugcaaauucuugacagguucaaaagguucucggugcuccuggaaugugcuagaaggucuucucugcacaguauaacuugaaagggcuucuuaagauacaaauccuaguguugugccccuggccguuugaaucacaaucucagagaagccauuuugcacaagcugacagguaacuuaggcaaaaucagaauuuaaaauuuacuauuuuagguaauaguucuuaggaccaaagggacaugcugggaagagucuucagcuguuauaucaccugaugcccaaccauuuucuuauuuaccucuucuagguugccaugccuuuggaaaagugugucaguaguuaugccuggccuuacagaauaaugugcucagcaaacuaaguuugaauaucugguuauugcugacuuaaaaauaaaaauauguucuacuuucugacagauauaggucagucauugggugagugagauaauaaaaaaaaaucuagugggaaaaaaucuuuuuaacuuggaauugaaauuguuagauaauuuaacugaagagagaauagcccauuuaacuauagguguaauguacacaguuuuuacaguucaaagacaguaugaauuuuuauauuuucaguucagauuuacaccuguaacauaaaaauguucauuuaacaauaaauaaauugucaaacaaaacuguggacuguauguggggagucagauuguaauccuaccuuccagaaauauauuccugguguggaacaauccacaugacccuuauauuauggucauauaauucaaacucauuuauccaccuguaaaauaaggauauugaucaucaucucuuacuuaauuucuuacacuuaaguuaugauuugagcuuauugaccgugaguuuuaaagcauguccuuuccuuuucaccuaaguggcuauauuucauaaauacuaccaccacuaccaccucuuccuucucuucuucuuccuccuccucuuccagcaugguuuugcuguguagcccaggcuagcuucaaacuugagaucuccugcuucccguagucugauacugacauuacaugcaauuuccaccacagcacacucuucaguuuccucaucuuuuuguagcccuuucugguagccaaaugcauauauaauugguacaaauucguaccuuugcauuggaguaaaugccuuauccacugggucauauaauuacaguucuauccauguggcuuucuuugugcuccagacucaucuucagcuucuugccugacaucugcccugucaugccugaugggcgucuuuuguaaauuugauuucauuauuuuuguuguugucuugagacagaguguugcuuugcagccuaggcuagcuuugcacuccugauccucuccccucuugagggcugaaauuauaggcacauaucaccacucuggcuaucauuaguccccuaaaagaaauaauggcuacaugaugcgccccaauucuuaaccgcauuaugaaauuaacaacauucugaaagugaggucaaaugccccacccauuccagcuugauaaucuauaucacauacucgugaugaagggaagggaugggugucuucuguucuuuuauauacaguaaagaaauaguucucucucccucccccucccccucccccuuuugcuccaugaacccacuggacaauacacauaaccaccuaggaaauggggaaaagaugccagccaugguuuguuuccuuauuuaugguguguuuguugacaaugcuggggaucuaaccugugaccucaagcaagcuuagcaagugcucugucacugagcuguguccccagcacaauagaggugccucucucaugaugaguucaggaggcauaaacacaaagggagauuuguuuuguuuuauauuuucgagauagagucccucuauuauguagcucuggcuguccuggaacacagagauccaucugccucuaccucuugagugcugggauuaaagauguguauuacccuccccaaccacaaagggauguuuuuaaaguagauuguagucugauaauuuuugucacuuguaacuucaaggaaucaagacccacucaggauauuuucucauuuucauagaugcuguguaagaacaauaaaaggaaaugggcauaggugugugcagcuugguggucucacauugccugaucaaacucugaaaguacucuacucacuaugugcaggccauggggauguaugcaagagggcaggucugcaccccagcuucaggaacucacacagguguuugucaguguucuguaggagggcguaaccaaagaggaccucccagaggaggccaauucaggcacagaccugcaaaaccaagaguuaacuggggaaaauugaaguagagaggcaaaggggagcuguugcgacagagcacucagcucuguaaaugcuuugagcuggccuggaacucaagauccuucuccuucagacucugagugcugguuuuacagccaugugcaccgcaccuagucaguauuuguuuuauuuuguaaauguaaucacauccugaaccuugagcuuaccaagcuuuguauguacaaagcuuaguaagauguaauguguuaggaaguauugggaguacaagaaaagggaaagucuuagcccuaaucugaauauucuagcuagcuaagucuucuucucuguuaaggauaguauuuacuccuuagggaguguacggcuuggagaggugagcucacuuuucaaacuaaacauugccccauuagaguuggcuuuucuuugagggcuuugccgcauaugaagaguccaggauugcaugcuaaugaguggauagcaguugucaccacuugaagauucauguacuguaugcuguguuugccuccuuuauuuaaucugugggucaggauuacaggcaguucgacaggagacacacaguaaagaugacauggauuugucacuccugcaccuugaugaacuugcaugagauuagugauuguagggagagagagcccuugcucucugugauggcagaaugaauucuuuugcuccuuuacucauauaaccauuugcucaucuuggccuuguuugagugccacuuaaaaggauguuauaaagaggaagcugggggaacauuaggaagguguguaaaagaaggcggaucagaagagaagcauaguagaugucaaauaagaccgcccugaaggacuuguuuuucguuguuuguacugauguuaacacugauaaccucagauagaaagaaagcaggaaggaaggaaggaaggaaggaaggaaggaaggaaggaaggaaggaaaaaaaaauaaaccagcagcauggugguguacgccuuugauuccaucucccaugaggcagaggcaggcagaucucugaauucaacgcuagccuggucuauauauugaguuccagggcagccagggcuauucaaaacaaaaaagaaaaccccaaaagcuaugcaguggaacauggaagcaugucuguaaguagcuauuucgaucuuguccagguucagggaucagcgucuucuggccuccucaggcauuugcaagcagauacacaaacagacaucuacacauucuuuuaaaagaauauugcuauuuucccaguguguuaaaagaaaaauuguuacaugagagaaaaggcaaagugauggaagaauaaauauauacaauucucuuuaauugugaaaguucaauucuaaaaguauuuuucaaguucacagauaacagauaccauggaaacuaggcauaguuguagccggacuuugucuacuuuguggcuucuuucuccuaccuuuucaacccccuaacacuaaauagagaaaaaagugagggggguggggaagugugacauuauuguuagacuacuuccugcugacuaggggugucaaguuccuuggggacaaguuugaucuucgcugucaggagaucugauuucuucucauuucuuugcaugugacuacuugacgaaccauaccaccuccugggacccuagccuuauauacccucuaaaaaguucccagaauuccaaaugucacauaaucacagaaacuaccugcagcugcaaacccaugccucugcuagagcaugaggcaaaucauagucagcugcugcagacaucggaagcagccccacaucucacuccugagauuaaaacgaaagcauaucucuauuucuguuuuuaaagaaaccaaauuucucacuaaccauaguaguucauucaguauugaauaauauucuaggugcuuuuaauuacauaaccucaaaaaaaaauucucuuucaggaagacucuucaagaaaucacaaugucaaccaacacagaccuuucucucucuucauacgaugaaggucaggggucuaaguuuauucggaaagcuaaggagacaccguuuguccccauugguaaguuggcugaugcucugauaugcagccugcugugagcuuggagcuauggaugcaugauaaauuuguauauugaguagauccugaaauaccuuuuuucucauuuuguugaaauaugguaagaucaauauauaaauuucaucacaaaaguucuauguauauucagguuuuuggcuguuauuucagggccccaugcucuauggggauccccagaccaccuucugacccagagacuuaccaggacucaagacagaaaaacccuguuaagguuucuagcauugaaaggauagaggugaaagucagcaaagacaucuaggaugaaaucaggagagacaagcacaagccuacaggugcuucccagaggacacugcauucuuccgccagugaugggcagcaacacuggcagacgcagacugccagacucagaggcaugcagcggccaugaaggcccuacuucccaggaaacagcaauaugaucaacaauggaaauucuaaagucaguaaauugggauaguucauucacuuaaagcauauaggaguuauaauuaguauuaaagcaguagaaacauucccuuuaaaguugggaauugaucagggaucugugcggacucugcuguuguugccuggagagacugacacuuugcaaauucagggcaggagcuguguacauacuuuaggaagaaacucuguuggucuaugggcaauguaauucucugcacagggaauacaagacagucuaaugagaagcaacuagaccaguuaggugccaccguucagacuccuuuacuugacucuuuuaacagugcuucucaaccugugaguuuugacccucucacaggggucaccuagaaccaugggaaaacacacauucacauuacaauucauaacaguagcauaguuaugguuauuaaguagcaacaaauacgauuuuaugguugggggucaccauaacaugaggacuauauuaaaggacggcagcauuaggaggguuaagaaccagugcuccagagagucccguucacacugaacccaaguaggaaaugacgucauuggugcagcagaaaacaccaggggaacgucuagcuggcuuuccauuuucuccguucuccuacagcuuucugguuugggucugacaaauuguauuuacucaagaguaguccuguuguccuuuguuucuuccuuuucagugcuaacucaguuauuuccuaaucuccuuugcucuguuuuaacauccaagcucaauuacaagcuuagccucuuuaguguguauguauugccuauuguauauugacugcuaauuuuaguuuuagguuaugcagucuaaguauuauuagccuuuuugaaagucaauguucauuguggccuaaugugugauuauauuuugucaaaauuuccuaaacguuugagagaccauauggucuguuuuaaaauuaauaugucauuucuuuauuauugucuaugugugcuaugugcaugugccacagcgcucauguggaggucugaggaugaccgucaggaguugguucucuccuuccucuguguugaggcagcucucucuuccuuucucuucacuauauaccacaggcuagcuggccuauggccuccugucuccaccuuucaucugcccauaggagugcugcugggauuacagauaauuaccacgucuagcuuuaaaaaaaaaaaguuggauuccaggaauugggcucauuguccagcuuggcagcauguuuaccugcugagacaacucacuaacccuggcauucuuaaaucugacuacuuacuccauaaacccacauuuguucagaaguaaucauuagcugagcauuguggcuugugcucuaacccagcacugggaagguaggggcaggagaaucagggagucaagcucaucuacugcucauugcagauuugaggccagccugggauacauaagacccagugcuuaagaggcagagccaaguggaguucaaggccagcuuacuguucacugugaauucuagacuuggcuuguaaagcaaaaaugauugaaaauuuaguucauguguuacuuaaugaauggucugauaaaguauccuuacaaaaauagcagaaaguacauuggcuaacgcucacguugucuuggcuccucucccgugcagcuaacacagucacaauucuuuguguugcaggaauggcgggcuuugcagcgauuguugccuauggguuguacaagcugaagagcagaggaaauacaaagauguccauucacuugauccacaugcguguagcagcccagggcuuuguugugggggccaugacucuugguagguucaucaggacauuucuuaaauuucuguuucucauugaugcuuuuccuuacaaagcaacguaaauacuuucugcugaccuuaaaacaguuugaaaauaccuuugauucauuuucuuaugaaagaauaauuaguuagagcagugaaaaagcuuugccuccuguaaugggaaauccuuauucuguaagucuucaauuucauugcucagauucugagcacaggguaauaguaaguuuucugagaaggauaugacgggauugaguuugggaggguagaaaggauccuaaacgugcuugcuuuuacuggcaucacgguuuauugacuugaucuuguccaauguaguggguguuuuuaaaauuuccugguaaauagugauugcucauuaaaacggugugacacgcacggugagcugcucacacuggccugguccuguagacugcuguguuuucugaauguugaaggagauguuuuaaugcuucucuucuuuuucuuuagguaugggcuacuccauguaucaggaauucugggccaacccuaagccuaagccuuagaagagcugguggcaugggaagugcuugcuuuaguuagacgucucauauugagguuacguguuuguaucuacaauaaauaacauguggguuuagacaaaacacgguauugaauauugguuuacuuucuugccagcuugauuugccaaauuguuagugacugauucgcuaacuaggucacucauggggguuaagguaacacagaagaaaucugucaccugaaaguaguuggguacaguguuuuccucacacccuugugaugaaagucauuguaagaagggcagcugacaaugcagauacacacacaauaugugcagacuaggccaugcuuugggagggugucaggaaagaauccuguuugcucugguucguuuauuuugucugcuugugggcugacuucagaacuucagguuuuaagguuuguuggcuucugaaaacacuuuccaaagaguccacaaaauauaacuagcuuauaaauccccuauaacuaaguaggagggagagagagaaagagauugugugugugugugugugugcgugugugcaugcgugcgugcgugcacguacagcaacuuggaaagcugauaagagcugcagaaaggcaguguuuauuaaaaucacacuuagaaacugguuguggguucugguuaagcucuuuuauaauugcaaaguucuauuuuugcugcuugguaguaggauaauucuuaaacaucuuaaacuauagguuuuuguuucuuuuuugugguacuaggcauuacgugcagggucucacauaggccaagcaagugcuguaccauggaguugaaccccggcagcaguagguacuguauguuguaacacaaggauaaaggaaauacauggccuaguacaggcagugugucuacuucguaagagccgugucuauccagguaccaaaagugagaggucagcagugggugggcugguguuuugagacauuacacacauacuuggacauacagaauguuaagugcacuuugaaauccauguccaacccaaacuaauauuccauagagacaaggugucauauguauuguuauuaaaauaacucugaacauaucag

SEQ ID NO: 5384 - RNA, 3074 nt, Mus musculus
cauguggauuguuccacaccaggaauauauuucuggaagguaggauuacaaucugacuccccacauacaguccacaguuuuguuugacaauuuauuuauuguuaaaugaacauuuuuauguuacagguguaaaucugaacugaaaauauaaaaauucauacugucuuugaacuguaaaaacuguguacauuacaccuauaguuaaaugggcuauucucucuucaguuaaauuaucuaacaauuucaauuccaaguuaaaaagauuuuuucccacuagauuuuuuuuuauuaucucacucacccaaugacugaccuauaucugucagaaaguagaacauauuuuuauuuuuaagucagcaauaaccagauauucaaacuuaguuugcugagcacauuauucuguaaggccaggcauaacuacugacacacuuuuccaaaggcauggcaaccuagaagagguaaauaagaaaaugguugggcaucaggugauauaacagcugaagacucuucccagcaugucccuuugguccuaagaacuauuaccuaaaauaguaaauuuuaaauucugauuuugccuaaguuaccugucagcuugugcaaaauggcuucucugagauugugauucaaacggccaggggcacaacacuaggauuuguaucuuaagaagcccuuucaaguuauacugugcagagaagaccuucuagcacauuccaggagcaccgagaaccuuuugaaccugucaagaauuugcauccaaacugucaauuugcagggggccucaguaguccgggaagcagauucccggguagggaucacccccucaaagagaggacugcuuuccaccccaggaauaaacgagggaagcagagaacagaaucgagucacccggacggcuggcacaccugaaccuuagucgugcuuuugugaucucugcaccccguucccuugucaggggcauucgcauuccgccacagccuucccuccuccauccggugacacagggucacguaaggucugcgcaaaccccggguggcgcccgggaaggccaggccgaggugcccgagcgcugcgcccugccucaccucccaccuucuugugaccuuguccagacuccuagacccgugcgaucgcgcucccucucccucuccucccacugcucccgggauccccgaagcuggcaccagcccgguccccguuugccaucguugccuccuccgcgacucucguucccucggccacgauccgcuccagaagcuccggccuccuuccuccggcuccacaugcacuggccgacggggaccccaaguccuccgcccacccgagggaccccccgccccgcagcccucgccucccgcccggcucccgcuucacucaccgagacgcggggucccuuccaguccugccgguuucuggccgccacccgagugcgagaacaccggcuucgccugcugcggccacugcucgccccagccaaucagaagccagcagccggcgaggccgggccagagacucccuuuacgugcgaggggcggugggcguggucacuuguagcgcggcgcccauuggcuggggggccggcccgguucguggcggcgcgcgcuguucgugucagacgugaggccugggcggcagugcuggcgcggugccgccuggcggccgcugccucccaaccccaauugccucgagguucucgcgaccgguucgcugggcuccgcgaacgccacgcacgcaggcuagaccggcuuaggugagccgagcggcccgcccgagcgggagcaugcgccgucggggcgccuuugggucccuccccggagcuggugguggccggagagcagugaccucacacaugccuggggaggagucugauggggcaggcagcuuccggggcggggcuucgugugggcuccggggauggcagacaccgacagccccacuaugggacgugucuguccaagacucucagcguagcagaacauggcggccucugagagagguaggcuacugguagguacucaacuuugagugacuucagggagaggaacaauugucuccucaccccgaauagagcaccaaccacggacaagagaaaggauuccgucuugucuacccugcccaccccuugccccgccagaggcagcucugcagagggcuucuucccccuuugugcaccgauuauauaaacuggcaagaggaaccacagugaaucggcuaacuuucuaacuuccccauaccucaauguuucuuuucuuuguaaacuaauuuuauuacauuuacuugugugaacauuugcugaggucagaggacaaccuucaccagucaccuccuaaugucuggacccuggggcuagaacucugauugugggauuugguggccuuuacccagugaaccaucuuguugggcccucaauacguuucuugaauuuccugaaggcugguguagucuuaugagccaccuuccaauaacuacauaacaggugucaugacugaauauuaaaauuuuguauuaccauuuuauuuauuguggggaggggcacaugugcuauggcaaauguguggagagcagaggacaacaugaagggaccuguuguuuccuuugcccacagguuccaaggaucaaacacagguuaaaaauuauuugaguuaagucauauguaggaaacauuccauguuauacaugauaaaacucuaugccuguggcuggagaguugucccagugauuuaaaggcacuuguuacucuucuuacaagaggauccagguucaguuccugacacucaacgugaggcucccaaccaucccaacucaguggaacucaaacccucuuuugacugcuucaggcaccaggcauguauauaugaugcacauacauguauacaugcaggcaagauacacauauuuuuaaaauaaaacuuuuaugguggugcacaccuuuaauccuaguauuuaggagggaggcagguggaucucagaguucaaguccuuccuugucuacaguacaaguuccaggacagccaggacuacacagagaagcccugguucaaagaacaaaaaugaaauaaagcuuuccauaccuugga

SEQ ID NO: 5385 - RNA, 3074 nt, Mus musculus
uccaagguauggaaagcuuuauuucauuuuuguucuuugaaccagggcuucucuguguaguccuggcuguccuggaacuuguacuguagacaaggaaggacuugaacucugagauccaccugccucccuccuaaauacuaggauuaaaggugugcaccaccauaaaaguuuuauuuuaaaaauauguguaucuugccugcauguauacauguaugugcaucauauauacaugccuggugccugaagcagucaaaagaggguuugaguuccacugaguugggaugguugggagccucacguugagugucaggaacugaaccuggauccucuuguaagaagaguaacaagugccuuuaaaucacugggacaacucuccagccacaggcauagaguuuuaucauguauaacauggaauguuuccuacauaugacuuaacucaaauaauuuuuaaccuguguuugauccuuggaaccugugggcaaaggaaacaacaggucccuucauguuguccucugcucuccacacauuugccauagcacaugugccccuccccacaauaaauaaaaugguaauacaaaauuuuaauauucagucaugacaccuguuauguaguuauuggaagguggcucauaagacuacaccagccuucaggaaauucaagaaacguauugagggcccaacaagaugguucacuggguaaaggccaccaaaucccacaaucagaguucuagccccaggguccagacauuaggaggugacuggugaagguuguccucugaccucagcaaauguucacacaaguaaauguaauaaaauuaguuuacaaagaaaagaaacauugagguauggggaaguuagaaaguuagccgauucacugugguuccucuugccaguuuauauaaucggugcacaaagggggaagaagcccucugcagagcugccucuggcggggcaaggggugggcaggguagacaagacggaauccuuucucuuguccgugguuggugcucuauucggggugaggagacaauuguuccucucccugaagucacucaaaguugaguaccuaccaguagccuaccucucucagaggccgccauguucugcuacgcugagagucuuggacagacacgucccauaguggggcugucggugucugccauccccggagcccacacgaagccccgccccggaagcugccugccccaucagacuccuccccaggcaugugugaggucacugcucuccggccaccaccagcuccggggagggacccaaaggcgccccgacggcgcaugcucccgcucgggcgggccgcucggcucaccuaagccggucuagccugcgugcguggcguucgcggagcccagcgaaccggucgcgagaaccucgaggcaauugggguugggaggcagcggccgccaggcggcaccgcgccagcacugccgcccaggccucacgucugacacgaacagcgcgcgccgccacgaaccgggccggccccccagccaaugggcgccgcgcuacaagugaccacgcccaccgccccucgcacguaaagggagucucuggcccggccucgccggcugcuggcuucugauuggcuggggcgagcaguggccgcagcaggcgaagccgguguucucgcacucggguggcggccagaaaccggcaggacuggaagggaccccgcgucucggugagugaagcgggagccgggcgggaggcgagggcugcggggcggggggucccucgggugggcggaggacuugggguccccgucggccagugcauguggagccggaggaaggaggccggagcuucuggagcggaucguggccgagggaacgagagucgcggaggaggcaacgauggcaaacggggaccgggcuggugccagcuucggggaucccgggagcagugggaggagagggagagggagcgcgaucgcacgggucuaggagucuggacaaggucacaagaaggugggaggugaggcagggcgcagcgcucgggcaccucggccuggccuucccgggcgccacccgggguuugcgcagaccuuacgugacccugugucaccggauggaggagggaaggcuguggcggaaugcgaaugccccugacaagggaacggggugcagagaucacaaaagcacgacuaagguucaggugugccagccguccgggugacucgauucuguucucugcuucccucguuuauuccugggguggaaagcaguccucucuuugagggggugaucccuacccgggaaucugcuucccggacuacugaggcccccugcaaauugacaguuuggaugcaaauucuugacagguucaaaagguucucggugcuccuggaaugugcuagaaggucuucucugcacaguauaacuugaaagggcuucuuaagauacaaauccuaguguugugccccuggccguuugaaucacaaucucagagaagccauuuugcacaagcugacagguaacuuaggcaaaaucagaauuuaaaauuuacuauuuuagguaauaguucuuaggaccaaagggacaugcugggaagagucuucagcuguuauaucaccugaugcccaaccauuuucuuauuuaccucuucuagguugccaugccuuuggaaaagugugucaguaguuaugccuggccuuacagaauaaugugcucagcaaacuaaguuugaauaucugguuauugcugacuuaaaaauaaaaauauguucuacuuucugacagauauaggucagucauugggugagugagauaauaaaaaaaaaucuagugggaaaaaaucuuuuuaacuuggaauugaaauuguuagauaauuuaacugaagagagaauagcccauuuaacuauagguguaauguacacaguuuuuacaguucaaagacaguaugaauuuuuauauuuucaguucagauuuacaccuguaacauaaaaauguucauuuaacaauaaauaaauugucaaacaaaacuguggacuguauguggggagucagauuguaauccuaccuuccagaaauauauuccugguguggaacaauccacaug

SEQ ID NO: 5386 - RNA, 52437 nt, Mus musculus
caaggcccgcgccugcgcagcgcggccgcacccccggccgcccgcucgguauuaugauuagcccugggugcgggguuccggcggccgggagggaguugucgacgccgcggccgcugcggacggaugcccgccugccggcugagguagggcgagcgcggcgcgggagcgugggccgggucugcgcuucuccucagcggccgccuuagcggggcugggcuggcgccgccgcaggcggaaaguaaguugcgcgcucggcccggggugcccugcgcagaggacgcggcccgcggcaccaccccggccccgagcucgcccggccugcgggcuucgcgcagcccggcccggcccugcccuugcggccgccgcgggauugcggcagcgcgggagucgacgcggccccgcgccgcgcccgcagcgggccccgggcgacgcgagauccacgggccucaguuuccccgugggccgcgagucccgcugcagagccgggcggccgccgccucacgauagcucggggacgcgguugucuacggagaagggcgcucggcugcggaaggggcagcggugcggcuccccggggacugcucggauuuuuucgcguuaggagacgcuguucuuuuccguagacaucgccuguugauuucuuuccgaaccauuugcaauaaaaacaaacaccuuguugccuuuugcuuggacucgggagccaggagaguggcagcccuuuaagcuuaggcuuccuccagcugugauguucuuaaacaguggggucagcuacaaccuaggagcuucgcugugaguucgggucguguaugcauuggggaauuucucuccgggguuccuaagacuguagaagucagaggcuguagggccucugggcugucagguuucuuacuuucccuuccguuuaaaugagcguauucuccaagucuuaggagccuuggugaaaccaccuggaugcuugaaguguuuugucagguuuaaggugaaguaagcgauggaccuacagguguacagcucuuucugcugaguuuccaacagauuccuguccagggucaaaaggcucaguuuggauucuuuguagggauugggacacugucccaaauugaucccuaacuuaucacaguucguaucggugcagucugaagcccagguugucaaggauuauguaaucaacuuguuaauuucuaaucuuguuacaguguuuuccagauuuauaaaaccauucccuucagagaaaucugucuucagcgucugguuaaauauuucucuuggaauuggguucuugaagacaauucuguauguguguuaauuaaacauacuaauuagacaaguuucuuucagagaacaucaaauacauagcaauuuuucuggcugucaguguaaaauugacccauuuuacagaccuagggaugaaagaaauuauaugacauucccaaggucacauaaugaagcuggguuaaaaaaaaaucgagggcauagcacugacuuaauauuccuguccucaaagcuuucugaucagaaacucuuaagugccacuuuuugacuuuuaaauuuuugcacagcuaguuauuuuacuuuaugcagaaauuuucuuuuauccuuuuaugcucuucugaguaaauuuuauaguauucugaguaaauuuuaaugaauaauugcaguaugacacauuugauuaaacaaugauucucaaccuuccuagugcuuggaccaguacauuuccucauguuguggugacuccuaaccauaaaauuauuuucauugcuacuucauaacuauaauuuuggugcuguuaugaaucacaauguaaauaucuguguuuucugauggucuaaggugacccccacgaaagggucguuugaaagcaaagaggucgcagcucacaguugagagcuacugguuuaaaacauccaagaacugggaaguuacacugauuuuuauuuuuacuucuauagagcagacagacauacagauuaggucuuuauguagugaucuuguaacuuaaucacauaauccuaaaaggaagccuuuuaacuguccuuuaauuaaaauugaaggacauuuguguuguuuuuacugggcaugucuacacuaaagugagguugcuuaucuccuguugaaagugaaacuaacuagaaaaggcuauuugggggauauaagugaguggcuaugauucuaagcacugguauuaaauaaaacauaauuuauuuccuauugcaccuuucugagcaucaguucauuauacugccuaggaugaaaaaagguaugugaauuuucuacacagcccggauuuucugacuuaaacacauaggugagaaauacugaaggcuuacuuuaacagcaucccagccacaagauagaauguuuagcuaaaacacauuuuuguaggaaaacuaacucagcaccaaguaauaucaguacuugagcaucagagauaggaaggaucaaaauucaaguccagcuugggcuacauaguauguguggcaucucaggaauaaaagcacacacacaaacacacucuccugaaacaugugaucucucucucacagacacacacacacucacacucccagcccuggggaggcugagauaaggagaaucaugaguucgaaacuggccuggguuucguagcaagugcaaacauaguaagaccuuuccucaaaauacaacaaaguccugcuguucaggaugcagguacuccccauuaugugcagacaaaagucuuaggucuacuaggguagaaaggcugaguagaugugggaggauaaacuuauaaggauaaggaugaauuccuagaguuuuuaucuguuuggaagguuccaggguagaaggguagcaguaggagaaagcagaaaccaguuucugcccuuagguucuuggaagcaagcuauuguggaacacuaagguaaacuagcagaaggauugcuuuugacaggaauagagcaggaggcagugaacgaacaguagggggugcuacucacugaaggccagucucaaaggcuagcauuccaggcagggaguugagggagcaggaggucagacucacugugagaaaaggaguugagguggacacagcacaacugcacagcacauucuguaaaacauuuguaaagggaggaaggugugacgccaacuuugggauguguuggcuuuuguuguuugggaagagccacacugucaaauccgugaggucugguagccuugggagagagcacugcagguguggucugccugggaugggcuggaacugaacuguuauuuucacagaauuauuuccucaucugcuuuucugcacaucuguuuugggcuguggucuuucaccccuugggaaaccauuucuugccuuugguaggagaggacccugcugacagauuccuucuccguccucccugaacacucaucucuccauugucacuucaagagccucccaggaauuuccuucggcaccuccagaauuuggccugugcgcagcaggcucuuccauguuuaucaguccucucucccuuucuuaggcugagaccccccagucugcugcugauagcaacucaguccagggcaacucagugacagggcaugguccauucaugggacaugucgucuccaggugcaaaaugagagaguucaccuaucuauuucuguucaccacucaauugcagauuugccuacaccauuuauuguuggguaugaagucagcaucccagcacaccauaugacugauaugguaacuggucaaacacagcuccagugagccugguuuucucaguuguugauaugugcuuacuuucucaggcaacuccuugaaggcugauugcuuugguucuuguauccccaggugggagccaugccugauacaguaugugcacucaagacgugccuucaucaguuaaaaugacuuauaagcccauuaauggaaaacaugccuguuuuaauacagcuaggcuggacuucccuuguuuuucaggcauacaguuuuggagcuaggaggaaauucaguucucugucagcaucuguagauguuguccuccuccuucuccagucugagguugguacccccagcucccgcucuccucauuccacaugucucucugcuugcccccugggugcuucacucauggagucugccucuacagcgaggucuucugcuugauccucaccaucaccguccagacucuggcagcccucaguucuaagccauuggugaucguguaccuggagauguuucuaguugccuccuuagccgucucccagaugaguuuuguccguccagucagaucuccauuuugcagcuggacuaauuucugaagccaucauuugauugcuguuucuuuaccugagacuccuuuauauaauaaaauguaucaguguguuuuagguagauacuauaccuaacaguuacuauauguacauacacuguaccuggguuacagaacugaauaaggcacacaugauuuguacagcuaaacuuaccuagccaguggggaugcagauuagugauuacauugucauacaaauaugugacacacagugaugaugauaaugguacaggauauugugcugcuaguguauaugguggagcuggugugugacaggagguggggagaauauaggggauaaucaggauggugaccuuuaagcuggaugguaaagcauuaguuagggcuagccagaccugagaaaaaaauaauuugguaccaggcccuuuggaucugugcuccacugguaguaccgucccaucacaggcccuuuggaucuguguuccacagguaguacugacccaucaaaguaaggucucagcuaucuuuccuggaaagccucuuuucccacaacaugauuucaauuuguaucuuaagcacacacagaaauuucucugggaugccuucugugaacccccaaggcagauuuaaaggaaagaacaccucuuuuuuaaugccugucccugcaagaggccguaaacaguggagcgguguuugggagcaggguguuacgguuacuagggaguaugacaguagauuagggaacuaaccuuacaguccuuagcacuguuagcaagugacacuuugaaauauggaaccuuaagccuacagcuggcuccuccugucucccucuguacugacucuacuugcuguguggcaaagcuggaggaaguuggagagaucgcgaaacuugguucacuauuuuaguccaguucuggguuggagagagagagagagaguagaacuuacauuuuaaacauuuucacugugacaugucuaugaaaaguucauuuugggucuaggacaaugugcuaaccugguugugaauggauuaugaugcuguauugugcaagagaacuaugguugucuuuaaugaugauguacaacccugaauaguagacuggagcuuaaaguugguguucuguucuaccuaauuuucuguagguuaaacaguuuucuguuggcgugaagaauuaugauagugcgagagaaauuugaaugacagugucuuuagucuggcuucagggacugauuuguucccuugguugaugaguguuuaccacaugcccuuaggaaggaaacugcuuuuuuuugaaacaaauggaaagaaugugauuugcaaaguacauuaaauuuguucuuuggaaaaggauacaauuuuuaaguaacuagagcuucccugcauuuuucuugacuuguucucuugguuuaguuugggaggacucuuguagucuguccacagaugguguacaagcaauugucggauguuguuuucaaguuguuccauuuuuaggugaccaguaaugaccucagccugucuucuguguacuuguuugcccauaaguuccugucuuaacuuaaacacagauucucaacaucucaagaauuauuguuggcagugcuuauuagcaggugagccuuugcugcauugugaguucuguucuguggguugcuggggccagcacuuccauggcauguuagaauuggaggagaccagaaauccccgagguccacuguagugcuuuguuuucucugggaauuagagaggucuggguaaaagggaagcacugcguuaucauaggaaaauguuguaguccugcguggggucagugggccuggaguccaccccaggcagcucuccccaggcacaggaggaaggcaaagggagcccuucacuaacgccuguguuccugcugucuuacccuuauguguauagauucccaggaauucugguccucuuuuuaauugucuaaauugauugauugauugauugauugauugagagugugcguguggagacuagaguacagcaugcaggugauggugccuggcaguugaacucagauggucaggcuugguggcaaugcuguuuguuguccccugagcaucucuuacagcuuagguuuucuuucuuucuuuuuuguuuuuuuuaguuuuuguuuuuuguuuuuguuuuuguuuuuuguuuuuuuuuuguuuuuuuuuuugagacaggguuucucuguuuagcccugguuguccuggaacucacucuguagaccaggcaggccucgaacucagaaaucugccugccucuggcucccaagugcuggauuaaaggcgugcgccaccacugccuggcuggcuuacuguuuuaaaccauuccaaauaaacuggaauuuacaugcaauuauaguaagagacauuuuaaguuugaaacaagacaauaaaaagucacugguuuuaucauaaaauucacuucugucuucacugaaugauagaaugcugucuauggaugguaaugggggaucuaauaaaucaacaaaaaaauguuuaugaacuuuugaaacugguuugaaaucucugauggucuuauuucuuaguugcuuccuuauggauccuaaauccauuucuugccuugagacacagaugagcccuuuccugggcauuuucagcacuucacacaucuugacuaacuuaguaacucaaugguuagucaucaagcacccuucaguaacagccuuuuccuuaguuuacaaaauucacuucuccacaguuagaacuugacucggaauggugcuucucuuuccugagccagccaagcaaauaccuucucucugcugcucuguuuacugcuggcucugcaggagccuuggucugacuguccuguccuucuuuggucccccuucucuuccaucugaaagccgcuggugggcuuuuucuagaggauccuguuuucuuuauugguuugugagguucuaaagacagggaugguauaguguccuccacuaaggcacacacuuuugcuuaauaaaagugacucaguguucuugcucccagccccaaagagcugcauaccugcuaccucgggucuuguuucuuaagagcacaaaaacaggccuucaacaauguauuucaaagagcauggccuauuucauagaucucuuuuugcaaaagguacauaucucuuucuugggcuauaaaaguaguacauguuucacuaacaaauuccaaaaagacaggaaaucauaaagaagggaaauauauuuuuauugauuuagcauuuuagauuuuuaaaauguauacauuaaagcaaagaacaugguuuuuuagaaaauugagaugaugugcuauuaaugaauuuagcauguaugaauguauaugugugugugcaugcauguagagggcaaagggcagcccugggugcaggcuggccagaaagccagugcagugagacugggcuuggcuggccagaaagccccuuagccuacugguuucugccucccugaugcucagauuccacacgugugcaaccacacuggcuuucuacauggauugugguuacugugagaggcacuucgcugacuugagcucucuguagccucugaacuuuuucuacauaguguuauacagcauaauguuaauacuggguagacugauuuauuccaucauuucuguguaauggacuuauaugcuaguucugaguuuugacauuuaaaucuuauugaacauuauuggauauaaaauauuuguacucaucuuuauuuuagacaccuuagaacaaguuaaauguuccuuaucugaaaugcuugggaccagaacuagguuuuggaguuugggcauuccucaccuuuuugaagauuuuuagaauaucagauuuuaaauagaaauuuaaugcaauuuguggggugggaucuaauucuaaacuugaaagucauucauguuccauguacaacuuaagacacauagccucaagauaacuuugcauaagcuuuaaguuugugaaaguuuguuucaugguaugaaacugucuacuguggucagauuugggaacucuugagguugggcuaggaauguccaaccuacaguaaggcuguaaaucaaggauauuaauuuaucaaguuuuugcuauucagaaaguuagcauucagccccacccuuguaagaaaauucuagugauucuuuuaagucagaaucagccaauacuuuuagucuguggugaguugucuguuucagcauuccuuuuaugaccauuuuuaaauggccaccuucaucccagaucagagaaagaaggaacagaggauaaaaaugaaguugacagugcuuauaggucuuuaaaaaagaggaaguuuucuacuuuacauucuguuuuccuggggaaagugaguuguuuuuuuuuuuuuuuucuuuugcagucauuuccacaagagcuuuuguuuaggucaguauuguuauguaaguacguaugucagcucugucaccacacugguagguuuaaacaaugauggcaugcuuuaccaagaggcagguucugcugaggugguugacuucgagcccccugugcuguggcucgaaggcuuguuugugacuugcuaccugggguccccuucuugucugcccagcaucguuugggacuggccuggcuccucuguaugucccaguuacaacuugaucucuugaucugcuuagacaagagaaagauuacuuaagcuagcacuuugaguauugaucugcauugaccagacagacgcugccuugagagccuggagcaggccucugaacuggcauuguugucuuguuugccuacuugcaagagaauucgagcaugauaacaagucuguuggugucauccuugugcaggucuugguuaagcagcuguauuguugagguguuaugaguggagcuucccuguuauuucuaggagacauagucucagaguagauuuccugcucuuaauagucuuucugcucucuucuucucgauauucugagccuuaaguguuguguuguaguugaauuguuguguugaguuguguugcauauguauccacugggguugagcacuccaagaccaguuguucucuacaauuugaccauuuggggcuuucuguaauggucucuggaaucuccuaggcagagaacuacagucaacuaagaaaggcugaaagacugaccaggagaaucuaucuucucagggaugagaccccaagcccugaaauccuauacauacaaguaacacuuaaugaaaugaacuaggcaaguuguguuuauauauuuguguguguguguguauguguguauguaucaggaacagagaaagagagcuauuaauuugagagggaguaaagggagucaugggaaagguuguggggagaaaaaggaaagggaaaaugauauaauuauaggcauugcgggggugggggguacccuguuguggggaaauaaagggguaggagagaugacccgugucccgccagagcuccgggcgggauggaagcaggggacugcugcacgcucagcugggugggcgccuggcugugagaagccacggaaccccagucuguggggggugaggggugaggggggguaguagggagugagggggugggggggugaggggggugggagagggagcaaucugggguccuugggccacacagaguccagagaugacaauuucuagcucuuggacacugcagaaaagcucagaaugaagugggggaccuggggguggcucagucagccccagugcagaagggagaaggggcagggauagaaggcucacugggugguucccacacuggcgagagagucuggcuagcucaggcugcuagcucagugcacugcuuggguuggcuggcggcucuuuagggggaagccugcuccauugcuccagcauggcagaucucagugaacagagaugguccaugguuuuacuguguuuauuguagaaaggcagagagggagaagaguagggaaguagaagccauggccacuggagagaggggagaggagaggaggagaaggaggcuaaaggugacagugagagcaagagcuuaagggagagaggaggggccaagcaucagcuuuuauagugggcugggcuaccuugcuguugcaggguaacugugggaaggagcauaccuggcuauagccuaagugacugauagccacagaaugauggagcuggguccucaugucaggagccuaugucugggagcauggcaaaugggccuucugucccuugcagauuaaucuguuggguuucugggauuugaaccuaacucgaccagaaaacagguugccuuucauggucccacaaggcaccuuucuuuccaaaguccuuagauuugaggauguaacucugccuguuaggacauuucuaauaggaguuauuggcuuaccucuuaauuuuaaugccacagugagucuguccagugagugcaggcugauacaguuauaauaaacccauaguaauuuuuagcacacccuucuccaguacagaacucuaguucuuccaaaacuuagggccuguugaccuguuguggguguuggucuuuaauuuacaugguuacucccagaaggaggagacacaccggaguauugcuaauuuuggauaaagagaacacuagaaaauacguaauagggcuguguucacuguaccugaccugugguuccugauauuacuggaggaucucauuagggucuucugggacccuguaucacuuuuguugauaaaguuuuagcaaaacccagcagcucacuuugguaaucaucacugaguguuggcugcaucacugaauucaguuggcucuuuacaggcguggcuuccagucugguggucggauguuccuaugauuauggauuaucacuuuaauuuuuuugauauuuguaaaaaaaucaaugccaguuaguuuguauggaaaagguuaaauccaguguuaggucagcuuuucaaaaucagagccuuggguuguguguguaugugaagaacuacuggccuaguuugcuuuguuuugggguuuucuguguauugggauauugauugauucauuuggggaaauguuauuuucuaaacaaagugucgauaggcuuagggguagcuugauuuuuacacacagccaguuuuguuugauuucucagcaagcugugaguuuguucagaguugugugcagugacaucuuugaucacuucuccugggggagaagaguugcaggauacauguuugacaaacagaccccacugcagcgguggugaugugaccaaaaaguucaaagugaguuucagcaggaguaacaguggcuuccagacccacgguagagguagcagaggcugcuucuacuacuguugcagcagcuugcaaaguguguagggccacccacacuuccuuccucuucuucagccacaccucuaugcuuagucgcuucugccugcuugaacugagagaacauuaguauauucuuauaacaccuaccacuacucguuucuugaacugccguuuccauguaccaaacacuguuggccuaguuagucugcuucacuucaagucuagccuagguauuaaacugcuaagucugugccaugcaagaaggcugcuuuaaaguggcuggucuuagugaugcuugcuguucagaaagaugccagcucaguaaugcaguuguuuaaaauguuuguucuacaaagacaggaaaaaguagucauuguacuuaagguaucugcuuuuuaacggugaaugucagguuuggaaccauccuccaagauugcaggugaguguuuacuaguccagguuugcauuuuccaaacuugaugaaguaaauuauuaguguauuuaauuuguuguguguuucugccaguuuauuuuaaaauuuguaccuggcuguguccccagaggacagcgucaaagcucucuguuugguuuauuaccagaggggagauacagaugacuuuucucuuacuauguccccacucuuuuugccaacauguucugauuaaacuuuuucugaaacuaaacauguuuuuucacaguugaaauucuaauuauggacaaaggcaggugcuacagaccagggguugaguggugaacagagcuggauaaaguugagaccaccguagguagcuaagagugcggauguccucccagcaccguggccacuccuuuacucucgagguuaaaguuuuccauucuauacguucagauuugcuaugaguauauuacuuaagauggcgugaugauguagucuuguaaucuuggcaugugggagacugaggcaggaagaucuggaguggaggccagccugggcuacauagugauacuaagucaaacauugcagcagggaagcaaguacuuacauuucuuuaaaaggcauuuuauugaaaaucagauuuuagccaaggaguggugguacacacguuuaaucccagcacucaggaggcagauagaccucuaaguuuaaggccagucuacagagcaggacuacauagugagacccccaucucaaaaacaaagaaacaacaacagcaacaacaaaaaagaaaagaaaaagaaaaucagauuuuaguguuguuagacauauuauuuucuguaucccaagaucuuucuuauugcuaguuuuucaguuugauguguuagggacgcaagaaccuaguucagugagcucuucgcuugauguagacaagcagccaggaggaacagcaggaaugcggcagcacaaacaagguugugggcgguguguuuucugaucacaaauauuguagucauauagcguauuugaucucuacuauucuuaaccuacagaaaagauuuguuucuauugccuuugagugugcacaugcacgugugugaguugcacaugugugugcacugcacaugaugagugcaggugccacagagagcugaaguuucagaugguuucugaguugcagguguuugugagccaucugaggugaaauguugggaauggagcuuagguaagagcauugcaagagcgguaagagugcugcccugcugagccaucucuccaucccccuccacagccuuuagagucuguguguuugacuuaguuugucuggggaugaaauauaguggcauuuuauauaaaccaggcuggcuucagacucuugauccuucuuacucugcccuuugagugcuaggcuuaccggcagggcuguguucuuguuaguaacaugucuacugagggagcugacuguacaguaaggucagguaacuugcugaggaccuguggcuugugauugauggucuggacucauaugaaggauagcuuucagaaccagugcuuaacuaccaugcugccuugauagagaaacugcaggaauggcuguuggagagagaagcaggcagggcuagugggaggagcugcuaaggcccacuuggggcugaagggucuggcaggcaggcaggcuggcugguaagcugcaguuuacccgccagugaaugggagacugugcgaauggcugugggguccucuuggcucucacuccagcagacuugccuuucucuccacacgucaucuuuugugucugcucucccacaccuuguacuuucuuucaagcacaccugaacuuaggcucacugacugcccagacacucagcaccuuuagugggacugugaguugcuuugaccuaccagaauuacucaagccuuuugcuuauuuguguuguguuucagguugguggaaagccuauaagcccacuuuggaaaggacuccuuacugugcucgggaugggaaacagugcagcugcuuugcucauagugacaguuuuguuuacucuuugguggcagacaugaagguguuucgugugcugccuguugcuggcaucacaaugcauuucugccuugcuuaggagugucuuaugcggguuccucuccucugcugcuguagugggagcuuggugaacuuguccagggguauaggcaggccgagcaggauccuagucagagauaaaucagacaaguugagcuucauuauucauucuuugcuggugcacaguuaggauucagcagaugcagguucagggccuauuaccuaggaggucuuuagaaaauggcagguguucuugggguucauugcaacuauuuuuuuaaaagcugugauucgggcuggggcuggagcuggggcuggggcugagacuggaacugggacugggacuuagugacagaaaacuugccuagcaugagcaaagcccuggcuucagucucuugcaguggcagggaaaggggaauaguaauuaauagagggaagaaagauaauaggaggagacaggucaccaaggacagauuugcaguuugcagguuugucuuguccuagaauauguaguuuuacuuuaaacaaaauugaaacaaauagaaugcacugaaaucauuuucuguauuuuccuuuaggagaaacaacaaauacugguaacagagugauuugguaugcuguuugcaagguacguccucgagccaguacagacacaccugcaccucucccagucaccucucaacauuagcauauaugggcaggacagagccacugagagccucagagagggagcaacaauuuauaauacugcguauuuauauauuuuuauacacacgcacacacacacacauauauauauaauguauauguauauguauguacaugcaugcugcguguauauguggaggccaaagguuaucguuguaucuuccuugaucauuauccaacugaucccacccccaauuuaaacacucauuuauuuacuuucugugugcgccuuccacagcugucucuugugaaggucagaggacaauuucuggguucuaaagauaggguucggguugucaagugaggaccuuuaccccuaagccaucucccuggcucuccccgccucauugaaccuggaacucauugaccuggcugggccagcuagugagcaugagcucagggacugccugccaucgugcuccccacccccacacuccccagguuuugcacuugagguuacaaauaugggucguggggauuucucucagguucuucuguuuguguggacaacauuuuaacccacugagccauuuucuuagucucaggcuuaacuuuaacaaucccuagauugauuuaucuaauuugaucuauuugccacuuuccagaaugcaucuuaacagaaauacagaggaaaagaauaaagacgagaaaauggcguaggcagucccaagaaauguuuugaaggugaaaguugaauuugcaaaaauaugcagcauauacuuagacagguaagaacagcugaacacacggagucaauugaggauugagauuagacagucucuagccaaauauauaugaauuaaaguuucuuuaggggaccugauguccaaacacagaaacacuuuucaauuuagauuucccugcuuauacuggucaguuauuaccucagguggaccaggauaauacauaguacagaagaaguugguucuuucuaacaauuuuauuauauacuagucuauuucuuuuuuuuugagaaaauuaugggguuguagaaauggcucagcaguuaagagcacuggcuucucuuccagagauuucugaguucaauucccagcauccauaugguagcuuacagccaucucuaaugggauccaguguugccuucuggcaugcagguguacaugcagauagagcacucuuauacguagaauauauuaaaaauauuuuauuuugugugucuguaucugugucuauaucuguguuugugcuccugaguacagguacccagagggaugucagauacccugggacuggaauuaacauugguuuugggaacugaacccaaguccucuguaagagcaguaagcacucuuaacugcugagccauuucucaagcucuuauaugguuuauuaauuaaaaauuuuaguaaaaaucaacucauucgguuuugguucucaagucaguuuguagagaaacagcagaacagguuguuuuaaagcacugacagguguccugugccuggggcugacuccagcuucucgacugccuugcggucuucauaucucucagaaugugcugaguagcugugaaaacugggaaaggguggugaagcuggauaugugacauguacagugcucauucagaagucagugcuaaguguaaucacagugccuucuaaaguauggaacaugcuaguuggaaaaugcuauuguuggccuguuuaaguuuauugucugucaguuuuugagguaagguggcccuaaguaagugauuucaguaauuuuugaagcaguguuaauaugauaauguaucacuuucauaaucgcauuuugacucuuacuauauuagauaucaaaugugauguuacuggaguggucagaucuucaagagugggcucuggaggaugaggauguagcucagugguagagcuugccuaaugcaagacuugggcuugaucuccaguugggcucugaagucugauuuauauugaauuuuagcuuuaauaccaaucacauguaugcaguuuccuuggcuuuaagaugagacagucugaccucaggaaccugugacagaguacagucccacuuccacgagugccuguggaaagauuucaguaaguuugggcuuuucuucugaucuuugaaauaacgugcucuaaugcuuuaaugcucacuguccuagugugcuuaagauuuaguuggagguuauguguaccuccaucauuaaacagcacagguagugugucugcuuuuagagcacacagcugggacuaugagagaaggcaucaccaaaguagugugcaugugugacaacuugucugggagguaugcauguuugucacugauucugguacucauuucuaaaguguuuguucaguuugugagauuuaaagugcuauuuuaacuuguguaauuuuauauauuucguuuuuuuucugaguuaacauuuauaagaacauauuucugucauguuuguuauuauaaagguugaaauuuuuaaguaugauaugaaauuuggcuucuaaaaccaaagaaucugagacuuagcuggucuguaagagugaaugcuuauauacucugggacagugagcggccauaguggauuaugugugaguuagaaaagcucauaauaggcauuaagagugagcaaccuccagccagaauauugagugcuugcuguguucaaggaugccuaacccaugaugucaggaagcggauaguugcuuggggaauaaguuucacuucagaaguaguaagaguuuuaguuauauauccucuuugugucaguauuggcuuagauuugaggcugugacagaauggucuucaggaaccuuuagauacucacagaucacauggcaucauucagagaugcagggagagaagacugccaaagaggccuuccuauacccucugcaacuaucacuagucucuggaugauagcaagugguugcuggguuucuaccuauguccuuauucuccauuuuuccuucauugugaaugcucaccauauuuuuuuucaaacuucuuauugauucuuuaugaacuucacauuaugcaccccgucgugccucaucccccauccucccaugucugccccugcagccuuacaaccugaccccaaaauaaaacacacacacaaaccagcaacaacaaagcauagaaaacaucucaucauggagacuguaguaugccacagugugagcuaaucagccuguuugcucucccuuaucugcaccaccaggacaauaauaagcacugcuucagcuaggcugccaaagucagcucuacugcucucaugcccuuggggcagcuccacugugcugcccagucaagguucagggcccaagugcugcagccugugagggacuggucagcucucccauucucagacccuuggggcugauucagucaugccuugccaucagggccagcucuucuguauuacccaggugaggugcagggcccaugagugcugcagccaguaagagggcagggcuaggucuuaugaucaguucuccuagcuacugcuggugacaaggagagaaaagggaggguaucagccccauacccauacuaccucacaccagacuagugguggggccagcucuccugcacucacccacugggcuggcuuaccuauauccuuucuaccaggaccagcccuaccgugcuauccugaguccugcagcugaugaggggcaggaauaauucucuugagcucaugacccugugagcagcuuucccagcugccaaaggggcaggggcaucuccugugcagccaugccacacccagcuaaugagugccagggucagcucucccacacucaggccauuguggcuggcucacucacaccccagcuaccaggacuaguucaacugugcugccugagcaaggcacagggucugcucuccccaguucugcugcuggcgagagaugagagaugggaccagcucuccagagcucacugcacccagugaggggaggggccaguuaugcacagcccauggacauccacaugauccugugauucucagaggcugcccucaccagggacagcccauguacucuagauguaauaugaguuauggacaugaacuuuggccccuguugcugaguagucacagacuuagacaugacccucaguggcagcucaggcugggaccugaccgaccauagccccagguggugagcuggccccucacaccagacuucuccucuccacccacaagucuccaguuccaucucucuccauaaagcucaagcuacugcacuucucuuucucuccucucugaccaccacauaaucucacauugugguagcucccacugcaggcuggccaugcaugcaccucguccuccauugugcugaguggcuuggagacagggagugucugugguccacuugugccaugggcuaaagggcauuguggucuuccuguggucucugucuucuuccugugcugugcugugccgccuggauuugauuuaauuuuuauauguccuagacauaaacagcuuuagucaccaaaccacccaucaagcuaggaugaaacaaagggcugccguccuuuuugccccugccuaguauaagaacaccaccaacaaggugucucugcccauugcuggggucucucaccauaguuuuaaagucugauggaauuuuacuuuuagaaaauauuugucauauaaacauaguuuuucaaacuuaucaguuacuuauuucugauauuccgcccccccccaaaauugcuuccaaugagcugcugcuuuuugucuguggacuaugguacuucuaaacuuuuauuuugaauuauaaauucuaagcauauaaguagauuuuuaauaacuacccugacucauuguauacugcaacugacuuaaggcacucaaaauaaaauaauagaaagaaaauccacaaguugauugucucucuuguuuuacagguauccauuaugauguugacaaugaaggccuuauuuccaacagauauacucauaugagaagacccacuucaagcacuuuuaaguaucuuucuguuuguugaaccagcauggcaggguucaagcgaggauaugaugggaaaauugcuggauuauaugaucuggauaaaaccuugggucgaggucauuuugcaguggucaaacuugccaggcaugucuucacaggugagaagguggcagugaaagucauugacaagacgaagcuggacacucuagccacuggucaucucuuccaggaagugaggugcaugaaacuagugcagcaccccaacauugugcgucucuaugaagucauagacacccagaccaaacuuuaucucauucuagaacuuggagauggaggagauauguuugauuauauaaugaagcacgaggagggucuuaaugaagacuuggccaagaaguacuuugcucagauaguucaugcuauaucuuauugccauaaacuccaugugguccacagagacuugaaaccagagaauguagucuuuuuugaaaaacaaggucuugugaaguugacagacuuuggcuucagcaacaaauuucagccuggaaagaaacucaccacgagcugcgggucucuugcauacucugcuccagaaauccugcuuggcgaugaguacgaugccccugcaguagguaggugaccuacccaggaagcucuguggaaccugccacugcuguuaguugguuauguugguugaaaauaauuccaaagagaauuuugauuauauaugucuuucuuaagaaauuuggucucaugaauacuguguguuccuaagcuggcagacagguuauuucauacuuauaagggaaaaugucuaaagguguuuuuaaaacaaagguaauuagaguauuguugaagggaaccuuucagggcauucauuguagcuuuuuuucuuaaagacugaguuuacucccuuucaucuucuuagauuguuuucugggaguaacccugaccaucccuuccugcaaauguccuuuaacaaucuugucacacaacauugggguggcaacauggcuauuagaaauuggacucaugcuaauugugaccuugacuaaguaacugaccacucugcuguuucuuugucuguaagauggacagcuuuccuaugguauuuuguuugcuuuuucauuguacagaugggaacuuugccccaucaccaugggaacaaagggcagacuaggaaacugcugugcuacaugccaguguauguggggcucuugguauggggcccuuagcauucccagcuguccuugccuucuccccuagcauccuucguucucuuguccagaguuaccugucuguaguggaaggacuugcuguuuuucagguuagauuagcuuuguucccuuaaaccauaucaguugugaaggucauacaagaaauuguucagacuugaaaggauuuguugaacugaaggugccaucagcuuuagauuuuauuuaaucucagagaaacauauucuuaggucacaugaacaggacaucagacuucauagacaagaguguugauaugugcgcugcaggccacaggagaugagugagaacaacaugcugacauguuagacugacgaugucacauaaaacaugguggagggaggcagaauuuguuagacuguuggguucuggcaaagaagggauggugggugaccucugccuucaaagaccaccugguucagucagccuuugguuaggguauuugagccagagauuuuggugagugaagccacuuaaaucagaaaauaaagccaggugacagaacaggcauggauguaaauauguaaaacagggugaagcagaagagaacuguaguaagauaccuuucugcuuuccacacaugaaguaagaccaagccaaauguugugaaaaucaggaacaauuguguaauuuagaagacaguuuggcaauacccugguaaagaaagauguacacaucaugugaucaaguaguucuccuauuugugugugugugugucugcgugugcguguguguguguguguguauggaauacagagccuuguggaugccccaacccacuaaagaaguguauuaugucacuguugaauaaguuguucaauauuccuacuuaauuuuguacguugguaaaaaugcagcacaugugccaucaugauggauuucuuuaaguauguguaaggacagaaagcaauugguaaagaggacauaugauacaaauguuaugauuguuuaaagcacagugcaguggcauguguugacaggugaugcaugggccguaaagugaacaugguuuuccaggaacuucccaggaaguuuuguguuucuguucuauuggcacuucuacacugaugcucuccucccuccccuccucccuccuccuccucugccccuccuccuccucugcuccuccuccuccucuuacgucuauccuaaauacuguauaaugaagcuucagaaaaguucagaagaacaaaaguguuuggagaauguuaccaagcagcagauaaugauguguuagugacgugugcagugaauucaguuauggguucuuucuuuuucuuuguuauuuuauuugauuuuaacugacccuuugugaugugauguagauaaauacaaaauugguuccacaaagucuucuuucuguuaauaugcuauuaugccaaaguuagugauguuuugacaaaaugauccuagauaagcugugccauuguucuuuaugggucuuggcuccuuuugccuuaaggcuuaguucuguugucauuauauucuugauucuucagggaaccagauuuugguuucacuuauuaaccacaccuuuguuuucuaugugauuuuuuuuuucuuuucgugauauuucucagcucugaguuuccucuguucuuguaugauuucuuggaaaccucuuuagugucuucauuucuaacauuuuuuaaaaauaauccuuuauggaggauuugugaaugguacuccaugucuuugucuaucuagaaaucugcucaaaauaauacuuugguuggauauagacacacauacuauuaauuuuacauguuuucugccacccuuuugcuucuaaaguggccagcugauaucuggugugagacuggcuuuguuucuugucacugguccuguguuacugagcugucuggguuuugcuucucugucugucagcauuccauugauagauuugucugaauguuuauuuuauuuuauuuuuuucugcuuuguggccuuucuucugcucacauucacuuuuucuggguaugaggagacauugguugcuuguucaucuugugucugugagauuuuucaauaccuugccuauguguauauuucuggguguugcagccuccuaguggauagacaaaaacuuccccuaagugggaagugcuggcuucuggacuuaacuauaugacagauucaguaucuccuuuagaugccaucuucuuuuccagacccaugguccauuuuuccuuccugaagcuggucugcuaggccuagguacaguuaggagguagaaaaaucagaauaccauugcuuagaucaguuccuuccugugucugguguaagucuagaaagaagcaccagaagguccuggagcuagguuuugggaguuguccuucauuccauccucuguagccccuuuucugccaggucuaggaauguagggguugggagggggcgagggguccgaccagaucuuguucuggaggcuguugcugcauucuccucuuggggcuuccagacagcugugucaagcugacuucuuguuggagagggaagaaaaugauugucugcauuaaaaacucuggacucucugguagcagcuuugggguacuguggagagacugcaguguggcaguggacagugggguuaccuguggaagaacagacagagguacacugggacuucuguuggccguggagaggaguaugggaauggagcuucauugagauuucuggguaugguuguuguuguuguuuguuuauuuuccaaaacaguucuaggaaaacacuuauucagauuuucuuccuuguagaaacucuuaagauaugaaaacuguugggucucggacuuuuggcgcucgugcagugcaggcccugacacugcuuagggcuucuugacuucucaaagauuuuaaaguuuaaaaaaaauuagauuugacauugaaacuuuuaaaaauuucucuugagauuuggagucuuccugggauauuagauuuuuugaccugaaaacuguauuagaugcuuccuaauuuauaggcaaacauuucaaagaugaaauaggcagugucagcauuaguuuauuauggccaguuauggaauaaauagauaugaagucuaaguuacuuuaaacaugaccucacauuaauauaaugcaaguuuggcuucagauuaagcauauagcuuaauauuugcauaugcucucuguauuguguauguacacauuuuacaaauauguaaaaauaauuauguguacucuguaguaucucuuacacucauggcucugcguuuuagugcugaucauccuacgucaugaauguauacucaugaauauuaauauaccaauuguagacuucuuccaagucugugcuccauucugcaugcacuacaacaugccuuugcauguucucaauacacugggaguaaccaggagcagggucauucagagcccgagaccugugagucgcaucgugggccuuuacagucccgucuccagaaacaaggcaggaugucuaacugcuauuccuaacagugccccaaagcauacacaguggaaggaagaaauaaaacugucucuacuuauaauugacaugguuaacuaccuggaaaaucucaagaagucuacaaaaaauuacuaauaagugaguucagcucacaggacuuaaaauccaagaaaacacauacauuucuguaauaucaaugaauaaacccauggaggacaaaauuaaaacaguaucauuuguaaugaaauaaauaggaacguguauggacuuaucuaacugaaagugaugaggugcuaaugugggaaaugcagagcaggcccuacucacggcuggagagugcacuguagaugccacccuguccacggggauccagucagcacagcccccagcugaugcccauagcuccuuacacacagagauaucuaaagucuguagggaaaggcagaggaccuagaaugacuacaguuaaaaaacaaaacaaacaaaacccaccaccaacaaccaauaaccaggauuucaaagggaucacuaauaagauaagaccagauuuagaaacaguguggcagguucuuacaaaauaaaauguacaguuaccaugcagcccuguggucacaccucugcugugaugaauagcugugcucacaucgacccacaagucuaccaucauggggagagcaacaccucccacaccaugggguuugugcagcaauaaagaugcucauuauugaagcucuugaguacacacuaaaggugcagaaaugcauacuuuaauucuaccacuaagaaaggagaggcaggaggaucaugaacucacaccagcuuuaguuacaaagagaacuaucucauagcaaaaacaaaaaucccaccucaugccaaaacacugugcacucugauuccauuaugggauucuuuuguggucacauuguagggaacauggugaugagugugaggguuagaggugaugguggugugguguugguucaccaacaugggccaggggcagccuuaagaugggauuucugugugugccuguaauaaaugacaucaaaacugugaaagguagcuuuaaaauacugaggucugagugagcugugcaagcugucagugucugcuucugcuucugaucugcuguaguuagggaaaguucugcucacugggaacaccacgugacacaucuguacacugagggucguccuguaaaucugagugugugagacugggagagagggagagagaagggggagggaagaagagcgagggaggaagaguagggaggaagaggaggaggagaguguacacacuccaauguacacauuccaggcagcagucugucucuaccuuacucacuggacuguuuauuuaaugguucugguggcaucugcugcuguuacaguuggucauaccuggcugucuccugaccucgucaucuccuguucuugccuggaacugaauagucuugucuaggauucuccugcauauaugccaccaggucugugaggcccuuacuucuccauagguggggcccccugccucaccaguccuucuccaguucucugggcucuguuaccuccugcaguaauaaugccugacauaaaagcccucagaccacuggcaaaacugccucaguguguccuguuuuggggagucacagaaugccguggccugugcuauggcugcugucccaggggaacauuuggccuuagauccuggcugccucugguugugggagaaagaguaaagaaaaagugcucuccauucuggaaaccuauccucaggggaauuucuacaguguuagcugcugugggaaaguggggugggaggauaggccugggagcuuugcucacauguuuucccacauguugguugaauuuaacucucagaagcuuguuuacauaugcauaugaagccaggcuuuaaagcuaggaccuuucuucccuuuaaaaaaauguaaaguuaaagaaagaaaaaaagaaagaaaaagaaaguaaauaagugcugguauuuguuguauaguugguuagucuuuguguuaaaaaaaaaaaaguagcuuaguugauagagcacuugucugacauacagaaggcccuggguuuaacccccacugcugcauaaaccuuaugugguccaggcaagacacucaagagaugucccagucccaguauucaagagaugggagaggagucagaaguuucucucugucccaucuuucccuuucacaucaguguggacacagguggggcugggacuucagcagugcuuuaagaacagguaggcagcaacuauuuaaacucagaaaugcauguagaugcagaauggucacaccaucagaucucaugcucaaaacacugacacccccuuccccuucauugagauaguuucgguaugugguccaggcuggcuuccaacucaaaacccuccugucucagccuucugagugcugagacuauaaaagggagccugagccuguuuuuccugcugcccuuucuuaauuuuaaagcucuauuauguauaaaauguaagccucuuaaagaaggaaaacugguuuguaaaacaaagaauuuagugguuagaacaaaugucuggguuuuuguuguuguuguuuguuuguuuguuuguuuuguuuugaaaugaggugucuuguagcccaggcuggcucagacuugcuuauguggcugaggauggccuugcacagugugugacuucuuucuuucaguggcugugguuucugucaaucagcuucucacuuaccacacugacagugguagaagaagaccagcgcagagcugcguucaccacgcagacuggccuguagaagcgggcuucuucauagccuucaucccagacauaucccuucaccagcuucuccuguuucacuccccucuuccuuuaguaaccacaccuuuaaaacaucaggcgugacaguguaugugcuaaguagguggagagcagaccugugaggccagccuugucuccuugguaagauguggaugaugccuaaggaacaucaggugaggcgccacacauguacacacaaaugcauucuauguuucagaaacuaaaugcccuaacuaauauccuuaaauuuuaacuuagaaaggcaaaugguagccugucagcccguguggcucuaugucuggggauuugagggauagagaccuucuccaagguagaucuaaggccugaagucaaggcucugggcauaaugccccuuugcugaaaauaaaggagggcuaguggagagguugaauaaagagagugaugguguuuagguguuuuuccugcauguauuuguaccacaucugugcaguaccuguggaggccagaagagggcaucagauauccugggaguagaauuacagaugguugugugggugcugggaauugaacucggguccucuggaagaacagucagugcucuaaagcacugaaccaucucucagagcccuuucccacuuuuccuacuguagauuaucuaucuuucuauaaauuaucuagcugugauucggguagaaaaugaugauagaaauuuugagcuaagguuucuagacaagguuguuccugaagaguccaucaaccaguggccacauuaccaaccacauuauacaccguaauggacucggaguuguucagcacauuuauuguauguuuuaaacucauuugacacguuagcuaaguuuauaugcaucaguucuucacugggucuugacauauuugcuacgguucauaagagacccucuguggggcgagagcuuaguagacagagaagccccaucacugugugccaggguggauucuuguuucucuguuuaagcaguacuuaacuuucuagaggacugaaauugguggaacagauucuuacaagacaaugaguccagcagaauaccaggaucagaugaucuacauaacucuuauuaagucuaagucaucuccaagcuuguauuccaacaacuaaaguagccuuuuugguuuggggguuuuagugauuuuaugcuuuucagauacuacucaaaagacccuuucuauuggagaacaccauuugcuaauugggcuugguugucauaaggaaucauuaaggucacaccuuugggcuccugaggacuggcucucugcuucaucucagaacuggugucagucuucagucagcucauguaaguguguuuucaguuggcacagugggaccagccaugauucccuguggggcaaagucccacuguucuccucagugggugccuuggugacuguucaauacaggcacagccuuuaccagguuguaagaaaacaacuugauacaacuugcugggauugaccaucuagcuucaguaucaaagugauagcaucaguuaggggaguuuggguucuugguggagaguuugugugaccucugucuaaccuuugacucucuggcuuugugaagggaggagaggaggcugucaugugaacaugggguugccuuauauaagauggagcgcugagacuccuaaacugucaguuacuguguucauagagaucuguuuaugcauucacacccccacccccacccguaagucucuccucuccuucaccuuuucuuuucuaauuuaaagcagagucuggcuuuguacuuccuguccuccugcuguagccuccagaguccugggauucuagauaugcaucaccacacccugcuaauaacuuuugaguuggcccugacuuggcagugcaccaggaagcagagaaaaacaagaaacaaaacaaacaaaacccgcaguccuuuguaccuaaaauggacaaaccauacauauuuuguuuauggcugucauucagaguuucuuagagauuugcaauaauuuuauauaaaauacuagcaagcucagcauuucuguuuccagcuuucaccuaguaggaaguguggagaccucuucuuuaacgccuguuagugggugcugcauucuggaaaggggccaugccucugcugcuuccagccccuucacugcugacccaggccucagugugaugaccucuuggugugcagccuggugaaugcacagccugguggugugcagccuagaguguauauguguugacuuugcaucugagucugcuguggcccuuuagaggaggcaggggccccucacagguuccucugcaucuuagacugguucuucaguuggcuauucuagucauguggacaaagaaacaggacuaauguauucagaagcuagcaggagaagaacuauuguagcugcugacuggagggauggcuuaucuggagagaaggaauggcagaccccuugggaugcagucuguuaaacauauucuuguauaugaagaguuaaggggggaaagcugagcauugagcugugcuuagccuuucugagcagauaaaaagggucucauuaaacaacuuguaaguaggcacuuguuaaguaagaaaauguuuuaucuuacaagugauuagaguauucaugauguaguguaaaacauagugaucaaaauugugguagacaaccuagugugaaggguacacacacagaaagcacugaguggaaaguucauaacacacauauuuacauagcuaacaauacacauagauaacauacauauaugcauacauucauagauaucauacauagauaacauacauacauagguaacaugcauagauagcauacuuacauagcuuacguacauagauaacacacauacauagauagcauacaugcuaacauacauagauaacauacauucauagauaacauucauacauagcuuuucucagaaaaaaaaaaggugcugaaguaauucaauggagaaaagacaauuuuucaauaugguugcaagcagacagaaaaaccucauagcugcuguuaaaccuaaguaucaaguuuaucaaguguguacuaacccaacagauggaaucacaccacucacuuuuguccucaguggagacguuucuaguuuguguucagagucagacugauuguagaagacugagugggggguugaaguauucaguuuacuaccuggaaccagcugugaagucacuguguccugacauaguauucuuuaguggguaccccuuugaaagagcauccacacuggauaugucaugaaagaguccucaucuugugcugcuguguucacacccuugucucucacccugugcugcuguguucacaccuuugucucucaccuaugcugcuguguucacacccuugucucuggacgugugcugcuguguucacacccuugucuccaugguuuuuacuuugaagaugugaaagucucagacuuugagaucagcacuacaauaaaauugaauggcagcuagggauuuccuccuagagcuuauaaaagggagguagaucaaaaagaucuaauuuuguaaaggugugcauuuguaacuaacucuucaccauugucuuuagcaauuccuugagggguuguuuugauuaggcagaaaaugugagggaaucagucauucaguuggauguugucuuggaauauaccuggguggcuccccguguuugcucugacuuggucagaacaugcaaaucaaccugaccuggagcaaggaaacggaauaaaucacaacagccaccaacacugccugacuccuuagauucucuccacguguuaguauugagaucacagacccacaaacacaugcaugcacauauacauacauagccauauacagcuccacacacaugcacauggauacauacaaagauggucaguaauccuaguuuuaaaaagaaauguuuuaugucagcuauagauuuuuguggaacauaccuggguuuacugaguguucauaaucuuugaagcaauuacuuguauugaaaauagaagucauccaccaggcagugcuggcgcaugacucuaauuccagcaguugggaggccaagguuggcagaucuccuaaguucaaggccagccugcucuaccgagggaguuucgggauagcuggagcuacacagagaaacugucuugaaaaaaacaaaagaagggagggguggaaagaaaggaaggaaaagauugaauuuuuauuacucucauuauggagagauugaccugugagucccuugagggaaccccacagauugcaccauuacaagugaaggcucccucucuccaagaauacaagacuauuuugaggucuccuucuuucucccuucauucucguuccuguggcacacacacacacacacacacacacacacacacacacacacacacacacacgcggagagggagagagggagcaagaugcucuguacccagaagcaguugauaucaccaagaaauuaccagagaagugauagaagaaaaauuaggcuuacggaagcgagauaaguuggcuaaggugguucuugcccugccaugcaugcauguucuucucaugaagccaugcuaaagaaguagccugugguuuuguuuuguuucgcuuaucuugacuaucuuacuuucuucauuuaugaaagccguuucuagauuggcacuagguuuuuaaagugggaugugaaggaaugcugaguuagugucuauugucugccuggauagaugugugugugugcaaacucacaguguggcuauggauguguguaugggugugugcaagcucacaguguggauguguguguacaagcucacaguguggauguuuguguacaaguucauaguguggcuguggaugugugugugugugugugugugugugugugugcgugcgugcaagcucacaguguggauguguguggaugugcaagcucacagugugacugauaacucuuuggguucuugaacuuuuucccuauuuugacuugagcaaacaaguuugcacaaggugguaaagagcugacuaaagcaaacugcaacuggugaucacugaucacccucugcguucugccucacaguucuuagaggccuccuccucuuggcuuuguuuuuuuguuuguuuguuuguuuuuuuauuuuuuaagauaggaauaagcacugccugcccuugcagucuggagcugcuauuugcacaguguuuacagagaacugugcucugcauggucucagguucccgcaguagcaggcucagcuggguccagggaauguggucugcguccacagaccucugcacaauggugaaaaaguaaugaccaccuacagcugugauuuccggguccuaggucucuaggcuggagggugaugugaaggagcuugaaaagaagaugagaguuguaggggagcgcuuggaaaguuaaagcacacgguagaauuggguccuagacuagggagucaaagaaccuguugaguaaaugggcagugcuguuuccuaaaauuagauaaaguguagaagugccauugaugagacugggccacagguggggacaauuugggacaaauuuuuuagcuuaguucggggggcauugauuuuuaguugcauggaacauuuugauucucucaagucuugcuggaaaggaaguguggagaccuccauggugauccacuccuccuggcuuugcuaaggaaggacugcuucccccugaaaccaugcuucaaaauagagaauagugaaacagagggugcuagagacagcuugcugcaugugugagaggcucaucuagcuagguuccucuacccucuucugcuuugcucuggguuugccguuuugugcugcuaggaaucgaacccagggcuuuggucagaccuggcaagcacccuaccccugagcacagccguggcccagcuucacuguuagcaaucuguugaaagaaccuggugguucauuuugugcuagcuuuccuacccucaggacuaaccacaaaccuuguuuggagcaggaaagaaccucuaguagccagggcuccagguaauuuuggauucggaccaguaccucuugcuggguaaauggaguucagugugggaaaccacaggcagucaagugucagacuuaccacacaggaaacaaggggcagauuuguguagguucccaggguccucacacuucugcggagagucccgggugucuuugcacaggucgaguguugguugcuaguaagugccauuugaauaaagguguguacaggaauaggagguguugugugcagcgcugcuucaucagcagugacucuaaagcuuucugguucuguuuacuuauugacuccugacuaguucuguuaaaagaaaguuugaggaaaacuaguagagguuucugucagaaaccucucauucuucccauuuuauuucuuucucauuuuuauuuuggauaauuccuauuagaaguuauuuuuuaauuggcauguucuuuuuccgucuuguuuucauuuuuaucuuuugauagccuuccuaagaggacuuucuaauauaaacucuacuacaucagccugagaaucagcaccauucgacuguauuaugauugauaauccuaccaugugccagugugggaagcugcuggacugauuugggaauuguauuucuaguucuccugagaacuaccagugacucccauccucuauaaaaucaaacuucagauuuauccucuucuuccuguguuaccacaaauugaaagauauauauauauauauauauuuuuuuuuuacuaaguaagcauuuauuuuucuuuuuuucuuuuuuuuuuuuuuuuuuuuuuuuuugucaaccaagagccuuuauaguugggucugaaaucaaaaugucacuugaaguaguagcauuaccacgcuuggguuuuggaugcuuuuuguuuguuagcauaucugcacacaaucucacuauuguguuuuuaaaaugaagguaaugugguguuucuucucuguauccauguuucuccagccuggccugcgaugguagcacuacuaccaccucaggcucaggagcuuauaguuguauuguauuaaaacuuuucauggaaaaauagaauaguauuaagaugaauuuuuauuaagauaaugucaccucccucuccaacuuaugagagguaauucugcuuucacccuuacuggccuucauaucagacgucugcuccuggggaccuucauuaggaccugaaagaagcaacuuaggugagggaagauugucuuagguuaugagagguuagguaaugagcauuucauuagaucauagcagggaagguaugaccuagcaauucucuggugggaguguauggcagagccgcucacggugguggaggucaguaacagaguguaagcaaggccagguguaacccucaaaggccaguuccugcucgcuugcuuuuuccagguuuaaccuaaagaugccacagccuuccaaauggcaccucaggcugaggaucaggugcccagaacauuagccaguggggagcaguccagacuuuagucuuaacauacugcuccuggucucagaggcucauggccaucucuauguaaaauguguuucaucuccauagucauaccagucccuacacuguucugagggucaacauucaaagucuguuugagacuaaugucucuuagcuguaacccuuauguaacuauuuucauuaugcagagguacagagugaacacgccccuucuaaaagguuggaauaggagaacaggaaagacuggaccaaagaaugaaacccagcaagcaaaucaacucugaucguuccauggccaguggcuagaguguacucugacaucaugaguuccuuccuguggcccugccauuugcaacacucagggcucugugcuaguuuuaagucagcuugacauaaguuaaagucauccgagaggagagaacuucaauuaagaaaauaaccuccguaagauugggcuguaggcaagcuuuuagggcauuuucuuaguuacugaugguggggagggcccagcccauuguggaugaggcaaacccuggacugauggucaaggguucuacaaauugaaaguauuuauauauauauauauauauauauauuuacuaaguaagcauuuauuuggagcaggaaagaaccuuuaguaaccagcacucaaaagcagacugaagcaagccauggggagcaagccaguaagcagcucccccuccauggccucugcaucggcuccugccuccagcuuccugccuugcuugacugucacauagacaguacugaguucuuccugccagcuccagaacuaucugggugaccuugcaccccuacuacagcagccucuaagugcccacaugacugaccaugggaaacacacuacugcuugcuuagggugucccuaugaugcugucuuuuuaaaugaguguuuuaaagugcuuuugcauuuuuacagccuggagcccucucugggucuagugcuaccgcagcuccucuguaccagcuguagcucacugguguuucuuucuguagucuucacugugaccaugcuccauuucauguuuucaaaucccgcauguuugcuucugauguuccgggugaagcuggcugaaagcagcagcagcgagccugccuguuggguacagucauugcuguucguguuugcugucuuagcccucugaauucugaccagaacagcccaccuaacagagauuauagcacucuaggccuuaccuaucuugggccuccaaacucaucucuguucucccacaaaccaguuucuaauacugaagucucauguccagguguaucacaccaucaccacacuaaugguaccaaugucacuauuauauuuugaauuguugugaccaaaauuccuaacgaauggucuaugaauuuucaguccauuaucauaaaggccaugccuaguuaccuaccuguacuuuccagcccccccucccaaaagcucugcacccugggaaauggcaccacuugcuaggagcuacguguucaaaccaugaagacuuagguuccgaaguccucagcuuuaugccuuguuacccugaagccuuccuugcuauuuuccccaccauccccagucuuuguuuuguuuuguuuuuaauuccuccuguugccuuugugccucugggaacuuagcucuggcuuuccucagagaaaugagacucuuguaaggucaaaugccucugcucugccugggacagugccugcuguugcugaguaaggcagggcaguucagugccucucgacacuuaacaagauugugguguucaccaucuuaucucacaguagcucccuaggaaugcagaugcagauuacucucauacuucuuucuuccauuguguguguguguguacaugcauguguguauguguguguguggguacguguguguguguguguguguacaugcauguguguguacaugcauguguguguguguggguacaugcauguguguguguguguguguguggguacaugcauauguguguguguguguauggguacauucauguguggguguguguauacauauauauggagacccaagguucaugucuagaaauugcccacaguagcucucuuccaccuuauucaaugaagcagggucucucagucaaaccagaaugcccugaaaugucuacucucacuagacaguuuauuguggggaugcuguuucuaucuuccaaagauagaugcagguggcugucaugcccauuugacauuuauauggguucaguucuggggauaugaacucuagucuuuaugcuugcagagcaaacauuuaaucacugaagcauuuuuuccggcccaaauccacacauuuuaaaaucauuugugacuauuccacauuuguuuaaugaacuauuuguuauuacggcuuuuuuuguugugagccggguucucucaggcugaucucaacuugugauccacugugugugugccacuguaccuggcuaguagccuguguuuaucauuuuccuuuggcccuuguaguggaaaaaguaaaaugaaucaaggacaaaaagagagaagagaaauaaaguccucggugucaacagaagauugguuccaggacguaccaucucaggccccagaacacucgcaucucuuguauagcuaugauaauaguauuggugugugacugucugucaacuugucgcagccuaggagcaccucaagucuuaguugaguaguugucuucauuggguuggccucugcaucauaucuuugagggauuaucuugauuauuaauugauauaggagggcccagcccaauguggguggcacauuaccugggcaggugacccuagucuauauaagaaagcuaacuaguccugagccagagugagccagccagcggugcucuuauguggcuuucugccgucaacuacaaaguuugaguucugcccuaauuucucucagugauggaccaugcccagauaaguccugcccucugguaaguugcuuuuggucaguguuuucaucacagcaacugaagaaacuagaacaaugccuacacagacauucucauauguauacuguaagaauugccuauauacauagugcuguguacauaguugagcuauccuggaugauaaggacagcaagucucugcaugcuuagugcugaucccucauuucuggaagggcuaccuuuuucugaagcugucuguugugugaccauauaguccuuaacugaaaugcuucaaaauuuucacaucacuuaguacaggcuauauuucuaaguucuucaacuuguaaguaguuccacauagggaacuuacuuaggcacuagccaggcugugcggucugcuuguuguguugcucuuaguugucccucuaacacacaguagacagaauacuacuauaaaaaauaggucaugugcuugaggaaaugacccuugccuuaguuacuucucugcuguuguccuaagacaugguaaccaaggcaacauacagaagaaagagaaggugaguccaugaccaucauggcucacagcuguuuguaacuucaguuccugggaaucugauacccuuuucugaccuccauggcacugcaugcauguggccuacauacauacuuaacauacauacauacauuuguaaaacacucauacacauuaauauaaaucuuuuaaaacucacacaaggacaguuuaaguuaaauaucaguuucauacauuuccuuuuaaaaccuuaacacuuuaaauacuucucaauggcuauuuaaagaauaaguaugguuggcagucauuacugagguacuugaguuaguagagcccccugagauccacugucaaggcagccagugcaucagaccggccaugcaucccgagagcaggccagcuauguccuggggauuagacugcguggccuguacgugggcccuguucugcugcuaucugccugcauuucauaagcaccuaccugaaaagccacacuguggggaaugggugggcucucacuuguugcccuccuuucucauuuaaaucaaagaaaugauuaacagauuuuaauuuuccucgcuuggaacuuccauuauuuuggguguuuuaggcuuacacgaaaacagcaguugccuguuagcaggugugaugacauggcaggcccauagugugccuagcuuuuccucugagccuguguguacuugcucaugugcauaugugugugugugugugugugugugugugugugugcauguguauugauauuagcacacauauauuuuaauuuuuggaaugaaaauuugugaugccuucuuuaaauccuuuuuuuuucuggaaaaaaaaaguuuuuaaaaaagcaucacuuuuguuuuuccacugacagguuuguuuaaagacaagagaggagguugguuaccauuaugguuccuccaguguuaguuccugcagcuucacacuuggcagguuccugucaggacagaaguuuguccaaagcuggacaguacugggauacuuuaaugacaagaaacucauucuccuuuuaaaaaaauuaauuaaaaaaaaaaaucuuuuaaaauccuguguguguuagggguggggguaguagugcacaugagugcagugcacauggcggccacaagagggcgucagauccuuuggagcuggcguuacaggagggugugagccacugugugggugcugggaaucaaacucagggccucuacaagggcagcuugugcuaacaacugagcugucucucugcucccccaccuccaugccuucccuguucugaugagcagcccucacuguuuauuugcaugaugaccauguuuugagugugucugagcuguagcuuucuccauuauaccugucaggagcuguaugacccagucaccaccccagaaugaggucaggaacaacugagguaacgcugaccucaggcaaauccuuuccaguuucacaguuuaacaucuuaucuuugaugcugggcaugcuauagucagggaagaguggaccuugucccuuggcuuagaagccugggaacacuuaucucucaguucucuuaucagacggggcuuaaacccaacucuguugagauuuuguagucugcucugaguauuuuuacauuaagaauaaaauacuuauuuuccucccuucccucccccugugcuccugguucucuggaugcucugguguuuaaccaugccgucuuugguuugcagacauauggagccugggcgugauccuuuucaugcuggugugugggcagccacccuuccaagaagccaacgacagcgagacacugaccaugaucauggacugcaaguacacggugccaccccgcgugucugcagggugcagggaguaaguaaagcaugcgcacauaaagcgacuccauuaacagaggcugacgcagcggcacagcgggaacccgcaucccuccaccugcagggauccgaguccaguuagcuaugagacuaagcuucugcuguuguuguuuggggcaccgauuaguauuugguaagaaauucaacaggagaaugaaaaacauucuugcacauacuuucaagaagcccucuuugccucucagccuccagaguggugguuaggaccgucucuagccacugcccuuuuuuuuuuuucuucaguggcaaaaagcaagaguugaagcuuccagaaaagaguugagcuuuccuguuuggcaggaucgugucauucauuacacagugccuccuggcugugucauaguagcaugucuaacuaacagcaugucauauucacaugcccucccacaacagaguaaaggcugugcuuuggugugugccaccgugggaagcuagcacugaccggcacauagggguuucucuaucaucugugugggagagaauccugagaaagggcuguuugcagucagugauauuucuaaaugaaccagcugagauugcaguuaccaauuaaaauguuuucuucuguauuaacaacuuuuugaguuuuuccugacaagcuguaagaaagagugauacacgauugaggguucucuuucagguggagccccaacuugggcaugggauucugccgacuuaaaugcugucuucucugcuuagugcuuaugugacaguggaaaggguacuugacaggguuacugugaaaaccauaugaagugagaguguaaaguguguaguugaguguaaaguguguaguugaggcuggagcacagaagaggcucuguguguggugcucgugcugguggcaauuuggggauggagcacguggaggguguuuauuuuaggguguagcauauagaaggcuuuuucuguguccugguugugaugguggcuuuagccuagaguacuugggaaacucuguccuccuguacuggguguuguugauuuuaggcuggaugacaugccuuccagugugagugcccacuugcaccucugcguguggacaugugcaaguaugugcgugugaguauguguacacaaacuugugugccugcaugugcaguggugauuuuagguccuugcucuuaggaagcaggcguacaccaagugcggguuagauauuuauaguccaugauaagcgucuccgcuuccaguuaaaaacagacagaagcgcuaucuauucacucuacaucaaccgugucauuuacucuacaucaacugugucauuugaaagcccaccaguuacagacacaacauggaugcccccauuccuaaggucugagacacggccucuauguaucccuucuggaggaauuauuuguaauaacuauaggaccauuccaaugagggaaaacaacagcagcaacaaagugagccuuuccuaauguguuuuucugaaugguguguuuuaaggagcauguccauuuuauguggcuuuccguguguuuccauuagugacugcgaugccuuuacuguuggaaccaugcucugcauggcugcuccuccugcuugucaucagccaucugaggcuugucacuuccccugugacggucccaggacuggcuucugaugcuauuaccucacagcuguaugucuuccuguccuccugucaguauuugucugccuaacaaggggcugcuuucuuauucagaacuuuaugcaccucacuguuagaauauuuagaauccuucacuguuagaauauuuaggacuaagaaugcuucugagacagauuagccucuccacauuggauaugaucaauaguucuuguguuuccuaggcuuuguugucuuauuuuauuccugccuuguuuacaaggugguuuuauuucuaauuagcuauugcuuuugauuguuaaguuagaauauagucuguauguuaccuuguauucaaaauguugaggcuuauuuaugccuaucaugaggauaauuguuacaauugaguucuugaaaaauguauuuucaaguuggggucagaggucuauauacaucuuuaaggucaagcucauuaauuguucaaaauuguuugcauuuagaguuuucuucacugcucuaagauuaucuucugugaugguggcuuuauuuuauuccuuaagguuugucagcauuugcuuugaaauuguuuuuuuggggggggaggguguuuuuuaguuuugguuuuucaagacaggguuuccuguguagcccuggcuguccuggaucucaggcuggccucgaacucagaaauccgccugccucugccuccgagugcugggauuaaagugugcgccaccacugccuggcuguuuuaagcacauuuaacaguggaugucugugcuguguauucggcauuuccagcgucugcauucugauuuucugugugucagggucuugcugauggcaccuuauuuccuuuguggguuuuuauuugugcuaguuuuugaagcauuguucagaaguucuuuucaguuacauucuacagaaaggaguuuuguguuuuccagaaccaguguuaguucauguguuccuucucaacuuccucugagcaguggauuucuuucuuguuucucacugggcacugagauggaguccucuuucuuuucaaaccacacagggagccguguggcugccagcuaccugucccuaugacccaacccugcuuuuacuaugguuuuagcuauuaaguauuccguguuuauuuuuugccaguccacuucuaaaaauguguuacaugauauuauuuucauuaggagagucauucauucucaugacacgagcugucucaucagugcacuaagaggcugggauuguuuuauuuugugaauacaguggccccagauucucauuugucagugaaccuaguuaaauugcuugugaccguguaagagacagugcuuguugguaacagccaucguuacuaguccuugcagacaauuugcuacaguaaugggccuaccuuucuucacagccugaucacacgaaugcuacagagagaccccaaaaggagagccucucuggaagagauugaaagccacccuuggcuccagggaguggacccaucaccagccaccaaguauaacauuccccucguguccuacaagaaccucuccgaggaagagcacaacagcaucauccagcgcauggugcucggggacaucgcggaccgagacgccaucguagaguacgucagagccuucagacacuaacggcucacacugcuugcuuuucuuaauacugugacugacuaccugaccaagaguguuuuaagggaggaaggguuuaauucugaccuguaguuuaagggaauguaaucuauuuugguggagaggugugguggcaggaucaggaggucugcuagucacacugcuucugccaucaggaagcaggaaguaaauaagaaguagaggcaggcuguaaauccacaaggucugcucuguacuuaccaggauggaaugaauggucccaagucuaaaggauuugcugucugcuccuuaagccucucugcacuguccuggaaucugcacauuauuuaguugcucaugaaaucugucaaaacaagagccauuuucccacaaccuuaguaguguagaccacacagcagaguaauagcggcaugcucugucugucugucugcucuaguagcaggucauguggucagagguccugucugaagauagagcucggccacagauaaagagcaguuacuucauggacuuaaugaaacagauaccacaacucaaggaagcaggagagagguaaccaugauuuggccacucaggucugcauucaguuuucugaccuggggaagagguugaugcaggcugggcauguagacccuguguguugcccagugaguaacaugugcccaguaggagcucuagucucugggaaggguuauaucugcauaaagggcacaccccuguagaguaguuuuagugcaguaaaaauaaguauuugcagaaauaaagccaggcuuagaacuuggccuuaguuuucuguaagauccggcuuaugaguuuuccauugaaaugaccugaggacacgggacacugcugcuucuccacaguggucccugcccauagucuccaugcacacugcugcuucuccacaguggucuccugcccauagucuccaugcacacugcugcuucuccgcaguggucuccugcccauagucuccaugcacacugcugcuucuccgcaguggucuccugcccauagucuccaugcacacugcugcuucuccgcaguggucuccugcccauagucuccaugcacacugcugcuucuccgcaguggucuccugcccauagucuccaugcacacugcugcuucuccacaguggucuccugcccauagucuccaugcacacugcugcuucucugcaguggucuccugcccauagucuccaugcacacugcugcuucucugcaguggucuccugcccauagucuccaugcacacugcugcuucuccgcaguggucuccugcccauagucuccaugcacacugcugcuucuccacaguggucuccugcccauagucuccaugcacacugcugcuucuccgcaguggucuccugcccauagucuccaugcacacugcugcuucuccgcaguguucucaugcccauagucuccaugcacacugcugcuucuccacaguggucuccugcccauagucuccaugcacacugcugcuucuccgcaguguucucaugcccauagucuccaugcacacugcugcuucucugcaguguucucaugcccauagucuccaugcacacugcugcuucuccgcaguggucuccugcccauagucuccaugcacacugcugcuucuccgcaguggucuccugcccauagucuccaugcacacugcugcuucuccgcaguguucucaugcccauagucuccaugcacacugcugcuucuccgcaguguucucaugcccauagucuccaugcacacugcugcuucucugcaguguucucaugcccauagucuccaugcacacugcugcuucuccgcaguguucucaugcccauagucuccaugcacacugcugcuucucugcaguggucuccugcccauagucuccaugcacacugcugcuucuccgcaguguucucaugcccauagucuccaugcacacugcugcuucuccacaguggucuccugcccauagucuccaugcacacugcugcuucuccgcaguguucucaugcccauagucuccaugcacacugcugcuucucugcaguguucucaugcccauagucuccaugcacacugcugcuucucugcaguggucuccugcccauagucuccaugcacacugcugcuucuccgcaguguucucaugcccauagucuccaugcacacugcugcuucucugcaguguucucaugcccauagucuccaugcacacugcugcuucuccgcaguguucuccugcccauagucuccaugcacacugcugcuucucugcaguggucuccugcccauagucuccaugcacacugcugcuucuccgcaauggucuccugcccauagucuccaugcacacugcugcuucucugcaguggucuccugcccauagucuccaugcacacugcugcuucucugcaguggucuccugcccauagucuccaugcacacugcugcuucucugcaguggucuccugcccauagucuccaugcacacugcugcuucucugcaguggucuccugcccauagucuccaugcacacugcugcuucucugcaguggucccugcccauagucuccaugcacacugcugcuucuccgcaguggucccugcccauagucuccaugcacacugcaguuugccaggccagaggguuauagaaaccagagcuacuguuccuaagcccugugaggugguuccgugacagcccacugcaggaggugggugaggccauacacuuauuguuagguccccagcagcuagccaccaugaugccugccuugacaugguguccugugagcauugcuguuuaaauggaugcaggaacaugcugauuguacucagggagaaggugagaggagccuccucuugauugcgcugacugcucugcagugccuacacugcugguggaucaagaauagaacugcuccaaccauucggauuggcuaucgcucaccuagcgccuuagguagcaugagccuuguccucaguccagucuucuggaagcaaaggauccuccucagcaaaacccagcuucacaugccagccacaccgggcagagaacacccuguugggagccucagugccuuucuuaugucugggacacuaacaccguccguccggcuaccgcagcagguugcuguuuccucacugaucugaacauuuuucuucaguugcuuuuccagauuucaguuauaaccuaaacaacuacaggguuuuauucuuucuaguuuguauuuuugucucauuuuaaaagcuucccagauaccggauuucauuaggcaauauuauuuuuuuaaucuuguaaaaaccuagcuguguagcuucugauuguuuuugguuucuuuccucagagcccuggaaaccaacagguacaaccacauuaccgccacuuacuuuuuacuugcugaaaggauccugagagaaaagcaagagaaagaaauacagaccaggucugcuagccccagcaacaucaaggcccaguuuaggugagaaaaauaccuuugcugauauuaguaaguuaacauuuugaguagggaacuguuuguugaugguuccuaguucuccaaguaggaggguccuugaccucauggugccgauggcugcuuuccacagagguuacagcacgcuucucugcuauacgugguaguggguguucccaauaccuaggcaucucacucuuuuuuccuucaagauuuucuccaagagcaguguggauuccccugcaaucacuuggaaagcuuuuuuuaaauaggagcauuuaggauuucagagguuggaagcuagagcacuuaguugacuuacuagcuguuggaucucagguccaaagcaucucugauuuaccugagucccgucgaccuccugagggucaugugaggaggggcucucugaguuagaccagcagggcuucuuuugaggucucggaccagagcccucacugaaguugaucgucaggcuugcgugguggaaugaacccucacuguccuucaaaccugugaccugucucgggggcuuuaccugcagaaguggggaguuguuauuccaccucuuuuguugacuggauuucagaacauucacccacacagcucucgguggccgacucugaccaaguaauacccuccaugaacucagugccgucaaccuuugucaguuucuuuugccacucuguucuguuaagaugugaucuuugcccuguugggcucuaccaguuguuggcauuuuggacaggugagucauaucauaugcucaggaaagaugagugacaaacuguaauuuucccacagagacagccagugagggaagagugaguacucacagguguuugugguccucuggguuuugcuuuaaggugggggaagggagaagagcugagccugcauccugccauguugcuccugcuucuccauggccccuugccuuagcuccuccuacucagugcucacugguuggcuauuuccccacaugguggccuuagaagccccgcugaacacccagcuccagcaguggcagaggcaggcaguuuuuccuccccuacaguugcuccaaguugggggaagaugucugugguaacauauuuacaacuguaggucacaaaguagcuguuguaaaugccucuggcaucauuacaguuucuggcguccacccuucccuugggcaauccagagaaccugccuauaccagcaacuccagauugaaagacaaaguuuaguuaacaguuuugcuauccuaguacccuugugugugcuggacaucccaggugaaucucauccaugcuguuguacgcauaaaggcugaagaaaguguguguguguguguguguguguguguaugugugugagagagagagagagagagagagagaguagauaugcauguacauguucauauaggugguauguguguaugaaugugugcauaugagccuguccacauguguaggugugcauuuguauauguaauggaauguguguagcaugcauguauacgugagauacuauaucuagauuauguauguagauaugcauuugaguauaugauagucuaugcauguuuguagguaugcaugugaacauauaugcagaugugcaugugugucugggggugugugggggugugugaccauguauguaagguaugcauguguguauguauucagguauguauauaagugugugguguugaguuuagggagagcuugggcuuccccagcaucucuaugccccauguuuuuuccgacagcagugguaugaugaaguugccacaugaccauguccucaagccacaucugcccucugggguccuugaucauggaccuaaaaugcuuuccacaugugugaauucuguccuaacucugugugcaugcaacauuaugaaggccuguuuuccauggcuugcuuguagagguucaaggacaccuuggguuuugguccucaccuaccuucuuugaaacagggucuucucugccaucugugcagguauugcuggccagugacucuggaaccucuccagucuccauccaccaacugugguggugcuggcuagugccggauaaccugugcuuugccugccacaucugacuucccaugggugguuagcauaugaaagaaagcaggcucuuaacacuuggacaggccagcaacuucaugacaguuucuuuuuccucuaucacacaggcagucauggccaaccaaaauugauguaccccaagaccuugaagaugaucucacugccaccccucugucacaugccacagucccgcagucuccugcuagggcuggugacaauguccucaauggccacaggagcaaaggccugugugacccagccaagaaagaugagcucccggagcuggcugggccggcacuguccacuguuccaccugcaagcaugaagcccgcagccagugggcgcaagugucucuucaggguggaagaagaugaggaggaggaugaggaggacaagaagccugugucccuguccacgcagguggugcugcgccggaagccaucggucaccaaucgccugacgucucgcaagagugccccagugcucaaccagaucuucgaggagggcgagucagacgacgaguuugacauggacgagaaccugccgcccaagcugagccggcugaagaugaacauugccucaccaggcacagugcacaagcgcuaccaccgcaggaaaagccagggccggggcucuagcugcagcagcucugagaccagcgaugacgacuccgagagccggcggaggcuggacaaggacagcggcuuugcuuacucguggcaccggcgugacagcagugaggggccaccaggcagcgagggcgaugguggcggccagagcaagccuagcagcgguggcgguguggacaaggccagcccgggugagcagggcacgggugguggcagccagggaggcucuggugggaccccgucggguacagcaggguccucaaggcgcugugcaggcccugacucauccucacccucccccgccucagccucugccgcuccacguggugcagagcuugugcagagccucaaacucgugagccugugccuaggcucacagcugcauggcgccaaguacauucuggacccgcagaaggccuuguucuccagcgugaaggugcaggagaaguccacguggaagaugugcaucagcgccccaggccccagccccucugcugaccuugacccggugaggaccaagaagcugaggaacaacgcgcuccagcuaccucugugcgaaaagaccaucuccgugaacauccagcgcagccgcaaggaagggcugcucugcgccuccagccccgccagcugcugccaugucaucugaccuguaaagcgcgcucacuucaucuguucugacgugacaaugcauggucuuugugcaugcugcuacacgcuacuuuucuuuuccagccgaaaagucuacugugugauuuuacauucaugauuuucaguguggaugaccaggaugaaauuguguuaucuggaacccaacguaaauggagcgcuuagaaauccauguucugcacuuaaccuggagggaaaaugcuuucguuuccuugugaaaagcccaaauuccugucuugaccuccggugauagggaaacuccaugcucugaggcacacuggugcccgagacagaaccaaagcaauaacguggugaugcccacaggccugggaggagcaacccccgcugccagccacccagggccugugcaccgagaaccuuagagccacgguuugagcgcccacaccuguuugucuuaaccaauagugugaaagcaguuggggcucuuaucuuuucacugacagagauugucuuguuuguguuaggugaggucagcuccuuagcuuugagaggcagcuuacccauagaauuacccaggagacaaucuucugugaggcaaugaggugaacucaagucuuaacucuacuuagaguguguaugucugucugacagaacaaaaauuaaaaaaaaaaaaaaaaaaaaaaaaaaagaggcucuguguaaguuuccccugcaggacacaaggcaggguuuccuucaaaccuguguggagaggagaagcggagggccugcugcaguagccacagugcacacaggggcaggcagcaaagucagcacucugacgaggaggcaggacauccugagguggugguucaggagcuugguggugagguggccucagguuucucccauuucauggcagcauuuggcucagcugugaagagcggcugguaagaaacugcucaggaaaggguagugcuuggagccgucaguggcacacugcugccuuccugccacgugcugagcgcggagcgcuagcuugcccucucccgcaccgacgacuccggacugauagcuaucuccugaggcaggccuccucccugaucuugggaagcccagaugcuggguuuucacacggugcccaagggauugaaagcaguguuuaagcggccugugggguaggugcggcuggcccaggguccuuuccucacucuucagcugcugcccuguucugagggacaacagugcagcugagcaugugucucagagcgggcagggcacaggccaccacuuccuucagugcucagugacugcugcuuuagguuaguguauauuacucagaacuucacaguguaaccugacuuuacuaaguaaaaugauacuuaagcuacuuccuagagcuagcuaacugcuugugcuuuaagcugcagucccauucagugugacauucacauaguugagagcugugaggggagacgugggugaagccauagagcacauuugcuugaaauucuuaagcagggaucuuccaagggccagaaaccagcgugguucucagagacggagccacgucugugugagccaggagagaugucuauaggggcauugcaauaaacugucgcagcuguuucccaaguaauguacauacucuucuguggucacggccagccucugagcggcgccucugcacucacccgucugcguuuggucuccagugguuuucuauucagguguauauacggugcucacuuuagaucagcagugucggccauuuaugcugcagagcugugucauagccuuauuaguugugugugguuggugacccucuggguacacaaugucuguugagugcugucuuacccauuuguugacaaguggaugucugugcauguguugugugucacggggugucgucacagugucacgggugucgucacagagggaaggagcagaaccaccacacccauaguggaccaaacuacguccuugcuguagccagggacucguccccuagccgaguuacaguaguguauaauuaaauauugugggaaaguuagucuuguauuuuucuguguguauauauauauaauuauguacuucuggaauucuaucuguauuuaaagaugugacaaucuugacaccaauuuuaauagucaugagccugaacaaagauguccuagagccagaguugguaugugcugagaacacaaacuugucagcuaauuggucagaugccucuaguucugaccagucuuuuuccuugugugaacauugacagguaugugacagaugggaaauaauccaauaauaaagugacauacugauguucagcaauaga

SEQ ID NO: 5387 - RNA, 1400 nt, Mus musculus
cuuuuaaguuaauauuuauggugcuguaaauggcaaaauuguggcagcuggugaaagacccccgaagggagacccucacucaagccucgggacagccgcggacccaagaagacacugagaccgaacucaaaauguagaaggcaagauuuaauaaaguaacagcaagaaagcacauagaccagagcucuggggucgaaacucauacaccuaguaugguguagaggagaaucuaccucgagccaaaauuuuucacaggcuuauauaggaaaaacucaaggggggagagcggggcagggaaaguacaaguuugcauaacuaagggguucugccaagggaauucuacguaacuaaggggucauguccuauuauuuggcaauguauccgguucauucugagguuguuccaggaggcccuuaucucaaaaauguucuuggaacagucuuuaguugggaggguucgaacucuagggugaggaguucaggaaugcauucuggggugaagaguucaggaguguucugggaacaaucucuagaugggaggggucgggcucuggggugaggaagaguuuagugauuuuuuuuaucuuuauucuucacugguaccuauugaaaagccaaaaaccauauccguuauuuaaacagcuuguaacuauugacuguauauguugaagaaaagacaaaaagaaugccaggguauauuaggguagaaacugcucuagcagucucuauccaggaccaagagagcugugguaguguccguccccauauuagaggugaggaugcugaccaagaccuuuucucacaucugggcaagcugauggaggagggaaguucaaccuguguaaacccugauuuuuguuaaugcaccuaggccuucauucauuuuguaaccaccauagacugccagagaggcccugucgggccuucagaccuaugauuuuguggaagggcaccaguacgaagcagguaucuuggggaaggagauaacaauucacagugagacugaaguucaauuguuggucauuccccuuuugccugaaaaacauguaauacauacaaguauguauuuucagucuacccccacuguucucuuccacuuuuuuuucauaguuuauaucuuuuauugaugaaauagcauuuugguuucuagaugauugugaacauuugauaugauuagucuguuaaaauauaaccauucugaaagguaugcagugguauguucaugugaauaauuccuuuuuaaaaaaaauuggauauuuucuuuauguacauuucaaauuucaaauguuauccugaaaguucccuguacuccccccaacucccccgcccugcucuccuacccacccacucccgcuucuuggcccuggcaaugcacuaaauaaagauagaauauuaaaagca

SEQ ID NO: 5388 - RNA, 9576 nt, Mus musculus
ccggaagugaugcucucaugcuucccgucccgccgucguugccauuuccuaguguccuggagguguguggggccguugagccgucacgcaugacgguggcgacgcgguggaaagugcggcccgcacucgggccgcgacgcgggcggugccggggugcuuacccgaggcggagccgcgucguccucguguuguggucgcucggcuuggggucggcucgaguuguuggcucccgugcgucagcgcugcacggggcagacgcggccaggugagcggcuaccgaggcaggaccgugacucuggagugagccccacgcgagcucgcagauuagacgugcagcgagaccugccgcuuagcacucggcacaguaaggaccgcaggaaaguguccugugcucuuguguacucucggagaguucacagauuacuccaucugucuuaaaaacaaaacaaaacaaaacaaaacaaaacaggcucagaggaaaaugucuaacccuggggucuccagugccugauaucugauaucucaaaccacggcacacauccuaguugccccagaggaucugguuuucaaauggcaugcauaaacggaaaggaaaauggcuuuucccaaauuuuguccacuaaacuaaccacauucguguaacauaucucucucccuguguaacacauaugcacgcgugcaggacugggaagcaguccugccuuuugaaucuucgcaggaaacagagcccugaguaaacugcaaacaauugcauuaagagaagugauccaacagaguuauggguggagaguaguccgugggauuacugaagcuauaaacagugguaugcccggagagaccagaaaguuaaaguuaaguuccaaguuaaguagaaaagacuuccaaaaguuuuaauacuaguuccucccuuugggugacccuccaguaguuuagaggccaugacuggugaguuccucauaaacaguugaaguacacuguuauaguaugagguacagcaagggaaaugagccauuguuuuauaucuggggaaagcaggaaaauauccuucaagagagguguuauuuauucggagucuugacacuugauuaagaguuugucagaaaugacgggaaaaaacagggaaggugcagacagguaaagugugguccccacccccuuauuuguaaaguguuagccccaaacuuuaguacaucuuuaccagcugaguuuugagccuccacucccagcacaaguuuaugaaaaaauuaaagauaaauccuauuugaauuucagugcuuacuacaggacauauuaaauaguuaaaucauuuaguauuuucuuuaacauccaguuuccuuguauacccugcuuuggaggccauugauguccuuuuaauuuggguacuugggggaaaugguuggagguguaugugaaagacugugaaagcuaagccuagacauucaguuagcuuuuauccugcaggugacuggagccacuaauaguuugaaaagggaagucacuuggagucauuucuguguuuguacucuucucuuccccggaggcuuugcuucuagcugcagaaccuguuaccagcuaagagcuaggugcuccaggacucugaucauucucuuuguguuucuguaggugacacuuuccucacuuccuuucuugacucugaaaaaacagcccccgcaguuugaagcagagacucauuuucagugugccugcuguagcuggaaccagcuucucuuuugggaucacaaugaccauggaaggcagggggacauuagauaucauccccaggacugccauguaucagaagcaggaggggaacuugacugugaagcaggaaccaggaagccagacauggggacagaagaacuaccuucccgucugugaaauauuccgacugcacuucaggcaguugugcuaccaugagaugucugggccucagcaagcccugagccggcucagggagcucugccacugguggcugaugccagagguccacaccaaggaacagauccuggaacugcuggugcuggagcaguuccugagcauccugcccagggagcuucagaccuggguacagcuccaucacccugagacuggcgaggaagcuguggcuaugguggaggauuuccagagacaccuuagugagucaggggagguaagcagucagucuauaggaacaucuagagccacucucuaaacuugggcuagccugagagcaaguauucaccauuccccacacuuuugccugguuugccuuuaggauuccugaacuugcuccacugauagauggaaaauaguuuucugcuauaagccauagcagaaacacaaaucccagcacucuuagucacuguuuuauugcugcagagacacugugaccaaagcaacucuuauaaaaacauuuaauuauggccuugcuuccaguuuguagauguuagacccuuauggcagggagcuugguagcucauagauuuauguaguacuggagaaguagccgugagcucuauauccugacagagagagagagagagagagagagagagagagaaacugagagacugagagacugagaaacuucaaagcccaccccaguggcaccuuaucuaaccuuuuaaguagcacuacucccuggugacuacgcauucaaaucuaugagcccgugggggucauacaagccaaggucuaagucagguguguuucuguggaggggaggugcaugugcagggguguguacaaccucaaaguguuguuccucuggugcagaagaucucccugaccugaaucagugguuaggcagguuccuggccuaugaucccuagggagucuauuaugccucuccaaggcuguaauuacaaacauaugcuaucaugccugacuuuuuaacauuaguucugggaaucccaucguagguugucaugauugcauguaaagcacuguacugacugagccaacuccccaguccugguugguucuuauaauaagugcagaggaaagcucuuuaggauaguagcuguagauauaggcaaaagauagaauuuaauacacuguaguaaccuaaccuucugaucugcuggcaguuaaauccugcuaaaguuugaguauuuuaccuaggacucaggcacauggguuucuuucccuuaaaccaccacaugaaccauuuacaggcaauaagccucauuagagacacacaucuccgacaguucugcuuuccugcgugaacauggauauguauggcuguuuugggguuuuucgagacaggauuucuuuaaccagggaaccagagguuaggcuagguuucugaccuaugaccccuaggggaucugacauagaccuaaucaaggcuaaguaggccacuuagcccugugguucuuagaaaacagcuuuugcaaagugucauaauucuuacacacaaacauagauacaaaguggcuggugccuaagcaagagagacagcugaaguuguccuccagcuccuacacacuugugccgaugcaccugcacgcacgcacguacauaccuacauucauacacacaaggaaccauucaguaaacuugggaacuaagguccucaggcuaagcaguauuuaccaccugagcuaucuuaauagcuucacgugguucuuaagcuaauguaccuccaaagaccugucaugguggagcuggcuaucgcaucugcucuucuagcuccuacaaggagagucuggggagggauggcagggaagaucgcaagcuuugagauuaguggaaagauaguccgguccuucauuuccuuggccguuuuccugugugggugucuuugaggucugggcucucugccuucagaaugcacuuaguacccaguucuuuuuccucgucucuaaucucuaggucucaccuccaguacaagaacaggaugugcauuuaaagaagaugggagcacugagugcagcugagcagucgccuaccucaaccuccaaucagggcuuggccccuggugcacucuuagauccucccugugacccaggagcuggacacgguacuccuucuccucaguuccauccccuagagucacuuucuuucaucagcccaacuugcacugaaaucccacauugccccuacagccagccuccuuccuuagcgacccuuuugucuagccucuagcugugcaugcauguacuuaccaaguuucccucaagccagagcagucuccuaccucaagcauguaccacuguguaccgcuggggaccagagacaggcaguauacuaugacugucuuuaagaguucuuauguagauggcagggagucagucauauacauaaaaagaagcaaccucauaagauauuugggugaagcugggcaugguggaucacaccugucauuccaguacuucaaaagcuaaggcaagagaauuccugagagcugaaggcaagccugaacuacuuuguaaguuuugcacuagccugugcuucagauuaauacccugugugaaacaacaacaucaacaacacacauacacauacacacacacacaccagcuaccacaaacaaaagauacaucuggaugguaucugucuguaggcauaauacugucacuguaaaaggggauuauuagauaaagugcauuaugaggcagaguaaguaugggguucuggaggaacaagcaagagauuuaaccacuaaaaaguggagaauggaggcugguugcggugcuauaugccuuuaauccuagcauuuaggaggcagaagcagacagaucucugugaauuugaggucagccugauuaauauaacaagcuccaggccagccagggacacacagugagacucaguuuuuaaaaacaacaacagaggaagagggagagagaaagaaugagaaaaugagaaugaauuuguugugaucaggauguagguauguggcaggucugacagagcagugggaacugggaggugugacuaaagccgggaagaucagaagggucgcugauggagggagacagcacagagcuagguuccaacaguguuccagauggcaggaggcugacugaagagauggcugaggaguuaauggcacuggcugcucuuccaggcucaauuuccagcaccuacauggugcuucaucaccauccauaauuccaguuucauggaauccaacgccaccuucuggucugcuaccagacacacaggugaugcacagucagaugugcagacaaaacacucauacccauuacaauaaagaagauauuuuaaaggcagggguguacaucaguguuagaaguguuaaggaaauuaggcagagagaauauaguuagaaguagagcuucaggcugaagagggucuuggaaggaaccuccaguucuguuugauaaauauugccuguuguauccucugaagagcauucccagcacacuuaggaugaggucuccaggagaaagcugagagucgguguauguggaguucccuggaugccugcagaucccaccguaggcacguggaucuuagggagcugagaggggggcuugacccacugaguucaccuuucacccccagauccugcuuuucccaaaguggggaaccccagagcccaggcaguggcuacugugcuuaggauggccaggccucaggugaguggcucuguuuuucuugaguccacgucugggugugugugugucuggguugggggaauggcugggauucaccugcagaccuacccaccuaagguagcgccuuugucucuccugcuuagugcuucccuuggagcuaggcccuugcccuuggcuuuaacaguuucauuuaggacaguuuuguccucuuuaaugugucuacuacccuuuuauucugugugacuucuguacgcuuaagaacucugcuucucuggcugggguuguuucugaacaauagaagcuuaucguuccaggagacggcagugaacaaggacuauaagcaagaaaaguggaguguccugugugagacggaggugguaagagaugagcacggccuggccucucuggguaauggcucccaguaacuagccgucuguccuuuacaucacagcccagccccuguauuccuuuguuuugauuuguuuuaacuuuuuauuauuugcaagcaugaaguagauguguauaaugaacaccccugcacccgucacccaguuuaacaauagucaucauuuucuuuauuuaauggaugaucaacaguagggagcuauggguuuucucagccauaagaaggagucccuuggguucugggaguaaaggucucuguguuugagggauuaggagaauggggacccagaacagucagauuggguagugggaaaugcugguccuggagauccagcaguccaccagggccaauguggcuggacugaccauguggcuaacgcagccguaugcauggacugaccaucugacuaacggggcccguacgcauggacugaccaugugacuaacacggccguaugcagcauguuuguucccugugcuuuuccacugaaacucuuuugaauucugaaacuguccguaucauagcuucuucucagcucugacugcaccguggcuuccccuggcuccauaugcauucagcuuuagaucuuacuugcaaucaugcccuguuugggggucaggaucucccuagaaagaacucugaccaaggcagugauuagacucuccucugugcuuuagaaaucauuggcccaggccacaaaagaugcugaugacaagcuacagauaagcuagacuugagucuuucugguaccuggcccaggucuaaucgccugucaccucuugaggaauguucaguuguauaagauucccuuuauaaggccugagcccccacccugugacuggcaaacucagggcaguagccagcuuggcagaggguggacaugaagguuacuaaccuaaguauuguauaguuucacuuguuaaauacacacugggcuuggccucuuugcaucaugguuuaaaaggagccagcauuugguaucuguugauaaccaugaguggcugcugcagcuuuccccagguuuugcauuugaaucuccaaaacuguagaccaguguuuaacuguuuaauuucuuuaucaaauugcuuuugaauuauuuuauuauuauuuaagagacaagcucacaagggcauacuuuaauuuguacuucaaaucacugaugcuucuuuuaguuuuuauaggauauagaccugccuuugcccaguccaguguccuaacugcuguucccuucaacuguucugaaccaguauacaugcuccauugccacgucacauagaucagucugugcucaugucauaauguaacucagaucugucuguguucacuucacaccgucacgugagaaagucucaccccucacccccaguuuugccuucuuuauuucuugccaaccuuuccucccucucucaaccgacuuagcucugucuggccuggagcucuguguggacaaggcuggccuugaucucccagagaucuaccugguucuccucucaagagcugagauucaaagcaccaccacacauggccuaacaucuuuuuggagacauguggaacuguacaaugucaugguggagaaaaacuuaauuuagccauucacuaagaagacaguuucacaauggcuccagaagaugauauaacacugugcuacacaaucucgcuuccagucugucuccuaccuagacugcauuagcucagguuuccucuguccuugccuuuccuccccauucuccucuauggaccauuguuccucuguguuuuaauaucccugaagaagaaaggggacuauuuuuuucucugcuucucaaauguugucucauuucuuagcaauauaauaugaucuuuuuuuucagcuacaaagcaaauaaauacaugaauaguaaagaagguuuuuuuuucuuauuucuuuuggcaacagguaagaacaggauaggaaguucugaguucaguccaaagcaggacauuucuaaaggaucacauucgcuugacacauccucagagggacucuuuggaguggcacugguggaaagagcgucuggugacaucuguaaagauccuuuagcacagagggaagagcaucccucagaugaagaaggcagcggacuagaaagugauuucuuggagaaggaagauaaaaauucuacagaagacagaaaugaggaauguaaagauguaggggugcauccagaaaugcccuccaguccuguugagcaucagggagaagcaaagaggcagaaguccuaucaaugugaugaguguggcaaaguuuuuagccagagcucucgcuuccuuggacaucagagaauccacguuggagagagacccuuugaauguaacaagugugggaagaccuuucaacagauaucucagcuaguuguucaccucagaauacacacucaggaaaaaccuuaugaauguugugagucugggaagacuuacugucacaguucccaccucauucaacaccagagacuccguaauggagacaagccuuauaaaggaaaugaauguguaagagcguccauucagaguucccagcuccugguccacaagagaacccacacuggagagaaaccugaugaaucuggcgaggcauucauuuggaauaaaagucuuauucaacaucagguccuucacauuaguaagaagcucuaugaguguaaugagugugggaaagccuucuauaccaacagaaaucuuauugaccaccagagaauccacacuggggagaagccuuaugaauguauugaauguggcaaguccuucagucggaguaagugucuuacucgacaucagagccuccacacuggggaaaaaacauacaaauguagugaaugugggaaagccuuccuucagaacucucagcucauugaccacaaacgaguucauacuggugaaaagccuuuugaauguagugaaugugguaagaaauucaguuuagguaaaugccuuauucggcaccagagacuucacacuggagaaaagcccuauaaaugcagugaguguggaaaauccuucaaccaaaacucucaccucauuauacaccagagaauucacacuggugaaaaaccuuauggauguaaugagugugggaaggucuuuaguuauaguucuagccuuaugguucaucagagaacccauacuggugaaaagcccuauaaauguaaagauugcaugaaagccuuuggugacaguucacagcuuauugugcaccagaggguucacacuggugagaagccuuaugaaugugcugaaugugggaaagccuuuagucagcgguccaccuuuaaucaccaccagcgaauucacaaugucgcgaagcccucaagucggcuucaggcaguaucuuaaggcaugguuuccugagacaaaauaaagaauucugaguuaauuuguuuagaagaaggaagucgggcagugaucccagcauuugagaggcagaggcagguauaucucugaguuugaggccagucuagugcacagagugaguucugggacagccaaggguacacagagaaaccuugucuugaaaagccccccccccauaggauauuuaucuuauucucuuucaaaugagugcuuucuaucugguauucgaucaca

SEQ ID NO: 5389 - RNA, 9576 nt, Mus musculus
ugugaucgaauaccagauagaaagcacucauuugaaagagaauaagauaaauauccuauggggggggggcuuuucaagacaagguuucucuguguacccuuggcugucccagaacucacucugugcacuagacuggccucaaacucagagauauaccugccucugccucucaaaugcugggaucacugcccgacuuccuucuucuaaacaaauuaacucagaauucuuuauuuugucucaggaaaccaugccuuaagauacugccugaagccgacuugagggcuucgcgacauugugaauucgcugguggugauuaaagguggaccgcugacuaaaggcuuucccacauucagcacauucauaaggcuucucaccagugugaacccucuggugcacaauaagcugugaacugucaccaaaggcuuucaugcaaucuuuacauuuauagggcuuuucaccaguauggguucucugaugaaccauaaggcuagaacuauaacuaaagaccuucccacacucauuacauccauaagguuuuucaccagugugaauucucugguguauaaugaggugagaguuuugguugaaggauuuuccacacucacugcauuuauagggcuuuucuccagugugaagucucuggugccgaauaaggcauuuaccuaaacugaauuucuuaccacauucacuacauucaaaaggcuuuucaccaguaugaacucguuuguggucaaugagcugagaguucugaaggaaggcuuucccacauucacuacauuuguauguuuuuuccccaguguggaggcucugaugucgaguaagacacuuacuccgacugaaggacuugccacauucaauacauucauaaggcuucuccccaguguggauucucugguggucaauaagauuucuguugguauagaaggcuuucccacacucauuacacucauagagcuucuuacuaaugugaaggaccugauguugaauaagacuuuuauuccaaaugaaugccucgccagauucaucagguuucucuccaguguggguucucuuguggaccaggagcugggaacucugaauggacgcucuuacacauucauuuccuuuauaaggcuugucuccauuacggagucucugguguugaaugaggugggaacugugacaguaagucuucccagacucacaacauucauaagguuuuuccugaguguguauucugaggugaacaacuagcugagauaucuguugaaaggucuucccacacuuguuacauucaaagggucucucuccaacguggauucucugauguccaaggaagcgagagcucuggcuaaaaacuuugccacacucaucacauugauaggacuucugccucuuugcuucucccugaugcucaacaggacuggagggcauuucuggaugcaccccuacaucuuuacauuccucauuucugucuucuguagaauuuuuaucuuccuucuccaagaaaucacuuucuaguccgcugccuucuucaucugagggaugcucuucccucugugcuaaaggaucuuuacagaugucaccagacgcucuuuccaccagugccacuccaaagagucccucugaggaugugucaagcgaaugugauccuuuagaaauguccugcuuuggacugaacucagaacuuccuauccuguucuuaccuguugccaaaagaaauaagaaaaaaaaaccuucuuuacuauucauguauuuauuugcuuuguagcugaaaaaaaagaucauauuauauugcuaagaaaugagacaacauuugagaagcagagaaaaaaauaguccccuuucuucuucagggauauuaaaacacagaggaacaaugguccauagaggagaauggggaggaaaggcaaggacagaggaaaccugagcuaaugcagucuagguaggagacagacuggaagcgagauuguguagcacaguguuauaucaucuucuggagccauugugaaacugucuucuuagugaauggcuaaauuaaguuuuucuccaccaugacauuguacaguuccacaugucuccaaaaagauguuaggccaugugugguggugcuuugaaucucagcucuugagaggagaaccagguagaucucugggagaucaaggccagccuuguccacacagagcuccaggccagacagagcuaagucgguugagagagggaggaaagguuggcaagaaauaaagaaggcaaaacugggggugaggggugagacuuucucacgugacggugugaagugaacacagacagaucugaguuacauuaugacaugagcacagacugaucuaugugacguggcaauggagcauguauacugguucagaacaguugaagggaacagcaguuaggacacuggacugggcaaaggcaggucuauauccuauaaaaacuaaaagaagcaucagugauuugaaguacaaauuaaaguaugcccuugugagcuugucucuuaaauaauaauaaaauaauucaaaagcaauuugauaaagaaauuaaacaguuaaacacuggucuacaguuuuggagauucaaaugcaaaaccuggggaaagcugcagcagccacucaugguuaucaacagauaccaaaugcuggcuccuuuuaaaccaugaugcaaagaggccaagcccaguguguauuuaacaagugaaacuauacaauacuuagguuaguaaccuucauguccacccucugccaagcuggcuacugcccugaguuugccagucacagggugggggcucaggccuuauaaagggaaucuuauacaacugaacauuccucaagaggugacaggcgauuagaccugggccagguaccagaaagacucaagucuagcuuaucuguagcuugucaucagcaucuuuuguggccugggccaaugauuucuaaagcacagaggagagucuaaucacugccuuggucagaguucuuucuagggagauccugacccccaaacagggcaugauugcaaguaagaucuaaagcugaaugcauauggagccaggggaagccacggugcagucagagcugagaagaagcuaugauacggacaguuucagaauucaaaagaguuucaguggaaaagcacagggaacaaacaugcugcauacggccguguuagucacauggucaguccaugcguacgggccccguuagucagauggucaguccaugcauacggcugcguuagccacauggucaguccagccacauuggcccugguggacugcuggaucuccaggaccagcauuucccacuacccaaucugacuguucuggguccccauucuccuaaucccucaaacacagagaccuuuacucccagaacccaagggacuccuucuuauggcugagaaaacccauagcucccuacuguugaucauccauuaaauaaagaaaaugaugacuauuguuaaacugggugacgggugcagggguguucauuauacacaucuacuucaugcuugcaaauaauaaaaaguuaaaacaaaucaaaacaaaggaauacaggggcugggcugugauguaaaggacagacggcuaguuacugggagccauuacccagagaggccaggccgugcucaucucuuaccaccuccgucucacacaggacacuccacuuuucuugcuuauaguccuuguucacugccgucuccuggaacgauaagcuucuauuguucagaaacaaccccagccagagaagcagaguucuuaagcguacagaagucacacagaauaaaaggguaguagacacauuaaagaggacaaaacuguccuaaaugaaacuguuaaagccaagggcaagggccuagcuccaagggaagcacuaagcaggagagacaaaggcgcuaccuuagguggguaggucugcaggugaaucccagccauucccccaacccagacacacacacacccagacguggacucaagaaaaacagagccacucaccugaggccuggccauccuaagcacaguagccacugccugggcucugggguuccccacuuugggaaaagcaggaucugggggugaaaggugaacucagugggucaagccccccucucagcucccuaagauccacgugccuacggugggaucugcaggcauccagggaacuccacauacaccgacucucagcuuucuccuggagaccucauccuaagugugcugggaaugcucuucagaggauacaacaggcaauauuuaucaaacagaacuggagguuccuuccaagacccucuucagccugaagcucuacuucuaacuauauucucucugccuaauuuccuuaacacuucuaacacugauguacaccccugccuuuaaaauaucuucuuuauuguaauggguaugaguguuuugucugcacaucugacugugcaucaccugugugucugguagcagaccagaagguggcguuggauuccaugaaacuggaauuauggauggugaugaagcaccauguaggugcuggaaauugagccuggaagagcagccagugccauuaacuccucagccaucucuucagucagccuccugccaucuggaacacuguuggaaccuagcucugugcugucucccuccaucagcgacccuucugaucuucccggcuuuagucacaccucccaguucccacugcucugucagaccugccacauaccuacauccugaucacaacaaauucauucucauuuucucauucuuucucucucccucuuccucuguuguuguuuuuaaaaacugagucucacugugugucccuggcuggccuggagcuuguuauauuaaucaggcugaccucaaauucacagagaucugucugcuucugccuccuaaaugcuaggauuaaaggcauauagcaccgcaaccagccuccauucuccacuuuuuagugguuaaaucucuugcuuguuccuccagaaccccauacuuacucugccucauaaugcacuuuaucuaauaauccccuuuuacagugacaguauuaugccuacagacagauaccauccagauguaucuuuuguuugugguagcugguguguguguguguauguguauguguguuguugauguuguuguuucacacaggguauuaaucugaagcacaggcuagugcaaaacuuacaaaguaguucaggcuugccuucagcucucaggaauucucuugccuuagcuuuugaaguacuggaaugacaggugugauccaccaugcccagcuucacccaaauaucuuaugagguugcuucuuuuuauguauaugacugacucccugccaucuacauaagaacucuuaaagacagucauaguauacugccugucucugguccccagcgguacacagugguacaugcuugagguaggagacugcucuggcuugagggaaacuugguaaguacaugcaugcacagcuagaggcuagacaaaagggucgcuaaggaaggaggcuggcuguaggggcaaugugggauuucagugcaaguugggcugaugaaagaaagugacucuaggggauggaacugaggagaaggaguaccguguccagcuccugggucacagggaggaucuaagagugcaccaggggccaagcccugauuggagguugagguaggcgacugcucagcugcacucagugcucccaucuucuuuaaaugcacauccuguucuuguacuggaggugagaccuagagauuagagacgaggaaaaagaacuggguacuaagugcauucugaaggcagagagcccagaccucaaagacacccacacaggaaaacggccaaggaaaugaaggaccggacuaucuuuccacuaaucucaaagcuugcgaucuucccugccaucccuccccagacucuccuuguaggagcuagaagagcagaugcgauagccagcuccaccaugacaggucuuuggagguacauuagcuuaagaaccacgugaagcuauuaagauagcucaggugguaaauacugcuuagccugaggaccuuaguucccaaguuuacugaaugguuccuuguguguaugaauguagguauguacgugcgugcgugcaggugcaucggcacaaguguguaggagcuggaggacaacuucagcugucucucuugcuuaggcaccagccacuuuguaucuauguuuguguguaagaauuaugacacuuugcaaaagcuguuuucuaagaaccacagggcuaaguggccuacuuagccuugauuaggucuaugucagauccccuaggggucauaggucagaaaccuagccuaaccucugguucccugguuaaagaaauccugucucgaaaaaccccaaaacagccauacauauccauguucacgcaggaaagcagaacugucggagaugugugucucuaaugaggcuuauugccuguaaaugguucauguggugguuuaagggaaagaaacccaugugccugaguccuagguaaaauacucaaacuuuagcaggauuuaacugccagcagaucagaagguuagguuacuacaguguauuaaauucuaucuuuugccuauaucuacagcuacuauccuaaagagcuuuccucugcacuuauuauaagaaccaaccaggacuggggaguuggcucagucaguacagugcuuuacaugcaaucaugacaaccuacgaugggauucccagaacuaauguuaaaaagucaggcaugauagcauauguuuguaauuacagccuuggagaggcauaauagacucccuagggaucauaggccaggaaccugccuaaccacugauucaggucagggagaucuucugcaccagaggaacaacacuuugagguuguacacaccccugcacaugcaccuccccuccacagaaacacaccugacuuagaccuuggcuuguaugacccccacgggcucauagauuugaaugcguagucaccagggaguagugcuacuuaaaagguuagauaaggugccacuggggugggcuuugaaguuucucagucucucagucucucaguuucucucucucucucucucucucucucucucucugucaggauauagagcucacggcuacuucuccaguacuacauaaaucuaugagcuaccaagcucccugccauaagggucuaacaucuacaaacuggaagcaaggccauaauuaaauguuuuuauaagaguugcuuuggucacagugucucugcagcaauaaaacagugacuaagagugcugggauuuguguuucugcuauggcuuauagcagaaaacuauuuuccaucuaucaguggagcaaguucaggaauccuaaaggcaaaccaggcaaaaguguggggaauggugaauacuugcucucaggcuagcccaaguuuagagaguggcucuagauguuccuauagacugacugcuuaccuccccugacucacuaaggugucucuggaaauccuccaccauagccacagcuuccucgccagucucagggugauggagcuguacccaggucugaagcucccugggcaggaugcucaggaacugcuccagcaccagcaguuccaggaucuguuccuugguguggaccucuggcaucagccaccaguggcagagcucccugagccggcucagggcuugcugaggcccagacaucucaugguagcacaacugccugaagugcagucggaauauuucacagacgggaagguaguucuucuguccccaugucuggcuuccugguuccugcuucacagucaaguuccccuccugcuucugauacauggcaguccuggggaugauaucuaaugucccccugccuuccauggucauugugaucccaaaagagaagcugguuccagcuacagcaggcacacugaaaaugagucucugcuucaaacugcgggggcuguuuuuucagagucaagaaaggaagugaggaaagugucaccuacagaaacacaaagagaaugaucagaguccuggagcaccuagcucuuagcugguaacagguucugcagcuagaagcaaagccuccggggaagagaagaguacaaacacagaaaugacuccaagugacuucccuuuucaaacuauuaguggcuccagucaccugcaggauaaaagcuaacugaaugucuaggcuuagcuuucacagucuuucacauacaccuccaaccauuucccccaaguacccaaauuaaaaggacaucaauggccuccaaagcaggguauacaaggaaacuggauguuaaagaaaauacuaaaugauuuaacuauuuaauauguccuguaguaagcacugaaauucaaauaggauuuaucuuuaauuuuuucauaaacuugugcugggaguggaggcucaaaacucagcugguaaagauguacuaaaguuuggggcuaacacuuuacaaauaaggggguggggaccacacuuuaccugucugcaccuucccuguuuuuucccgucauuucugacaaacucuuaaucaagugucaagacuccgaauaaauaacaccucucuugaaggauauuuuccugcuuuccccagauauaaaacaauggcucauuucccuugcuguaccucauacuauaacaguguacuucaacuguuuaugaggaacucaccagucauggccucuaaacuacuggagggucacccaaagggaggaacuaguauuaaaacuuuuggaagucuuuucuacuuaacuuggaacuuaacuuuaacuuucuggucucuccgggcauaccacuguuuauagcuucaguaaucccacggacuacucuccacccauaacucuguuggaucacuucucuuaaugcaauuguuugcaguuuacucagggcucuguuuccugcgaagauucaaaaggcaggacugcuucccaguccugcacgcgugcauauguguuacacagggagagagauauguuacacgaaugugguuaguuuaguggacaaaauuugggaaaagccauuuuccuuuccguuuaugcaugccauuugaaaaccagauccucuggggcaacuaggaugugugccgugguuugagauaucagauaucaggcacuggagaccccaggguuagacauuuuccucugagccuguuuuguuuuguuuuguuuuguuuuguuuuuaagacagauggaguaaucugugaacucuccgagaguacacaagagcacaggacacuuuccugcgguccuuacugugccgagugcuaagcggcaggucucgcugcacgucuaaucugcgagcucgcguggggcucacuccagagucacgguccugccucgguagccgcucaccuggccgcgucugccccgugcagcgcugacgcacgggagccaacaacucgagccgaccccaagccgagcgaccacaacacgaggacgacgcggcuccgccucggguaagcaccccggcaccgcccgcgucgcggcccgagugcgggccgcacuuuccaccgcgucgccaccgucaugcgugacggcucaacggccccacacaccuccaggacacuaggaaauggcaacgacggcgggacgggaagcaugagagcaucacuuccgg

SEQ ID NO: 5390 - RNA, 67690 nt, Mus musculus
uccguuggggcgccaaauucaaaucugcggccaucuugaagggaggauucuggugguccuggcguaagcgaaucucggacggggucgccauggcccccggcugcaaauguaaguugcgagccugccuggugaacucaucgccgcuggcagaugccggugcuacggggcgucaccucuuagggcgccccgcgagggcgacgacggcacacgcagugggaacccgaguuccucacggagcgcgggcgucccgccucggccacccuacacccgagcgcucuucucugugcaugggacccugcuguuuccuugcuggcuucugguguccugagggcggcccuugcgcugcacuugaugcuugauuaccuauuucugccuuuuuugaagggaagggauuuguguucccuucgguggccuacccucagaggagggaacuuuaaagcgaauugcaacggucccuuuacaacaguucccauucuucaugcaagacuucaugaguuccugaaaccagaacuguaucuuaguacagaacccuauagauaaugugcucuguaaacuaaguguacuaagauuagcuaauacuaaaauaccucaauuauaguaauagacaguaauaguuauuugaaaguagucuuugccucaauuauaguaauagacaguaauaguuauuugaaaguagucuuugacauagugucuuauuauaccggucuuuuauccuaugagauucuacggugucuacuugcugagagaaauucuguagacaguaugacagaguuaguauccaaaagucacuugaacacaagcauugugauauagccacuugaucuaauaacaaauggcugagacuguuaggagaguaguguuuauaguaccuggcuaaaaagaguuguguagcaugaggcuuuauauugagaccuuguuuaaaaaaaaaaaaaaaaaaaggcuuagaaauuguuucauucugaauuuucuauuuaguuguuuuagauugugauugauggcugaggaaaaaaacauagaaaaaagaagugcagauuaugaguagacuaauauauauauuaaucuguuuucaucacaaagagauugauuuaaucccccacuuccaacguauaugagugccaccucuuauauugccuauuaucuuucuuaaauuauuuuuaauuauugguguguaugugagugcacaugcauguguauaugugugcacagcugcgaguguaguuuguguguagguugcuugugugggugaagauggccguggagugguuggauacucuagagcuagcauuaugagugguugugagcuucugaauaugggugcuggcaugugugguuuuuuuuuuuuuccuuuguuuuucggcugauuauaagauuugagaauaaaaugagauacuugagaaaauugugaaauuauacauuugaaauuuacaauaguguucauguuuguagcucuuugucaauuguuauuguuuccugaugaauuguuuuaguaacccuuuaagucuauuacacugauauuugaacagcucugugugaucuuuuccucuauuuaaaguagccugucuccucuaccucuucagcaguaagagaauuuaagcguacaaacuaguacaugauagagcuuaaauucuuuuuaaaaucuaggcucgucuuaagguuucugugaagccagacagggccuggagcuucugauccucaggauuucaccucccaagugcuaggacagcgauagccuuguagucagucaguaacuccuucggccucagccagucuucugauuucuacccucaccgauuaguuuuaccuauucuugaagcucaugagcaugguacauauauucuuuuucuuguuguaguaacuguccugacacuuugugccugugggcacaugauaggcagcagcagcuaucacugcuguuuaguguuguacuagguaagcauguuacaacuuguucuccuuuugauugcccuuuaguucacucuuuuuuuuuuuugaacuuggguuucuaaguugaauuaucaugaguaaaacaccuaugaauaguguuuaacauguuucuaggcagacacaaaaaugaccucaaaguugaaaaagauguacagugaauguauacagaggauuuccuuguaaagccacaacuuuaugauagccucauaauaagacuuuauacuuuaaccuugggucaacagauaguauagugagguggcugaugguaggaaauaagaauuccagaaugccuguguucaaguccuagcauuucucaauacaucuuuucagguuucaggaauuauaccagagcugccuacuucucugaaguuuguuugcuuguuuguuuguuuuuuaagacaaaaucucugcauaguuuccgacauccugguacuugguuuauaaaccagacugaccucuaacucugagauccuccuuccucugccucugagguggucaguuucaagccaugcaccagaggccucuucccugaaacucuucacuguugggguggaggguuaaacguuuucuuucgugacucuuuguaacucaacacaaacauguacacacaugccuauuuguugggguaacauguuuuguauacugugaaggcauguccugucucuccuuuccugccuagcucuaggacaucaucagcucuuuauuaaagccaaccagugaacgccuuagguuaagugaggaagggcagagacauaccuuucacagcauacaaaacauuaucccagcuucucccccuuuaacaucugaucacuuaaggaggucucugcagauccagaguggguucucuuccugcacuucuccaguuuucgucccacggaaucuagcugcauuuacuuuuccaaacucugaaccauuucuccucagcucagccagauaagcaagcucucuguggacucuccaccuuuacugugccuugugauccagagucacuuuacuuuguugucuguuguccaguguugaggacuuguugcauauuuuugguccaguuuccuaguuacuuaaguaaauccaguuuuugcuacuccaucauggcugacugaugauugauugaaaucaauuugaaauugaaauaaaauagaaaccaaauugaaauugauugaacuccuucuguucauaaggacaagcaacaagaugaucugagauuucagcugucauaacacgaacugauauauauauauauauauauauauauauauauauacacacacacacacacacacacauacugucucuuugucaccaacauuugagaggacugugaaaggugcuguagggcuguggggcggggugguuugguaggcuuguuuguuuucuacuucacagguguuggguuaagguauagguggaaguauaaucuccagaaaucaaguucugugauaacauuuugcuuuuaauuuuugugugaacagaacagaauccuuauuguccuagucucgaucaucagagauuuuugugugcuuacuaugaaucagguacuuuagguaugcuuuauaaagcagaagaauaaugcuuauuaugauagccaagaaagggcacugagagagauacugugcaugaggcgggguagcagagaggcuggcaguuugugucugugggcuccacaucugcucaucaguacacaggaaauauucaggacaaaauacauccaucuguauagaauauguacagaauuguuuucuagucauucucuaaauaauacaacugaguacuucguaacauuuauaccauauuagguauuauaaguaaucugaaauuuuuuuuuuuuuuuuuuuuuuuuuugguuuuucaagacaggguuucucuguguaguccuggcuguccuggaacucacuuuguagaccagacuggccucgaacucagaaaucugaacucagaaaucugccugucucugccugcugagugcugggauuaaaggugugugccaccacugcccagcuuuggagaucuuuuaacauauacaagaggauguuuauggaaugacaaccauuuuaaacauccacagaauuguuagguaucuggagucaugaaguaaaucuguugcuaacaaaggauuauauaugcuauuacauagugugguuggggaaugccuuauuuagaagauaauauuugagggcuggaaagauggcuuuauuugauuaaaacacuuaccaccuagccugauuaccugaguuccaugcccaggacccacauaguagaagaaaagaauggacuccugucacuuguccucugacccucucuacacacacaaaauaaauaaaucgguagauaaauagauaaagauuagagaaagauuuaauagauuaaauguuuaaaaauuguguuuugccuucauaguguauguuuaucucuguguuggaaugacuugcucaccugucugacuggauuucagucuccucaguagaugcuucuuuguuugcucuuugccuucggaagcuuuuguagagguguuauccccugugccugguugaucaguuuccaggcuguggucauacuguccaucucuaaccuauuuauuuugccccucuuuugccugcuagguuaacaugacauuugauggggcuagggcaguaaagaaggagggagacuuguaauaacccacauaaaaaauaauuguuuauucucuggugguggcaguggauuuugaaccuagaaucaaguguuuacugaaagguuuuauuaagagugaggaagaauggaguuguggugggaccagcccuggugggucuuuuuucuuguuugguucuugagacauuggaaggggaagagcaucggcagggguaagacuuggucuugcaagauauuuaagguugcuguauaacaaugaaacauuuuccuaucuuaaaucuaagucagucauuuagcugugguagcuauccugccagucugaguuccucugacaagagaaucaguuuagcaccucauccuaaaacagcaggagauuaaguaaaguagucuuugaucuaucucugaaggaauuuugagguucuaacuuucagccugcuaauugaagucccaggaagaaaaagggacaguuugaaaagugauuuuggagagagcucagcgguuaagagcacugacugcucuuccagagguccugaguucaguucccagcaaccacaugugguucacaacuaccuguaauaggaucugaugcccucuucugguguaucuaaaggcagcuacagugugugugugugugugugugugugugugugugugaaaagaaaagaaaaagugauuuuagcaauuauuucuaaguuguaaaaaauuuccuauggccgggcauggugguacacgcuuuaauaccaguacuugggaggcagaggcaggcuaauuucugaguucaaggccagccuggucuacagagugaguucuaggacagccagggcuacacagagaaacccugucucgaaaaaacaaaacaaaaagcaauuccuaugcaagcucucuaagaaaagggggaaagggcuuauaacaaaaaggaggaugugggucuaagaaaaaagggcauaagcagaaucuaagaaaagcagguugaggaaaaugcaagaagggagggauagggagagugugagcuuucuuuucuuuguccucaguacuuauacaucuaucagaauacaugaucacaugguuaaacaucacaaguuuacacauaaauucauaucauaaaucaaauaaauuuacaacagagacugcuuauauguauauccauuaggaguaauuaucuggcuaaacauucaucaccugucacaagcuuugcagguucauggagaguuuaaaaauccuaauuuaugugaccaagguauuagugaacuuuguauagauaaacccagucaauauuuuauaugguaaauuguuaguuccuuucuaaugaccuuugguuaaugguuuuacaaccucuuggaguguucuaaguugcagaaugccugcuuacuaucucagaagcaaauaucucauggcacuaaagacugguagaguugucauugcaguuuugacauuagaaaggacuuaauaacuguuauuaaaagaguuuaauaaugcuauaaauuuaggaauucuuacaggaucaucauuaaguauuaagaaaucuauuuuucuaccuagcaucacucacuacaagacaguacaucuucguucugcagagaucugcucaaauggaugggcugauauguagugauugcuguauauguguaauaauaacaggaaaggcauauuaauagcaggaaucuuuccuaaaaugaauuucuccucggcuuugccuaccagaacaaaauccaucauggauuacaauccaaagcagaccaucucaggaagaucaucugcuaguuucuagcuucucuuaugacggcuccugacaguuguuuuuaguacuagagcaacagcucugacagaucuaaugggcuaauguugccuaccagucucuagagugccaacagaauagacaugucauaguaaaaaccuaagaaagauuauucaauaugaccucacaggaccucagacagaucugcugacucucaaguuccaguuugcaguccuaacauuaaguuuaguuucccuuucauuagaggguaacagauacuuauaacaaaguaagaucugguuccauccauuggcccaucacugucuggguucuggccuguccuauaggguguucugaccacagaauucuggagucucuuuggauggucccuuuuuccagcaugccuagacccuuagaaaaauuuuaagauuuuagaggauggaggggaagagggagaccauuguuucaguaaucugauagcagaagugccuaugauuagaauaagacuggauucuguggucuuaggcccgagaaaagaaagauagaguugucauuugcugaaaugaagcaguguuacugggcacuuaugucuauacccucugccucagucuuucugccuuccaaaagaaauuagagacuagaaauugguaagagauacugauauauuuacaguuuggccaagauauguauuguaaaagagggaaucuaauuuccuucacauugugccuuuggcgguauugagauuuauagcuuugagauccagauugcaagauaugcagauucauaucauauucauaucaugcauauucauaucagauucagcugggagauaguuucauggguccuuuccuuguugaguggaugggaccucagguuucucccauugucuggauucccacuuucacggaaugucuccauuuucacauuguaaagauagcacaggugucuaggauuuagacuucuguccuauagcuccagcuauucugucucagcauggaaccauggaaucaugggaucaugcuuauagcagcacauuugcaaugggaaagagaacucaguuuuggauacauuaaguuugaaacauugccuaccuaaccucaauauggagauuaucaaguacguaguuuuaaucccaggauucuggaggcagacaggugaauuucuguuaauucuguuaauuucuggacaauuagagcuaucgagacccuguuuaauuaaugaaucaacuuggaaaucaucaauauguaccuagcauuuaaacuugugagaccaaauauugucaccaauauaaugggcugagauagagugggaggauaauugaggccaaggccuagaugugagugucagggaucugagaaugcugaggagcaguguaagcauccaaagacaugguuuccguuaugaagcucuuuuuccuugguuggucaccuagccuaggacuagaaguuuuauaguaguugaaggggaagugacuugucuugugcaauuuguguaggguccauauuggaagaggugaguaguaaucucacugucuuaggaacaaggaaacuuuacaauauaaguaauuuuucuuaggacuggccauuuguucgaguauaguguuagucaugagcugacucuagaugucuauguaagcuaugguaagauacugcggucaggcuccaaagacuuguggccugauugcugugaugaggguuuuugcauuuaucuuuguccuuuuauccuuauagaucccuuaucuuuuuuuuuuuuuuuuuuuucuuccuagcugaguuacggaaugugacaaauucucauucuaaccagccaagguaagaaaacgucuugcugaugagcauggaaaaauuaggauauagucugucuuucuuuccuucuuuccuucuuucuuucuuucuuucuuucuuucuucuaagauuuauuuauuuuauacaugugacuacacugucacuaucuucagaaacaccagaagagggcaucagaucccauuacagaugauugugaccccccccccccaaugugguuucugggaauugaacucagaaccucuggaagagcaaucagugcuauuaacugcugaaccauuuuagcauguauucaaccagcugaaaguagaggaaaauugcaugccucccguaccuucccaauucccagugacuuacaaagucaauugcaaagacuuacuaguacuagaaagagggaaaugauagaaaucagugcguggagcuucuugaaauaacuauuuuugauuuuauuuaagguaaaaguuuguagugauaucucuugggaaauaaaucuguaaagguugugagcuuugugaagauuuuaaagggguaaauuucaguagaguaggucuaguauuuggacucauuauagaaauauuacaggcaagcugagauucuggugauuuucagcuucuuuccccaggaaacuuaccuguuacuuuuguuuugguccuuaguaaugaaggugacgcuaucaaaguuuuugugcgaauucguccugcugaagagggcgccagaucagcggauggagagcagagcuuuugcuuaucugugcucucccagaccacucuccggcuacacuccaacccagaccccaagacuuuuguauuugauuauguugcaggcauggacaccacucagguacucagcacuggaaacuuggccuuucauuugaaauauguaauguagggguucaauuugucacuuuuuagcuuggcagauuucagauaagaaagcuauaaaacauuccauaaauuuuuuugaaagaguuuguauuuuauuacuggacaaacacccuaauuuaagacaugagcaagucuccagguuaaaaauguugaaauccgucugguaggacugguugaugacuacucaguauaaauccucagucuugccacugugugaauccuuacagacccagcuucguucuccuccagugucuucucuuauagacugguacugauuuuguuaccaguuuucaucuggauccacugaggaauaggaugauuuugcuucuguuucuuggccaggaaucgcuugauucugaaagucuugugagaagccaaucaggcguagugcguacuauggcaaauaaauaauuagaacuaaauaaaguuuaaauuucaguuccuuggcuccauuagccacauaaggugcuuaagcauuuggaauauggcuaauauguugaaugaacaaaguuacagagucacauguuguuaauggcuacuggaucagacagcauaggucuuuaauuuuuuuuccuuuguaauagggucuuauguaucccagacuauccugcauuauacuguguagccaaagaugaccucagacuucagaucugcuugccuccaacccgagugccgagauuacaggcauuuacuaugaugccugauauaugccauucuggagauugaauccaggacuuuguguacuaggaagcacuagcaagcacucugcuaaaugaacuccauccccagccccucacaagucuuuacuauacacaugagauuuuguuuguuucaaaaaauuuuuagaucuguuuucuuuucagcuagaaaauugcuagucaauagaaauauaaaaugagcuacacuuaucauuuaaaaauaucuuuuuuguuuguuuguuuagucgauugguuguuuuuuuuuuuugagacagaguuucucuguguguagucuuagcuauccuggaacucacucuguaaaccagguuguccuugaacucagagauccuccugccucucccuccuaauuccugggauuaaagaugugaguuaaccaccacccagcugaaacuggauucuuaggguuccuggaaaugacaauggcaaaauauacuccaggucaaggagaauuuaguaagcuguuccuuccuuccacucuguucuaucaagaucccagccuuauucaaggugggccuuccccauucaguugcauauacacaucccauuccuuucugaaagacaggcaagguagccugugucgguaagcccagcacuaagaagccaaaggcagauggaucgaugacagccucagcuacauaaccaguuccaggaauacaagauuccaaaaccuaaaguaucuuaauagacauaguggcagaaaaaagaaaccaguaaaauuaauuauggucauagauauuauuuaacucaguguccagaauaccacuuuaauauguaauuaauauaaacuauuuuuaagaucuuuuucauucuuguuaauucagucuuccaaaucuccuauauaauuuaaacuuauacaauaugccuauuucaacuuguaaucuaaauuggccucucaauagccacauguagcuuauggacauuguagguuuaagaauucuuuuguuguugauaaacugugucuauaaguaaaaauaaaauaaaaauacuuucaguacaaacuagugacaaaauaagugaagaaaauauagagcuauggaguuuaugcuaacagugaauaauauuuguauauaauauauagaaucugucugaaauucagaugaaugcauuuaaauuuuuucuuuuagucccccguccucuccccccccccccccccccccccuugagacaggguuucucuguguagcccuggcuauucuggaacucuguuuguagaccaggcuugccucccgagugcugggauuaaagguguguaccaucacaccuggcuagauuuauuuuauauguauugaguguuuugccuacauguaugcuuauaugugccaugugaaugccugguguccuuggaagaccuuaagugucagaugcucuggaacuggagucauggauggugguaaaucaccaugugcauuuugggaaucaaacacagguccuauacaagagcaaugaguguucuuaaucacuacacuaacuuuccagccccaugugcauuaaaaaaucauugcugcucuucuaaagguccugaguucaaaauuccagcaaccacaugguggcucacaaccaucuguaaugagaucugacgcccucuucuggagugucugaagacagcuacacugcacuuacagauaaauaaauaaauaaauaaauaaauaaauagaacuagaguuacagacacaauuaugagucugcuauauggguuccaagauucaaacuaggguccucuggaagaagagcagccaguagugcuccuaaccacugagcuucgucucuaaucaucugcuugcauuuuuuuuuuccccugaggcggggucuuacuauguaacucuugcuaccuaggaacuuagguaguccaggcuggucuugaacuccugccugccucugccuuccaagugcugggguuaaagacauuuauccccacuaugcccugcuuuccuuucuuuucuuuucuuuucuuuucuuuucuuuucuuuucagauaauuuuuuuuuuuuuacuaaaaaauuuaaaaugacuuggagauagcauagucauuaaaguauuaaggauccucuuucaaucccuagauccuguguguaaacaaagccagauuugguggccuacacuugugaccccaauggugggaaggcagagacagggaucagugggacucacuggucagccugccuagucuacuuguugaguauacuuccucucaaaaucaaaacaagucaaaacaaaaaaacuacccuggauagcaucugaggaacaauagucaaggugucauuugcacaaccccccuacauaugcacacauauauaucuaucuauaguauaucuauaucuauagauagauagauacccccaaagaagugaaauauaacuguaaacaauaucaacacuuuagaaauaguaaaacuguuauauuauagaaauugauaagguuaaaacaauacgguugacauuauuauuagguuucucaggugcugucaaguggucagguuugugaccauucccuggucauguugcuccaaagcaauagacaugcuaaaaucuaugauuauauuggagauuauuugaccucaugauauuuguaauuuuaccuuuuaucaucauaugugguuuagccauuuuccuaaaguagauguaaccuuuaagcaguuauaggucuuaaagucuaagcacuuaguuuuuaugauaugagauauagguuagaaguauuuuuauuuaauauguuuggugcuuauauuuguaggagucuguauucucaacaguggcuaaaagcauuguggaaucaugcaugagcgguuauaaugggaccaucuuugcauaguaaguuguuaacuaucucuauauaaaaguaugacaguacuuguauuaguuccuauuuguugcugguuuaauaaaucacccaaacuuaguggcauaaauaacagauguaucagguucaucaugagccucacugaacugaguuuaugcuguuacuggugcuccauccuuuccggaagcuguauaggaaaauauuuccuuccuuuccuagcuucuagggaccauucaucuuccuuggcucagagccccuuucucuguuuugaagcuaauaguucaguaauccaaugguauauuuuguuccuaguuuguuccaucuuugaucuuugagguuucucuguugcuuugacauauucuguccuuuguuuuugagcauuuccuuacuuuaucaggcugcaugacaugccaagcucuuauauguugucuauccuaguucuagaaucauuaaaaccauggcuucuuuuguuggaaaaugguaaugagcagcugagagaucugaaaguucuguaucauccacucauguagauauuaugcuaacccuggguuuauacugaugucuagcacuaauccagugaccacaggguuuauucuagucugucuuucuuguuuaguuauuuaccuuugcuguugguguuaaaccuuuuacuuuuacugucuguuauccacuuacuaacuuggucaacucugguuacauguaaagcagugucagaguuaaaauguaucacugugagaaaaauauuaacuguuaaguauuuagauacaauucuuuuuuuuuuuuuuuuuuuuuuuuuuaugugcuuuucaguaucgugaaaacuagucuugagggauaaagcuuucggaccauuccagcucagcaggccucuggacccucuucugaaguguccucagcauggugccuaccucuaggggaaagccaagggaaacagcaauaagauguauauuuugggaguaucuuagacagcacuggccaacaacucaaaagagggauucacuugucuguuacugggauuuuuguuggguagucuuuggcccagaugagaaguuuauuaaaauuuuauagguacaugugugcauauauauuuuaaaaauaauuaauaguaugauuccuuaugacuuuuucagacauccuuauuguuauuuuaguuuguucgcuccuuccuuauuugccuucaccccuuccccacagagcccccccuuucccauuuuccuggucagaucacuuuacccuguuacuaccucucucuggccccuaacgcccuauccugacaaugggccuguuuuauuucccugguugcugcuggguaugugcucacaucuaaagguuuggagccaggacccuuuaaaugguuucuuuuacaggaugaaauacaaaacuguuuuaucauguguucucaaagcagcaagaauuuuuuccauagauuauuugaaugaugaaauucaaaaugauuuugaaauugccacaggcuaucuguauaucuucagagauauuuucuuuggagacucuguagacugccuugcuugcuugcuugcuugcuugcuuauuuauuuguuuaucuguuuuccuguugauugacugacugauugaugauugauugaaagcaucucacugugcaucucuggcuauccugaaacuuugauauagaccaggaaaaacucacagaacugugcuugccucugccuccugagugcugggauuaaagacauguaccgcuaugcucagcuuuguaguaauauuuaaucuaagguacauucauuaauauauuaauucagauuucuuuuuauguuuguggguagaacuuggagaugaaugagugauguauuaguuggguggucauacagaucucagagaucugccuguuucugcuuuaugcugggauuaaaggcauuuuccaccgugugaaacccuuaaacuuauuuuaaaacaaagacauuuuaauguuuuuucaaggcaaagaacuucaaaauuaguacauuauuuagcaaaauuuaaaaacagaagucuaauugauugugguugaauaaauuauaagguucuguauccauaaaauacuauuguagcuauuuauaaaaaaaugaggcagcauacaccuuuaaccccagcacucaggaggaagagggaggaagauggucuacaaaaaaaugaauuccaggauagcuaggaccauuaaacagagaaacccugucucaaaaaaacaacaaaaacaaaacaaaacaaaaaaccaaaaaagguaggcaccagauuacugacugauugaucugaggugcuauuaagggagaagaaggcugccgagcagucuggagaggauccucccauuguauucuagcagaccauauuaaauuagaaggguagucucaauuuuaugugugaaaauaacacaaaauuuucuuuuuacagugggcagacuggcucugggaagacauuuacuaugauggguaaguaaagaccaguguuugcugucuaaaugcacuuuguauggugaccacuuggaacauguuuuagggaaggcauuauuucuuugugugauguugcacccauaaaaauagggauguugcccauguuucuaccagcuugugaguuccuggacagucuaguuaauccuuauuauaucuguguucuuuagcucaaugcuuggcacagacuaaguauagauuggguguuagacacaauuuuucagugugugugcgcaagugugcacaugugcucgaguggaugcauauauaaacacuaccaagguccagauuccuggucuaugacuccuaccccaucccccaaagcagcugaugauucuuauccuuaugagguuucuugcuuuggaaugucuacaaauaaaauuauaccaaaaaauaauauaucuaaaguuauuuuccuaacuccuaugccugcuucccuccuuucuuuauuucuuuuuuuggggagugggaggugggggugggauggggagagacagaaucucaccauguaggccuagcuguucaggaacuugcuauauaaacaggucuaccuugaagucacauucacccaccucuaccuccucuggagugcugggauuaaugguguacaucacuuuguccagcuccuucuuuccuuucugugcaguucccuucucaagaacaccacccacccuaccucccuguucaucaagaucucauguagcccaggaugaugucaaacuuucuuuguagccaagggugagauugaacuucaucuuccugucucuagcucccaaguucaagguuuacagaugugcccucugcacccaguuuuguuuuguuuuguuuuguuuuugaaacaugguuucucuguguaucucuggcugaccuaguacucacucuguugacuagucuggcuuugaacugagagauccaccugccucugcuucuaagugcugggauuaaaggcuugugcuauuauacagccugguuuagcguuuauccuuaaaguacaguuuacaagagcauucacaaacuucuaagugaagugccacaaggccuuuacagggucacuauaagguuuucauuauuucccuguaccuuucuuguacacaucagucuucuguuaguuccuuuguucucuggggcauacuuaaugucuauaccuucuguaucauuuuguuggucuauuugcgaguggguuacaguguacuccaggcugaccuugaacuugcagcagcccuuuugccuugguugcuuguguccaggaauuaccagugcauaucaccauucucagcuacaccuuuucuuuuccguuugguaacuggguuucacuagcuggccucaaacuugcagugauccaucugccugugccuugaaugcugggauuaaaggcguuugcuacacacuacuucccagcuuccucucucucaaaaacaauaacaaugaacaucaaaacaagcaaaagaccaaaccuuuaaguucauuuauguuacccagcuauuccugggcauagggccugcccuugagugugguggauauacccaguaacauuccuuuggagaaaacugauuuucucguugucaguaucaguugcaaauagcuucuugguuagggaugggacuccauguccacuucucccuucucauugcugggacccuguuuaccuugaaccugucuagaccuuuucuagcuauaaauacugcuauaguugucuguaggaaaaacaaacuuguauccaguguaacuagucagcucacugucuacucagaaaugaaagguaggugggagcuuuucagagggugcuuguuggcagcuggcguguagcucuuugcauuugacaucagugaguauaguuagcaggcaggugugaagaggaauagaaggugcuaacacagcuguugcagccacugguaguaggauccuuaacucugcaagugaacagcuuuguguguaguuuuaggaaauugggauuccuuagugcuuggcagaagcugguguugcagcuaccaaguaggccacauacugggauucuucaggucuucucuuguauguuauauacaaggcuucacaaggugugagaauuucuccccaucaacuauuaaguaauuauuaguaauuauauaguaacuauguccccuaaugcaguucauuccucagauccuguagguuuaaggccugguccccaaggcagacugccuuccccacugcagguacuaauuguaagcucaguuuguggcccauguugcaaagccuacagcuauagacuggguucccacaacccuguccuuagguuugauuaauuugcuauaaaucaauggggauccuuaccccuuugggguugcauaucagguauuuacaauucauaacaacaaaauuacagucaugaaguagcaacaaacuaauuuuaugguugggguagccacaacaugaggaauugaauuaaaggguuucaccuaccuccucaggugacgcuccccaccuaccuuucauuucugagacgacagugagcugauuaguuacacuggauacaaguuuguuuuuccuacaggcaacuauagcaguauuuauagcuagaaaaggucuagacagguucaagguuaacagggucccagcaaugagaagggagaaguggacauggagucccauuccuaaccaagcauuagggagauugagaaccauuguuauggagguucacaggacucagggaaacuuguuuaccauaauggcuucuccugaaagauuacaaauaaacagcauguaauagcauuacuugaacacugaaaaauaccugaaaauaguuuaaagggacaaggacuuauuuuggccccuuguuucaguguauggguggccagcuccauuggacggugagacaaaaaauuaggguagaggugguagaauauaguuaaugcugaugguggccaggaauggaaacagaaggccugugcugguguaccuucuccccauugcauccaucuucuggaccuauaggaucauaccaccaacauccagagcaccuuuucuuauguaguuaauuauccuuggcaguguccuugaagacaaaccuaaagugugcuuuggauuacuaaacaacuaggucuuuucucuauccaagcugucacaacugucacacagccagaugaaaagauaauagagacaggauuguuagaaucuggaaaagagauuuuugucucuguagguguaaucugccacccuccuaugacauaaguguguucuuguucaccucauggaaacacccaugaguuuuauuccgcuauucacaagcucucauagcccagcugauauauauauauauauguauauguauauguauauguauguauacacacacacacacacacacauauauaaugugagugcggguuugugcacauguauuuaggugcuuacaggugccagagaagggcccugaauuccccuggagcugagguuacagacaguuguaggccaccuguaugggugcuggaagcucugguccucaggaaaaacaaugucuuaguuaggguuacuauugcuaauaucauaaccaaaagcauguugggggaagaaaggguuuauuuugcuuauauuuccacauuacuguucauuaucaaaggaagucaagagagaaacucaaacagagcaggaaucuggaggcaggagcugaugaagaagccauggagggcugcuuacuggcuugcucaaugggcuuucuuacagaacacuggaccacccacuuagggguggcccuacccaaaguaggcugaacuuuuccacaguaaucacuaagaaauugcccuacaggcuugccugauauuuugggggcauuuucucaauugagguucuccucaggugacgcuagcuugugucaaguugauauaaaaucuagcuagcacaaagagcagguacucuuaacugcugacccagcuuuuuuguugggguguagcuuguuuugggaaugaauguaaagcagacugugggugaccaacuuuaccuucagugucucuucucucccugagguugggaugugaggucccugagcauguggcuaguucugcuggcauccucaucuugucauuauucuaaucauggcuucauuaguaucaugcaauuuugaauagguuuguuguaaacagucuuucuccuuuaugcucugaacucuucuggggcugcuucagggauuagggacacagguaaaaaacaaaacaaaaccuuuuuuuaaaauuuauuuauuuuuuaaguuuucuuuucuuuuuuuuuuuuuaauauuuauuuuauguauaugagaauacuguugcugucuucaggcacaccggaagagggaguuggauuucauuacagaugguuaugagccaccaugugguugcugggaauugagcucagauccucuggaagaacaaucagugcucuuaacugcugagccaucucuucagcccaggcaaacauucuugaggaaaggauacucuuaccacccuacucacuuaggaaauaacagaggauacagaacuugggagguagggacugugaggauacaucaguguaaauaucagaagcuggagauaguauuccuaacaguucuuacauacuucuccuuuccuacuuguaacagcauagagaaaccacucugcauugcucugucuucuaggaauccaugaugucauuacucugugcuucuuaguacuauggcuuucacuguccaauuaagaaguaguagcgccgggcaugguggagcacgccuuuaaucccagcacucgggaggcagaggcaggugcaucucugaguucgaggccagccuggucuacaaagugagcuccaggacagccagggcuacacagagaaacccugucuggaaaaaccaaaaaaccaaaaaguaguagcaaauccuaauuuuuagcacuuaauguauguuugauguacaauuauaagugcuuuaucugcagacuuucaguucuucccaacaacucucuaguuauugacauuauuguuccauuuuguaguugaaaauucugaagcuuaggacaguaugggucucugucuuauuucucuuguuaugaagagacaugaugaaggcaauuuauaaaaugaagagcuaaucagggcuuacaauuuuagaggguuaguccuugccuaucauggcagggagugugacaacaggcagacaaguauggugcuagcacaguggcugagagcuuacaucugaucuacaagcagaaggccuacagagugagcuaacugggaauggugugaguuuuugaaacuucaaagcccauccccacuaccacaccuccuuugacaaggccacaucuaauccuuucaaaccguuccacuaacugcagaccuaucauucaaacaugcgagcccagucucauucaaaccaucacagucuaugaaaacaaaaguauaaaaacagaguaguuaugucaguaccugacaguagagagauguuaagcuuugcauggggauaaauuucucugucagaccacaccuauguuuuagaauuggguuggugguuuuuccuucagucucaaugacaguuuuauuauugugucuuucacagauguaaauguaacuugcuugaaacagaacuaggaaguugauuaugccauauauuauuuuauuccuguauaaacugccuuuuaauauugccauuuugaaggauucucagaauaaaagguuuuuguuuuauucuuuccuuuuuuucucaggaccaucagacucugauaauuuuucucauaaucugagaggaauaauuccacgaaguuuugaauauuuguuuuccuuaauugaucgugaaaaagaaaagguaaagcuuacuguaaaaacaaaauguuggugugcuggagagauggcucagcuguaaagagcaucagcuguuccuccagaggaccugcauucaauuccagcacucacauggcaaaagcagcuccuaacugucuguaacucccaucccagggaucugauauccucuccuaaccucugggcaccagacaugcacauggugcacaggcauauaugcaggcaaaacacacauacacauaaauuuaaaacaaaaacaucaauaggccugggguuugaauccccagcacugcaaaaacugagugugcugguauacaccugugauucuauuacaauggggguggggauaggaggaucagaauuucaaggucaccagaaguucagagucauccuaaucuauagaguucaaggcuagccugauugcaagucuacagaagagaguggaagcuucugggccucuccaagauuuuuaugagagaaacuauauagaaaaaucucaacugggggaggguguuuaucggaggggaaacccggaaaggggauaacauuugaaauguaaacuauccaauuuaaaaaaaaaaaaucucaaucaaggaaaauagaguguggugauuuaaaugagaaauguaccccauagucucaggcauuuacauucuugguccccgcuugguugcacuuuucaggaaggcuuuggaguuauggccuuguugggaggaauacgucauuggaggcaagcuuuguagaaagucucaaguuuacucucuucuuccugcuuguguuuugcaauuugagcccucaguuucuggucuuagcauccuguuccuuuuccuuagcagcugcucccuuucugccaucauggccucuaacccuguggaaucauaagcccuuccuucuauaaguugucgugacuguggguuuuaucagagcaacaguaaaguaacuaauacauagaaaacacugaaagucccauccucuagcugugcucaagcuuaaagguguccauaaguccucaugauggacauuaaugauggacccauccuuguuuguuugcagaacuugcuugcaucccauuaucaucuuguuccauauggguuaugacuucaucauucuaaaucuuugagccagagugagcggggucuaccagagugagcagagguccuaaauucccaacaacucgaugaaagcucacaacuaucuguacagcuacaguguauacuuauauacauaaaauaaauagaucuuuaaaaaaagaaccuuuaauuuuaauauuuucaaauccuauuuuuaaugaugguucuuaaaugcuuuaaccucuuuuguagccuaccacccaccagagguaguggaaaagaaaggauacaggggaaguugaccguuuaaaaagguucuuuggagcaacucucaucuguauugucuggaaacuggcaguucaguucacagguuagcagcagcagcucaauccacuugcaaacacuucacuuccuggacaucagcaggccaguuugguagaguugggauagcagagaggagucagcaguaguggcgcuaccaggcagagccagccaggccucagccucgagggccagggcuaacagcagcaccaagagccagccaggccucagccucgagggccagggcuaacagcagcaccaagagaaguucuggguugugccucucucagcaaagcagagaucugcgaauacucaagaccaacaaccauugcacagcuaacucuauaagcaagccuagcucagucuccaucacugucuugucuguugaguccuauuuauaccuccaaauaucacgucuccuccaugggucuugccucagaacaugucucagaaugugcguuugacaucacugccaaucagccagagucuggggaaguggcaagaaacuguagcacaccaccagaaguuuuuugguguguuucucucuauggauucccgagaaauugagcucaacuccgcaauguaaggcagugcaguacauguguguuguuagcaaagaauacuucaucacauguccuuucacgugcuugcuuuagcagaacauccugcgucugcuucaugagucugccuuagucuuucaccuguauccacuucaggaaaacauuccuucauguguuugccccaucuaaagaaccuuaaauuuuuacuucaagaacccuuguucuggagcuggagagauggcucagugguaaagagcacugucugcucuuccaaagguccaaaguucaauucccagcaaccacaugguggcucacaaccaucuguaaagggaucugauguucuccucugguguaucuggaaauagcuacaguguacucauauaaauaaaauaauuaaaaaaaaaaaagaacccagccaucauugggaagagaggccccuuggucuugcaaacuuuauauacaccaguacaggggaacgccagggccaagaagugggaguggguggguaggggagcagggcggggaggaggguauaggggacuuuaaggauagcauuugaaauguaaaugaagaaaauaucuaauaaaaaauugaaaaaaaaaagaaccauuguucuuaugugcuuuacauacuuguauaucaaagaaauugguauauagcaccagcucaccauuuacuccuuggcagaaaugugccuaacauagcagguagacuuaguguuugacaguaaaauaauuaaaguuagcaccauguauuucuauggcuaaaauuuuuuuagagugggauaguaaugguacaugccuuuaaucccauguggaaggcagaggcaggcauaucucuaagaucaaggccagccugaucuacagagaguuccaggacagccaggacuacacagagaaacccugucuuuaaaacaacaacaacaaaaaaaaaacucuuuuuuuuuaaugaauauuggggucuuugucagcauguaugucuguguaccaugggcauaucugguacccaaggaggccagaagagcaugcgagaucccuggggacuggaguuacagauguuuaugagccucuauguguguacugagacucuaaugaggauccucugaagaagagucaagugucuuauguacuagcuaucucuccagccuucgacguggguuuuuuguuuuuuaaaguaagguuuucuuuaaugaguguuuuaccuguauguaagaagaucauauguacauaugcacauuguagaugccagagaagggcaacagaccuggacaugguguuguuagcuccuaugugggggcugaaaaccaaggccaagauuuuuauaagagcaccaaguguuuuuacccacugaacuaucccuccauccccaaauuucuaguuuuuuaggaugaauuauuuucagucuuuuaaagaacaugaaucuuacaucaaguaaaacuaucuggaccaaugauaugguucaauggauaaaggugcuugucaccaagcuugacaaacugaucaagaucccuugggacccaaauggcagaaggugguaacugacucccaggcguugucuucagcucuacacauauguuucacauaugaguauguuuauacauacaaacaguaaauaaauguuaaaagucaaagcuuuaugaggcaguacaauauggagagcgguggaaacuuaguugaauugcucugcuccuguugcugugagcaggcucuuuggagccucuccaaagagguggguacccccacuccugggguugcagugaugauacuuaaaaauucaauaauguuuuggaauuaguuuuccagauuauuuucacugacuuuuucgauguuuuacauuauacuaaaggacaauaggaaaguauaccugaaauagcucauggaaaaugaauggcuaaaagcagcgugcuuuucuuugacaggcuggagcugggaagaguuuccuuuguaagugcuccuuuauugaggucuacaaugagcagauauaugaccuccuggacucggcgucagucggacuguauuugagagagcacauaaagaagggagucuuuguggucggugcaguggagcaggcggugaccucagcugccgagaccuaccagguacccugccaggagauacguuugauguucaggcaauaaacaugcuaugaagguauccucaucucaaagagucaagguugagaugcuaaaaagguuucauaaaggcauagcaaaacaaaaaguauucaaauguuaauuaaauauucaaagaaugugguucuauagcuuuuggaaucuguccugugucuaagagacauuuuuuaagcuauauaaauauauaauugaccucauaguaaauauauuuauuuuaauaguaugaaaaggaagcauaaaguacuguugaagaacuauaaguaauuugaguaauaucaauuuuauggggaauuaggucagugguauagagguugacuaguagucaaaggccauuugcuuagucuacaacacugacaagugauuucaguguuauacuguuucauuaauaguguuuuaauaucuagcauuguagccuuugauguaacuuuccuggguucucuguuacccuuauugcuaguguguucuccaaguuguguuucgcaggucgucagcaucagcuacaggucuguuaggaaucuuagcugaggccaaggauggcaguacacuccuuuagucccugcagugugaggaagaggcaggugggucugcuggauacccaguuggaggccagacugauuuaaacagaguugccaguuaguaagggcuauauagagaguccuugucacaagccaccacuacccuccccucucccaaaaaaccccacaacauugccuaaggcuugacauucccagcaucuguccaaaguaaugccucauuucaauccuuacuugauguugacucacaauauagacuucaguaacaucccaaggugaugggggaaauauauauaguagauauuccacucugugaggucagugcacacaugcucuuugguuucucuguagcucuggguacccuagaacuuacuuugugaaucaggccucaucuugacagagauuugccugcuucugccucugccucccagugcugcgauugaaagcuugcaucacuguaccuugcucccacauugcuuauuuuuaaauacagaagcagaccuuuuuuuuugaaagaauauuuauuuauuuuauaugaguacacuguagcugucuucagacacacuagaagaggcaucagaucccauuacagauggcuguuagccaccaugugguugcugggaauugaacucgggccuucuggaagagcaaucagugcucuuaacuacugagccaucucuccagcccccagaagcagaaauuuuuuauagucacaccuuguauauaguagacucagaguuugaacucugguuugucugagagccugugaucuaaaccuugauacuuuuucuugucugaauggaaagaaaaauucuuugcagggagaaagcugccaaaacauuagacuaaagaugauuugagauuucuuuuuggcuuagaauuuuuauuaucuaagcuaaagcaugggauucacgucuacagucacaguacuugggaggugaagcagcaggaucaaagccagcuugaguuauguggugagcuccaggccaaacuggcaacacugacucuuucuaugacaugaagagggaaagaagaaaauuguuugauauuauucuuuauaggucuaccaauuuugguaucuaaauauauacuucuuagaacuugugauuaugccgggcgugguggcgcacgccuuuuaucccagcacucagaggcagaggcaggcggauuucugaguucgaggccagccuggucuacaaagugagcuccaggacagccagggcuaaacagagaaacccuguuuugaaaaaccaaaaaaaaaaaaaaagaacuugugauuacauaaauucucacaaagcuagauaacaauggaaaggccccuguucuauauggaaacuacucuguuguggauaauuaccuauguguuauuauuuucucucaugucauguuuugaaucugccuuggguaccuauuguggcuucguguaaccgucuccuuuucccaaggucuuaucuagaggcuggaggaacagacguguagcaucaacaucuaugaacagagagucuucuagaucccaugcagucuuuaccaucacaauagaaucaauggagaagagcagcgagaccgugaacauccggaccuccuuacucaaccugguggacuuagcaggaucugagaggcaaaaagacacccaugcagaagggaugaggcugaagguaggugcagugacggccuucuuacuuagugugaacugcuacugaaaagucagugcugccccaaguacagagaagacuuuagaagaaauaagaguuguuccuacuaagaaggagcaaagauuuuaugagauuauggcaguaagcagaaauggguaggagucuaucccugucaggagcaagaguggcuacuuuuggccaugagggaacaaagaaaggaucuguggaguagaccuuugggaggauggaugucuuuaauaguaguugucucauagaaaccaggguuugguucugggaagaggaacagagaauaccuacccugcagagugauagcucaagguuuguugggccuuguaaagcaacuaugcauuaaguauuucagugugcaucagucgauugaucaguuauagagcaagaaagcccaggucaauuaggacuaugaguuccaggccacauuuguucucagcuuucuauucccuggaaaacauuuaaaaguuuggagcauucgugugguuuccuguagaaggacuauauuauaaacaaguagaucuauuacuacuacuccugaaucuacucucugaauuuuacuucuucuacagaaucaaauguggcauagcauucucucucucuauuggucagcagcagcagcuagcuggagcuccagaaagcaagagacguuacugacuagaauguagauucugaucuacuccugccagaaucagaggggaggagcuaacaagaaaggagagcuaucauguauagugggaaggcacauagccugagcuaugagcagugggaaagaaauugauugugcuguguacuguaguauauaucuaaguguugacugaaauauguacaaguuaugcaguugaggaaugugaccuaagagaggugagucagcuguggaagagagcuucgagccugcugagcuuacagucagcagaaggcucauggcucugucaagagagaaacgugcuguacagguucuccuugacuucuagugguguugccuccaaagacaucugguuaggcugaaacaucauaaaccagaagugcguucgauauaucuaaccugacaaacuuaccagucaguaaggucucaugcuuucuggagcuccagcuugcugcugcugcugaccaguagugagagagaaugcuaugccacauuugauccuguggaagaaauagaacucaggucccaagcaguuuguagugcacugggacuuuuacagcacucugcaguuagagugcacacgacacaggaagagggaugacugagcuuacuguucuugcuuacaaguugacuuuaacuuugacucuccuuugcuuuccaucccagguugucgucuugcuacuuaaauuuuagcucagaacaaccaaagagugacguugcaccuacuuuugcuuuccccuaauuccuuaggaggcagguaacauaaaccgaucgcugagcugccugggccaagucaucacugcccuuguugauguggguaauggaaaacagaggcauaucugcuacagagacuccaaacuuaccuucuuacuucggguaaagcugaucacugguuccugccaccuuugcauuaugguuacugggacugacaguggaaguguuucugagucuuuauuauuuucugaaaaauaucuuaggauuuacagucuaaaaacauacaccauugaugucauuaaacaggacucccuugguggcaaugccaaaacagcuauaauugcaaauguucauccaggauccagguguuuuggagaaacacugucaacacuuaauuuugcucaaagagccaagcugauuaaaaacaagguaaaagugcaccucuagcauuguauuuugcauuuauucaucuauuuguuuguuuguuuguuugcuugcuugcuuauuuauuuauuuauauuagggcuauauaucacaggguaaucauaaaguuggcagaccuccugccucagccaccugaguuuugggaguaaggcaagcagcaccauacccuguucaugcuuugcagccuuaugcauggcauuugaaacuccagguuugucgugugguuguuaugguuuugcugucugcuuguuuuuaaggcaauuuuccuuuuguuguuggaugggagaguaauaagccuaaacuauacaagcagaguugguauguuuuucgugcaugcacgucaguuugcauacaugugccugcccugaacccauauguaauauauaugguagcaaagaauaaugcuaugaaagucacuucauaauaaugaaauuugccuuuuaaguuguguacaucucugcauauuccucauuuuauuuuauaucaagucaucucuuuaauagugguauacaccuccagucaggaagcuuuucuuguaaaguacuaguugauaaaccacuuaaugcuucuuguaccauaugguucauuucaauuacucaggucugucuuugcuauaagaaagcagucauagacaguaugugaacaauagcauuggcgguguguccacuguuagcauuuugucuaagcuccaccccacaguugucuggcaacagccagguauaccugacucagucaguauaaaaggggcugcuugcucccuuugcucucucuugccuucuugcguuugcucuguccucucuccccuuccccaucucuccucauuucccucccccauuuuccuccccucugucucuccacaugcuuguggcuggcagcccuccuccuccuccuccuccuccuccucuuccucuuccucuuccuccuccuccuccuccuucuccuccuccuccuccuccuccuccuccuucucucucucucuccccccucccucccucccucccucccucccucucucccucucuccuccccuuccagcuccccuccccaugcccugaauaaacucuauucuauacuauaucauccuguggcuggucccucagggguaagggacgccucagcaugggcccacagaggcaccccucccccaccccugacugcacauccaccaggcacauuccuucucucuucauuuuuauaaaacacagcacccaucaaagcaaaguccauauuugccaauacauagcacuuuaccaauaccuaguacauacugucagaagaccaacaagaguugauuucagacaaaacaacugugccaagaauugguagauucauucuuuccuuuuuaaagggaaaaacugggcaucuuauacccaguucauuuagcagaaugaagcagaccacauuguuccucccacuggauaagugagaacaacauaggucucaucuuuuccuucuuuuuuuuggguaccauccacuguuuacaugaauguuaacaauaugaagaggaaacaucaggagaacuuccuggcuuagucuuggcuuaccagaaggcuuucaagaguagaaccauguuaaugauuacacuuacagugucacugauauaauagugaugucagaaugccucauaaugaggcuggccauaugaaucagaagcaauuggaaaguacuuuuaaacauaugaacaacaaaacuaacaucuuuguacuaccugcucccaaugguaaguccuguucagccugucaaccugugaaugggaaagaucaacuguuaauauuuccaggugggcaggcugaacuuaagaacacagaggacuugguuugucacaggagguuuuuccucacugaaauaguucaguauuucauagcuaggccucuggucugacuggugcuuagcuguuguuguuuguuauuacccuuaauaaacuuuaccuuucauuguuuuugcuuuuuguuuuuagacaggauuucuguguguagccuugacuguccuuagagcucacuagguagaccaggcugaucuagccacgaacucacagagauccuccugucucugccuucugaguacuaagacuaaaagcauacaccaccaccgcccagcaauaaacaauuuuuaaagcagcuuuagauuuauagcaaaauugaacaauaaguacguaaugauuccauaucaucccugucuccuccacgugugccaugucuacuacucgcaucccuugccacagugaugccuuugguggccuuuuuuuguuguuguuuuguuguugcuguuguuguuuuuugcuuuuuaagagguuguuuuaaacagggcaucuuuaagaaauggaagacaccauuuauuuaucauggugauagcauuuguuugaaaccauuuaaauaauaacauuauuuuaagaaagugaagauaacauuuauuacugugauagaacagaaaugaacucugaaaucaaucccugcuuacaggccagcuauagaaacauaaaguggcucucacugaagagggucguugucagaagccauccaggaaaggcuguggcaagcaagugagguuuuuuucgagauggcccaccauuuugcauggcuaugaugggugcacucugagagacaagguccucagagacuucaucccaguauugcuucucacugcugaucugucuuuccugucacuauuacauagccuaaugauuucugagcauuagcccaccuuauugggcaaauuuccugcaaaacaacaugaagaugaacuuucaagaauuaaugcuagaugaauuaauuauagcauucuugauuugauucaaauaauuuuaagaagaaaguuuaaggagauguucuuaguuguuuuuccagagugauauaauaaagaaucaagaauaggaugugcucccuucuuauagaauaguaaguaaaggcugcauaauaaggaguacaauaagcuuucauaauugcacuagaagagaaauaggcuugagacagauuugugaucaaaggaaaauauuuauucuaggucaggucuaaggauggggccacaggugugcacuaugauuaagcaaggcuauuugcagcuguugcuuugaacuuauaaugagcuuauagaaugaugaaacacugcuuugaacuuacuaugaacauccuucuguuacuccccuuuuguauaacauuucaucuaugagguaauguuauaaagaacuuuugucucagaagauauaaaaaugccagagagaaguagaauguggcuuuuggggcucugccacauccaccauauauauauauguauguauguauguauguauguauguauauguguguguauacauauauaugugugucugucugucuguacauaguacauguguggguauauguguauguauauaaguaugcaugaacaguuguggaauugaugaaauaggucgggucuggccaaaguguuuauuuguaugugacuauauagugugugugccugacuuucuuccuuuuuccuuccuuuucuuuucucucugacuugcagagaguugacaaaguccuagccucuuaacuggccauagaggugcccuugagccagagagaaaagagcucagauaacuaagcuuuuuuuuuuuuaauccccugcuucaaucaguuguuaaauugccagaagccagaggcuuuuggccacagaauagcaaagaguuaaagaagguagaaauugccaaagguaaagcagcuuuggccacaaucaccaccuccauccaucccucaugucagcugccuuccucaguuccuggaugcugggguuggccccugggaggugguuucugcucuguuggggauugugagacaaguggaccaugccaccagacaaaagaacugguaagguugaaacagguuuaacagccuggagaaucucagaauugagaaugguggcauggagccagcucucugcuaagcuauaccuguccuggaacauguaaccaugauaccccacugagaagaccaugacaguuggucacguagcauaagaaccaggaggucucugugcuaaugagguaucuggauaggacuuauguguuuaggcaaugagcuuuccuuccugggcauucuucccuguaaaagguauuucaucccugguucacccugaguaagacauaauucacaucuaccauaaaauaaagcagcuuguacaagcaaugaccgucucccucaucaggaaucaucaaaugggagaggccaugccuaugucuccuggagagucugaccuguccaggagucagccauccccuuccugccuaacguguaggcgaagcacagaccccugcccccuuucucaacucccugaggucccuaguggugucuggguacacaggagauuguaaaccauggcauuugucccagauugcgauauuucuuguccagaagaacauaggcugggaacccuuaucacggacuguguucugccuccccugagcagcuugccagcggugcucccagcaccccugcagcaaggaggaagguacacagccugacagaauugugcccuuuuaagccagaguuuuucaccaaaggcugauggacagaggggaaauagccuuguugagguguuuguuugaaagaggauacaugguucuuaaaucaggaugauacacucagaucugaaggugaccuggccuaagauaggacugauugaguggagaggaugagugggaggaggggauggcaagaggaagagggcagcucugcugcuugggcucugaccgguguuguauaggcacaggaagaaggagcuugcugcccacuucagcaugcugcuuuaguggcugguuugcuguuggucagauugauggauaguuuuguuugguuuuccacguucccgcucauaccgaacaaaugaaaaacaggauuguauaacuugaaaggugcucuuucagugcuuuauuaauucuugucuaggcugugguaaaugaagacacccaaggaaaugucagccaacugcaagcugaagugaaaaggcucaaagaacaacugucucaauuuacuucugggcagauaacaccagaaagcuuauuggccagagguagguugaacucauuguccuucucucuuggaaagacuucaugggaauguuaugucaagaacuccuacuguuagauagauggauggucagcauacagugaggcuucccacauuucucacacccacucuccuucuuucauacgugugaaaucagacacacguauugugugaauacgcuuugugugaaucagacagcaucugaggugcagugagaaggagauucauaaugauuuugaguaauuccucuccuaauaagugcuaaaaagaaacaaauaaauuucauuaggucacagcaaacauucugccuuagcauauaaucaacauauguuugggauugaacaggaaauguuucuucaaaaauaguuuguaggauugagagucauaaaauguaaaagcagcaacaaaaaacaaacaaaaacagaacuggggcuaggaaugugucuugguaguagacacauugccuggccuaugugaggcacuaggugugguuuccaguaauauacaaaaccaaaccaacaaacaacaaacaacagcauguauuagacugagcauagucuauaaccugacucccagaauucaggaagcugaugcaagaucuagaacuagccacccucuaacuguuagacagccuagucuuucuguagaguggcugacugagacagugucaauaaauaaguuuucauuggcacacaugggucuccuccuuguuccuuauagacucauuucuagcucugguguuucaugcuuauaaguccagcauuugggagaauugcagcagaauugccuuaaguuugauaccaaccuaggcuacaauuuuuaaaaauaauuuauauauuuuauauacauugauguuuugacugcauguaugucugugugaugguguuggauucccuggaacaggaguuauagacagaugccauguuggcacugggaaguaaucccaguccuuuggaaaagcagacagugcucuuaaccacugagccaucucuccagccccagcugcaguuuuaaaaacaaaccauuucuguuucuuucaccaaauauguuugugcuaaguaaauacagagaaaugucuuguuuucuucauagaacagcaauuugcuaaguaaguuaaugugagauugcuaaucagucaugacauucuguuucuuaggauaguugguaggaauaaagacuguuguaguuuugaaaaaugagcauauuucuucuuuuccccuuuuagauaaagagaagacuaauuacauagaauauuuccuggaagcaauguuauucuuuaagaaaucugaacaggaaaaaaagguaggaaauugaauuaggaaacgggauucagaacaucuuguacuuuaguguugugguugauuuucauuacuucagugagugaaacauaguaacagguguaaaacgaaaaggcuuucaaaagucuugccuuugaguuuagacuuaguacucugauggguucaugagaauguagggaaacugaauaauuuuucaugucuaacugaauccugaauuucuuaagucucuaauagaaaaaauuacccaacuagaagaucucacccucaaaaaggaaaaauuuauucagucuaauaaaaugauugugaaguuccgggaggaccaaaucaugcgucuagagaggcuccauaaggagggucgaggaagcuuccugccggaggagcaggaucgccugcugucagagcugcgggaugagguccagacgcuucgagagcacgugagugcagccuaccucuguguuucuaggagggagcuuuacagugugacuaguguucaccaucuaaaguguguacagaguguucaccaguaauucguucuguaauacaguggaaagacagcgcuuuaagucaguuugacugguaguauacgcugcauuucuuuuccccuuucccaaguaugaagcugaagacaaaaaaguaggccagcaauucguacuuugcccauggaccugugcucugcagcaguucuaccagacagucucaggacaguggagcauuugaaguucuuguuuuuuucuuuuuucuagagagagugaguagguaaauuugaaaacuaaaauaaucuuuuuuguauccaguauguuuaauacauguccagucaguaggacauuuuuacuuccguuuauuuuguauacuuuucuacauuuugcuaguuaauguauuuuagagggcaauucagucuuaguagucagaaauuuuucuacucuccccccucuuuuuaaagauuuauuuauuuguauuuaauguguauggguguuuugcuuuauguauaaucugugcgugccuggugcccaaggaagccaguagagagcguuggaucuccuggaacuaggguuacagcuuuguggguacugggaguuaaacccaaguucucugaaaaagcagucaguguucuuaacugcugagccauuucuccauccacuuuaucacauccauccuuccauccuuccuuuucuccuuucuuccuucuuucuuucuuucuuucuuucuuucuuucuuucuuccuuccuuccucccucccucccucccuccucuccuucucuuccuuccuuccuuucuuccuuucuuccuuucuuccuuucugugcugaggaucaaauccagagccuuuuucaugcuagggucuugcuaugucucugaguuacauccucaaguauguuaauuuagcuauguucuugugugaagaguuacacacuuguggcuggguguccuauauggcuuggguggaaguugcaagcaaaguaacaaacacauuuugauauacccaccacugccaagucccuuucuaugaagacuguagcagaguacaagcaggauugcuauguccuagaauuucugaauggcuuucagagagaccaauucacuuaggaaaauguguaaaugcaugaaguaugcaacuucucaaugucacagguggagcaccauccuagacuugcaaaguaugcuauggaaaaccauucccucagggaagagaauagaagacugaaguuacuagcacccguaaaaagagcccaugaaaucgaugcccagucuauugcaagacuagaaaaagcuuucgcugaagugucuagcacagagacaaaugacaaagguaagaaaugauuguugugaaaaggggcuggagcaaugacuucaauacuuaaaagccugccuugccugcucuuccagaggacccaaguucaauucccagcacccaugucagaguuccauuuugauaaaggaucuaaugcucuuuuucugguuuccuuggguaccaggcauacauguggugcauagacauacaugcaggaaaaaauaccuaugcacaaaggacaaaaauaaaucuaaagaauuaaucuguaggacaggaaagauaauuucaguaaggugcuugcuuauauaaacaugaggcccugaguuucuagaacucuaauuaaaaagguagacuuguacuuguaauccuagcccuggggaacuggggagacuuugacagguugauccugggauucucuggcugaucagcccagucuauucgccaaucagguggauccuaaggaaaaaccccugaggcuaguuucuggccuucgaguaaaucguguacaccacaaauacccagagaaagaggaaggaacaguuauaucaggugugcaugugcugcacaccugaaguccaagcacuuaguaggcugaggaauagucauuuuugggauaaccuagacuaugaaaugaggcccacucccaccucaggaaagaaaccaaaaagaaaaagaauucaaagcagagcuagcuaggugguuuagugcagcaugcuguucuuucaaaggucuugagucugguuccccacacguguuagguaggcagcucacaucucuuguaacuccagcuucaggggcuccaacacuacugaucuuuuggggcaccugcacucacaugcauacaccuauacacaggcauucacauacauaauuuuuaauaauuauuauuuuuuuuuaauucagagccaccaaaacagaaaacaaaaaaacuaucccaaagaagaaaaagaaacauuugcaguaucuuaugguuagccuuuuuaaccuggugggcuaauuuauugcaauuguauguauuuuuuuaugaaauaaguuauuuuuauuuauuguauuuuauuuauaugaguacacuguaauugucuuuagacacaucagaagaaggcaucagaucccauuacagauagugugagccaucaugugguugcugggaauugaacuuagggccucuggaagaucagucagugcucuuaacugcugagccauuucuccagccuuuucuguauuucuuuauauuuuaaaaauaauuuuuaaagauuuuuuucccuacaucacaagauaauaaguuguucagcuaauugcuauaccaaggaaaggacuguuauaucuuuuuuuuagugauacuuuuuuuuuuugguaaaagauuuauucagauauuuuuauauaugaucuuagucaaaaagcugaaagugauagauaucaauuuuuauccugcguauuaguuuuucguugcugugacagacuaucugaaaaaagaaaucaucuugcagggugauuuguuugguuuaagguuucagagggguuugguccauacuuugccagcuccauuacgcucaugucugugguuagcagaaguuuauaucagguaacaccagagcuucucagcucacagaugagaaaguggggagaacagugggguaggacuccuucagagcacacgccucugacuugcuucuucuucaucuucccgacagcccaggagccuguaaauccaucaggguuaagcacaggccagaaucaccacgaggacagccccacugcacauaagcaugcagggacauuuaaauccaaaucauaaugggaauuuucauguuuacaguauaggacauuucaaguuuuuuacuacucaaacauaaauaguugaaguauuugucaguuuggcuaaugucaguccaaugugagagauguccaugggucaaauucagguuucacuaguguuugguucugguauuggauuaugcucuguagugauacauuauuuucauaauuauuauaugaaaagugccuuggaugguacuaagucuaaagcucuggggggaugguguagcacuugcugcugcgaguucucugagauuugguaacguucgguuugcuccauucugaggcagcauuuacugcuccuuccuuuaucucccucauacaagacagggccucugugucacuguggcuguccuggaacucacacagaucugccugccucaaggcugcacuaccgcuguuuagcucuuuguuucuuuuuaaguuaagaaaauucuaauguuuauucugaauuguuugccucuuuccuuuuuuauuuuauuuccuuuugugguacuggggaucaaauucaagguuggguuucagaugcuaagcagccacucugccacugaacucuuccccagucccuucucagucacucuguguuucccaucuauccguccucccauacaucuguuucuugauuucuuuucaaggcaggguuucucuguguagcccuggcuguccuggaagucacucuaguccaggcuggcuuugaacucaaggaucugccugccucugccuccgagugcugcuuugguuugauguuguuugcuuuuguuuugucuugccuuuuacauuuucuaagccuucuauuauucaauugugaauuaguuaaaaaaaaaaaaagauucacaauauuuggagaaacucgauuuuauaugcaaaauuaaaauuauccuuguuaaucaguuuuuucuucaaaauuauuguucacaauggcuacccacaucaauuuucacaaguucagcugugccaguguucuccaucuagcaccaagcauggugcucaguaguguccauuagcucuucauccuagggaacaguguucccuuaacuacacuucucccuccuguggucuuugcuccuugaacacaacucucacugaccucuggguacacugucacccagaguguccugugaaucuguguccucacauuucucacacucgcccuccuguccauuucuuucuuauccucgugucucagauuguaccuggaggagagcuuggaaaagugucuugucauuucugucuuucaaagacuggagugguuuccuucuuaacaggucugcaaggauuuucucccaaagcacuaaaagaaucaaguuucuucacaaacaccgagaaguuaaaagcacaacuccugcaaauucagacagaacugaauaauucaaagcaagaauaugaagaauucaaagaauuaacucgguaaaguguaaauacacaugcucaccuguuuuccuaauauuuuaauguuaaugauagauaacuuggcauguuacuuuaaauaugaaccuuucuagcaacuaauuuguuuuguucuauggaaacacuuuuuuucuuguaucucucuucacuauauauagcugacaguagaucaugcagauauuuauauaucugcaguagaccaugcagauguuuuauccagugcucauuugcugagugucaauugauauugcugaguaaguucaucucauuaccaauuaaaaucacaguuauagacuaaaucaagauuucuuuuuagaaauuaaagacuuuuuaauacuccuauuugaugcucuuuguauaaaaggauaaacuauauugauaguauaaccaagguuaauccuaaccugacagcauacugacuugaauuugagcucuacaauuuacuaauugaauaccuuuaauaaccaucagucugugagcccugauuuacaugccuggaaaaugaugguaaugauuugggaaguauuucugacucaaaagccaaaucacaugugagcauaaacuguaauguacuuaaaaaugcuuaacauuccucacuaccugaagguacuaagauuuaacaaugucuaucaggaaaaagcagcuagagcuagaaucagagcuucagucuuugcaaaaagcaaaccucaaucuugaaaaccuuuuggaggcaacaaaagucugcaaacgccaggaaguuucccagcugaauaaacuacaugcugaaacacucaagguagguaucuggaaugucuauuuaaauuggaacagucucuuuuauuaauaaaaguuauuuccaaacacagauggcagaauacccuaguauucugaaagacuccaguggcaacaucaaggaggaguaauaaaacauuugggaucaaauucuguuucgucaugaacuuuagacagugcuuccuaacaucugaacuuuuuucuguuaauucuuuuuuuucuuuuuccuucuuuucuuugagacagggucucaaagccaaagcuuuccucaaacucacucuguagcuuaggcuggccuugaacucuugauucucuuguuuccaccccuaugaguacaaggugugugccacuaugucuagcuuugcaguaugcuuuuuguaacauucaaagauaggucuuuuauuguuguuguguuguuuuuuuucaagacaggauuucucuauauagccuuggcuguccuggaacucacuuuguagaccaggcuggccucgaacucagaaauccaccucccucugccucccaagugcugggauuaaaggcgugcgccaccacugucuggcucaaagauaggucuuaagccaaggauaguggugcaguccuuuagagucagaucuacuugaguucgaggacagccagggcuacacagagaaacccugacacaaaacaaaaacaaaaaacacaggguuggggauuuagcucagugguagagagcuugccuagcaagcgagcacaaggcccuggguucgguccucaacucucaaaacaaaacaaaacaaaaaaacaaaaaccaccacacacacacacacacacacacacacacacacacacacacacaaacaaagacaaagguugguccuaggucuuuguauauuaacugguaucugaaguguuucguacuguaaaccuugucacccuacauccuuuggguaggauccagugccgugucugugccgaggaccucauacaagcuuagaugcacugagcuacauccucaaccuggcuuuuauguuuuggaugacucagugaccuuuaauguuuuccagguucccacugccuaugagcgguucuguuggagacacacuugcccaggugcucauguuagagugucagccuuugagcaaguuggggagcagucuucuagcacucucuacuaaugggcacccugaauuccuuagaaguuucuuguuguuuguuuaaauuuaauuuauucauuuuacauauguaaguauuuugugugcauguaugcuccauaugcaugcagugcccaugaaguacaaaagugggucuuauaaucacugggacuggaguuauagaugguugucaccgugugggagcuggagucaaacccuguccucuggaagagcauguauucuuaucugcugagcuaucucuucaccccaccccggacccucgaauguuugcuaaugugaugagugaaaaaugggaucuuguuaaggucccaccacccacccagcuucaaguuccauuuuuaaaacuguauuucaacuuagcaugcaacuauauugaacuguuuuguuuauuugguccuaugcuuaaagaauacauccucagccggguggugguggugaacaccuuuaaucccagcacuugggaggcagagagggcagauuuuugaguucaaugccagccuggucuacaaagugagcuccaggacagccagggcuauacagagaaacccugucucgaaaaaacaaaacaaaacaaaaaagaauacauccucuugauaaacugaugaauaaaauuuuaauuuuuauuccuauugauaaaaucuaguuauuuuccccuuuguacuaauguuucuuuccacaaugauuguucugcagauaauuaccacuccaaccaaggcuuaucaacuuuguucuagacuaguaccaaagucaagcccugagguggggagcuuuggcuuucugugcacagagagcucuagcaggcuggauaaugauauauuaaaugaaccagugccaccugagaugagugagcaagcucuggaggccguuucagaggagcuucgaacugugcagguaaugcuuacuuuuuaggaaaaagaaauaauuuaauguucauuuggauaaaauuuggguacuaguuuaacucuguaaauuuuaaguuugcguauauaaagguuuuggacuugucuguuuuuuuguuuuguuuuguuuuuuucgagacaggguuucucuguguagcccuggcuguccuggaacucacuuuguagaccaggcugucuucaaacucagaaauccgccugccucugccucccaagugcuaggauuaaaugcauguaccaccaugagcggcuuagacucuaauuuaauucaagguugaauuuuaaccacuucuugcuuugugcuuaaauguauccauuucaaucagauaugguguaauuuugaaacguaggaaugaucaguguaaccuucugaagauuucuggcccagcaguccuucacuauguuuucuucuauacggguuugaguuuguuuguucuaguuucuugucucuuuaaccaaaaagaaauagggcaggggaguucucuuagcaguucagcugccuuucuaggggaccuagguucaauucccagcacccacgugguggcuuccaacuuucuuuuuuuuuuuuuuuaacaaugcuuaugaauuucuuuuuuuaagauuuauuuuccccacauuuuuuauuagauauuuucuucauuuucauuucaaaugcuauccugaaaguccccuauacccucccuccacccugcuccccuacccauccacuccuacuucuuggcccuggcguuccccuguacuggggcauauaaaguuugcuagaccaaggggccucucuucccaaugauggccgacuaggccaucuucugcuacguaugcagcuagagacaugagcacuggggguacugguuaguucauauuguuguuccaccuauagaguugcagaccccuucagcuccuuggguacuuucucuagcuccuccauugggggcccuguguuccauccaauagcugacugugagcauccacuucuguauuugccaggaacuggcaaagccucacaggagacagcuauaucaggguccuuucagcaaaaucugcaauagugucuguguuugguggcugauuaugggauggacccccggguggggcagucucuggaugguccauccuuucaucuuagcuccaaacuuugucucugcaacuccuuccauggauauuuuauucccuauucuagggagaaaugaaguauccacgcguuggucuuccuucuugugauacauuuacacaauggaguacuacucagcuauuaaaaacaaugaauuuaugaaauucuugggcaaauggauguaucuggaggauaucauccugagugagguaaaccaaucacaaaagaagucacuugauaugcacucacugauaaguggauauuagcccagaaaccuagaauacccaagauacaauuuccaaaacaagaaaauaaggaagaccaacgcguggauacuucauuccucccuagaauaggcuuccaacuuucuguagcuccaguugcaggugaucugacacccucuucuggcuccugugggcaccaggcaugcaguugguacauagaaauauauucaagcaaaauacccauacauaaaauaaaacuaaacauuuuuuuuuuaaauguaaaggccuuuuugaugacugcaauguguuuaaugcaggaacaacugaguguucuucaagugaagcuggaugaagaagaacguaaaaaccugaaacuucaacagaauguugacaagcuagaacaccauucuacacaaaugcaggagguaaggggcagagcccagccucagaaggagcugaaacccucaacgugaaggcacugugaggagaugagaugagggauucucccuuaaaagcccuuccacucuugaaguucuuuucauuuuccuuaauaaaucuauguacacucugaccucuuuugagguccccccgccccaacauugccagaugaaaauucccuuacuaagcccuagucaacuuuuuguacuucucugauagugacacagauacccauugucucaguucuggaccacuuagugaggugugcaaguggacuguguagaagaaaucaaaauggucugugcacacucucauauugauguuggauugucaucuucauuauaguucauaaacaaccaaguuucgucuugucauuuaccuuaaaacuagacauuaaauacaaaaacaaauugugucuuaguauacuuuuccaauguauuuacuuuucccaaagcuuuucucaucagaaagaagcgauuggaccaaacaacagcaagagcacgucacacagcugagugaccuggaaaagcagcugcaggaugcucagacuaagaaugaguguaaguuuggacaacuggggacacucaguauuguuuuuaauauuuaaauuauugaguuuuguuuguuuguuuguuuguauguuaagggcuugcuuguuuguuguuagauaauugaucuuaaauuuucaugguaaauguauaauaaauaaacucucaaagaaauaauuuuccucaagauuggucacaaaugaauauuacaaguguuuacuuaaaguuuauuuaaaagcugggaagaugguuauguugccuuacaauuuugaggaccugaacucagaaucuagagcccacauaaaaagccgggcauggugugacacacaucuguuauccuagugauaucaagauggaagacaacaaacagaucccaguucacuagacuaauccagccuacuuacuaaggcacugggccagugaaaggccuggucucaaacaacaguggaaugcaccugagcaguuaguucuauccaagugucugcucugaccugcacacggacauacgugaacaagcauaccuaaauaaauacauacaaacacacacacaaaguuuaaaguccuuuaaaaaugaagugucuuuaauuugaaagcugaguuacauuaauagugacaaaguaaaccauaaauuauuuauauacucuucuagguaugggguaucuuuccuacuuuuauuuuaguauauacuugucuucaucaagcauuuucagauaagccagguaauccagcagugaguggguuaagucaggagguucagcagcuggaggucuuccugggaugcauaagauucuaucuccaaaauauuuucaguaaauuguaguaaacuauaagucacuuaaucuacuuuuuaguuggaguuaaaucuuuugaggcuacaaguguuuaacccauuguugaaaaguucugguauauuacuaaagcauuucaacagcuaagagcacaccccuucaaauauguuaaucucucaaguuuuucuuauacuaauaguuuuguugcauauucaacuggaaagaauaucuuaaaaaaucaagugaccuaaaaacuaggaacagauguuaucucuuucuauuucugcagaaauguugggacagcugaguaugguagcauaugccuauaaucccagaacucaggaagugaaagcaggaaggugaggugggcaggguuauccuugcuacaugguaagaauaaggccaggcuggggcaaaagaaauguaggugcaaccaggaccuaaggagaggagaaaaaaaaaauuuaguguuuagugcuuaguuguugguguuuguccuuacagugguaacauuguuauuauuugcuugcuuuauaaauaauauagucuccuuuauacaaagaaccuguaaagggaccuguugagaccuugauuuccuuuauuuucuaguuuugaaaugugaggugcaugaccugcgaauuguucuuaauucugcugacaaagaacuuucuuuggugaaacuggaguauagcacauucaaagagaaucacgagaaagaacuaagccagcuuucugaaagacaugugcagguucagcuucagcuggacaacgccagguagaguucucugauggcuaaagaugcuugcuucauuauucguaguacucuuugaaguauuauaaucccaacucacauugcauaagccaucaaguacacuguuuuccuaauugguguuggcuucacuauaaacaguguguguguguuuaaguguauugauuuacuuuuuuuugcuuguuuuuuuuuuuuguuuuguuuuguuuuguuuuguuuuucugagacacugucucccuauguagauuugccuggccugaaaccuauucugguucccuagugcugguaucuaagacaugugccaccacaccugaucaaaucacacugcauuaucuacugagcuauguguuuaaaugcuaucuuaaaaagcaaugauuauccuagccuuuaaaauauauuggucaaaauguaauuauaauuuuuuuauuaacaacgucuuagugucuguaguguuauauaagcuacuuacugggcugcucacccucugacccucagugucuggugaugcuucugcgugguagagcucacacugccauuugcuucuuacugccuuuugccuguacucuccaccuugaagacauacacacauccccaucucaccccuuagccgcugcuucauugcccuuugugguuugcugcuucugcccuccucaguuugcacagcguaugggucugccucagugagccguauauaagcuacagcucagagcugagguuguugccugauucuuugggugacugcuggguacccgugaugcagugugcuggggagaggagcaaaaagcguaacugaaccggcaacuagucauucuugcugagauuaaauucucugauguuuccuguccuaaaaauauccguuagagcuagacuuuguuguuagcaaaguucuuaacagcuggauuugaaccguuaacaaugcuuggaaauuaaguuucuagugccuagcuagaaacacucaagugagcuacaucaccaauugucaauuagcuguuaaauugccaaucaguuaacuucaugagcaaggauauggaaggaauacuugaggcuaguauuuccuuuucaucuguuucuucugguuuuagugguuuccacauggguaccaagggcaacccacacaaggccaugacagcucucugaaaaacguaaaugcuuugugauagaaaaacuugaacuuaagaaaaucugacucaaaaaaguuuauacuuuccauuucaaaauuucuuccugguaaagauuagaaaaugaaaaacuucuugagagccaagccugucuacaggauuccuacgauaacuuacaagaaguaaugaaauuugaaaucgaccaacuuucaaaaaaucuccaaaacugcaaacaagaaaaugaaacuuuaaagucugaucugcauguaagugauuaacaguguuguagcuggugagugagugagugagugagugagugagugagugagugcauccugggucuuugcuuccugucccguucucugauuuccuggagcaaccacaguucuugguauauuuuaacugccugauacucacaacugucacaucacaccuaauauaugguugucuuuuagaauuugguggagcuuuuugaagcagaaaaagaacgcaacaacaaauugucauuacaauuugaagaagauaaagaaaacagcucuaagugagugcugcuaauucuuccuauuagaauauuguucaguacuacauucuuuaucuugcuuugggaacuuuagggucuugcugucuagcacaggcuagccuuaaccccgccuuccuccuguuugggucccauguguuaggagcauaggagcauagggcuccacugugcacugcuuuuaacuugugcuuucauuaacaccuuagcuauuuucaauuuggagaguucuuuucauuuagggguuaacucagugauauagcacuuucuuuuuuuuuuuuuuuuuuuuuuuuugguuuuucgagacaggguuucucuaucuguccuggaacucacuuuguagaccaggcuggccucgaacucagaaaccugccugccucugccuccccagugcugggauuaaaggcgugcaccaccacgcccugcugauaauacacuuucuuauuagacuugaggcccuggcuuaaaucccaacaccacacauuuuuuuaaaaaaaggaauuacuuuccuuuaaagcauuccaaagugaacagcaaauuuuguaaaaguagcugugaagaaggaaacuucaguuaaaaauauaacuaauuagucuuuguuuuuguugguuuggaggagugguugguugguugguuggcuggcuggcuggcugguugguuuguuugguuuugguauaguuuggcuuuguuuuguuuuguuuuguuuuguuuagagacagugucuuacuaugugauccuggaugaccuagaacgaauagagauacaccugcuugccccugcuuccugagugcuaggauuaguguauaccaccucaccaggcuacugacuauccuuuuauuauuggaguauagggggugacuuuauuucugucuucuaucaaucuuuuucuauuccuuuuuucccagacucucauugucuuauuccugucucucucagugagucucugucaguagucucaugaccacacuaggaagaauaauuggguuuuagucacuauuuacagcauucuuuugugauuguucuuggcccugauucacuauguugaaaggagagccugccacuucuugagauauagagaauuaacauuuagucauguccagugagcuggagccagugcugugagucugugcugugggugcaggaauacagagugaggcaaugaaugagacaucccugucuguagucaugggcuuuaccuuccauuucagacagaugcgauaaauaaugugugcugugugcuagguuaucaaaugccaaacccuagagaaaaaaaugaaagaguugugguacaaaaauaauuccucauuaaauaguugugaacaaacauauucaacuuuuagaucuccgugggaaugugcuaacccaggauuugccugauagacgucacugaaugacauuuaauuugagucugcauguucauuuuaugauuucauuaauucuuuuuuuccagagaaaucuuaaagguucuugaaacuguacgucaggaaaaacagaaagagauggccaagugugaaaagcaggucagcuuccuauccugaauauagaauuugaaauuuguaacuuuuauuccugaagucugaaaagaaaguggcacagcuuuacaguguuagaaaucacuaauaaaaggcuucuuguuguugcugcugcugcugggguucaaacuagggucccuuccacugaaguacauccuggguccuguuuguuuguugguuuauuauugagacaggaucucuguguaauccuggcuggccuggaacuuucuaugcagaccagacugguuuccagcucucagggugcugggauuacaggcauguuccucuagaccuggccacccuugauauuuugaggcagggucacacuauagaugcccuggaauuuacucgguagcccaagcuuucucugaacuuaagagccucuaggcccugccuuccaaaugcuaggauaacaucugacuaguucuguuuuguuuuuguucuuuuaauuuuguuuguuuguuuuugguuuuguuuuguuugaaacuugguuucucuauguagcuuuggcuauccuggaacuuacucuguaggccagucuggccuugaacucauagacccaacuguucugccuccuaagugcugggauuaaaguugggggccaccacucccauucccuggcuugaauuuuuuauuucucucucucucucucucucucucucucucucucucucucucucucucucucucucucucucucguguguguguguuuguucguguucugguucuauuauuuguuacuauuuucuauuucccagguggcuguaaugauauguacuggugcucaguugauugagaccucaaaacccacuguccuuuagguacuguuagaguagacuaaugugcugugcaguuaucagcuugguuuuuguuguuuuuaaugugacuauuuacuuuucaccauagauggcaaaaauacagaaacuagaagaaagcuugcuugcuacugaaaauguuaucagcucucuggaaaagucuagagagucugacaagguagguagaguuuucaguguuauucuuuuguauuuuguuucuuuauuuuuguugugguaucuauuuauuauuagaucuaugauuucucuauauagccugagcuggcuuugaaaucgcaaucauuuuacacaagcuucugagacacagguauaugucauuguaccugcuuuacauugucuuuauaaugcaacuuaggcauuccugucuucuguaccaucucuguccugcaggaugacuuacaaacugccugguccauuugcauuuagguccuuuaagggugcuggagaauuggaaauucaauuagguaauuuguuucuuaaccucaaccacaaacuacucuuuuuuaaaaaaaaaaaaagauuuauuuuauguauaugaguaugagaaaagggcaucaauuccaguauagacgguugugagccaccaugugguugcugggaauuuaacucaggaccuuuggaagaggcagucaaugcucuuaagcgcugagccaucucuccagccccacaaaccuacucuucucuauuuuuuauucguuuguuugagacauggucucacuauguguacuaaauggauuggaacuuacuauguagaccaugcuggccucaaacucagaauaccugucuuugccccccuagcacugagaugaaaggcgugugcugccacauccaccuuuacucuguuccuuuacacggcuuauguaacauguguugguuguuucaacuagacugcuauuacucugacccuauuuuacugacuauaaguucaugauguacagucucaaauccuuacuguugacuuugccagaauaauaaaagugacuugucuuuccaaauauaaaaauggucuaacccugucguacaagcacuuaggauacugaagcaagacucucauuaguuaagaggccagccugugcuauauagagaucuaaaagcugagcuagccugagcuacauagugaaacccuaucuccaagggaaaaaaauuguaaaagauggaaugucacauaauauuugcuaaaguaaauugacuuucuuuauuaccacuaguuaacagaaguaguuuauguguuagcuacuuuucuuacugaugugaccaaauacccugaaaagaauuuuuaguagggaagauuuauucugacucaggagaagcaaggcauggcuccauguugauaaggagcucuauggcuauucauugcaaaacaccuaaucagacacccagggagcuuguguagcaauuggaggugccaauaacccuaguacccacuuccuccaacuaggucucaccucccaagugguccaugagcccccaaacaccaccagcuucugggagucaguguucaaauguaagaguauaagaaaaaguuuauugaaacugcaacaguucaucuuuuuaaaugauccccauaauguuacuggcuuugcagauaaauguuuuuguccuugucaggaacuugucaccaaccucaugaaccaaauccaggaguuaagaauaucaauuggugaaaaaucagaaaccauagccacccugaaacaagaacuucaagacauaaauguaaguucugucacaggaugcugagcuuaagcagggcacgauucacaggcucuuugggggucuguuagccaucccaacagguaagaagauuguauguugcaguaaguuugacuguagaaguuaauacccagacgauuucugagaugugcagugugcacauuucuggacaaaagcauuucugugccaggucuuuuugaccuggaauauuguucucagcaccauucuccaaccacuaacaaauaaacuagaaauaaacuaacaguuaaggcuaaagagggcuccuuauuugacucaagaaaaaaaaaaauacaugucuuaguuaaauuugaagauauuuauuacauggaauugugucucugaucugagacucgauaucauuuucugaaguaacuguuguuuagcauugauguuuugcccuuugcuugggccaagguaaaggcuuuuaucugcauuaguucugcucugacggggcuugcuucaauccauauuuaucuucacaggcagacucugaugaggugacagagcuagauggcuuucucuaaccugcgggacuguccugugguucuucgccaugugcacuagcucuaccuccuucccuagcaaggcuuuguggggcuguggaaguggcuuagugguuagagaaguugcuacucuuccaaggaccugaugcagccccccccacuggacaucucauaacucugugucacgcgcacgcgcacacgcacacacaauaaaacugaaaacaaaccaagccacagccaccacacgagguguuacugaauuagcucguuaaugcagugcucucccuggaacuaagagacuucuaaguugcuuugcugugcagaugagcagaacucuagcagauagcucuugugcugugacuuucuuuucugcagugcaaauacaaugcuucauuggcugacaaagaagagagcaaggaauugaucaggagacaggaaguggauauccuggaacugaaagaaacucuuagacugagaauccucucagaggacaucgagguagguauuaacgugguacuuucuuuuuauuauuucuauucucucucucucucucucucucucucucucucucucucugugugugugugugugucugucugucugucugucugucugucucucccccccgccccgcccuuuuuucucuuugagacaggaucucauugugccaaccaugcugaucuugaacucacauaauuccucugccucugacuuuuuuucaaaggaugacucagaggguaaaguuacuuccucugaaguugaccaucuuauuugaauccucaaaacccacaugguagaaggaagaacuguuuuauuguugaaaaaccaacaguaaaaauuauuaaguccuauucacaaaaauaaaauauaucagaaucuuaaggagaaaauuuagcaaguguuaggcugucagagagauuccaagugauguaaaagaaaacuugaaaaggaaaguacaaaauuacuauagacacaaaaauucauguauucuaguucaaauuguaagucuuaaaaguugaugaaaucugggcauggaggcacuugccuuuaaucccacuguuugggaggccaaagcaaguguacacaggaagguccaugucagccagaguuacccagugagccugucuuaaaaggaaggacagagagggaaagggggaauccagguauaaacauaaaaugcauacacacaaacaaacauaaaacaaaaaagcuucaagucagccggugugauggcuuuaaucccagcacuugggaggcagagacgaguggagcucugugaguucgagaucugcauggacccaggacccuguuauacagagaaacccuguuuuggaaaacaaacgugugugugguggguguguguguguguguguguguguguguguguguguuuguguuuggggagguacauguggaggccaggcaccaucaaaauccugguuuuugagauaaauccuuccuuccugugacuuggaauucacugauuaggcuagaguauucagccugugaaccauggacauccuccugucucucccuccccagugcuguguuugucggcaugccauuaugcccagccuuuacaugaguguuaagaacugaacuccagucuucaugacugcacuaguuuccuuucuauugcugugacaaaacacugauugaaaacaccuuggagaggaaacuuacuuucugucuuacacuuccagaucacacucgauuauugagagaagucagggcagaauacaaagcagaaaccauagaggaggucugcaugaucgcuccgucccuggcuaacucacaggcuuaugauuaacucuaccaugccuagagauggugcuaccuacaggccagacaaauccaggcgauucaauugaggcuuuccucucaaguuaacaagauaacuaggauacguggcaggauuuuauugacugaguaucuuucuagcaccucaggcccuuaucuaucuaucuaccuaucucuuuguuuguuuguuuguuuguuuauguggauuuuguuuugcuguuuauauuugugugggguguaugcaguacucuuagaggccagaagagggcuuugggucuucugcugcacacuugaguccugugcagcagcacuuuauuagcaucugguuacauccccagcccucggaucaucuuuguaaacagugugcacacgucguccauacgggaagggaggaugagcaggugcugcucugccgugcucaccagaguguuccuaugcuguguaagugggaauuacauaugcagccauuagggauuuucugccacuuuguaccaccuuauucuccgagguuucaguagccagugccauggugagcuguuacagcucuuccuugaguacguaggcuagacacaucuuuaacagcuauuuaccuucuaggcuauaaaaaccagagucaaacuaaggauaauaguucuguagauaaagugcuugcugcauaagcauggugaaugauaauaaacauuccuaacauuaccucugacgucuguauaugucacauggguauguauacacacacacacacacacacacacacacacacacaaagagagaggcaugugugcaaaauaucuuaaucauguaagcccaugaaacucaacuauugagacauuaaguaagaucugcuucuuaaggguucuuauggaaagaugaguucuaaaauccugauugagaaacugaaucuacugacaucacaccuaggccuguuuacauacaugucagcugagaggggugucuuggaaugguuuaccacauaaaccaaaggaaaaaacuuuuuuuaacaauguuuuuuaaagauuuauuuauuuuauucauaugaguacacuguugcugucuucagacacaccagaagagggcauuggauccuaugauagauggcugugagccaccaugugguugcugggaauugaacucaggaugucuagaagagcagucagcgcucuuaaccacugagccguuucuggagcccaggaaaaaacguuuuaaauguuuaaguauuuccuuuccuaacuuuaaauuuguauaggacuauagucaugauugugagcugaauggcauagucagaaauaaaccuuuucuuugggacauugcucccugacagagggacaugcucugugaagaucuggcccaugccacugagcagcugaacaugcucacggaggcuuccaagaagcacucuggacugcugcagucugcucaagaggagcugaccaggaaggaggcgcugauccaggaacugcaacacaagguaagcggccacucagcugcucagacaccagcaaccagcagcacgguaccgacuuuccugcuuugacaaaguucucuguguuauagaaauggaacaaauggaucaauuaggggguuuggcauucaacuauggacuguacaauuggguuuccacaugugagucucacuuagccacuuccucuuuguccugggcucuuuacacauugacaacauugucugaagcgagguuauggcugaaaacaaugagauauuaagacaaaacuauagcauucuucaaacuaaugaauuuugcacacauacauauauaacauuuaagaaacuuuuuuuugcuguuguuuuagauagggucucacuauuguauguuggcuuugagcucauaauucucuugcuuccaccucucagaggacuaagaguggagauacaugucuuuauacccagaauaaaacaauuuugcauugacagauaauuggauacacuuaugagguucacagugauagguuuuacuggaguggguugagacagucuuguuaauguagcccuugcccuagcuugcuugguacucaguagguagcccagacuagccuggugcucuagaauucaggguguccucaaacucaggguaacccuccuacuucagccuauaaauuaugagauuacagucauggggcuccuuaccugccacauuguguugcuacaauauguguuuaucuguguguguguguguguguguguguguguguguguguguauguguagagauuaaaucaaguugguuaauauauccaugaucuaccauacaauuuugugauacaguuucaaaucuauuguuguugucauuuugaauuauacuuuauuacuuuauauauuauuuuugcuuaugcucaaaauauauugcauuagaucucaaaaaguugcuuuuguuugaaccccgguucuucugugagaacacuucuggcaucucccauccagggcucuucagcuccccagucuauguaaccacucuucuacauggcaccucugagcuaggcuguuguggauuccacauggacacgacauccuuuucuuucuucacuuggguucuaucaauuccaugacaucgucuagguucauuguuugccugucucaggcuggcaguguucuuguguaccucagcauuacguguuuuuugcaucugcugguggauacuuaggguuacuauguucuuuggcuauugugaauaaaccugggguuaaaauaggaauauggcccucucuucaaguguugucacagaguggggagaugggucaguggauaaagcaguugccaggcaaggauuuuugauuugcagaacucacauaauagccagguaggcaugguggcccacuuguaaucucaguaugcaguaaggaaaaccagugacucuccugagcacaagcugaagcaguaaacugagaaacugccucagcagcaguuggccuccacagaucauauacauuuauauacauucagucugacacauaugugagccuauacacauguacguauacucauacgugcaugcacacauaccacacacacacaauuucguuuucuucagauguaaaccagaacugaaauugcuggccacauggggaguucuaguuuguuuuaaggaugaccuuccccauucuccaugaguuuguagugauuggcguaccaagauccauguagucucugcauguccucaugagagcgucucucaccucuacagggacaucacacugcgacacugauuugcuuucucugcggcuggcaguacugaaguugucuuuucugacugcacuguauguucucaguuauuuucuaaaccauaaccuguugucuguugaaugugcccaguuaaaccaggagaaggaggaaguggagcagaagaagaaugaguucagcuugaagaugaggcagcuggagcacgugaugggcucugcuaccgaguauccacagguacuuucccagaaacugcauuucagaauaaucaauuuuacaaaugaagaaaaaauuguaaauaaugggggguuuuguuuguuuuguuguuguauuuuguuauuuuaaaggaaaagcucuucauuagugccccugucugcuuucuacuuaguaaagucuuguuuuacuuggauaagaaugaaaauaauaagcaaaaugaucuuuaucagcaugcucuauacucaagaggcuuggcauauacaugaaaaugcauauuuuaucugcuaaguguauagacuggaaaugaaaucuucauagcaucauguaaucaagcauuuggaugaagugugguuuuauuucagagucccaaaacaccaccccauuuucaagcucauuuggcaaaacucuuggaaacacaagaacaagagauagaagauggaagagccucuaagacuucuuugcaacaccuuguaacaaagcuaaaugaagauagagaagucaaaaaugcugaaauucucagaaugaagguacaugacuuuuuuuuuucagugaacuuuauuuuaaaaggcaacagcuuccuccuagcugcugcugauccaaauucaaaaggcaacauucuaucauagauagagaagucuuccucccaccccugaccccuugcagucuaguuuguugucccuggaagcucccaguuuccuuuccuuucuuguuaaaguguuucaguguauacugauauacuuuucuaaagucuauaacccucucccugacuugugcaggagguuuacacaaagguuauauaguuuccacaaaccacaugucaugggcaguggaagaagaggccugauuccuugauuuucaccucauagugcuguccaguaucugcaucuuugccagcuuacuagcuacaacguauuaucuccgcacaguuugaaugugugcauacguuaugugauugggcaugcaugugcuuguggaggccagagguuaacaucgcauguauuuaucauuuuccaccuuacuuuuuagggaggaucucagacagacacuauacugacugagcugucuucuuaggccuucaguaugguuugaaauuuaacucuuauucugucuuuucuccucuccucuucugcccuuuuccuugucuuuugugagugugugagggucuguauaugauauaauguaugguguguguguguucauuguaugacugagcacacauauaccauagaaugcauguggaaguugaaggacaaccacaggugucagccuucaucuucuauuuuguuugcugcugugugugccagagauuggcugauccaaaacuuacagagauuccauuccccaccaccacuguaaagggaauaagaauuauaaacaugugcccagguuuacguggauucccgggaguuaagcucagguccucacacuuagugggcaaguguuuuacccacugagcauuuccccagcuugcucuuuaccuuacugagacagagucugacuguagagcuaugcaaccagaugggcucugaacuccugguccguuuucccucagccuccugagugcugggccuccaggccuggcuauaaagugaggaucuaauuuaagugugcguuuuggccucaauuuuuaauguuuagcucaauuggcauguauuaaauagaaucaaaaguugaaagcaguuaccagagauuuuguaucaguuuuuucucuuagaggaacuuggcuguuauguuacauuaauaaacucuuuaagacacugaacauguuugugagucacaguucuaagacuuguaagugcuugucacaaacuguuuaauccaauaauagcuguugcauuauuguauuguaggaauguaaaaagggauaccugucuuggucacaaccuuuucuuuggaugaguugggggagugacgcggggucucaauucauagcccuggcugcccuggaacuccccguauaguccaggguggccucaagcucacaguguugcuugccucugccuccuguaugaaaucaaaggugugugccacuacaugcaguuucaggcccaaccucaagaagcaaaauaacacccagucuagugugucuucugaaaaacaaaaacaaaccguuauuuuguguauucucaggaucaauugugugaaauggaaaaucuacgccuggagucucagcaauuaagagagaaaaacuggcuccugcaacgucagcuggaugaugugaaaaggcagcaggagagugggucaguaggagccgaaaggccuccaccuggacuggucugccugcauggccuucauugagugagguugaagcgaacuuuaccagacaggacauccccaugagaagugcuugguuggucaugagguugugggcuuuuucuagcauugcaggauaagacauuuaccaccuaucagcucagugaacuaagcauuugggauauauuuagaagauguaaaaauuuuaaauuuuuuuuauuauauaaaugcauuuuauacaucaagcauauuaauaacauugaguauuuugagaaucaaauaauacuuuaaaaauuuguucaacuuuuauauucauauucuuucauacacuaaaaauaacauuaaugaacauuuacuacuaucuauaacuaaggauccuauaucuaauuuugaauacuaaauuguuucaaaacauacaaaauauucuuugggaauuaagcauaguaaaaggguauaaaauauuaaaaauaaaucauuaagaaauauauucaaaagcccuuauaugguaccaucugacauagugagagaguauuaaaaacauacauugucuaacuauacauuuauuuaaaaaagauuaucaguguuucuaggaaacaaauuauuuuaucaguaaguauauuuuaaaaauuucaaaacagcaaaaauucuuugaaguuaaacauuaagaaaguucuaauuucaagcacagggaaaaaaauuaaaaauauuuccaugauguuuauagaacaugauuuuaauauuuucaacuguuaauauucaacaaacagaacaauuauuuuaagauauauuuuguugucaugucucccuucucacuuaugauuuuauuaauuugggugcugucucugugcccucugguuggucuggcugaggaacucugucacaggguggcagccuuaggaagguugagaagugcugcuccaggugcuccaggcaucugcgagucuacucaccuaucucccacgagcgccacaccuugcuguucuuaugaagagcuacauagcuuucccaagucacuucaauucaaaguacuuuauuucacuuccuuucagguuucuacaaacuauaacccaaucuaguucacaggccguucuuaaauaacauucuguuggugcauaguuaccuuccaguuuuuuguuuugucuuguuuuuuuguuuuuucuuuugagacugucucacucuguagccuuggcuggccucaaacucagagauauauaugccucucccuccugagugcuggaaucaacauuguauguuaccaagccuggcuugcuuccuuucagucaccaugcugaaugguuguaauguuauauggcuaccaagcucuaaaauaaugucuagaucuuauuuuauguauauagguguuuuguccauauguguaucuguaucaaugugucccuggugccugggguggucauaagacagugcuggguuccauaacuaacuagaguuacaagugguuauaugccaccauguagauguugggaaucaaacccuaguccucaggaagaacagcaaguacuuuggacugcugagccaucuuuccagcccuaugucuggaucuugacuauaucuauauauuuuuuucuuaccccuaaauauggaucauugcacacugcacuccuuuccuugaccuuggcugacuuugacauugacucucauugucaguugacuaggcuacauuuaugaaagaagagagaagcccugcugugcugugaccacauaagagauuccugucaaagcucacaucacucaggcagguuccacagugaagucuuccuggcccacugaacuacguuuacucucccaacccaggcaaccuugcagagaugcaugugcagucuagacuguaaucccuuuguuuguuucugaagcauuuauuuucugugaagggagucccugauguuuguauacaugggaagccagaguagucaucagaagcugcaaccuaacaaacuggaaaagccaagauaccagacgacccuccuguaguugcugacagucugccuucguuuagucacaguugaucugcagguugccacucauagcuaaguuucuucacuaacucuucuaccaagcuuugauuagauuucugcacuguacucuucuugcuuguauaguaguaagaaucagucugaguucuggggggauccuauuuaucccaugugugggcacacugauuaucuguacucaucacaagcguuagcugcgcuguagcuacauaaaauaaauguucauuaauucuugaauguacuugacaauguuucccugucuacucccuaaucuaugcagcgaucagagucauccagacagucaacagcugaagaaugaacaugaagagauuaucaaagaaagacuugcuaagguauggcuuuuuuuuuuaauuacagaaaguucuucugugagaauugcuuuuauaaauaacaauguuuauuuauucuagaaaccauacauuacuauauaauugagaaguaaagguguaucugucuguaauuccaguacuugggaaacuggcacagaacaguuaccauggucuguggcucuaaccauuaacagaaagaaggaaggaggugucuugucucuugcuucuguagcaagcacuauguuuuccacauacaguuauguacuuagaaguguggugucuucuggccaccaugcuggaaugcuugggaaccaguagccuuugcauaucauacgggacucuggacauggacauugguuugauuagcacaaagggaaauggacuuguucuucucaccuuuuuuaaaaauaaggauauuaaagaacuuaaccauccuuuuuguuuuccuuuuuauuauagaauaaacuuauugaagagaugcugaaaaugaaaacaaaguaaguaugcuauuuuauaguucaaauccuuuuaaaaauauuucuaaacuuuauuaugggggaguauaugcaugccaugccaagcguguggaggucugaggacaaaugugagaguuggcucucuucuuccaccauggguuguaggugucaaacgcaggucaucaggcucaugcaacaguguuguaccugcagagcuaacuggccagaccugguucguccguccuuucucucucucucucucucuuuuuaaauuucauguguauggguguuuugcuuugccuguauauauguuuguguacuauauaugugcaugguaccuacagaggccagaagaagucaucagaucccucugaaacuggaguuacagaguuaugaacucuuugaggguagaauucuccucuaaagggaaaauacaucaauaaaauaccuuuuuuucuucugugguauaugugaguauaauugauguuuaucaaagucuuuuuuuaauauuuuaaaauuuuuauuuaugugcaugugucuauuuauggguaugcacacaugcaugcaugugucugcagaaaccaaaaagaggacaucagagccccuccagcugaucaggcaauugugaccugcccuuuaugggugcuuaaaauuauaacuacucagccaucucucuagcaucaaaauuauuuuucuugaugccacuuucucaacagggguuuuaaguaaagccacuuaaacaaacaaaccaaccaaagcacaugugcaaucuccaguuaauuauugaguuccugugcugugagguuuucuccucauggacaauaagggcacguuaaugcuuccaacuaguagugguuaagcugacauagaggauggugaacuauccagcuaguuuguagaacugcagcaaauuuagauauauccuuugagaccuuguagcaugguaugugguggcagaaguccuuggugauaugugguccuugaagcaugaagagcuuacacugcacugugggcauacauacagcacauuuuccuaaaugcucuaggaacuagauaccaaacugcaguagcauaagcaggaaauacuuaauuucauaugcuaggggacugagauucugcuuuugggaugucuggcuacauuaugccacuacaguuccaccagcgucuuuccauaggauggugcagcaguagcugcugcugcugcuuuucuucuuucuuuuuucaaggucucauuuuguagccccggaguucuggcuagccuaaaauuauuauguagaccagacauccucagggcuuagaaagccaguauccagcaaggaaaaguagaacucacagugcucaugcucagcuaaugacagaugucagccauugcugggaaguagaugagcucauguucuucuuugcuacaucagaugaguuucauaaacaagaagccaagugucuucacguccuucucacugcuucaauacaauacucaccaaaaagaaaaaagaaaugaagaaagcucuuacguugauuuacaguuccaguugauauauagcccaucaugguggcgaauagcauggcucaagaguaggaagcuaaguuuuauauuauauugcauuuguagucacggaucagcgagaaagcagaaguaugacugggcaauaaaaauugauggugcauaccuuuaaucccagugcucagaaggcagaggcaggugagucucuugaguucaaggcuaaggcuauucuuguuuaccauaguaaauuucaggacagccaggucuacacagagaaaacccugucucagacagaucauuuaaccucaagucaugggccccagaguuagauacuuccuccugaaagcuuuuacuuccuaaagguuccacagucuuccaaaauagugacaguuagcuaggaaccaagugaaaacacaugagcccaagggaacuuuucaucuucaagccauaacaccugauccacaguaagguaggcagaggcagcaucugaacguuuuaucccaccaaagcggauguggaacacucccucauuaucuccuuggguaccucugagcaugcucuggaaacacauccccuagacugagcuggccuguguggagauccugagcaccaccucaucuuggcaguguuacauucuguaugcauuguaacaguguuuccaauggaaauuguaucaaacugaaacaguuuuauaaaguggguaaaguccuacauuuuuccauugaguuauauacaguggguaagaaugaacaccccugaggaaagggauaaaguuccauugucugaagacuggguuuuaaaagcagaaaugauauucugagaucagacacaauaaagccuacagacuguaacaauaccuuacuucuaucuccacuuggacaagcuaaguuuuauacuaaauuuuuaugagguuagccugggcuacacaagagccuggcuccaaauaaauaaauaaaaugguuugaugaguuuuucucaagaugaaagucuugacuaacaaagcaaccauaucugauauucaguacacuuucucuuccaugcucagggugaagcugagggccugggccaugucaggaaaguauucugucaccuagguucaguccaguucuagcuuaugcucuucugucaacuguacaggagaccugaagaucagugaugcuuucaaaucaaaauucuguacuuagaagaaaaaaccuaguuugaauccugcuuuauaauucuauuuccuugaaauaccauaaccugaugcuuauuccagucuagaagaaguccagagugcacuucacagcaaggagaaggccugccacagaaugagugaggaaauugagcgaaccagaacuuuggagucuagagcauuucaggaaaaggagcaacugcggucaaaguuggaagaaauguaugaagaaagagagagaacuuuccugguguguuggguuuuccaugcuauguagaaauacuuaaguagaauaagcaaaaaccaaaucucugguucaguuucucuagugugcagagauauauggccacagaagcuugaccaccucuugauuggagcucuugaaaagagauacauaaugugaucuucccauccuuggauugacaggaaauggaaaugcugaaaaagcaacuagaauuucuugcugaggaaaauggaaaauugguaggucaucaaaaccuacaucagaagauucaauauguaguacgacugaagaaggaaaauaucaggcuuacugagguaaaacugaaacuauucucaauaaauggugguuuuaaagagauuuuaguaaagaaaauugucacugcuauuucacuuuggguuuuuugagacagggucauacucugaaauccagucugaaacagaacucucacagcaguccucuugucucagccuucgcagugggugggauaauaagugugugugagccacccaauaauacugguaauucagguuaaauucucauagaugccagauauuuaauauuaacuuauaaauuaaacauuguagcuuuaauuugaauauauccuuaaugaguuaagaaaacagcuccuauaauaauuaauuuccuuuuuuauuuuaauuacaggagacagaaaaauugcgugcugaaaaucuauuuuugaaagaaaaaaagaaggaauucuaaggaucccagcuaucuucauacacaucacuuuguuuagauugauucuuuaaaagugggauuguauuugcucacaugguagaacuaaacuaaaagaccuuaacuaugaaucauggugcgcacuaaucccgaguguuccgauggauagugugcaugcaaacucagcagccuguuaaguaacaaugcauuccaagucauguguacauucuggaagacccuuaaaagucuguagcugaggucucuggugaauucuagucagguccuuuucuucuuuuuuuauuuacuuuauuuuauuuuuuuuuuuuuugguuuuuugagacaggguuucucuguauagcucuggcugucuuggaacuaacuaacucuguaguccagccuggccucgaacucagaaaucugccugccucugccucccgagugcugggauuaaaggugugcgccaccacggccaguggguccuuuucuucuuagauucgccuuugauaaacucgcugugaauccgauggcuguuuuguauugaacuuguucauauauauugguuuguuuuguaacuguuauggccauuuucuacauguccaguuuuucaaauaaaaucuuuuuuaaaaacaau

SEQ ID NO: 5391 - RNA, 2583 nt, Mus musculus
cugcaccuggcucccgaaggccagcuuggcggcggcggcggccagagccccgaacgccccggcgcacagacaguugaacacgccccagaagcggcgccgcaucgcgccuuucuguaggcgagcggguaacuccacgggugagucaggguaagcggccgcagacacggcggcacccgaggacugcggaccggccgccaugaggcccgcugcgcccgccacggccgacugccacgcacgccgccacccgccgugagcccggcuagggcggagccaggcgagugaggcgaaucugcugcaguggaguccggagccgagccgagccgagccuacaaaugaaaggaaucuggagcccauacccugcagcgugugcaaacccgcgacuaaggagagccugcggcuccggcgaaccugggggaugggaauccgguagcgaggaccgugcgccacugaaggaagcgugcuaccgagagguaccuacugugagagaggaaucugcugacgugaacuuggggaggaggggaguuuaucuccgaggagaaccugcggcggaaguaaccuuguuucugaaagagcccugcagucaaggggaaccugcuucugagaagacggggaggucugccacuuuacauggaugcgcaccuaacaugcuaauccugaagccaagcugcaccuucaaagcaccucugcucccucguggacgcaggagaugauggaucuggagaccggccgcuugagacagaacguuguuugggaaaacguuuguucugccuggaccaucagaagcacagucacuucuaaguucguguaaaguaauugagaacgacaaaaaaauugaaaaaacaaccaaaaaaaaaaaaaacccaaacaaaccguaaaaugucaucuacugucgguaauuccagaugcuuaggaugcugaggcaguuaauggucauccugagcaacuuagggagacauugucucacuugagagggcuggcagccaggcaugguggcacacacccguaauccuagcacuucugaagcugagguagaauuacugaguuugaggccagccugaccaacagagagguacuaagcaagccaaggacuuuuugagacucucaaaaaguuuuuguuuuuguaauaaaggagaguugggguuauagcucagugcuuccauaauacaugaaaaauccugaauucagucaauggcaguguguauggauauauguuagggauacauuuccuuaaaggagagcuguagaaguguauaacgugagcuaaguguggugguugguacacaugaggaagcagaggcaaguggaucucugugaguccgagaacagccugcucuaaauagcucuacauagccagggcuacacagcaaaacuuguuuuguugauauauaaaauacaaauaauauuuaauguauggggcuuggaagaaacacuuuauucccuguuaaagagcuuuuucauggacauucuuacaugcuaccuugcuucucaugcgggugguuuuguggaugaaauaaaaggauggauuacugggguuuggagagauugcuuagcaguuaggcagcuugcaaccuucccacaagugccucccaaccucauaccuccagggguuccacuauuuucuggccuccaaaggcaccuauccucauguacauauauauacaccugaacacagauacacauuaauacauaaaauuaaauuuuaaauaaaaagaauagauuaucccaauuaguccuaugugguauaaaccacuccaauuugcagauaaggaaguugagacucaaggguacucacuguacuauuccacuuaauaauggagauaguguguggcaacaacugauaggagaagcuaaaacaaaucuaagcugcaucugucaaagacuuuaucccacggauuauaaagguaauuaacagaaaugaccuucauguucuggcagaguaagguaaguaaguaagacaacuaauucacacaucuuaugcaugcucuguagagaaaaagugggcaacaguguauugucuagcuauaugacuuccaaaauuagugauuuaaaccaaggaaaguuaggggguugauuuaggguauuauuuguguauccaugucagaaccugauuggccugggugugacgguguguaacuaaaauccuaggacuuuggaggcagaggcagggggaucaggaacuuaagggaguuuaaaagcaaaccuggauuacaugagacccugcuucuccuauagcuuugguuacuauggcccuuguacuggcugguuuugugucaacuugacacagcuggaguuaucacagagaaaggaacuucaguugaggaaaugccuccaugagauccaacuguaaggcauuuucucaauuagugaucaagggggaaaggccccuuguggguggugccaucccugggcugguagucuuggguucuauaagaaagcaggcugaacaagccaggggaagcaagccaguaaagaacauccguccauggcuucugcaucagcuccugcuugaguuccaguccugacuuccuuuggugaugaacagcacuauggaaguguaagcugaauaaacccuuuccuccccau

SEQ ID NO: 5392 - RNA, 1178 nt, Mus musculus
aguuuagacauccuggaggccggaagcaacaggagcacuaaucauguaggcagagaacuaaguucaacaccccucugcuuuucuggaagaggugggcauacagcacugcccuuguucccuuaaccuugcaggcuauccacuaacucucccacaggugacuccugugugucccuugagaagauggcacaugggacaagugaugagucuauggaauaggaguguauccagaagacaccugcuaggugucuccagaucuggaucaugggaauccugcuucacuuucuauccucaaguauugugagccccaugagaccaggcugggagcuuggccucccaagaccuacccaacacaggcaccaggacacagacagggccagagucacauacuugaacagauggccagggucaaaagcuauuuguguuugguuuugaguacgggugggaucacccuugcuuucauguuagaaaucuguauucuggaugcucuggccuuugaagggugugggaagacagccucaggcuaggccacgcugcugcugacacagggccagaagggcuggggcugaaaggaaacaucugugagggguugugugagggccagcugcaugcagagccagaauuucacauguuuaagcagaucuagguggggugcccagaucuuguuuuguccaguuuugacuuuaaauguuuucaaagcgguggaggaaaacagaaaaauaaacugcauugugccuugacccucuucccaguuuuccaccucugcuucuacacuuagcacaauaagauagccuugaggguggagggcuuagcacacauuuccuuagggaaauauuaaucuagugugucuguccuggcugaaacccagcccucccugcuuucuucugacacaugauggggacaguaccacagauguguaguuggaggggggggaggggguaaaagugauagggcuccagguggccugucagaauccacuguggccggcugcacuggugcugugcgccuggcuagagagaaguggaguagacaagagaauaugaaugcuuuacagauccagggucagcauggguagcagaugagccagaauugcuguuauguauccguccaugcuuuguacagggaagugcaaacugcccauaagggcuucauacauaggcuguauucugagagcugcacca

SEQ ID NO: 5393 - RNA, 2210 nt, Mus musculus
aauuuugaggauuuuuuuaugaguucucuuccuguaaaacaaaacaacgaaacaaaaacaaaacaaaaaacaaaacaacaacaacaacaaaaaaacccauauguaucuauuguggugaagacacauuaaaaccagccagacuccagaucugaauuucugaacucagcagaaagguacaagaguccugucucuggcuccugagguagcccggagacuuucucccuucuuaguuucuccuaagcagaaaggagguacugauuagcucuccugggggcgugacagagggacugucugggcuccgggacucgcucugggcuucccgcccucggggguccccucgcuccgccuccacgcaccgcccugucgcucaggucuucaguucccgccccugcgaguggagccccgcccucccaauuccccgcacccggugagccgggggcggggcgcgcggaaggcggagccgagcaggggaauccucucucguuucgccgcgagccagcagagccuccuggccguccaagggccccagcucugggggcagcggaaccucgacgagcggagucugaagaggccaucgcggcccgugagccggugucgucccaauacacuggcagaguuccgccucggccuuccaggccccgcgguucccucaccggacggucgccugcgcgccaugcagccgccgccugccccgcgcgcguaggcgcucgccacaggccaugcugccccuucucgccgcgcuacuggccgccgccugccagcugccgccggcgcacggcggggccacggaugcgcccggccuugcagggacgcccccaaacgccucggccaaugcguccuucaccaacgaacacuccaccccgcgucugcuggcaucggcggcaucggcgcccccagagcgcgcgggcccagaggaggcuccggcggcgcccugcaacaucagcgugcaacgacagaugcugagcucgcugcucgugcgcuggggccgcccgcggggcuugcagugcgaccugcugcucuucucuaccaacgcgcacggccgcgccuucuucgccgccgccuuccaccgcgucgggccaccacugcucaucgagcaucuggggcuggcggcgggcggcgcgcagcaagaccugcgccugugcgugggcugcggcugggugcgcggccgccugcgggcucccgccggggcucccaccgcgcugccugccuacccggcggccgagccggggccgcuguggcugcagggcgagccucgucacuucugcugccuggacuucagccuggaggagcugcagggcgagccgggcuggcggcugaaccgcaagcccaucgagucuacgcugguggccugcuucaugacccuggucaucgugguguggagcguggccgcccucaucuggccggugcccaucauugccggcuuccugcccaacggcauggagcagcgccggaccaccgccggcgcccccgcggccgcuccugcagccguacccgcggggacuaccgccgcugccgccgccgcugcugcagcugcugcugcugcugccgcggcugucaccucggggguggcuccuaagugacccccuccgccccgcguccgcgcuguguaagcgcucgcacgcgccuuccucaccggagacggggcaggugcgcuucgugcuguccuuauuguucauccuuuucccgggaggggaccgcagagaggcacaaaugaggugggaaagugggguuugugcugagguucugguucggaagagcaggggcaagcucucgggcugaagggugggauccacgcguggcucgaggacacaagggaaaccggcucuuuccccugcggcacccccucccugcgcccacaugcccuuuauuuauggcagaaagugaccagauccuguguauuuguuuuauauauuuaauaacuguuuuaaaugaaaguuuuaguaaaaaaaaauacaaaacaaaaagauucaacugcuaaagcugugguaacaggagcucuuuguaucugaauguaguuguauuugaagcuucuuguuuguuuuuuuaaagggggggacgagggaagauuugacacggauuuauuguaauugcuuacaaaagaacuuuaugaaucuuuuccaagucgaucuauucagugacauggccuggugggcguuucuucuuguauuaaugugguuuucuggcuuuuaauacagacauuuuccuccaga

SEQ ID NO: 5394 - RNA, 898 nt, Mus musculus
aucuaggccucggaggagcugugguugucacccucuacaggauggguuuucccgaagcugccagcuccuucaggacgcaccagguuucagcugcucccaccagcucugcaggggauggauucaaggcaaaccucgucuuuaaggagauugagaagaagcuugaagaggaaggggaacaguucgugaagaaaaucgguggcauuuuugccuucaaagugaaagauggcccuggcggcaaagaagcuaccugggugguggaugugaagaauggcaaaggaucugugcuucccaauucagauaagaaggcugacugcacaaucaccauggccgacucagacuugcuggcuuugaugacuggaaaaaugaacccucagucggccuucuuucaagggaaacugaagauugcugguaacaugggacuggccaugaaacuacagaaccuucagcuucagccgggcaaagcuaagcugugaggagucccuuuggcaaccucaggacaucaagaugagauguguagauagguagagauccacgucucgucgucaggacuuagacugacaccucccgaauagcaugagauagauuuguugcuaauugggugcggucaauuguguuuccccgaagcugggagguacauagggccucccugccugcacugcugcuuugaggacuugcauucuacugugcuugaugaagcuacuaugucaaugaugguuugggguaaacuugaguuucagaauaaaauucagaacaguaaaaucugaagacugaguaaacaaagcccuuguuuugcuuagaaguauauuugaggaucacuguguuggacacucggugugacauuucuccuuggggggacuagagaagaaacagauuuccauaguugaccaggaauuagugc

SEQ ID NO: 5395 - RNA, 2856 nt, Mus musculus
cuuucuuucuuucuuucuuucuuucuuucuuucuuucuuucuuucuuucuuucuuuguuuugagacagguuucucuguguagcccuggcuguccuggaacucauucuguaggccagacuggccucuaacucaaagauccaucucccucugccuccuaagugcugguauuaaagaugugcaucaccacugcccagcagugacauauuaauaauaauauuaauaccuaauaauaaccuauuauuaucaugauauuacuuuuguauguauuuugucuacauguauguacaugcaccaugugcaugcccaaugccuauggaggucagaagagggugucagaucccuggaacuggaauuacaaacauuuguaagccaccauguggguacaggaaauugaaccuagguccuuuggaagagcagucaaugcuuuuaaccaacaagucaacucuccggacauaaacccaauucuuaaagaacgauuccccagaguagaguuuuucaaguuaauaguuacuuucuuucaacacuuugacaauauuugccuuauaauucuaguuucaauuauugaugcuuguggugguuuacauaugcuugguccaggaaguggcacuauuagaaaguauggccuuguuggaggaagugugucacuuuaugaguggacuuugagggaccuuccuccuagcuuccuggauucuagucuucuccuauuugucuuuggaacaagauguagaacucucagcuucgccagcgucaugccugccuggauguucccaugcuuccugccaagaugauaauugauugaaccuuugaaacuguaagccagcccuaauuaaauguuuuauuaugaguugccuuguucacggugucuuuucauagcaauggacacucuaagaaaaugcuaaauuuuucuuuuacuauuauguuuuaaaucaauuacuuguguauaugugugcgguuauguaugugugugauuaugggugugcuugugugugcacacaugcaugugugugacuacuuuguguuuuguguguguugugugugugugcaaucgugugugccacagcacuuguggggagguaaaaggaucccucuguggagucaguucucuccugcuaccuuuauauggguuccagacacugaccaugagucaacaggccagcacuacaaguuccugaacugaacugucuugucugcccuauuuuguaagugaaugcuuccuucucugacuucacuaaauaugucccuugucuuugucaucuuuggugaauuuaguauagauguguuuuauuaucuaaucuaagccugagccuaaguaauauugaaccuauaggauuuauggauccauguuucuucucaguuuugccaaguucauauauauuauuucuuaacuguugccucuguuucugucuuuuucuccuugaagaucuucaguuagaucuauguuaauauuuucucuccuauucuacaggucuuauaacuuugucucugccuggucuaaucuccauaucauuguuuuauuuguaugacugguugguugcuagacuguuaaaagggauucuguggugguuuaaugauaaugugacccauaaguucauaugcuugaauauuugguccccaguugguagaacuauaugggaaggauugaaagguguggccuuguuggaagagaugugucauugagggugggcuuugagguuucaaaaaccggggccauucccaauuagucuucacugcucccuacuugggauaugaauauaaggucuuagcugcugcuccagcaccaugccugcugccugcugucugcugccaugucccauucccauaauggucauggacucugaugcucugcauccaugagaccaaaauuaaauacuuucuuuuuuauaaguugccuuggucauggcauuuugucaugaaaacagaaaaguaaguaaaacaaaagauggaacugagaaauaggauguuacugugacagaccugaucaugcugguuugggaugaauauggaagacgggacauuggauuaggaaagcuguugaguacuguaagcaagguuaaguggaccauucuuauaggaauggagaacaguggugcugagauccauguggauuauggaugcucaguucaagaaguuucagagaacaauauuaccaaguguuagaaaccuguuuugauauuuuggcaaagaauauugaugcuuucagcccuuauucuaaaaaaucuuccuggaacuaaauugagacuuuuuggacuaauuuuauuggcagagcagauuuuaagacagcguaauauuaacucuguugcaugacuguuaguaaucauucuuauguaggacugcagugaaagguaacaaguaggacaaaaggaaaaugcacaaaauggacaguggaggaggagacaaggugcugugaagcuuaauguuuguacugaaagagauaaggagagggcugagagcugaggaaaaauggaauaaagggaggguuguccucagagcaagaccccaccaacagcuaauucuauuuguaaaaaggaaaugccuaaggaauuuucugcaaaaagcugcaacagggaaaaaaauguuaugcaaauguaauucaagaagggaacagguuccaacugaaguggcugaaguuggcggcauuggccagguaguucuggcuuagaguccugagggauacaggaguaaaggaauuguggaaucuuccucugcaguucagaaaagccucugaggccagguguguggcaggggaguuccugcauggaagcccagagaaaccauacaugaaguugugagagccaagccuggauuguguuggagaucccaagauguuggagaugccagaauccugugagaucccgg

SEQ ID NO: 5396 - RNA, 1441 nt, Mus musculus
auuuuuguuuccacuucuuuuuuuuuuuuuuuuuuuaaaaaaaaaaaagacacauuuauucagcgucaugaucagacuauuacauuuagcaaucaacagcaugggugaaaaaggucuacaguaaaaccuuuuguuggaaugcuuuacacuuuccacagaacagaaacuaaaauaaccuguuauacaauuagucagucacaaauacaguccuggaguuuuugcccacacacaugaguauugucuaaaacaugucuucuuuguagcagcuaggcccugccaccacugugcuuggcugaguucacaaaucuguuguaaccuguagcuucccugucacuucucuggcucuccucuccugcuaagcuuuguuuccuggcuguauguaauuagaaccuccugccacugccauagcuacugcugcugcuggaaccgccauagccaccuugguuccgugguuuagcaaaguacuggccuccaccaccauaagggccagagcuccugccuccaaaguuuccucccuucaucggcccaaaauuggaagacugauuguuguaauugccaaaaucauuguagcuuccaccaccuccaaaauugcuuccaucauugccaaauccauuauagccauccccacugccaccauauccaccaccaccacggcugccaccaaagccaccacgaccacugaaguucccuccucgaccaaaauugucauugccaccaaaaccgccuccacgaccaccaccaaaguuuccagaaccacugcgaccucucugacuggaugaagcacuagccaucucuugcuucgacagagccuuucuuacuucacaguuguggccauucacaguaugguauuucugaauaacaaucuuauccacagagucauggucaucaaagguaacaaaagcaaagccccucuuuuucccacugccucugucagucauaauuucuaucacuucaaucuucccauacugcucaaaauaaucucguaggugauguucuucagugucuucuuuaauaccaccaacaaagaucuuuuucacaguuaagugggcaccuggucgcugagaaucuucucuugagacagcucucuuagguuccacaacucuuccauccaccuuguguggucuugcauucauggcagcauccacuucuuccacaguggcauaugugacaaacccaaagccccuggaucucuugguguuuggaucucucauuaccacacagucuguuaguguuccccauugcucaaaauggcuccucagacucucgucgguuguuucgaagcucagcccuccgaugaagagcuuccgcagcuguucuggcuccuugggagacucggacuuagacaugacgguagaguuacgagagccuucagcgaugcuuccucggcagcgucaaagagcagaaaggaauacgauaacgaacgugccccuuguuuccacuu

SEQ ID NO: 5397 - RNA, 434 nt, Mus musculus
cgccaugccggaaccgcgcgccucugggugccuaaaggugaacgcagcguuugcugcgcgcuacagccguuaccgcgagcgugaggaacuucagcgacgugagugaggggcgccugcgcaggccaagguguggggaacugggucuggugaugguagcuaugaggaaccccguguauauuccacagugaaagaucgcuauggagauccggacgucgguggcgacuccaguuccgagucugacuccagcgaugagcauguggugagcuuccgcaacccggcuucgcguccuacccauguacauggggcuuucccuaaccgggcuugguugucccggagucuucaggacccgcccccaugcguagagugacaggcaguacccuccucaacucagggaucgccaaauacauccuccuuucuggaagagacuccaagcc

SEQ ID NO: 5398 - RNA, 434 nt, Mus musculus
ggcuuggagucucuuccagaaaggaggauguauuuggcgaucccugaguugaggaggguacugccugucacucuacgcaugggggcggguccugaagacuccgggacaaccaagcccgguuagggaaagccccauguacauggguaggacgcgaagccggguugcggaagcucaccacaugcucaucgcuggagucagacucggaacuggagucgccaccgacguccggaucuccauagcgaucuuucacuguggaauauacacgggguuccucauagcuaccaucaccagacccaguuccccacaccuuggccugcgcaggcgccccucacucacgucgcugaaguuccucacgcucgcgguaacggcuguagcgcgcagcaaacgcugcguucaccuuuaggcacccagaggcgcgcgguuccggcauggcg

SEQ ID NO: 5399 - RNA, 6571 nt, Mus musculus
ugccuucuugccugugcucagaucaugaagccuauuccgugcagugaugcacugauggagcucuuaugagagcugagcagaaugucaugcugagucuccaaaguuucaagcuaaacaaaccuuuauucuuuauaaaguaucagcuuuggggauuuuauuauagcagaggaaaauggauugauguauucuuuuaguuuguucuuuucauauauaaaauaugggccaaaagaauucuauauuuuuugcauuaauuuauuuggguguaugucuccauaugugcacauuuagagaucaaaggacuauuuguuagaaucaguucuuuccuuucaucaugugaguuccuaaaauugaacucagguuguuaagguuggugguaagugccuuuuccagugagccauuugccaguuuuuaauuuuccauuuuaauuuaguaauauuaugaacauauucccagaucaauaaaaauucuuuaaaauauaccauauugacugacauuuaauauuucugaaauuauuaaacuauaugacauuuuaauagcauuuguuaauaucacccuaaaauuguuugaguauucuugaacuuuucaaauuccuuuucagaaauacugcacuaauuuacauuuguaucaaacugcaagucagugacuguuuuugccauaucuggaccuguaaugugcauuuuuguuaguaaaaugaaauaauauuuauucacuacuuucagcauccaaaagaacuuuuauauuuuaauugucauuuccuuuugaucaguauuuucauaucaaugcuauugcauuuauccucugaucuauuugcaucuuugcuaauuauuuaaaauaauuggauagaaaaacuuuaguuuguuacagauuuaauuuuuugacauaacaucuuauacuuuauaauauaugucaauaugcaaauaugcaaaauucuucucuauuacaaugcuuuaauuuuuuucagaauauaacaucauuaggaauugaauucaguaaaaguaguggcuuuguuuuuaaauuaauaaccacagauccuaucucuuauugggcccaugccacucauugucaccuuuauuccaguuucuggaaugccccauuuuguuuauucaucuccuuucuaacagagagaaguucaaggaaacaauuaaagaggugacuuauaccuaagcuaccucuaaguuuccuuugacccuaaaagauugggaauccugacuguaagaacugucaguaucagucuuggagagcuauauacugucuccucauucucuucuuagaccuuccuugguugacaccuauggucugaaucagaagccagcagagagcucauguucuccuguggauggagauauagaacugguccuuucuaguugguccacagagaggaagggcagccauuuugccagugguauagccacaugccuuugaaacagcugccgaagguacuuccagaaccguucacccacaaaaacauaaaugauuggguugacacaacaguggguguaggcaaucaccucagucaccugcauggccagguccaguugcuuacucugcucacacugauuggugaauagaacaucuuggaaagcagaaacaaauacacucagauuguaggggguccagaggaggaagaauagaagaguaauagcaaauaucagacgcacggcuuugaccuucuucucacugggucuucugagcagaauucugaugaucccugcauagcagauuaucaugacuaacagaggcaaaauuaguccaagaagguuuagcuuuagagcuugaaaccucuuccacugcuucaggcucuuguaggggaaaugagggcuacagguacggugagugaacucccacugggccuuaaaaaaguauaaggcaggcauggaagcuaagauggcuagggcccaggugauaauacuggugaugaugccaaaaguaacaguucgggcccucagggcaaacacagcauggacaauggccagguaucugucaaucgucaacaggaugauaaagaagaucucacuguauaaacccagguaauaaaacccagagagaagcuugcacauggcaucaccaaaaauccagucgucuuucaacuuguagucaauccagaaagguaaagugaaaaggaagaccagaucagagacagccagguugaacagguagaugcuggucaugcuuugaagccuccuaugcugcaugagcaccagaaucacuaggacauugcccaccacuccaaugaugaacacuagagaauacagggggggcaggaguccagccccaaaggcucuuacagcagucuuuuggcauggaguggaguccccauagucaaauucuguaguugugggguaggcuucugugaaaucugaaaucuccauccuuugcugaggaacuggucaggaauaauagcuucugaauuuacuuuucuguuaaagacagugaguccugggcaacaaagacaagacaaugauuauauuucuuuaacaaauaaacugcggauugauacuuagugauuaccaaauccuagggaugaaauggaggguaaggagucauugcauuuucuacucacauggaccuuguagacuaagaggggaacagaacaaaugaguguguguguguguguguguguguguguguguguguaauucauucaacuauuucaagagugauggaucaaaagcaaaagugauuuuuuuucacacuguucuaaauaaagauuucauaucaacuccaaacagccgaguuuggacuuaauuuucaacaccuauuaaaugggcaaauuguuccuauuuagaagugaugaaacagagguacaaauuaccacaggauacugcauuguggcgcaagaccuuagaagcgauggcacagagcuaaagauugccuaagguuacaaaaauguggcacaagacauacaaugagagcugaaguagaaaucuaugaguguguuguuccaucccagcucugaaaugauaggacucuucugccucuaaucacagcacuuggcugugccacuguugucuccauaaaugcucuggggaggagggcaguuguggauaagaauaaaaaguucauagcuauggaagguuauuauuuuuucuguuuuucaagagucuacaagauuguacuuuaaguuguaaugaaacaaugcaugcuaguuaauguaaaaaucauggugcuccaagaucacuauuccugaucaagaaaauuccuaguaggacaacuauagcuauagguugagacacaagguaccacguugguuguuugguuuaggcugaucccuaucacauggccuuuauauggaacagauagauuuacaguuaacucaacugcccuaguaagcaccaugagacagcuaggaggaggacaugaccuggagacagaaauggaaaaugggcucagggaguaagagacgccuguauccaacaggagacagcacacaggagcuagauaaaaacugagacucugcugaaaugggcucuaaguuacuguuuauuauuauuauuauuauuauuauuguuauuauuauuauuauauuaucaucuuaaaucaggauugccuugagauaaacaaaaggucaauagauagcuugccauuguaggacuacuuucacaccauguauguuuguacaugaauuauuuccaguuaacuuuuugaagaaucccucaagaggggaaauaugagcuuuguuguaacauaauagcagugugaccuuagauaaucaaucugcuuuuuuagucuaaguuccccaucuggaacaggggagauuaaugaaugcuuaccuugaaaagaugcuaugaagcaaugugaaaaauaacccucuacccacagacagugacuaucagagacccggcugucacacagugguccuguucuaacaccugccauuagcagaaguucugaccacaaugucuguauuccuucuuuccuuacuggguuucuucauagguaacauagaaagugauuuuucuugauugucaaugacaguucuuccaugugaaucaugcuauaaaaucucuagaaagcuugucucacagaaauggaaagucaaguagugguuacagacagagucuugaauagaguuuggaagaaggguggagagaguuuggaaggagagaggacaauaaacaggacagggcugaaacuggacagcaugacucuucucaugcucuauagcacagcaaggugacuaugguugauaagauauauuugaauauuuccaaacagcuaaggcagauuucugagguacccaggguugacuucccauuacucugcccuuguacugaaauguccccugcauaucuuuaaauaugcagaaguggcacaugugaaauaaaaccuaauuguaaaauaaaggaaaauguucaguauguugcuauugaucagaguuguaguauuugacucaaauaccuuucagcuaauuaugcugcaccugcaccaucaaucugugaucacccugggcuucugugcuaucccuucugggcucuuuaguaaauguuuccugauuacaaagacuguucuggagcaguggucuuugaacauuaaggcacauuggaaaaggaggaaauauucugcugaagugucaagaggggucccuucauuuccuaucagcucuguuccuguguuuacuccuccaugucuucccugucagcucucacuggggaaacuuggguggcagucaggaaugauugaggcagagauuucuacuuccugcuguucaugcuagugcugaagaaggcagacauucagcuuggcacccaggauuccuagauagcugacagcucuaguacagagucaacugaaguuggggagcaauaucauguggggcaaggugauccucaggagcccaguuccuguggaacucuagccaaagugaagucaggcugaguucagcacugucaggugcuguguuccacagccaccugccuacugagaaaccucagcgcuaucuguucucucuaaacuuucagguuguagcaguugcggggcacaccgcugcuaaggagacaugaccugggcugugauuggaggagaaagcaaaggcccauuuugccauugaccuucccaggccugugaauaguuucuuguagaagucugccccaggugccuugcacagugcucauguagauccccauagccuggacucuacuaguguccuguagccugcucauuugugaagugucugggaagagaugauaagaaguauccaggcccaaggggaagccagaugauuauuguggcucaaagagucaguugugugcaucuguucacucugcacacaugucaacuugcaaguuucuaccauagauaucaacaaauaguaccaaccaugguuuucguuuuuagggagaggccaguauuguucacuuucuagcauuuuacuacuuaggccuuccucacugaauaacccaguccugucucucaugcauccuaaugcaaggccauugcuacauaauuccuucaguauccuagagcuucuugcuauuuguuguacagaggcaaacugucuaugaaaaucuaaggguuucuuguucuuugaaaauuuauaguugucccuucucucuccaacucaugaaauuaaagcaaaauagguauuuguuagugucaguccuacacaucucuuuucaucauaaaaccaacauacaccauguuagaauacaacaauugcagucuaaaauuccaucuacuugcuacuucuugagggugaauuuucuccuucuccaagacaguagucccauuuuuguaauuuuaguuuuacucuuaagaaauugguucagaauuuugucacucuugcauuugcaaugauuuuucuuacuaacauauagucucuuguuaccauuucuuuauauguugcauuuuguugcuauuuggcgaaguuucauaaagacaacuauaaaaauaacuuuccacgaaggcauuucuugucucuuuaugcugguuuacucucuuaauuaaucaucgauaacaaauuccucaauaucacugagcauccagccuuaauaauacguccagcauugucaucauuucccaaguauuaacugcuuuacagaugcaacaaugggcuacauaggcuccaucugguucucaaagcauuauccaauguugaagaucccagaacugcacucauaacuuaagauugccuuucacaguaccuggcggcauagaaaugacaaacaucacuuacuguguuuccagaguauuuuguccacacagacuuuguuucugggccuuugaggaucuuuaugaauucaagguucaaggucccaaccuaguaggaaguucuuggcuuccuguaugaugauggagauuagacucugguuuuauagucuuucagaaugacaagaaugguguaaaguucuucuuuuuuaugguuggcugccuaugaagcacuacagugcucaccaguggccaauuccugggguccaaguucacuaaaguguucugucuuuccucucugcuccaguuccaguaaaguuccagucuucucagagguagcucugcccuacaagaauuguguagggagggguuggauggaguugaguugaacucugugugugacaaugagcuguuccuaggacucaug

SEQ ID NO: 5400 - RNA, 6406 nt, Mus musculus
ucauuacaccucuaaauuuauuuuaacuaaacaaaauuauguguauuauuuuauuuggcauuugaaaacagguauucacagauauaaaaaaaacucacauugacaaacauuuaaauggacagacucaaguugauagaaguaugauacaaacuugguaaagcgaaucucgaauacugaagcaaauguucucaagacuccauaaaaagaccacaacccucccuugccaaaaguccacucaauuuuaucuuaguaucuaagauagauauccaguuuguuuuucauaagucaaucuuggcauuuuuauggacaauuaauuucucuauucacaaaaggcaucauaauuauuuuuacuuucuuaaauuaaaguugaaguuuuuuuuuucuuuuuaaaguagccaagaucuacaguugaucuaucacaaucuuuguaaguucuuuuuacucuuuuuaguuccaggcaaaggacccacuuuacagcuggcuuuuaggaucuugccauucaaacagucuuuguuguuaugguaagcacacagacacuuuguacaauauucaaauugacagcuuucccguuugcagacugcucgcucuaaauaguggucauauuuugcagggaaauuacagcgaacacaggcuuugaggcuuucguuguucuucaaugucuuugccaccuggaagaaaaagaaauccauguguauuuuaguaucuugaauuuguuauuaaaccaggaaggagaaccaugccuccaauacagacauuaaauacccauuaccuaauggguucagaguaauaggugcccuuaaacuccugaaagguaugccuuguauucagcuguucuccuuuugacaguggcaacuauaagauguaguaugggacagucuugggauauuucgaggucacuacugagaguagaugaaaaggacggaagaugugaccucuacugccuuaaugcuuuuuacuacaaacccaaacaacaucaucaugugauguaauuuaguaccagacaccagauagcauguaguggcaaacuguccugugaaacccucuuucuuacuuuaacuauaaguaaguguuccucauuucuaagacuuucccgauaguuaccuccacgaacucauugugccggcuguagguagaaacucucugaccacgcugacuggaggacuugauuugaacaucuuuuuugggaggugcccaggucgaugacuuuugaacacaaguuagugcagcucugcccacaacauauccucucguuguagcauguagugacaacuuacugcuuuccugauucaaaguuuaaagagauuuucaauucuuuuucauauuccuugauaaagggaucccacaggacuguaaucgcagccccuccauuggacagaguuaugcacagaaacacuccaaaaaggaacucacucaaagugugaaucagagacagcuauuaggaauuuaaggugcccuuuaaaccagccaagaccaacacuaaauaaaguccuguccacagaacaaguagacaggacuuuauucuucccauaccaauagagggcagcagucagcuaacaaacauuuauuuuaggauuuuugagaacagguucaagauguagcuccaugcugucuuuaaacuucucaagccuccaguauuccaagauuacagacacuugagaccauccugccuuaggagcauacuucaaucauguaaugaucaacugucagaaacaccacaauuagcaaguacuuuagaaaauuaaacucuuccucuauaccaggaaguuaacugguugcuuaagaccacuuugugguuggugugucucauacaaaguagaauuuuuuaaacuuaggcuuauuaacaaguucuauagaggauccacacacugcgagcgccucacacccuuccuccccaggaagcugccauuucuuaugaauugaaugaauuuacaagcacuuguuucucccccuaaaagagcaauggcagcuuaagagaaagagcacuuuggaagacuuacaaugacucgcugcaugguuuugcuguagagcuggaacgcccccuuauuguuuuccaguaucuucuuccaaauucugcucacuuuagacagacugaaaacaaaggagacaaaggucuaaguccaacagagaacugaagcagaugacuacaagcuacacuaacccaacacgcacugaaacuggguggauuaagaucugggaaugacagagcccaguuaugagugcuuagccagacuaccaaagagccagccaaaacuuuuuaaguuuuuaaaaaaacucccaccaagcuuguuguauauccauuuuugucuugaguaucuauuaggauaagcaauuucacaccaguacaauguauacaccuccaccuuagugugacaggauauuaggcuaacuuguaaccaauuuugaaaaaucuauuacaucaacugaaauagcacaccucacaaugcugaauacagaaaccacccacuaauagaaaccaccuuaucuacccauuucauugcagcuagccagauaauucaguauagaauacauucuucuaauggcagacuaugaaauucaaagugacaagacuggaugcagauuuccauagauuuucuuccauuucaaaugucaaccaaacauuaaaaggaagucagcacuaagaccacuuuacauuggucugcucaaccagguccuauguuaucuauacaugcagugcgcaacacccucaaacucacuuuacuaaguccaugccgcugagcuuagucaaaauguuagccaacaggugcacgaauccccugcgggagagcucagccaggaugucuaggugcuccaggcccauuuucuugccaauuauauuuugcagucuaaaguucccgcuggcaauaacuuccuucagcauuucucgauccacuuuaggguuucgcuugccauucuuuuuuaguguugagcaaaccacucuuucaaaaugcaggacaggcagcaagguuuuguugggaugcugguccgggcucugugauggcagcagacgggccuggggacuguuucugaaauucuccaggauaaggaugccaucgucacggucacuuugugugaaagaugaguagccacuguccucauacagucuacuggccucuagcucuucuguuucguuugaacuaucuaguguguuuuguacgcguugauuuuccuuguuaucaugucccacaauuggugagucgaugaaagacaaccucucaugguuucuaacacagucauuacaggaagguuccaaacacacgggacuguaggaagcuucuaucccacuguccucaggcuucaccacuucaagcucggaaagaucaggguugcaauuaaaacacuucauuguaacagaaagaacagggcuuucuucuuuacaaccuacaaaaaguacacaagaaauagaauaaaaaucacuuuugugguaacuuguuccccaacgucuugcugagaacugaacucugggucuuuauagacauuaucauaacccuuauauacccagcaccagaaauggauaucuuccauuaccauggugugcaugugccaauaaacagaauauuaacucaauacuauuaacuaaaacccauacaugacacaguuccaggacgccacaccccaucuagcuaucauuuccauaggcuuccuuagaacuaaugagccaagccuccucuccuccacuaacucuucucugugggcacagcaggcgucaugcugcacaggugaagcugauggggcagcacccccccacccccgccgucccucccuucccugaguucccuuagucaguuccucugaacugagacugagaccacacggccucauuucuuugagacagaggacuugcaggagcaagaaagccauaggacaggcagcuccggcaucagcacagggagaugcucuccgucugccugugcaauguuuaccuuuggcccgcacugcucuaauucucaucucacagcugucccagcuggccuggggcugcacugcacaugcugacaucauuuugauuuuuaaguauuuuuucuuuuaaacuucuccagacuacaggacucuguuuucuaaauuagagagaaguaucagaagauaagagucuggaccuuaacacacacacagcuaaauccaucugagagcaagagauuucaauuucuaagugcuccaaaacaguaagaaauauuuuauauuauguucauguuagguagacacaaaggcagauuaaggaauuccauacucccccaaucaaacaaaugugggguacauaucuagucuugcuauuuucaucugauauccacuuaauggcaaaaacuuggccucaguuuucccacccacaaaauggggaagaaaacaaaacuggauuaaauggaugaucuaauuaaaagcaucuguuuaucuaguuaaaucacaaaaaggcaaacuugcuggcauuucuuacacugaaaaucaagauaaauuccacaaaagcacaaaugaggaggcaaaacuucaaaugaaagaaucucugcggagcuuucugaccagcuuauucuauuagguuuuggggagggggcuguccuuaaaugaacuuacagauaaaacgaaaaauauuucaauguuuuagaacucacauuagcaccccucagccaaucacgggaugggggaaagguggagagcuaaagugcaccaagucuggccuuucauuuaacuuauaaacacaggcuuuacacuccagauuaaagacuguaaugaaagcuggccuuaaagucuuagcucuuccauauguuaacuagguuucagucucaguccccagccauguggccaaggucaaacaccaucccuucuuugugcaagggugaggaaaggugauugaaaguauaagccaagagaaaaccuuuaagucuacuuugaaaaauauuuaaauguucuaauuauuuuuuaagguuucuucaaggcuguaaacccagugggggaggggaguugggggcagcaagcauuuccugaggaggaaagcugagcaaaagaaucccuucguaaaccauuaaauuucuuauuuucuaacggagacucggguacucuuuuacagacacauucugcuaagcuaguacuuucuucucuucaagacuuaauuccuuuucugaugaagaaagauuauugaggauauauauauauauauagagagagagagagagagaaugaauuaccucuuccuucaguuggaaauuuucuacgauagaaccgaugcaucuuucauugagaugccaagaaagauaaaaaauuaauaagaaaauaaacaauugauucucucugcucaccuaaacguuggaaaaagugaccauuaauucuucaaaacacccgaaaauuaaacaaucccuccucgauucuuucaucagcuaaacacuacaggcaaacucaccguuuuggaggaaaaagggcgcuuuuuaaaaggcccugcugacuccaggccuugagacuuacugagaagcagcaaaacaggggaggaaaaaaaaaacuuuuuccauuugguacagugggcaggcgggggcugggggguccuuuacauuuggcgggagcugagaaggagccccuagaaaugcugagggggucgguggugggaggugccccgagggcgcggugcacgagggaaggcgggagauaagcgcggagcucaaucucccgcgcucuccagccagggcucugagggcaaaaaguuacggagacugaguauggaugugagauagaugaguugugaaauggggggcguagaggcuagagauggggccaucuggccagcuuggagucccacaguccugucacagcucgagcaugaguugaggaggggagaggagggggcauuuggcgcccaggcagggggugggguggaaugcggcgcgcagaagccacuaccuugcacguccccagugcagggucucggggugggauggaauaguaggaccccguacaaggccgaccacaucugucccacucugcaccagccacccuugcuccgcgccuuccucccagucccgggcccaaauaggucgccugaggcccggaacaccgugaucugcaagcacccaguuucugaggcugccgccacagagaaaggauucccacgaugcccgccucacacucaccguccacgguaguccgcgcgccaagacggcagggacaggaggacggccggcgcaggucacugcaggugcgccggcucaugccgcaaaacucgggcuccaaugcuggggagguggcggcgacgacaggaaaaagguggccggccagacgaggcgccgagccgcagcucuuaaaaggcgccagcugguacuuuuaaaaucuuugaauuuggugcccaaaucagaacagaccaauggggcgcggcguuugcacaagcgugccaauaggcaggcggcaugagaggacgcccucgcucgcccaauag

SEQ ID NO: 5401 - RNA, 1612 nt, Mus musculus
cccuuuaaaacuuuaucugcauuuauuuuaugcugaauuuauccccgggccauggguuuuuguuucuucaguuucuucuaggauaucuuuuucuucugugcagccuccucuucuggcuuuggaacgaucuguuccuucucagugagagaugaugucaauguggcagggggagcucauguguggguuaauccggccaugagcucuguagguucgucggcgaucuuagguaccuuguucaccuggauauguucaauaacuagagaaucuacgucuaaacccuuaaguucagcguuacucucggcauuuuuaagcaugugcagcaaaaauucagcacucuuuuuuuggccaccgacccuguguccagccccacuguuuggccugggcgcaccuacagacuccaccauuauacugccggaauggcacacauugcuucuuuaaagugacauccuucggauacuugguggcuuuccggauaugcauacccuugauggccugggcaguuuccccgguguucuuaaagugauuugcaugauuuugugggguuuucugggucaagagaguagcgaaccaucguggcaggugaccucuggcccaugauuucccuucuauagaucacguuuuucauguuauagcuaaguaguaaguaauaaucuacuuacacagcaauuuucuuccaccuucauuuuuagaaacuuuacauuaaaaaaaaaucauuacauuuauuuauuuggguggguacaagccugcuauagggcauagaugugcaggucaaaagucaacuuguggaaguugguucucuucugguaucccguggggccaagggaugaacucuggucguuaggcuuggcagcaagcaccuuuaccagcugagccaucuuaccagcccagcuguacacgguauaauuuuauguuuagagucaaugauuagucugcaauucugagaagagugggagaauuguacuucuuguaagacccgguugacccugcucucuggauuaaaaucuagaccacaggauucccuaauuggugcguguucgaguaagaacacacauuauauucagaagaggcuggcaguggccaagugagaucccagcuggacauucagcuuggcggcgacucccuuccauggccccucugaucaagccggagagcagcccgcguuacccacgacccguguuucaucauccugcuggagugugaggugaaugacuauuuugugucccuuggauaacacuuugacggcagaugcagauuaacugagaccuuacucuucgugaagacccuucagauuugacaguccuguguaucagucaacucuccucucagaugucgggaaugauggauuagcgauccugcuaaaccccagugugcccauacgcauggguguuuucaaccucgcuguugcccacuucauagaaucaaaugcugucuucacagguuagcccugagaucaacuuacaacgcaccaacgcuguuggguaccagaagacgaacauuuccaggacucugccuaggaaucuugccaugccuuuuaaacacaacucgaaggcccucugaagacuuaauaggugagagauggaucguuucucuacugcccugacuguauggcauu

SEQ ID NO: 5402 - RNA, 2540 nt, Mus musculus
agagacuuaacaaauaaacucuacuguuaggagugauuuucuuucaauugcuggauauggugauuuuuauuuucuuuuuuaugcccauugguuaguuuacuacaauccauugguuaguuuacuugucagggugaacuugccuuuucuuuaaaagcuaagauucagaaaacacgcuguugaacuagugggagccauuuaugaggaagucgguguaacgcaagcgaaugcccuucucuccuagaugaagcacgugaugcaaguucuagagagacacgaaacccagcccuaugaaguggcucucguucacugggagaacgaagaacucaacuacauaaagacagaguaagcagugucucugcacaugcaugacgagggugagagcggcgaagccaagcagagauuacugcaaauauauggagagccuuuaagcuacugguacacgcccagcaccacaccagacgacaggauuuguguuuaacuucucacggaaucagcuaagucaaacaaauacaaguauuacuccaaaauuaaaaucguauucuuugugagcaaccuaaauuaacauagcacggcuucaucaggcggguuuaugagauuguuccgggaaggauuuacuguuaaguacauccauguuuucccaguugacuuugucacagaacuacagugagcagauacaggagagccacucugagaaugcugaggccugacagcauucucgggugaggaggcgaggccuggccacaaccuaccugaguuucuaacuguaauuuaaacccuacucagccuccucagugcucugacuacaggcuuacgccuuuaagucuagccuguuuguucuguggaauuacuaaucuacuauaucuuucuauugagucauuuuuucccugauguuuuacugaugaacauuugacaauaaagucuauuguggaguuaaaagaugacucaguggucaggaggacccagcucaguccccagcaccagcucaacagcaguguauuggcugggcagaguagcucagaccuggaaccccagcacucagaagcugaggcuggagaauucccaugaguuugagcucaccuaggcuacagugugacacucucaaaauauaguaaaaaaguucacaaguuuuacccgacauuuuuguggguuaauuccuaggaauagaauuaugugggucaaaggguaggaggacauuuauaaaauguaauaacaaauuguugccaggcuggcgacacccaccuuuaaucucagcacuccgcaggcagaggcagguggaucucuguaaguucuaggccagccuagucuuauagagcaaguuacaggagagccaggucugcauagagaagccuugucucaaacaaacaaacaaaaaaaaaaugucaaagugguuucuagaagcuggugaaguguuuuucagaagagcagcugcuuuuaagauuucaaagcugauuuuucuuuucuuuucacaggggacaaucaaaacugcacagaggggaaaucaagcuaaacucugagcuggacuuggaugacgccauucuagagaaauuugcguucuccaacgcucucugccugucagguaaaacgucccugcuuuguggaugacccagauaacauguucuuaagcacuagaugauaauuucagucucaggacggccccgauauuccguuucuccuuagaaauguaugaauuuauguuguccuuguuacuguacugucaaagccccacuucuccacaguguaguuccuuaguuccuuuucccggacucacugccuuuguucucuccucuccacggcugcucuacucggugcucuaauucagagauagcccagcucgugugcugagauccggaaaccaugggugcuguguaaggccuccucugugcagccucugaggugcugggauucgcucacagcccugaggaguauaagaaaggccaugaaacucuaacccccugccucacgcacagcacuaccuguaaggcuaggugugacuugugcccucugaguuucagagacaugaaaaaauauggaauucuaggagauauacguguucuuccaacagacuuagaaaucuggaguccacgcccuccuuuucuuucuuuaacuucuuuuaucuuuggcuuugaaguuuuaguucuuuggcuuuuuuuuuuuuuugguuuuguauuaaaauuacuaaaaauuucauuguugggcugggguggugcacaccuuuaacccaaguacucaggcagcaaaauuaggcagaucucugugaguucaaggccagccugcuccacagacuaaguuccaggacagccagggcuacacagagaaacccugucucaaaaaaaucaaaaguaugggcuugagauauggcucagcagguaagaucaucgacugcucuuccgaaggaccugaguucaaaucccagcaaccacaugguggcucacaaccauccauaacaagaucugacucccucuucuggagugucugaaggcagcuacaguauacuuacauauaauaaauaaauaaaucuuaaaaaaaaaaaaaaaaaaaag

SEQ ID NO: 5403 - RNA, 2310 nt, Mus musculus
gggcagagcuaugacuaaaaauaugacuaauaauuaccaugaagguaauuauguccuuaauuguauguguuugugauaugagugauccaugagacaugcacauaauacaguauguuuguagggagaccgacuuugucaauguauuacugccaaaacaacauacauuuguaacacaaguguuuguauggcuuguaagcuagggccaugauuccagaguuuuaagaaugguaucgaguggcgcacuccuuuaaucccagcacucaggaggcagaggcaggugaauuucugaguucaaggacagccuggucuacaaagugaguuccaggauagccagggcuacacagaaacucugaaaaccaaaaaaaaaaaaaaaagaaaaaaaaaaagaaugguguugaaaguuggccuagucauucuuuuuccuuuagaacuuugaguauauugacccaaacaccauacucugaacucuuucuuauucagguagcaacauaauuaagagcugaaaggaucauuaugucauuuguguuuuauuuugagacaguucugcuguguuauuguuggccucaaacugggcagucugccucugcuuuuccagugcagagaugagugcguuucccuguguagccagggcugcucuggacaucaggaucugccugcuucagcuuccugagguucuagguguguccccugcgcacugacagccccuugacuuagaggguagaguaagagucaccaguagugaacgcuggcuuugcugguucagaacuugacuucucucuugccaguguggugcuuucaugaucacaaggucagaagaagacucuccccagcucaaacauuaccuuaggaaaacacagagcgagaguuacuacuucuugugguagaacugaauuucauuuucuaagaaaaaaggggcuuuccuugguccacaaaccccuggugauucuucacugugucaggcugacauaaguaacagcauagcagugaaggccauugacugaagacugcgguuagugauguggcccugccuucucacaagacugcagggcugaggcucagguagccgaguagguguuaggcuccacguggcaaacuaaugaaaaggagccaaugccgucuuuaaaacucgggaccucacuuacugcauuugcacacuagccuagucauccgaugcaaguacuugggaguagagcccgggcggggcugcugcugaccucaauggugaugaggaugacgaucauccacuccaagcggagugcucgcuucucauugaggugauuccgcauuaggucuguuaguuccaugcagugcugcaguuuuucauucaugaccugcaagaaagagaaaacagguaagauaugcuaggucaucaaauucuuaugcuuaguccucuaagaugaccagcgguuagcaaaggguguuuaaugacuccaucuagaaaccuuuuuguaaugcaguuuuguuuuauuguguauguuuaugaauguacaugugcauagaugccuguggggccagcuuguacuaagcguuugugagcgagcuauaugggugcugggaucugguuuguuuuuuuuuuuuuuuugguuuuucaagacaggguuucucuguguagcccuagcuguccuggaacucagaaaucugccugccucugccuccugagugcugggauuaaaggcgugcgccaccauacccagccccgaucuguucuuuugagagaguuucucuguacagcccuggcuucccuggagcucccucuguauaccaggcuggacucaaacuuugccugccuccugagugcugggauuaaaggcgugcagcaccacugcccggcagaugcugggaucuuaacucuguacaggacacacuccuaaucaagccaucuccgcacccgcuuauuuugagauggggucucauguaaccuaggguggccuuaagucuucuugcuaccaccuccaggaaugcugguauuccaugggccaccacaugaaaucagugcuggcuacugaacuugaggcuucaugcuugauggcaaacuaaacuaccaggucaguuuuauuucuuggucccuuuguauugcaguuuaaaaagaaacccugcauacuaauccaugacugauggauguuuaagaaauagcauuuuguuacgggaacaagaaacuuuauuaagcaugacaaagacugauuuggcacuuuuccucucucucuuuucucuaugcucauacccuuucucucuuucucugucccccaucccucccaauggcaacuccuccuggccucaauucccaauaaaccugccuuuaauaugaucuua

SEQ ID NO: 5404 - RNA, 105548 nt, Mus musculus
auauaagugaagcaaauauuuuuauugaaaucaguugucaaaucacaauuuauccaaaggaacauaauguaacauuguucuuaaaagaaggggcacagauauaauacagacaaacuccaguaucuaucaaaauaccaucuguaaagagcaggucucacuucaaucugcauaugaauucgguccagccuagaagaguacaauccaaaaaguaacaacaaauuccuucugcguuaggaaauagcucauggccauggcacacucaucuguccauauuguuaagagauggggcuuaaucugacacuaaggagacuucuuuccaaccuggacuggauuagaaaaaaaaaaaaaaaauguugucguaauguugggacauucugaaugucucaaaauggaguuuuuauuucugagcucacugugcauaggaaaacaaccacuuucagaggacuacgagcccacagaguuaagcaucaguaaacuuuaaaaagacuuguaucuuccugccaggaauguuauuucucuguuugcugcagguuacaguugaggcuuggggcuucucaaagcuucgcuauggcugcacacccauuauauacugcauaauacaaaaggcaugugcuuaaaccuuagaaaaaaaauauacaauagguacaggaggaggacuacauaaaacauacauauaaauacauaaaggaggaggcuccaguuugagaagugggacuagguauugccgacauugguuccagguggagaaagcaggaccuuaacucugaaauacauggcaccaaggggcaaaucaagggcagucuugaaaagaggaaauguuagcuggcucuagcucccgaugcagccucaggauugucggggugcucugcaggguugaaaucauuggacggcucugcucucugcaccucaagggcucugaaauuuuggucucaaggucccaacagcagcaucuuguuccgugacuucacuucacauucuaguuuuacaaugagcaacuggagaaagaagagagagaagagauaaaauuccccuuucuuuccucauuguauggacaacaggauaacugcccaagagccacaggaauggggagcucuggguauggggagcuccaggcccuaaauuaaaguguuaaaaguuuuggcugagcugggugugauggugcacaccuuuaaucucagugggggaaggagagaggcgaggcuagccuggucugcauggugaguuccaggacagccaggacuacauagugagaccugggcucaaaacaacaacagcagcagcaaaauuaagccauuauuuucauuauaucagcaagacuugggauucugaugagguaaaaaaaaaaaaaaacaaacaaaaaaaccaaaccaaacaaaaaauucaaauauccacccuagauccaacuguaguugauaauuauuuccaacugaagguugguucuguauaaaaucaguuaucugucuguguaauugcauagauggggcagggaaacggguggaggaggacuagccauccagaaggaaguuuaccuaccucacgucuuaggauucugucaggucucccuuuggcuccuguaggucguccucuucugucugggccuuguucauuucuucuuucagggcaucuccuuccucgguuagcuuugguccguuggugucuggggacucuuugguuagauuuccagaggcauccgccucugccuuggcuaagcuuuggugcugggggccgucagcagcauguuccuuuucaucuuugcacugaagaggcagcuucucaacacuuucuuugacacuggcacuuucaacugcaagcguggugaucauuucugaagccuugcucaugccuucagaacuaucagaaaccgcaaguccuuccugggcuacggcacugaguguuccaucuuggggggagacuugaaggucgcuuucaucuuuguccagcaucuguugugcucccuggcugucagccugcaucacaggaaccugauucuguaaaucagaagcguggguuucgggggcuguuucuguacgugcaaacuggucgacggcugucuggaugacacucuggacaaucuuauugcucuuacucucaaguuccaagaucucagguucagcccugaggauuuucucucuugcugcacucuccuugccggcagcaucaggaccagcaucuggcuuguuaucuucaucugaucucuguuucugggaugcgcucacuucucuuugaaggucagaauguaggaugcuuucaggagcaggaguuacuauuauugggauggacucugccugagacucaggccccuggggcacgguguccucuccaugcugaagagucccguagccaccgguuucggagagcuucucagcugguaaugauugcgcaccugcacacuccaaacuuucauccaucucugaaguugccacaguuucuucgaccuuuuucacagcuucgguuguuugagugacuggugugucugagcuuugaacuugaaccucuaugcaaucugcuuugucuuggucugggagagaagggcuuccuucaaggcugcccagugccuuuccccucucugagugaggcaugucagcugucaggacuggcuuaggguggguuccuucaugcucaggagcagcuguuuccugcucauguucuucacuggcuugcucugucuuggucucuguuuccuccuuuucaacgucgguucccaucucucuuuucuccgggcuaauacucuguucuucauuacucucaguuuccugacaucuggccacuuccauuacuucacugucacgugucaagucagcagucuuuugacuguuggguccagugugcacaggcaccuccaguucuuuaacacacuguccgucuuugacuuuuucuccaucaaacuggccagccucacccucuugacccaccucagccuuugccagaauaggcacugccccggcagccagcgcuuguguggguucuagaacaucccuuccugguuuuucccuguguucuuccugggcuggaaaacuagaugguguugaaggccccuccgucugagcagcagcugccuccucuucagugaccugugacugcuugacggcggcaauggcauuacuguccuggcugucaacggucucgucuugcugugucccguuuggagugucugaaucugcgaggggaguacuuccauuugucucacugucugucaagguuucagaugacucaggggccacagccuguuccaucagcugcuggugcuugauaaccuggcaugugguggcacggucuacauccucugugacuucaggaacuucaaggcucucugggguagccuguacagucucggagcccugugcaagaugcucaguuucagcuuccugcacggguccuuccggcacaacauccuucucuuucucgguagccagcaccucggaguccuccucuaccuccuccaccuucuccagugcuuucggcccugcucucugcagagucuggguugcaggcaccugggaguccucuuucacuuugucugcaacggcuuggaggacggccugcgucuggcgcuccuguucuuccguaucuagcaugccacccucuaccuccugaacugggguggcuuccucugugguguccggggagucggacagcugggaaacugcagacaccaugucuguggucucuucugccccugaugcuucgguaaguucuucagcgcggagcgccucugugguuucugcggcugucacugcuucugagguaaaauccacuucacuggugacuaugucgucaugggcaucuuugcccccugguaaagucugggcgagugcaggaguugcuucugcagugaugucuuuuucagugaccucuccaacaggcgguguggccacucccucugcgugcucaagagguucugucauggaagcagauauccacgaaggggaccgcucuucggcacuggugacugcccuggucccaucaaugaccgcgacacucacggugugaaccagagucuuacuaagcuccucagacacauacacagcccccuucagcuggggcagcuccacguucuccugagcucgcugcgcuuccagcuucucucucucuaccgcaucguacucagacagaggcacaacagcugggacgucggggucguccucauugaucucuccuggccccgagucuucaacggcggccuguucuugcuucccaucugcccuuuucuuccgccguccaggaauaaauuucuuaauggaaacccaagauuccucucuacuugguucgaucucggaggccaacugcucugcaccggagucuucggcucucucuuccaguuuugacuuggauuuuuuucguggagugacuaaucucuuaaaugacucccagguggagacgcccuccccuucagaagggcuuccagcuggcucgggugaggaacuuccgugcgcuuggucuuguuccugggugcuggcaggaagagcaucugcuucuuugucuuugcuagccuccuccgcucuguggccauccccucccaguguucuuggcccuccuucaucaucugaagaggaugccuuccucgcucucuucuuggacgauccgacacaaaucaacgccucccaagacacugaaguauccacccugcgcuuuggcuccucugaccuuugcuccucgccaaccgcucugaccucauccugcauuccagacgccgugcucuccguggaggacaagguggcacucuugaccuuauccagcucuucuuccuugucgcucucagaaggucuucggacccguuucuugggugucaccaucuuuuugaaggaugcccagggggugaucccuucccuuuucuucucuccgucggaagucgcuccuuccucagcuuccgcuuccuggggugcuuccgauggccccuucuccagacacgcgaucuccucgggcucuucaggggaagaggcagagcucucucccuucugcucgucagcacucucuggggacucgguuugaauguguugguauucuccuggcucuucaucucccccgccuccuccucucuuccccuucugcuucuucccggagagcuucuuuaagcccgaacugcugaagagcuucuucaggggacuucccuguaccuugauucucuccugagaggacagcaucuccaccucacugacaaugccuucgggguguuuggguagcaucuucucuucaggacuuagaucugucagcugaguauggucacccccagagacgcauacuucuuuggucuucaucagcuccuccacaggcucagcuuccugggggaccuccugggucucagccaguuucucagggggcaaggauucucccgauccuuccaccaccacauccccuuccaccucugcuccuccuugcccuuucgucaucuucuccacggugcucacguggaccucugcaacaacuucuuggugggcuuccgucuucucaucaaacacuuccguugccaaaggagcacacuucuccgacaaugccuccaggucaccgaccuggucuuccaaaggcaacuccaccuucucauagucggcugacaaccuggccuggucugugccuucugcaggcuccugcuccucggcuggggcuggcucugucuuuuccccuucuuccucgucuacuuuuucagccucuugcuccuuucucuucucggaaguuuccagaucaucuuccuuugguuucuugaagcuggucuucuugcgccagccggcccagccgugagugaagaauuucuugaaggaagauguugucucauugcugacagggcuggucggagauucuaggggcuugguagguucuuucucucgguuuucuucuccaucuuuggcugcuucuuccucggucccuugaccagauucggcuugaaggggaauuucugugcugcucugugcuugcuucagggugccuucuugcuucucuguggauugcuucagcucacuuucuuuggaugcugauucgccgacggucuccacuccgggcucuugguggucuccugcuccgacggaggcuucugccccuucgccuucauccuucuugacagugaguagcuggacgguaucugacuuuucguuuuuauccuucuucaccgugaauuuaaaaccaacaaauuuaaauaccuucuugaagccgacgucauuagcuugggacucagcagccugcgccauuucuuccacauugcucucugaagcagggaucuguucgauuauuuccgguguuuccuccugcucguccuuugugauaucuucaacaacuguggaacuggcugccauuucuuuagcucggucuuuuucuuucacaucuucugacucucucuguccaacuauuaacaagggaaauggagaagaagggaaaauuacuuuguucaacaagcguaacacucuccuuaguaguacagcguaguagauuguggaaguauuuguaaauguuucauagauuggaccauggcuacuccuuuccaaggagcaacuaaaaccucuucaaaggcgcuacacgcuuggcuccuuaccucuccuuucuuggcuguugagauauuaguuacauggacugcagacagagaugccucagugcuuaauagcacaugcuguuuuuguagaggaccuggaggcucaauuccaaacaccuacaugguggcuggauccaacauccuguucuggccucuaugggcacugaacacacaguacacagguguguauauaugcaagcaaaauguauacaaggaaaggauaucauuuuuuaaaaauccucaugaaugcaugaguagggauacaaaaacaagauccaguaaaugaggagugaggaguauuuuuuuuuuuuuuuuuuugguuuuucgagacaggguuucucuuuauagcccuggguguccuggaacucacuuuguagaccaggcuggccucgaacucagaaauccaccugccucugccucccgagugcugggacuaaaggugugcgccaccacgcccggcaaagaguacuauuuuuuuaaaaaagauuuauuuauuauauguaaguucacuguagcuaucuucagacacuccagaagagggugucagaucucauugugagccaccaugguuguggcucacaugugguugugagccaccaugagguugcugggauuugaacucaggaccucuggaagagcaguuagggcucuuaaccacugagucaucucuccagcccgaggaguacuauuuaaaaaacaaaaucaggccgggccuugguggcacaugccuuugaucccagcacuugggaggcagaggcaggcggauucauucugaguuucagugccaaaccaaauaugaagguggggguggggggugggggagggggagucgggaagaggaggucuguuacuuagagaacaggggcaggaaggacugcaagcuugaggaccauccugggcaaagugagaccucgucucaaaaguaaaaaauaaagccgggcauggugagcuaugucuguaaucccagagagcuugagaggcagaggaggucgauuccugugaguuccaggaugacauaauaugucucaauuaaauaaucugccucgggcuggcgagauggcucagcggguaagagcgcugacugcucuuccaaagguccugagugcaaaucccagcaaccacaugguggcucacaaccaucuguaacgagaucugacgcccucuucugggugucugaagacagcuacaguguacuuacauauaauaauaaauaaauaaauaaaaauaaucugccucaaauaaauaaacuaaaauaauaauaaaaaauaugguggucggaauaguacauacagucaagaaucaaacguugcuaaauucacugggagaaaaguuuacaggaagcauaaaguuucagaauguugaagucugcccccauaguauagcuggagccauuuuguuccaugccugccagcuauuuccuauuguugcuauaacaugccuaacagucacugacugagaaaaauaacuugacucagagcagggucaugcugaccacauacccuguuaugcucuauaugcuauaagguuuauuaaucuuaagaaauucaacaaccugggcuggugagauggcucaguggguaagagcacccgacugcucuuccaaagguccagaguucaaaucccagcaaccacaugguggcucacaaccaucuguaacaagaucuggcgcccucuucuggagugucugaagacagcuacaguauacuuacauauaauaaauaaauaaaucuuuaaaaaaaaaaaaaaaaaagaaauucaacaaccauaagcuucacuuaggacccaagugaucaggccugacaaccugugggaaucacugagaaagcacaugucagauucccaaugaauggaaucuaguugugaggaaaugauaggccaaaggcgccccgugcucagccuggucugcuaagccaaugacacaaaaggccaagguuaagcaggaagguuuguuugcaagaaacuucaaaggcuggagaggagggagaaagaaugugguaggcuauugaugaugcugugauuuucuguuauaucagcauuuaaggaaauuaaaaaaaaaaaaaaaaaaaaagauuggguagggucuggagagagcgguuaagagcugugacugcucuuccagagguccugaguucaauucccagcaaccacauggugacucacaaccaucuguaaugggaucugaugcccucuucuggugugucugaagacagcuacaguguacccacacacauaaaauaaauaauaaaucuaaaaaaaaauagauuagguguaaaaagucaaacaugauuuaaugaagcucacggggcccagggaacugcaguaugggggacauuagggacauaacuagaccccucccccggcacugaaucacacagcagcucacuagcgaaaaccaccacugaaagcauaguuggugauggggugggguggggauguuuguaagaaugauuuaaaauuaggugagguuuauuuuuguaaaaugagggagugcaggcuuugaaagaccaacaaguaacuucauuuuagccuaaauucucugccccaucuuucacaaauuauuaucaauuaucauagggagggauuuaguaugugauauguuuuaaucauuuugcuagucugaguucaauuucaugcacuucuaaagcagcacaggauauguacuucuuuauguaacagacgaaaagguccauucaaacuggcggaacauuugacuacaggaaggguaggcagauuggcaguccagugccagcuugggguacucacaaagauccugucucaaaauaaaacauaaacuggggcuguaguucagugguggaguguuugccuaguaugcucaagguccuguguuccacacccaucaccaacaacaaggaggaugcuggggaacuccuaugaucucauccauccaucuaucuaucacaaacucgagugguccacucauauaaggaagcaauauagcuaauacaugcauauuucaaaacugcuauaauaaaauuuuuagugguguuaccacaauaaaauaacauggucacauaauggcuacguuaauuaguuugaauggaucuauagucugugcauggcuccaugauuuuugacuuguuagccuucagaaccgugugcaaauauauuuaccacuuaaaacauggagaaaaggaagaggaaaacaaaaucauacuuugaugaaaacagcaauuuuacuccagaaaauauacacaauuguuauuucucuauugagaaucuaaaguuagccaagagucagagguaggcagaucucugaguucaaggccagccuggucuacagagugaguuccaggacagccagggcuacacagagacccccccccccccacccaauccccgucucaaaaaaaaaaaaaaaaaaaagagaaaggaaggaaggaagauacucuaauucuuugcuucuuggaagguaaguuauugugggcuugugcuacaagguggagaaauaaaaucagucacugacaaacucauuaaauguuacuaauaacugggaaaaguauaaaggauucucuuacuccaagcccaagacuaaaauacccccuugccuucucuggggguaggaaaugcaagaauuuucuugaacaggguaauaaagagcaguauuccacaccauugccucuacaaguuaauaggaaagacuuuuaaauucauuuuuaaauauuuauuuuuauuuaucuuaugugugucugugugagugaaggccucguaugugaaauuaacacaaaagccaaaagagggagucagaucccuuggaaguggggagccugcuaaguccucuuuuuuauuuauuuuuuuuccuucucucucuggccugcuagcuccagcccaaagauuuauuauauguaaguacacuguaacugucuucagacaccccagaagagggcaucagaucucauuacggaugguugugaaccaucaugugguugcugagauuugaacucaugaccucuggaagagcagucagugcucuuaacuggugagcauucucgccagcccccccccccccaccuuuaaguccucucaagaaagcaagaacucaauagagcaauuucucuagucuccauaacaauuaaaaagauuuauuuucccuacaaauaauuuuuuuggguuuuuuuuugagacaggguuucucuguguaguccuggcuguccuggaacucacucuguagaccaggcuggccucgaacucagaaauccgccugccucugccucccgagugcugggauuaaaggcgugagccaucuccaccggguggaaaagaaauuaaaacaaaacaaaacaaaaauccuaguuuauuuuuauguguauguucugccugcauguuauaaauauacucgcaccacucucagaggucaggagcaagacggaugguugugagccaccaggugguuaugggaaaccaaacacaggccuuccucaagaacaaacuguuuuaaucacugagccguuuucccagguccacccuuuucccuuuaaauucuacacugggugcuuagaguugagcuacaggacacaaaacaagcaggugccagccaacuagcaggacaaaacagguaaggauggcgaagcaauacucaaggaacugcuuuauguacucuuuuucuaaaacaauguugggggugggggggugggagugggggauggagagauggcucaguaguuaagagcacuggcugcucuugcagaggacccagguucaguacccacaggguagcucacagcugucucuaacuaugguuccaggggcucugacacccucucaccaaugcacauacaaaauaaaaauaaauaaauaaauaaauaaauaaauaaauaaauaaauaaauaaaugcuuaggaagucuuaaguggcuuacuaguccuguaguaaauuauaaguaaguuucuuauuuaagaacuguccuccagauacaaccccaaauuaugaacauagauagcauccuuuccgauuugccuauaggauuagacuacucugcgguuuugucggccucuucuugccucaaucccugaccccaauuuguacagaacuuacagggaaguucacuuccaaaaauucggccucuacugcauagccaagcuaucaaacauccgauggcccaagccuugagcuuagccuucgcaacuaccaagccugguggccaaggccguuuaaaucagguuccaacaggauacagaaauguccucgcgcaccacugcggcguggcccacacgcgcauuugcaaagccugcaucaugugcuugaacccacagcccacgcagagaugcgguccaccucccucuaugcuccaugguugcucucuccaggcuggggaggggguaaaaugaccucuuuagucuuggaucauuuucuggcucucuucugccaaccaccucuguuccuucuccaagcuaugguacugaaggcugugcccucugucuggcaagaagugauauuuuacucuugggguagccuguguauugacccugugugaaaaucuauuaugcuccgcugccgccccccccccccccaacaacuggagcaggggcugucccugaaucuguucccugccuguggauccuguucccuaacugaacugcucugccuugccucaguggaagaggaugugcccaguccugcaguaacuugaugugucaggagauacccugggggcccucccccuucucagaggaaaaguggaagggagugggcuguccgggaggggggcaugaggaggagacugcugagaucagaacguuaaauaaauaaauaaauaaauaaaucaagcacaugaccuucauggaggcuuggcccugcucuccaaggcuaaguugacuuuggagugcagagcucgggguuggaaagcaaugcccucuguccuggccugccucgccucucaggaagacugaaaggcuggaaaccacacaccccuaucuagagcaaucaccauucccagccaccgccacgcuacggccgccagggggcgcacuacucacaacauaaguuacuccaccagggcaugguggcugguggcccggaacagcggcccgagaggcccggccagccgcucccggcugccccaucgcggggcaccaaccggccgcggggcaggcgucggccgcccaguuggagagggguacccuuggggacggcuacauacgucacagaggccgggcauugucggccagguaaccaaggcaagcccacccccccaccccccacaaaauccagaaggaucuagaaucacgugugggggccucaccccccuagcucuagcacaggaauagacgagggcuuucuggcaguccccacucuguguaccaccuauaucugacuaccuaguuaacccucaaaguaauggccacaggcucucaggacacauuucugcguggguuuggcuuggguguaagcacuuuaaauggauaaaacccaacuguggugugguauguuccagggcuaaauucuuuccuauugccauauacagucuuaaugcuugaaggcagagccuccaacugguucagaagacacaggaacuucaaaaauggccacauagggagaaggccccuacagcgacuuggggggacaacuuggcaguuuacuacaauacuaaacacauuuuuuuauccuucgagacugcaaucaagauccuuggcucucacaaugaguugagagcuauaguacacacacacacacacacacacacacacacacacacacacacacacuugacacacuuguacuugggcacugauuucagcuucauaacugaucgaguagccaauauagaauucaguaggcaguuagguaaaaagaucguggguugacaggggauuagagaagaaagaaugaauagguaauaagggaugugcuaggcagggcuacuauacuuucugguaauaauuauauugaaaguauacacacccuugacauuugucacaauccaucgaauguacaccaccaggacaaaauuacacacucgaugcucugacuguugcugugcugugaggcuucgucauacguccauaacaaagacaccgcuuugggaaaggauuuugacaauaaagaccaaacacggaaacuuuggauuauggcuaauuuuucuaugaacccaaacugcaugcaugcaugcaugcauauauauauacacacacauacacaucacacauguacacacaauacauauaaauaaaauauauaauaaauauauaaaacuaauauauaacauauaauuauaaguguaugguacuuggagauaacugaaggcuggcuugagucagggcugcaaugggagaagcauaaaguuugucuuuuugauucuauacccuuucuuuuuuaaaaaaaaauauuuauuuuuuuauuuauuuauacacuguacacuauagcugucuucagacacuccagaaaacagcaucagauuucgucacggaugguugugagccaccaugugguugcuggaauuugaacucaggaccuuuggaagaacagucggcacucuuaaccacugagccaucucaccagccccucuauacccuuucaaaacacaaacacccccuacuccccaucccauuaaguccuuguaaaauaugaaaccuguaagugccacaagacaagaauaaguguugggacaugucaccucucccaucuggacaggaaaauuacuguauguguaaagcagacaaugauuguucuggugugaaaaguggcauuuaagccgggcgugguggcgcacgccuuuaaucccagcacucgggaggcagaggcaggcggauuucugaguucgaggccagccuggucuacaaagugagcuccaggacagccagggcuauacagagaaacccugucucgaaaaaccaaaaaaaaaaaaaaagaaaaguggcauuuauucaugcuuacuuucaguuauauugaaaccaaacaaaagagcacacacacaccccuuguccauccacugggagcgacuucaaagauccccuggccaucauuuugaaacaaggggaaaacuagcuaggacaagaaguauuuacagugcuaaaucagaauguguuugucaggcgagaaaccagaaaacaaauacagugagaaaguguguguguguguguguguguguguguguguguggagguucaguaaccaauaagggacaaaugucacucugcccaguguccugagaaggucccagcauagcauucuggcuacauuaccuaaauauugaaccaaagcagacguaaggacagcauaaaauaaaagcagccaaaaauauccuagacaggggcugcgcaugcuguucuuugugcaagaugcagccacuaaagucacaacucucagcugagguagacaggugcacucgguuugcaaaagaccagcgaggugaacugagcucaucgguggugugggugggggggcagggcuguuucucacugcuaaccggcuaauggcuuguuauauauagagucaggcagauagggagucacugacucaguuacugaugacuccaucagauucaguggauacuuccaauccagugcucacacaacacagggggcccugguuaaacugaacggucacaaaacuaaguccuggaucuggaaaagguagagagagauaagggaaggagaaggcugggaggacauaagaaaggggauguguggggugagguuucaggaaacaucacauccauggaggaaaguccuagaacaaagucuuuccuuaggggccagugagacggcucagccagugaaggugcccguugaccugaauuuuauccuggggacccacagggcagaagagaaccaguucacacaagcuguccucugacuuccauuaaaguacuucggcauucacauguauuuauguaugcauaaaauguaauuuuaaaauugcuaggugugguggcacuugccuuuaaucccagaauuugggaggcggaggcagauaggaucucugagaguucuaggccagccuugccuuacauagucaguuucaugucucucuauuccucucucccaacccuucucucucuccccucccucagcccuccuugaggcucccgggggcuggguuuacagguggguaaaauggaaaguacagcuuuccuucucccaaaggagaaagaagccagguagugguggcucgaaccuuuaaucagcacuaggcagagacaggggaaucucuugauuucgaggccagucaggucuacagagugaguuccaguacauccagggcuacacagagacaguccuaaucagucaagcuaucccaucccacccccugccgcuguauugcuccagugagccagauccccagcccaaggacuggggucuuuacauuuugacuaaaacgcuauucucaccugaggaauaccgaauggcagagaagcaccuaaaaaaauauucaacauccuuaaucaucagggaaaugcaaaucaaaacaacccugagauuccaccucacaccagucagaauggcuaagaucaaaaauucaggugacagcagaugcuggcgaggauguggagaaagaggaacacuccuccauuguuggugggauugcaggcuuguacaacccucuggaaaucagucuggcgguuccucagaaaauuggacauaguacuaccagaggauccagcaauaccucuccugggcauauauccagaagaugucccaaccaguaagaaggacacaugcuccacuauguucauagcagccuuauuuauaauagccagaagcuggaaagaacccagaugccccucaacagaggaauggauacagaaaaugugguacauuuacacaauggaguacuacucagcuauuacaaagaaugaauuuaugaaauuccuagccaaauggauggaccuggagggcaucauccugagugaggugacacauuaacaaaggaacucacacaauauguacucacugauaaguggauauuagcccaaaaccuaggauacccaagauauaagauacaauuugcuaaacacaugaaacucaagaagaaugaagacugaaguguggacacuaugccccuccuuagaauugggaacaaaacacccauggaaggaguuacagagacaaaguuuggagcugagacgaaaggaugaaccauguagagacugccauauccagggauccaccccauaaucagccuucaaacgcugacaccauugcauacacuagcaagauuuuaucgaaaggacccagauguagcugucucuugugagacuaugccggggccuagcaaacacagaaguggaugcucacagucagcuauuggauggaucacagggcucccaauggaggagcuagagaaaguacccaaggagcuaaagggaucugcaacccuauaggcggaacaacauaaugaacuaaccaguaucccagagcucuugacucuagcugcauauguaucaaaagauggccuagucggccaucacuggaaagagaggcccauuggacacgcaaacuuuauaugccccaguacaggggaaugccagggccaaaaaaaaugggaauggguggguagggaaguggggggggaggguaugggggacuuuugggauagcauuggaaauguaauugaggaaaauauguaauaaaaaauauuuaaaaaaaaaaaaccacacacacacacacacagccggcuaauuaguaagcuggcugguuaugcucauccaaaacucaaauggcuuuguuuuguuuuucaaaaacaaaugugcuuauuguuuuguguuggcuuugguuuuuuuuaaagauuuauuuauuuauuauauguaaguacacuguagcugucuucagacacuccagaagagagagucagauuucauuacggaugguugugagccaccaugugguugcugggaauugaacucaggaccuucggaagagcagucagugcucuuaaccgcugagcacucucuccagccuuguuuuuguuuuuuuaagcagggccucaaauaucuugagguuaauaugaacuagcuaucuaguugaagcuggccuugcauuuguaauacccaugccuccacuuccuaagugccagauccacaggcaggcacacuaugcccaaguacuuagcucauuucucugaguucuuaacaccaucuaucaguaaucuauagaaacaaggauuccuguuaagacaauaugcagagaugaucacuauuaauauuuaugggcuuuguuguuguuguuguuuuugauaacuuguucaaugguuugccaaacuauagcauaaugguugcaugauucauguuuaugugcuccuccccccccucccuccuccccccccccccagccccagggagugucauuacagaguuugagcacaagagagcaguguugcccagcuggcugcuguggaccaauaaggugcaagagcagaacccagaagggcggucuggugcacuuucaaacucagccaaguugcaaguuccacuggugccuuuaaauaagaaaaauaagaaagacaacaacaacagauuuuuaauauaaaccuuuccagggcguuaaggaaagccucugucucucucaaguuggcucucuuacccuuuucucuguuccaugcaaagcugcagaccccucaccccauucugacccgugugagccugguguggccucauggucuguguuuuuacucaacucuuuacuccccauccccugcuuuuagcucucacuggcccaccuugaaacauucaaauuacuuacauucccgaguucuagcuggcagcagauauccccagaccagacaucguucccauccacccauggacugccugaaccucucugacagacaggguccauucacagacaucgcuuagcuaacaaagagaggcuuguuuuuggcagggcugcauguauacaacuccucauauagcugagauuagccuugaacuacugauucucuugccaugcaauccaagagaaucuucucaaucaagagcuugagaaguuguugaaugcuugaaaacaaacaaaaaaaacauaaaaagacccaaagauggggguggggguuaagaagaccuaaaccaccaggcuucuaagggagggaaggugccauaggccuuuaaucccagcacucuccaggcagaagcagauggaucuaugagaauugaaggccagccuggacuacauggugagaucugguucaugucugucugccucacacacacucacacacacacacacacacacacacacacucacucucucucucucucucucucucucucucucucucucucucucucucucucucucucucagugguagagucccuaugggcagcagaggcugguguucccaccagcuauguguggauggaugcaugagcgccaccacacauguguagaagucagaggacagcucugugcaguggcaccuuccucccaccuucacacgggcuccggggauuaagcacagauuacagcugaacuguggagcccuuggagucagggcaagggguugagucugcagggcuuccagcuccugcacaaucaccugccuuagauuugccccacuagacagaaagugggaaagcuuaaaggucccuggaagcaacacugacucaggguacauuuccuuguccccuuaaaagucuaugcaucuagccgggcggugguggcacacgccuuuaaucccaacacuugggaggcaaaggcaggcggauuucugaguucgaggccagccuggucuacaaagugaguuccaggacagccagggcuacacagagaaacccugucucgaaaaaccaaacaaacaaacaaaagucuaugcaucaacaauacaagcaguuguagaagagaucuuucucucucgguguacaguaacuacucaguacagcucucagcaguccuaccacugugaagacaacugcuauucacacagcgaacggggcucagacucaccaggaucgagacgagggcacaaacucgaaagguccaagucaauagcaaugggcaucuucauaucgcccuccccgcaccccgccagcaacccaucuucuccugucccgaggauagggugggaugaguauucaaccagacuuagagcaaaaaaaaaaaaaaaacaaaaacaaaaaaaaaacaaaaaaaaacaaaaaaaaacaaaaaacaaaaaccauuuugggggaaaagcuucauuuaaacugaacuugcagcaaccccguuucuucaucaccucuccuauaggacaguacaaccguguaacaacgauuuacagguggugcaaggacucuaggaguguuuaaaagcacaaauggcaugggcugguugaauaaaaucacuuuuucucuaauggacacauuuuaaaggagucuuagaacuaauuucccacaaaugucaagagacaaccacacuuaggagauggagauaacacacacacacacacacacacaauuuggaagcuuaaaagaaaaaaaaaauaaaacuuuccuccuauauuucacagaaacguuaaauauuuuaaucuaaauuuagccguugaguuuaggugacaccacuucguaaaaacaaacaaaaggugcaacaccacaaaaacuauacuauucacuauccagguuuagaauagccagugcucucuguccccaggcacagcuuacugugugggacaucuggaacuguuuaacuuuccccccacgagcuccuggagucuuuccagaauucucugcauucugaacccaccccuuauaucaaaacacgcccagcucaacucugcucguccuggcgcucaucagccaugaacccgccaggcagaaaagcugcuuagcggggcuuaacaccgaaauguaaaaggaccagccaggugacaccauuacuaugcggcucuuuggccaccgugaugcaagggugcccugauagcaucaucuaugccuucagaaagagauccucuaugagguacucugaagcuaggcguggguaacuuccuuuuaugacaugaggaagcucaccacucaggguucucccaauuguuggaaacaaacaguggaggccaccaagcaccaaaaauacugagucaacggccgcagagaccagcgcagcaccucaacucucuggacuacuguucuguccucaucacaaaccggaaccaacacugacaccgaucccagccaugugcagcauauugcucccccaccaauaauuugcauagaaaaguacauuauaagcucucuacaguaugcacaaaugcuucuguggcuuagguuuuguuuuguuuaauuaaaaaaaauguaaaucucacuggcucuuguccccccccccccccuucaaggacaccacuggcucuuccccucucucuccauuuuuucaaaaaaagacacacuuuguagcccaggcuagccucaaaccagaguuaauccucugccuccguuucccagugcugcuggauguauaggagugagccuccacacuuguauccccaauuacucugcaagauaaagaaugauguuaacuaucaguuaaccugaaaaaaaagugcgugaaugaaugaaaauagaaaaaaaugccuuaaaaauuuauuuuuaauuauguuauauguggauguuaguguauaggagugcacaugaaugcaggugucccacaaggaccggaacagaggaguaucaggagacucccuggagcugagguuaaguuaaagucacccgugagccaccugaugugggugcugggaucacaccucagguccugcucauaaccgcugauccaucucuccagcucugaaagauacuuucucuuaacucaaaaaaguaguucuggcaaguuaaguaugcauaaucucucucgugcacacaugcacgcacgcacgcaugcaggaacacacccuaguaauaaauaagaugcaaguaaguagugacucuggauuggcacaggugggagagugccccugccugguguacaugaaagcccggugccaucccuagcacugcacaaacuggaugugguagcaguguccuguaagcccagcacugggaaggagacacaggaggaccagaaauggaaggcacggaaagggugauccuugccuaaguagggaguuugaaacagcuuaggcuaggugagacccuguccuuugcugucacagcaccacugugcaucagggaaggagccacuuucucacaaucaugucgccaacaacuauuuucuaguuucuaugcccaguuaaugcuaauggaggcccagaaugacguugccacgugcuguggggcaaucccucagauccuaacucagcguguacggccuaaaccucauaucucauaugucugugugagcuggaagagaggcgauagaaaaugucuuuaagauuucuccugcuuuuagaacuaaaaacauggggcuggagagauggcucaguggcuaggagcacugacugcucuuccagagguccugaguucaauucccagaaaccacaugguggcucacaaccaucugcaacgggauccuaugcccccuucuggugugacaguguacccacauacauaaaauaaguaaagaaauuuuuaaaaagggaagaaagaaaggaagaaaaacaacagaguuccacguaguugcuauacacacuccaucaucuugccugcauuuaagaagugagagcaccaggcuccuucuccaaugcuacaaaaacucucuucccuuuuauuuaaacaagcaguuuagaagccuucacugcuuuuaagauucugaacaacugucugucugagucaggguuagucuguguagccuuggcuaagugguucuagaauuagcuuuauacaucaggcuggccucaaacucagagaucugccugccugccuuggccuccugagugcugggauggaagggucacaucaccacgcccagcucugaccuacuccucuuacccccccaccccccacaggguuucucuauauagcuguggcuguccuggaacucacuuuguagaccaggcuggccuugaacucagaaauccaccugccucugcuucccaagugcugggaugggcaugcgccaccacaccuggcucugaccaacuucuuaauggcuacuaagaauacaucuuccuuaaucaguuaacuuacaaaaaaaaacaaaaaacaaaaaacaaaaacaaaaaaaaaccucaaaaaaccaaaaaaucaaaagcauaaacacaaagacaccgagauucucuuugaagaagcugcuugcccuguagcugcccaguucuuuucuguuucucccuaguuuaucuuuuuuuuuuuuuuuuuuuuuuuuuuuuugagaugagguaucauuaaucccagccaggcuuugaauuccugauucuccuuccagauucaggcaugcuagcaaacauuuuaccaacugagcuauaccuccaaccccuugccauuaaagauuugugcucuuucuuucuuucuuucauuauucuuucauuauuuccuccuuucuuuugaggcagaguuacuccaugucacaccaggcuuccuacaccucucuauuauagaccagacuggucuugaacccauggagcgcagcuagccuccuccccgagugcugaauccugcaccagcacgucuagucucuugugcaguuucugauuacuggcaaaaaguauaaaaccaggcaacacuguccauaugcacagugugaaguauaaucuagaaagccauagauccaaccacuuaauaguaccuuaaaaacugaacgguucuucuaaauacucugccuguggcuccacugggauuacccgcuggaacccccuccuucccacaagaaacugagcacgagacaaauuaauaaaaaauggaauacacaacaccuuauacacacacacacacaaaaaaaaugccaggagagagggagaucucagaggacccauucaaaguguuguucauccauccauccauccaugcagacacccugacucgggcuggagagagggugcagcaguuaagagaauaagagaauagacaacucuuucugaggccagaaguucaguucccaacuaaaacuauaagcuguaacuauaggcucuaggggaauccaacaucucugacucuggagggcaccuguacucauacacggacugacuggcacacacauauacacauuaucacaaacaaaucuuaaagaaaacaccuaaugaacuuggaagaagaaugcuauucauuuuuuuaaaacgucuuuaauuuguagguuucauaaauguccacccuggccagcaguagaaagacuagagacaugacagaugggacagacuaugaaagagcccucggcauaaacaagcuaaacuauaggaagugagagauauuuuuagcucugcuaaacuuuugaagucauuuaaaauuccacagggagacacggcuuuggggggaagagucacacagagaaaaaauauggaagcccuggaaagucuacgccccacuuugagacaacagauuuggcagcauucaucuuaaauauuuaaaucggagccacuuuuguaaauguaaguuagcaaguggaguuuaauuuucuaagagcguaaacgggaaagugagcguaaacacgcacucuccuauauagccagucucagacuaucuaucaaacgccaaguuaguggauuugcaaaugcauucugaacgccuggcguagacugcccacuucuagaaguuggcauaacauuacaacucacacaaguagaguccuagaaaacaagcaugggaaaaauaauuauuuucacuaccuuuuuuuuuuuuuuuuuuuuuuuuuuuacuaauacuuaaauggcauuucuucccuuagguuuaguaacuauguauuauguauuaguauuauggcuaauacuaaccacguaugacagaacuaaacuaaaauauuagccugauacacgacuucacucaacguucuuauuuaaugagcucuaggaagcacugaacgcuuacaauuucucagacauaggaacuuuuaaaauuagacuagggcagguuauccacagugaaucugaugcugauucaacucgcuagcugcuguggcuucucucaacagcacagcccccacuucucuaaggggaccggauaaggcucccaaccagaugcauugucccgugagcgcuuccaggaagauuuugguuuaaauaaaaauaaaaugugcgguucauugguuuccgaggggcuauggaaugcucuccauauucaauuaucucucccuacaccggugaaaguguagggagagauaauugaaagcuaauaaaauuccagccacacggcucaccucuugagacucuucuuccagagucacaucagcaggaagaagagucaccagucuuaccugugaugguaauaguccccagcauauuuaguuacaguuuucggccucuuacggcaggaagucuccuucuccucugucuacucccggcuaaccagugagaugaaaaggaaugcaguccucagagcaucaaggaagcucuccagcccuggaggugcagcaaugcgcacuggagaagcgcuucucuggcuaauuauaggacggccccgcccacgccguaggccccgcccacagccagccagcccacaccucuguccggacuuggcugcaccacccggggaagucacgugccccauuuuacagggcuggucucugugccuggucugucgcgacccaggagaaaguuuuaagucucuggggugagccagaccccgagcaucaauauuugauccaagcggugacuucaucccuggcaccgacuccugcaucucaaacuuuuaaaauuauguaaaggcaauaacugcacagauauuaaauucuccgauuuuuaacgccauuuuuaaagguggaugaggugcaaagcggcauuuccuuuuuaaagcccauaguauguugccaaccguuuccuacacuccggucagcguaaagacccacaacucucugcgaucccaggccuuuugcaaaggguugucacaaagcgaacuaucuuuagcauuuaaccgagacaacuuucuaaaaagcagaaauaucugaccuuugggucucucuacuuuucgugguagaaaugagcuaaacauuggguugaaacuucaccaacacucuccuccuguuacaagcguauagcaaauaaaacagcugcauuaaaaauccaggcagcccaauauuucuuuucuguuaaucuugagauuguuucucuacaaagacacaaguaauaaaugagcuggaucuucaguuaggauagguccaacuggccuguuggagcgaaccaccucuccccaccccaaaauaaaagguuauauuauugcucuucucgucagacuugaaggccuuguucaugacuacuuagggaacuggagcggggagaucggugcgggaaaaagaguagacagagacaagcgacauaaaaaggggauuaaaaaaauuuuuuuugaaagaaagauuucagacauccacgaugguugcugcuucuugccaccaggaggcacaaugcaccacauuccagcccagaaagagcgaaaaagggacaacuccugggcaaucagacaaugguuacacauaucagcauuacaaagauccagaaaggcuucccagccaacgcccaaccuggcuuugagucucggcaagccaggcaaugggucuuauccugguugguuaagaucugggagcagacauuugcccucugcauucccaauaggugggguuucagacaacccagacaucucucuucccaccaucuauucccuguguguagaucauggauaagaagcccuauaugcagggucagugguccacauuaaacuagacacuucccccacagugucccaggaucccugaaggcccagggaacuaagaauacagaaccacuucccaguauucaguuguagacagcacauggcagucaccccacuccucuguggauucggguuuacauaacugcaucaccaacaccuucccuucugaccccaaauucuaacaacagcgacgccacuuugauagcuaaggggaaaauucaccagauacaaagcagacaaaacacucuuuuaagaaaaggcuaaguaaggcaagaucuuugcuuucauaacacaggugacaauacacuccucaaaugagguucaaagugaggcagcuaaggcucaaagacagcacaauggaugcugugcuagaggcugacccucccagcacacaguuaucuggaaucacuaccucccuguguaaugaagaacagggaguauauauagccgugaccaucagcaaguuccucuggggcuggccuuaaaauggaaaaccaucaaucaggacagaggcagaaggaaaggucagacagaggggucacugcaagggcaggcaccguucccuugacauuacuccuuuccacucgcgugaaaggagacguuuuagagccaggcaucaccaccuaaaacaaagaugacagaauauaugcccaucacuuggcggaagauugcuaggggguguuuucuuaaaucugcaugaucuagucaauaaauauuugccaaggucaugcuccacuuuuguugugcugaaauccacugggcgcuaaucagauauuauggccuuaggauacuuaguugagaguggcaaccccuggggauacaaggauagagcuagccuaagagaagaauagggacucccuaauguugaauacaaagaagcagcauccuggggcaaugucuggaaagagugauuugggaacucaggggugggcuccucauagcuacuguuacuuacaguucauguucauguucagaggcccaagacagcaaaggagagcuagagaugcuaaccagaaaugcuaguuaacaaggaaagauuucuacggacaucuuaagaacuuuguaauaacacagucucagcaaggaaagcagacagccaggaaugguguacuuguguaauuccaucacuguggacagaaggcuagccucagcuacauaaugacuuugaggccagccugggcuacaugagucucucccaaaaaauaaaaauuacaguaacaggacaaacaaucugaguacagcauauaacuucuuuaagauauacagagaugcacauaacagcacacaccuguaauagcagcacuuagguaauagaggaagaucaggaguucaaggcuacccucaggccagcuaaacuauuggaccacauuucaaauaagcaaagaaagaaagaaacagacaagagaugcaaauguggggcuagcgggaugguagcugagucauuaaaagaggauguuguucuugcauccagcacccaucuuuuuucucugcucccccccccccacacacacaggguuucucugucuagcccuggcuguccuggaacucacuuuguagaccaggcuggccucgaacucagagauccaccugccucugccucucaagugccaccacugcccgucaaaaaauaacucugucuuuuuuauuuuauuuuauuuuauuuuauuuucauuuuuauuuuguuuuuuugagacagggcuguguagcccugguuguccuggaacucacuauguagaccaggcuggccucgaacugagagaucugccuuccagcaccuaucuuagguggcuuacaaccauaacuauaacaaccguaacuccaguuccaggggaucugauauccucuucuguacuuuggaggaaacgcacacuuacauaugcacauauccacaaauauacacauaguuugaaaagaggggguuguugagauagcucagggguuaagaauacuggcuguucuuuggaaggaccaagguucaauuccagaaccuagaugguggcucaugaccaccuguaacuccagacucaucuuagagccuccucuggcaaugcaaccacagauauacauuaagauaaagacacacauaaaaugaaagucaagaaaaucucgacaagcagugguggcacauaccuuuuuuuuuuuuuuuuuuuuuuuaaucccagugcuuggaggggcagaggcaggcaguucgaggccagccuggucugcagagugaguuccaggacagccagggcuacacagagaaacccuguuucaaaaaacaaacaacaacaaacaaacaaaaaaccucagaagaaaagguuuuuguucauuucuuuucuuuuguugagacaggguuucuucuguguagcccuagcugcccuggaacuugcucuguagaccagcuggccuugaacucagagauccacaugucuuugccuccugagugcuggaauuaaagcacggcugggcaaaagaaaaguuguuguuguuguuguuguuuaauuaaaauaaaucuuugagauaaauguuaauaaaccaaugagaagauguucaacaucauuauccauuauaaauauguaaauuaaaaccacuucacacacccccaggaugcuaauagccaaaugacaacaauaaccaugaagaagcuguugcugguagaaagggaaacugaugugaaaagugccugggacuucuccaaagccuaacacagcugccggaugacccagcaacaaauaugcacccaagagcaugagaacacacaaucagaggagaaccuggaccauucguacugacguuaggaacaaaguguaaagcugugucuuuaaaaacaacuuuagugugcccaccaacuaacaacaggcugaaacaaguauagugggucuuacacuguaguaagugguucuguguaaggaaauagcagugauuaaaauggaguuugugggggcuggacccagguucaguucucacacccuaugaggcugugcacaacugucuauaacuucaguuccagaggaccugauaaauguccucugaagacaucaggcacgcgcauguauacacacgugcacacgcgcgcgcgcgcgcgcacacacacacacacacacacacacacacacagagguauauaugcagaccaaacacccauacacauagaagaaaacuuaaaaaucucaaccccaauccacaaaaagcuaagauaauaacauuuugucacaauggggaaaaaaugacacacagacauagcacagcuaaagaaaaccagagagaggggaggcggaucacacauggaaagggaaggcuuccccuaagccugugacucacugagagaucucggucugggggcagucagucccugcuaguaucaacuguggacguuguggucuagggcacacugcuguuugggagcagaaaaggguugccaagauccuuugggguacagggcuauuauuaccugguggcugagcaucuguggccuccaugcguaaugugcacagucuugcacaaugcacacugcaagggaccaccaacaacugcaaggugaauacacacugacuuccuaccacuuuggguuugcugguuuccugcuugucuguucugacauaccaggcuggccuugaauuccuuauuuucccaucucccaagugcagaaaugaacacacauguacaacuauaucuggcugucuguauguuuuuguuuuguuuugagacagggucuuacuguguguauagcccagguuagccucaaaucucaacuuuccuguuuuggcucccuccaugcuaagauuacagauaugggaguccccaugcccugcucucaacaguaaacuuuaaaccacuccuggauuacuuccaacacccaauagaaugcaaaccaucccaggguaacaguagccauucuggauugcuggaugucuguaccuucagaguaucccagccaaacauguuugcaaggauggacagacagacagacagacacaaacacacacacacacacacacacauacacacacacacacacacacacgauuguucagaggcuagcugauccuaugguugacugauuaaguguggaaucugcaguuccagaggauguacuauguauaccuaauaucagacuggaucucucuggguagcccuggcuguccugaacucagagaucugccugucucuacuucucaagcacaaggauuaaaggcuauacugaauaucugaagggauacugacaaguuaucgacaggauagcugguucuacugggcucugagucucugcccuaaggagcaagagcacuagcuaauugaauuuuaugguccagaugcauuggauauguuaacacagauaugguuacuuaaguuuuaaaaauccaaauaaauaaucuggagagcaugaaauuuuaaaacacuucaaaagcguagaggaaaauggaaaaaaaaaaccaaucugaaggagggcuggacgaugggcugacagcugagagugccuacugcucccucugaggacccaggcuucacugccagcucccauaucagacagcuaacuagacaccuguagcuugcacagaccuguuugucucugccuccugaaugcugggauuaaaggugggagccaaccccauaccuauuucuuuagagugaaagcggagagugaauauuuugauggagucccaaaugcuauguaacauguguguuuuuagaaauuguuuguuuagugggauauugugugcuuuguauggguuuguguaugugugugcaccuaccuguguguguguaggucagaggucagugucugcugucuucacuguucucuaccuuguuucugagacaaugaccucggagccugucauuucagcuagaccucaggaucugucuguuucuacccucccagugcugggauuauagacaagagccaugagagccagcuuuuaugucggggcuggagauccucacugugcuucucgcagagcaagcacgggacaaugggagccauugucccuacccauuguccucaagucuuaaucaagaggaguggggaggagggauaaucugaagcuacagacucaaaagaaauaauagugauuacauacauggcacucacugauucucugugacagcaauaagaaugagagccccaaaccacacaauagccagccucaaaccuucaaguaaccacguuggaaaacacaaaggaaaaagcugaggauuugccauauauacauacauacauacauacauacauacauacauauauauauauauacacacacauacauacaauacacacacacauaugcaugcuuagucaucagggaguagaacuauuugagaaggacuaggagguguggcuuuacuggaguggguguggccuugcuagaggaagugugacaguaggagugggcuugguguuuucaaaagccuggauaguuucacacauccugcccaguauuucucucccucccccucucugucuucagaucaggauguaacuauaagcuacugcuccagcaccaggagugccaccauggccccuccaugcuccugccaugucaauaaaggacuaauccucugaaccuguaagcgagcgcccgcccaguuaaaugauuucuuuauaauaguugguugaccaugcugucucugcacagcaauagagcagugacugagacaaguggacaaugaacuuccccaggugagcugucugcauuucuagcugacagguuaucaaguggaaauggauccuggagauuguuuucugugagcuucgggaggcugaagucuccaggaagcacacaggggaugucuggauaagggcagguuggacagcaguguauccaucaugcugacccugauggaaucucaaugugucugaacggaaauuaucucagcgaggggaaacucagagccaagauuugacagucaugaugaagugauacacuucuuuaaaaguucauucacugacuaucucaguuggcuugggcaaugacacaaagcaccacaaaccuggcacacagcucccggacacccagggcucauucucaucacucugaaggccagaggucugcaguuagcauucugucauggugaggaccuggugagguuggacacucuugacugauuuuggggauauuuuguuuguguuuguacuagggauugcuuagggccuagugcauucuagccaaguguccugaaaagucaccucuaggaguuggcaagauggcucaggggguaaaaaaaaaaaaaaaaggaacucccugccaaggcugaugacuuuaguuagaucccuguaccccacuugguggagagaccugacugcuauaaauugcuccagagaaagaggcaggggguggagggagagaggggagagaggcuaaauguaauaacaauaacuuuuuuuuuuaauugccauaucuggggcuggaaaaauggcucagcaguuaagagcauuagcugcucuugcagaggaccuggguuagguucccagcacccacaugguaaacagacauguaggcaaaauaccuguacaccuaaaauaaaauaaaauuauauauauuuuuuuaauuuaaaaggcagggucucuugccgggcaugguggugcacuccuuuaaucccagcacuugggaggcaaaggcaggaggauuucugaguucgaggccagccuggucuacaaaauaaguuccaggacagccaagacuacacagagaaacccugucucgaaaaacaaaaaacaaacaaacaaaggcagggucucucacuggccuagaacacaccaaguagaguagacugacuagccaccaaguuccagggacccucuuaccuuggccucccuggcaucaggauuucaagcaugccccauaccacacuuggcuuuuuaaauauagguucugggggauuguacuggaguccacaggcauguuuaccaacugaacuaucuccccagcccuuuuguuaguuuagucuuugaauaaugucuuaguuaggguuuuaccacugugaagagacaccaugaccaaggcaacucuuauaaaggacaacauauaugugggucuggcuuaggaguucagagguucaguccauuaccaucaaggugggagcauggcagcaucaggcagucauggcaugguguaggaggagcugagaguucuauaucuucaucugaaggcugcuaggagaaaacugacuuccaggcagcuaggaugaggguuuugaagcccacgcccacaguaacgcaccuucuccaacaaggccacaccuaguagugccacucccuaggccaagcauauucaaacuguuacaaacuguaucccaggcuagccuugaacucaauauauaguagaagaggaucuugaacugguguuccugauuuuaccucucaagugcuggggguugcagccccaugccuggcuuuacucuuacauuuuaaagagagugagagauaagcuuaaaaaugagaacuaguacuagugagguccaguuaguuuuggcaggcuuccaccaggcacauuccucuugaaacauacguaaguccugguguuuuuucuuucaaugcaaggcagcuucuuuucucuggagauauuagggaagaugaaagcggcacgugauugauguuugcaaauacuuaagaggacugccuucggaaagggaggugagugugcucugcggagcuuagaaguuagcccuggagacaggcagauuuucaggccuccuuuuauggaggaaaaaaaccaaaacaaaacaaaaaaccuccccagaagcagcagccacagcgggcagggaccugacacaucagcccugugacucucuucucucuucuccuuaggcuucuuggucccaaauuugacaaucacaggauguuaagcuaacugcccccuuccccuccacccucauuuuagagauaaggacucacaaagugugaguuggcccugaaugggcuaauguggcugagggugaccuugaacaucugacccuuuuucauuaucuccugugccaccauaccccaauuuaauguaguuccagggagagaacccagagcuuugugcaugcuaaguaaacauuacaacugggccacagcccuaggcucugaagagaaaaggccuuuaaauagccaauuaagccaaguaugguggcucuaccuagagagucugagacuagccuggguuauagaacaaauucaaggccagcaugggcaacucagggaaucuuuaaaaauaaaauauaacauaaaaaugauuaaacaaaggguuuaaaaaugaggucacuuaaggugggcucuaaaccaaaaaccaucugguauccucaugagaagaaauuuggacaauuaaagacacccauggauguagaaaggaaagacaauguagggauagcaagacagcagucaucuacaagccaaggagagaccucaggaguuguugaaaccgcucagacuaugggaauaauaaaugucugucucuacaucacagacuaugggaaggauaaaugucugucguuacgucaucugcucuagaguuuuauucuagcggccccgacggacucguacagugaggcaauggcuacacacuuggcacuuuucuaaacaugacacaccuguguuacgauacagcaaagcuggaaggcaagauagcucagccaaaacaaagaaaaaccaaaaaaaaaaaaucccaaaaaugcuugcucuuaagccuggugaccuaaggucgaucccucagacucacagggugaaaaaaagaauaucaacugcagugaacuccaugagcacauaaacacacacacacagaaagacagagagagagagagagagagagagagacagacagagagacagacagaaagagagguaauuuuaaaauguuaaagauaccuuaaagcagccaugcacagugaucugucuuuaaucccagcacucaccugaauaacauauauauucuauacagacauuugaguagcaauagcagucagaaaaaaccucaaaguauaagcacacauggggaggggggauguuuguuuguuuguuuguuuguuuguuuguuuuugagcccugguuggccugaagcucacuaccaagcuggcuucagauggaaaacaauuuucagucgucacauauugauugcacaugucugcagguuuccuguguguaugugugggugugcacguggaggacaacguuguagagucaguucucucccucgacuucucugccaacuccagggaaucgaaggcaggucgcuaggcuugugcaacaauuaauugcauuuaccugcucaaccaucuugcuugcccagaggcugcgugcuaagcuaagagaaugcauuucucugccuaacugcugugccuagguugaugaccacgccacaggguggugugauuggaggauaccacaggccuucaggaauagacuguacugggggaccuuaaguuauuggggacauacuccuggcauggauuauaguacaacccccuuccugcuccuuuugcuucccagcaggagauuagcaucucgucccauuacaugcucugguccuggcuauuuggcacacccaccuaccugagaccaaagcaguggacggcccaggcuuggacugaggccucuaaagcaguaagccaagaugauugguuucuuucucuuggucauuuaacauccuuagguauuucuucacugugucagaaagucacucagacacuugcuguacugaccccuacaccauccucacaaagaacgugacuaaacggaguggugaacggacuacauaaaaccauagccaucuguacuuggcacuucuagaauuagcuagcugacaggaagcaauggcuuuugucaacaucauuuccauccacucuucuuucccaguccuagccuuccaggaacgcagcagcacuaacacacuagagauccacaugacaccuuguggcgacauucguuuauaaagccauuaaccuugcuccucauacccaaaugccucugaggcgagauaguauuggauacaauguccccucacgaaccuuuuauccaauuacgauuaaaacuucaaauccagaaaaaugacuuuuaguaucagauuaaggaaaaccucugagguaauuuauaaauaggcauaaugacauuuuaagcaccuguccaaggcucaggugucugcaugagcuaauccucugugcuucuaaggcccaaaggagugacacugaugagucagccuucagaggaugcucauuuuacagacagaaauggauuccacagauauauggagauguaucuaaaugaaggccgucugcaugccugugugcauaugugcgugggugcgugugcgcaugcgcgugugugcgugagugugugcgugugcgguuaagagaaaguagaagcagaguacagugacaugcaccuguaaucucagcacuuaggaagcugaggcaggaggauugccuggacuauuucaacaccagcaggagugaaucuaaaugaguucccaggguggcacaccuaaagacuuuccccggaguucaaagcuuaguucacguuagugcucuauaguuuucaaaacaucaacgagacaggacggagcuugaggaaacaccacacaacauuauuguaucugaaacacacagugugugcuguguguggggaggaggcgcuccugggucuacaggacauuucuaggaauccuuguucacuuauggauaggucaggaugguauugcaggccuccaggcaagauaccagccagcaguagacacccgagggccagcugcacacucugaaagggaucuagcuuuguuaacaccuaugcaacagaagggaguguggccaagacucacaaaacuggggcccucacagacauggugcaugcaccuguaagaccagcauugccaggaaacgacaugaagacuaccgggaguuugaggcaauccugggcuacauagagagacucuaacaaaaauaaagcaaaacagauugacauacugaaccaaaggaauggagcugucaugaacucucccuucaccagguccccauucccuggcucuguucucuaucaaggaggcgguaagagagacaucagaugucaggugcuaacaacugaaaccaagagacacagaaggaagaauaacaauaggguggcaggcaggucuuccuaaaacauacaagauuauaucacauguuaaauuggaaaaggaggcaaaaaucauaaaauauuucuucugaguagggaaaccaccuuuaucugaaaagcaagugugugugugugugugugggggggggugucuuuguuuacuaggagcuagggcaggccuucgcgugccuacucuccagaucaaguuguuauuccucaaacgaggaagaaggaucacuuuugauuccagcguagaugaucuguaagggaacagacucacugggagagugguaauuauucaggucaccuuugguuuuuccauaucccaaagguacucagcauuaggaaggggaaagcucagauucaauaaaacaaguaucaauaaaagcaccauuagcgaaauguauucuccacaaugcagcaaauucagccauuaaauaauugaguuaccaguccuccacuuauguuaucccugagggauagcauggagguauagaaaaguggauucuugugaaauugagaacuagacacucuagacaacucugcuuuaaccagugcccuuagggauggaaggggugagugacaagcucagaccauguaacggggacucauucccugcaugcagccucuuacugcucucugaugaacgugacacucacugguucaccuggcuaauacuuucagaguggaugaguuccacaggaacaaguaccaaccacaaagcagggagggacaaauaccagugcaaauucccucaggucagggugcgcaaaugcuguaauaccuacaugaagacaauaacugaaaacaaggacagagcaccacuguucuuucacucacacaaaugugaccggaaagauugaaaugucguuuuuuguuacauagacuccgcaaaccacagaaacacccagacaucccugccuugugaaggaaacacccaaauauacugagaucugaggcagugcugggcgacuugugugagguuccuuagacauuuuguuuagcaacggguuauaguagcauccacaguaauaggauguuuaucuguuugaggaacaguaguaaaagaugcucagagagaaagccaagcaguuuuaaucagaagauaaauugacgaauccccggaagaggaugcggagacugacucugaaagggaagggaauugcagugauuuuuuuuuuucacugcacauaaacauuugcauucaaacucuaaacauguauggccugaagaugucccuggggcuggcuggcaaugugucuaaguggguaaaagaguucaccaugcaagccugaggacccuaagauuuaccucuggaagccaugagaaagaaagguagacauggugguggccauuggugaucccagcauuccuaaagaugcaaugagaggcagaggcagaagaugcacccagauggaugugggccaaguagccuggaggaugcaguacaguagccaaagccucaaauaagagcugacucaaaaaaacugucuucuaaaaaaaaaaaaaaaaaaaaaaaaaaaaaaagcuggguguggugguacacaccuuuaaucccaacacuugggaggcagaggcaggaggauuucugaguucgaggccagccuggucuacagagugaguuccaggacagccagggcuauauagagaaauccugucucgaaaaaccaaaaaaacccaaaccaaaccaaacaaaacaaaaaaagucucuaagaaggagagagugagggcagaaagcacccauguguuaggagcggguguggcggcagucccaaaggcgccagggacuguagcuaagucguaugacuugcaccugacuuccucauauaagccacaaacaucuugagagcugcacaggugcaccaggauaccggugaauccaguuugauggaaauaugccccugcugcccugauuagcugaagcugugugccuggugaggcggcguggccugcuguguguggaugagaguauaaaaggagugagaggcccaggguucgggggagauauaaacaagaagaaucaggacugaauaaacugcuguuagaaggacugguggucgugucguucuugcuggucgagagcggacgugacacccauggggaaaaaaagauuccaauauaucugaauuauugauauauauuuuguuuuucgaggcaggguuucucugugcaguccuggcuguccuggaacucacucuguagaccaggcuggccuuaaacucagaaauccaccugccuuuaccucccaaguguggggauugcagacaugcaccaccacugcccggccuuauugauauuucuuaauuucagaaaaagcaagcaaguuauaaugggaaaauguucacuucugucugucuaaaacuguugucagcgacuucuugaguuguuaaagucugcaggagcuagaauuaccuaggagacaagccuccaggcaccccuagaaagauuuuucuagauuaggucagccuaaucuaggccgcugaccuuuccuagaaggguuaucuucaguagguuaagugagaugcaagacccacccucaaaguagacgccauucccugugcugaauccuggucugcaauaaaagagcuaauugaacauuguguucauugcucccugcuuccugacugcagacgcuaugugaguauccacggcaagcucacauaaccugucugcuguggggggaccugucuguuguggggggacuguaccuugaacuguaagccagaggaaaccuugucuuaaacugcucgucagaguauuuuagcacaacagugaaaucgacuauagaaaauuaguaucagaagugcccugggacuuacuauguagccuaggcuggccuugaacuuugaagcaauccuucugccucagccuccgaaauucuggcauuauaggcagguauaaauuaccauaaccacagaucauuucucuucugccuuugguggugcugggagucaaucccagagccccgagcaugcuauacaaauauucuaucacugagcuacgcccauagccucauaaguagcaccugcugcuuuaaaguaaccguuuggcaagaaggcugcuugaaucagaggguaaguaaaaacacuugcugugggagcaagaggaugggaauuugacuccccaggacccacgugaaaggcaggcucagcugugaggucagguaaccccggcaucggaggugaggaucagagacagaugcccugucuccagacagagcuggcugcugaaaaccaugagcuucugcuguugugaggggauccagucucuaaaaacaaggugugaggagggggcaaggcgcucucaccuggccuccacaugcaugcaugugcuugcgcacguguauauaauuuuccuaaaggcgucuaacaggggucaaggccccugucgugaagccugaugacccacguuuaaucacuagaacuccuaaggcagaagcaacucccauaaguugucuucugacuuuuacauauauacacacacacacacacacacacacacacacacuccacaggcuuaacacuaauaucaauaugaaaaaaaugcugaugaagaauuuaacaugaggauuccaccugcauuaacacagccaggcugggaauucugauagccaggcagauaagagcaaaagcaaguuggggaggacaggguuuauucggcuuacacuuacacauugcuguugaucaccaaagaaagucaggacuggaacucaagcaggucagaaaacaggagcugaugcagaggccauggagggauguuccuuauuggcuugcucagcuuucuuucuuucuuuuuuuuuuuuuuuuuuuuuuuucuuucgagacaggguuucucuguauagcccuggcuguccuggaacucacuuuguagaccaggcuggccuccaacucagaaauccuccugccuuugccucccgagugcugggauuaaaagcgugcgccacuacgcccggcuucagcuugcuuucuuauagaaccuaggacuacaguccagggguggcaucaccuacaaugggcccucccccccugaucacuaauugagaaaaugccuuacagcuggaucucauggaggcauuuccucaagugaggcuccuuucucugugauaacuccagccugugucaaguugacacacaaaaccagucaguacaguggccucuacaguccucucagaggauggcuaccguucccagcaguugggcuuuucucggggucuucugaaggaagucuguuccucuccacucucucaguucucggcauucggugugugcccaggcuucccggaccagccaugguuaacugccugagucugcucagggaagccaugcaaugcagucacagguggggacaggauggcuuuucauagaagcugguguuuagccaugugcugaaaugucugagaaaccacgucuggggaaaagaagacagcaaacagcaagccuccacgagacaagucacagaugacaagggacaccaugcuuuccaggaugucaugggaugagugccuggccccgaucccaaauaucuagccuacacauuguacgaaaaucacucauggacuugcaauacugcacaguggaaaagacuugaagucaaacauuggguuucauacaauagaaggugaaaacugacuugugugugcaccacacacacacacacacacacacacacacacuaaauaauuaaaaauaagaacagucggagucaggguggguggcaagauggcuugccccugguuccucucaccaaaucugauaaccugaguucaagccccagaaccaacaugguagaaagagagccaauucuugccaaguuguccccugaccacuacaagcacacucagaccucugaacacucacagauaagugaguaugugaacacacauccacacacacucacagcaaagaaauuaaaauauagcagauuuaaaaaaaacaaacaaacaaacaaaaaaaaaaacaagacaaaacaccucacucagacugucuuuuuucugccacauuucaaagaucucaaauuguccacaaaauccuccacaaaccagugguuuggcucccuuuuaaccagccccaguguuuucugucuggguuuguauucaggcuuugcuacuacaacccaauguugucaucuauaaaauucacucuugagaaacaugaaaucaagucacacacacacacaaaucccucaugacguuuuaaguaagcuugugaucucgcgcugagucacauucucagcuaugcugggccacgaagcaaagugaucagcagaugaagcucaaaggaaaccucuggugucacacuuucuccaggcugcuucuauaugugccccacauggggacagugcagugguuaauagucaauuuagaauacuaauaaccuagcuuugagucccuagaagaguaccuagcccacagacauugccauaacuacugacaaugaggaugaaguuuagggaagcuguggugguuugaauaugcuuggcccaugggaaguggcacuauuuggagguguggucuuauuaaaauagguauagccuuguuagaguggguguggccuuguugguggaagugugucacuguggagaugggcuuuaaguucuauacucaaacucugcacaguguagaagagagccucuucauggcugucugaggaagacaaaguuuccuccuguuugucuucgaaucaagauauagaacucucagcuccuucuccagcaccacgucugccugcacaccaccaugcuuccuaccaugaugauaauagacuagacuucuaaaacuguaagccagccccauuuaaauguucucauuaauaagaguugccuuggucaaagauagacacuggcaauugucuagaaucuacaggacccugacuuccaacccuaacaccacagggaagugaucagacaucaaguguuggcucuggauggucucgguucugcuaaaaacccauuucauuucuuacaguacuaugcauaaaaccugggccuugcacacuauggauaaaaagugcuacaaacacugggcuucguccccuaggccuuauggugacauaucugauuccagcuuccucagguguuagugcuacccuugaacucagggagaugcuccacccgaacucugagcagcucccaucucuugcaaaauucuuagguaaucaccaagcagccucuucuucgucuuauguuuuacuuauuuaucuucuacuggcugccuucucaaguccccuguugggaagaaucagaaguagaaaaccugaauaaauggucucugaaguaccugagccacagugacuucaaugggaugaaaaauaaaaauaauucauuggacagcuguagagauggcucaggcaguaaaguuccagaauuugauccccagagcccaugaagagagccaggccacgguggcaugagcguggucucuuagugcuagagaggcagaucccuguagaugcuguucaaacagccaagccuuuuggaaacgcuucggccauugagagauucugucucaaaaauccaaaguagauggccccugaguaaugacgcagagcuuguccucuggcuuccuccugcacacacgcaccuguacacacaaacuuacacacacagacacaccagccacugucuggcucaacucagaaaugaacauggagaggacaaaggguucuccucgggaauuugauuuggguccacgccagcugucugguggggauuauuugaaagucucacacucagucggggaaauacuucaucugugagacuauguaugcauuucuaacuuuauauggugccuguggugauauauaaagaucaguucuucccaccaacuucaaagcagcuccuggcuugaugcagcacuguggggguauaggagaaacggguuccauguguucagaggaucuuauccagcgaggcaaugcccagugcuuucaucugugccuuaucuauauuacacagaagagccaaguuacuacauggaauauacccuuuaaaacuacauuuauauauguauauaucuguguguguguguauguuuuaaguguguguguguguguguauguuuuaaguguguguguauguuuuaaguguguguguguauguauguuuuaaguguguguguauguuuuaaguguguguguguauguauguuuuaaguguguguguauguuuuaaguguguauguauguuuuaaguguguguguguguguauguuuuaaguguguauguauguuuuaaguguguauguauguuuuaaguguguguguauguguauguuuuaaguguguauguauguuuuaaguguguauguauguuuuaaguguguguguguauguuuuaaguguguguguauguuuuaaguguguguguguguguauguuuuaaguguguauguauguuuuaaguguguguguaugugcguguguguagaguguauagggcagagaggacaacuuucaggaaccacuucuuuccuucuaucgugcaaguccugaaaacaacucagacugcaagccucaacggcaaucaccuguaccugcugaguaucucaauggcuccucuauauccugaauugaauggcaaauggccccagcacuacugccccaugaacaaacauggaagcaacacuuuggcuaaagaugcagcagcccauugucccuucuuccccacugcacucaagagcuagaugugacuucccugaucacagcugagggaaggagauauauguacaugccaggagaucugugcgugugacacaggcaucuuuggaaugaugcuaaacugucgcuuucauuuuuaguuggaucagguguuggacccucacuuuuauaaagcaagcaucuuucuaaugagaauucauacuuaacaucaucacucaagaaugagggucugggcggugguggcacgcaccuuuaaucccagcacuugggagacagaggcaggcagauuucugaguucaaggccagccuggucuacagaguaaguuccaggacagccagggcuacacagagaaacccugucucgaaaaaccaaaaaaaaaaaaaaaaaaaaaaaaaaaaaaaaaaaaaagaaugacgaacaaugauuuaaaaaccaaaaaaacuccaagagaagaccauugaagagagugugaugcuaacaccggaguacaagggcuacccagacugcauguuaaacaucuccugagaccagcugacuguaucguuggcauuaugcacugugagucaguacaguacgacaggguuuucuguugacagcaugugacaacccaguucacugcaagugcagucuacccuccagcucccaauguccugccaaagccagucuggccugcaaggacggcuuaccaucuucaacagugacuucuuccucuugcccauccuggcuuuccucuuggacguggacaucuucuuguucagcuacaccauugacggcagacagcugaccauucuucugugggagcuggggggaggagggagacaaagccacguaaacaugagaucagucacauacuguccccaccccaccccagugcaaguuaaaaguaaugccuugacuuccgguguauaaacuaugaaauggcggggggcggggcggcggggaaccugaagaugaaaguucuagaagauucaguaaccauauagaauaccugauguucugucaccaaaagauugacccuugcaugugcagugugugcacaaguccaugcacucauuccucuguccauuagcuauuuaagagccuguuucagaaacugcaaugcagcacuugggugagucucagcccugagcuuacauccuagcauagcacagaagcuaaacuuaccuugucccuuccaucuuauucuugugaugcugggggcuggagauccaggaccuugauacgcuagggaagaaaucuaucaucugugguccuagaaguguguguguguguguguguguguguuacuauaaaauaguaauucaacgacucuggcuuuuaauaggccacacccacucuuggauguauuccuugagcaucucuuccuacuaacagcuauuccuaaaucuguuaaaaaugccuuuuaguaaggcccaacccuugggcuggaaaguuggcucuguagaacacauagcucuugcugccaagucggacggccugaguuugaucucugguagaaggagacucaauuccccacaaacuauccuuugaccuccaugugugcaccacagcacucaugcauacacaugugccagcacacaccaauaaauguuaaaauuuaaaagaaggaagggauggagaugacuuagggcuaagaacacuggcugcucuuacagaggcccauguuugcuucgcagcaaccacaugggugggggacaaacagccauccagaaugugugcccuccuccaggaggguacaaggcacacacggugcacauaaauacaugcaggcagaacauucacuuaccuaaaggaaggacauuuauuuuaaaaauuauaagauccaacucagcuucuuaaaaacauuuaaaacuaaacaaguaaaaccacauuucuuuguggccagauacagguuaggaaaaauaacugagcuuuauaaguaagguguccuuaaguuagagcuucaaacuuguauguagauggguguuuugccccgcaucuauguauauguacaugucugugccauguauacauagagugcccaagaaggacaaaagaggacaucagauccccuggaacuggaggcagagaugggugcugggaaucaaaccuggguccucuggaagaacagccagugcacgcuuuuaauaucucuccauccuucaaaucugcugaucaaacacaguuacugaguggcaguuauaaagagugccacgaacugacugcucuucagagguccugaguucaauucccagcaaccacaugguggcucaugaccaucuguaauagaaucugaugcccucuucuggugugccugagggcagcuacuccacucauauacauaaaauaaauaaugaauaauuuaaaaaaaaaagcaccaugaagcaauuaugcaaagcaagugguagcaguagauagcuccaggcugugguugggguguccagggcuuuaucaaggagguagauagagcugaggguucuccuagaaaggacugugugagaacagaggacacagcgacgggagagggucaguccauaaagaacuugccuuagguuaacuaagaccugaauuuguuuggauccccagacccuaugugaaaguguggugacaugugucuguaaacccagagaugucaagaggggaaauggagacacagagauucuuggagcucaugggccagcuagccuggucacuuggugacauucgaggacaaugagaggccuugacucagacagaaggugaaaggugacugacugaggcuguuccacauauccgccaugcgcaugugcaugugcacacacacacagaaaagaaagagagaagaggggcuagucacaaacucagcuaaccccaugcugucacugcucauggggcaguggauagcuccagacaaagagguacugcucuuucuggaaaguucuguggccuuuagacuaguguacggaucucaccgugcaauucucuauucccagcaaagcccuucccccucuugcauuuccucugaaguagcaccacacacggacacugcagacagagcagucagcuucaaaaugcccaugcugaguccaguuauuagacgagaugcucggauuacaguucugcuucaaggguucacuuaccaaaauaugaaagaugggaauuuuaaaugaaacaaaguuagaggagagauggugucucaucaggaaaaaaaaaaaaaacaaaaacgccagcacauuuuaaacugaauagugcagggcugggccgggguuggaucggauugaguuagcagucugaagggcagggggauggggagaccgaaucacauguuaugaugaaugugugguaauugaaagaaucuuuggcucuguuuugaugugcuaguggugaugguacaaaucuguaaucuaggguacuugggagugggggaugaggcaggagaauuggggguucaaaaccagccuaggcuccaugagacauugcaagcaccaaaagaaauuagacagagaucucaggaaggaugcagugaaagauguaucugugaacacacacacacacacacacacacacacacacgaauccauggaggcuggguuuacuagggcauaucuuccccaaaugcucuccaguuuaguaaggucuuguacuaaacccaggucaccugucuuugcuguccacgcgugcuuaauaaaacccacuuuuaaugcuguaaacaauagguuaauuguaaacucuaaacaaacaacgguucucaucuucuucuucuucuuccuccuucuuuaauauuuuggcuuguuuuuguuuuuauguagcccuggcuggccuggaaugcuccaauagauagaccaggcuggccucaaacgcaagagauccaucuaccugcccaaguacuagaauuaaagacauagaccgcuaugccuagcucauacauuuauuuauuagcaugugccuuaacuuuuucucaaaaucacacguaugugucuggguauaauauauguuugaguguaggugccuucaggucccccgaggcuucagauccccugaugcuggaguuccaggugguucugagcagcccccugcaugggugcuugaagccaaacuuggcuccuuugcaaaagcaguguauucacuuagccacucaacuaccccuccaaaaccaauaccagcaugugcuuuuuuuccccccacaaccacaaaacuggagcaucugcacugguccccguacugagaagagcuccucacuaacucuuccuauccaucauccuuagccgggaucuccuuuccugggacucucacaggaccucugaagacaggauuuacacuccgcucagggcaggaugagaugugaauggacccagaugacgucagcugguguccaguucagggagaaagguaauuuugaaauucaagguuuucaagaaagaaggugauccagcuauuuuucucucuggagcuuucucacucagcuuuacccacacaucuuggacuuaaguauuagggauacauuuauuucuuuugagacaaaaaauggaauagagagacacagcccucaccccauaagcacagugaguaccagaaacccaaucuccccacuggauuugcgauucaaaaugugaagacgccuccucugacuaaaucaaaacccuaaguguuuuggagcucauauccucugggcaggucagccagaguuuaucccaguaaaguauuaccauguuacaacaaagcaacacuaaaauaaucaaaccucucaaauguuuccaacaacagccuuccucuaggaacacccggggauauucaaggcaguuguaagacaucugagagugaggaccgggcaucucucucuucccuucguucauuauaaaacugucuagagcuugcccugaauucucuguguggaauaugaauuucuuaaacaaugaacaaaauccaugauguccugccaucuuucaggauggugaggauggaggagaggcugguagaagagccacuuccucugcaggagccaucuuccuaucuuacguucuucccgauuggcccacacagcuggggaugacccagcaucuggaacauauagaggaggcagcuccaacuccuguaacuugcccuaccuaugauaccagaaaucauguguacaaauaaucagaaugggugugggggggggggggggacugggaucagccaggcuugguggcacacaccuuuaaucccagcguucagaaggcaaaggcaggaggaucucugauuuggaagccagccugaucuagagugaacacagagucaguuuaagaucaaccagagcuacacaagagaaacugugccucagaggaaaagauuaucucaaccauuauauuauaguugagucugaagugccaauauuuauugucuucaucauccuuagcauauuaauguccucaaucaagccauucaccaaaauaccaaccaaggcugggauauaggcccauggacaaagcaaucucuuauaggacagucccauguuugaucaucagcaacacaugcaccccuagaauaccaccugacacauguuaagauccuaauaagucaacuauaaaauucuugauacguuauguguugucaacaaauggggucuccugacaauuccuugucaagcguauguucugugggcagagcacuccggggacucgugcauguguuauucaugcuuuggauccaaggaggaaucuggcgacuggggagaaaccacagucucuuucuuuuuuuuuuuuuuuuuuuuuuuuuuugcuggucugggaaagaaagcaaggaagagccacagagguugauguuaaggaggagaauggccugaaguuuuguuucuaucacuugguuguuugggggagggggacauaugacuuauccauuguucuauaaaauagcaugaccagaaacaacuugaggaagaguuaauuuugccauaugguuccuuccacaugguuucaagcagcaggcaagaagcuaaggguucccaucuuugaccucaagcguuaagagaaagaucucuggaaguaaggcugucuccucucgaguccccuccuagugaugcacuucuuccugcaaggccacaacuccuaaaccuacccaaaaugcuaacaacuggagaccaagcauugagaugccgcagccagccaaugggggacauuucacauucaaaccacugcaggagguuuucaaucagacugcaugggguaaguaguacugaggucaagcucucauccccccaggcucugaaaccucaccucagcucauuuucccaauuauaaaccaagaccuaauacacuuuucuguuuuuagacugucuggaauuccaacgaauaguaucugggacauucucuaagucauaaaagcacacacugagccgggcuguaguggugcacgccuucagucccagcacuuggguggcagaggcagguggauuucugaguuggaggccagccuggucuacagagugaguuccaggacagccagagcuauacagagaaacccugucucgaaaaaccaaaagaaaaaaaaaaaaaaaaaaaaaaaaaaagcacacacaggagacccuuuauguccugguccaguccauuuguuuaaaugaggacauaugcucuaggccagucuuuucuggcucuuguaucacacugaggccaucauuucugaauuguccucuuguauugacaaaacaacauuagcaaauaaacugacauauuuaagauguuacugucaaauauucugccagaacaaugaaaaaaacuagagugccuuuagauuuuccagaguuggaagaaauguuuucuuuagggaauugucucagcauuuuggcgacaaugaaaccuggcucucugguagcauuggccacccuagcacuggggagacagaggcaggaggauuaaaguuugaggccaagcugagcuaguauagcaagaauuucuuuaaaaaaaaauaauaauaauugggggcugaaaagauagcuuagugagugguuaaguuguucuugcagaggaccgaguuugauuacuagcacccacauggcagcucacaaccauccauaacugcaguuccaagcgauucaacgaucccuucaucucugcagucaccagucgugcacaugauuuacauagacauauauacacaagcaagcaaaacacucauacaaauaaacuuuuuaagucuaagaagcuuucuagcuaguuaaucagaugucaauacaggggauuggaaagacucagauuaagaacucuuccagacccuaguuugguucucagcaccuucuuuaggcaccucauuauaucuccagcucuaaaggaucugacuuauaacuucuaugggcuucauacacauguggcacguacacgugcgcacacauacuuacauacauacauacauacacacacacacacacacaaaucuuagaaaacaauccuucaguauagauaagaaauuuucaauuuuuuuucuaguuuaaacagaagaggggcuggagagauggcuucugcuuuucugaaggcccugaguucaauccccagcaaccacauggugcuucacaaccauguguagugggaucugaugcucucuucuggugugucugaagacacaguguacucauauacauaaaauaaauaaacuugggggggagagauggagagagagagagggaagagagcagaagaacuaaggagauagcugaguugguggugguguuggggaggcacaguagguggauuucugcaguuagucauaccuaacuggugaguuccaugccaaggagagagagggagggagggagggagggacaaugccucaaagcaaaaagagcauguacuacacacacacacacacacacacacacacuaguguagcuuauugggcaauggcacuugacacuaagcgagccaagaauaagacuuaaaaugcaaagaagcaauuuaaaaauauagugcagcgagugaucaagcccuugguuaugguacaauuuuauguauuuaucuauuuauuuauuuauuuauuuauuuauuuauuuauuuauuuauuuagaggcaggguuucucuguguaguccuggcuguccucgaacucguggugcaauucuuaaaguaagagacauguauuucucuucaguacauuuaaagaaaacuaaccuucaggcaaucagaaaggccaugaggagcgcuccuaacuagcaagagcuuucaaagacaauaaacggacugcuuauuagguuucaggggauuacggcgcugcugagccaaaagcucucuccaaccacaugaaacugagaagaauccaucaggagacuccagugaccuccagagagaucugggaaguccuuaucucaggcaacugagauaaaacagucacuccagagcauggaguggccccaccacacacacacucagcaggauacagaagauaccuccacugagcuuucuauagaaucagguuguuuccuuccccucccauacagcagaaccagaagcaacagaaagccuccuuagugacuggcuuuaauuugaaguucagaagacaggauacuuacauugcacaggaacauccuggucugcaacccucccauuucagagccuccaguucuaggaucucacuuagaaccagugguacuguccgccaucacccaaagaccagaguacaagcguacacaaaucgccacuuagcccuuuaaaugcuugauuggcauaggaaaaacagauguaaauuuaaucucagugugaaauucugauuuucagggagcugcagagauggcucagcaguuaagacuaccugugcuuuuuuuucaaaggacuagucuagucccagccccuaguugggugacucacaaucacuuagcacucccagucucaaaggauuugcucuccauuggcacccacacauguugguacacacaccaccaccaccaccaccaccaccaccaccaccaccaccacacaaugaaaaaaaaaaaaacaaaacuuucugaaaaugaaaauucuaaaaaaaaaaaaaaaguguaucaaaagauggccuagucggccaucacuggaaagagaggcccauuggacuugcaaacuuuauaugccccaguacaggggaauaccagggccaaaaagggggagugggugggcaggggaguggggguggguggauaugggggacuucugguauagcauuggaaauguaaaugaguuaaauaccuaauaaaaaauggaaaaaaaaaaaagugaaaauucagauuuucauagaagaaagaaacuucuccgaugcuuuugaccagagucacauuuauuaucugaggaaggaucugggaugcuaucugcccagaauacaagcuccggccagucagugccccuugaugcagcuaccuucuuuggcaagucucuauggcaacucucuauggaugcucgaccuucguguucuuguaauuuuaaguaaaauucaugagaaucucuuaacauaauuucaggaggaagaccucagcuuuaucuuuaucaugagaaaaaguguuccaagacagccacugaaaugaccaguucgcuuuuagugggcacaauucgcuuucucuucagccaaacacuucaaauauuccaacuuuugaaaguccuagagaguaauuaacauaauauuguucaugcaaacagacccugagguggacucaucuaauuaggagcauugucuacaaauuagaccucuuaaaaaccagcccuuuuucaaaccaggaucgggaucuaaaaccaucaucggcacagcgggcacccgccuaaaaaggcucugcacuccgcugugcuuggaaaagugagcuuucucggaauugagcuuguuuacuuaaauuuaaaaggacccuuaaugugcauucugagccucuguggagaaaaaucacuguagcauuuucugagaggauuuauccaaagcaccccugugaguuacagcuaguagccccgucccuaaguaagagaccgcgaacacacuccagugugucaacacacggcucagucaaguaucccccaaccccaccccauacacacacacuuuaaaugauagaaauguuuuuaaaaauauuaaaacuucuggguucucugggaaaguauguaaaagaaaacacagaguucuaaaucugguuagggggagaucaaccauacugacuucaggcaaagggaauuuauaagaccucugcuugagacaagggacauaaaaacuaccaucuagcagcaacagcaacccacugagaagaccguccuuagggcagcuucucccuugcaauguuuggaaaacccauagccucagucaggguuaugcagacgcucagguaacacaacaguaaaaaggugugugaaucuaaaacugcaucccugaugcuucuagcaucuuccucugcauggacguuguuaggauacaggcgauccuaccagccugcucucagggucguagcagucaucaccugcugcuuccaaggggugugcugaggauaaaaagccccccccauuccccucucugccuccucucucgggcuucuccugugcccucucucuuugccuucaccucugccucccuccccccaccacugcccucugccugcugucuguggauuauuaguauggaagcucucagccacugcuccaguggcaugcuugccugccugccugccugccugccugcugucaugcuccccacuauauuggucaugggcucacccucugaaacuguaaucaaucccccaauuaaaugcuuucuauugcaugucgccaugaccauggugucucuucacagcagaacaggaaguaagacauagcuagagcuuugaccucuacugugaggucaagggugaguucagagcugcagagcauacauacaagcuauccaggacaaaucacgggccaucauccgucguccuaaacacaaaggcagcaaaguaguacucuaaagugacagaaaaaugaaaauggcagcugugagcuaaugcaggaguaugcaccuguaauccuagcacccaggacagcgaggcagguggauugcugagaucaaagcaaacaaaauauacagugaauucauggcuaguauggauauacaugaugagacucuaccaauaauauaaaaucggguggcagagugguuuagcucacaccaagccugauaacugauaaguucgguuuucaagaucaacaaugugggaggagaaaaccaaugccaaaaaguuguccucugauuucaacaauguauguuguggcaucugugcucgacuccaaacacacgcaaaguagguaaaauauaagcaucaaauagucucaagacacaaauuaggaugcagaaacauuucacacaauucugguaaccugcauccuggguuucuuuuaaacccuguacccaggaguuccuaacaggauguauuuggagcagacgucaguauaaggaccuaaauccucacuuaacugcuacgugcaccacauagccaaggacuucagccauggcuuuucccaaaggaaucugccauuucagaguaaaauaauuacauuauguugcugccuaguaaauuugauuauaaaauuuguuuugagccgggcgugguggcucucgccuuuaaucccagcacucgguagucugaggcagguagauuucugaguucgaagccagccuggucuacagagugaguuccaggacagccagggcuauacagagaaacccugucuugaaaaaaaaaacaaaaaaacaaaaugaacaaaaaaauuguuuugaaauucacugugugccguggaaaaccuacagccaugggaugacauaaaauuucaaccaggagaaaaaaacaaaacaaaacccacacacacccaaaagccaguggcauccccagugaaguguuuugguuuuuuuuuuaagauuuauuuauuuauuuuaugugugugagcacgcuguccuugacacaccagaagaaggcaucagaucuaacuacagaugguugugagccaccaugugguugcuagaaauugaacucaugaccuucugaagaacagucagugcucuuaacuguugagccaucucuccagaaccugaaguuuaaauuuuaaauuuugaaaaaaaaacaaaaaguuuuggagacagggucucauuacguaacccaggcuggcuucgaacucacaaagaucuaccuaccucugucucucaaaugccgggauugaaguugugcaccaucaagucaauggugaucccugccuuuaaucccagcaccagggaggcagaggcagaggcagagggauuucuauaaauucaaggucagccuggucuacagagugaguuucaggacagccagggcuacacagagaaacccugucucgaaaaccaaagcaaaccaaauaaacaaaaacagaugugcccccaccaugaccaaccaaaguaugagaaacugucaaugccaaugcaguuucucaucaaaggcauguccccaaaucaaggguggugccauauacuugucauccagcacugagaggacuguucaaggcaaucauuuauggccguaauucucaaccuuucuagugcugcaacccucuaauacaguuccucaugugauguugacuccccaaccauaaaauuacuuucaacuguaauuuuccuacuguuaugaaucauaaucuaaauaccugguauuuccaaugguccuaggcuaccccugugcaaagguuguucaacacccaccagggguggagacccauggauugagaacugaugagguauuacacaagauccugucuaaaagagguaagacaucccuaacauagguaccaguaacuucaccaugugaacgugaucaagcuacauuguauguauggauggaauuuucaaagaauuacuaaaaauguuuauaguucuuaaaagauaaaaacgugcucauggagagauggagaguguggaauucacagaguuccaacuuuacaggaucccccuuaacaucagggcagaaggcagagcuggccaggaggaacacacugaggucuccauacuaaaguuuucccuacucugcaaaaggcagcaggcaccagcauuucuuggcgguucuucgucaugccggugguugggauauacagaaaggggagcagacguuuacuacuaauuuagcucaauacuggcaacacguaaaaaacauaaaaaccauccacccuaagaaaauucaguggcuuugagacaucuucauagagggauugcugucuuuucuuuuuaacccacucagaauguauugaccaucccuuugcgcuuuucaauucucuucugugugccacguuucuguugagaaggaaauaacaagugaaaccgcuugucuuguuuuuugcagacugcaucuaaugcaaaagcauuccagcaguccaggagaaugugauuuucccaggagccgacaagugcuaugccaucauccgaugcacagaaccguucuagcacgaagaaaacagcaaauugcuaauucaccaagagccaugcaaggauugccaaaagcauccaugcuggguucuacaccacuucucaccugauuuaagcaucucugacuuuuauuccuuccaaagucugcuaaggaggaggcccacggccaggcggcucccugaagguaaguuagaaggcacagggaagaaugcuguggagcaagguggccagguggcccaaggacuucaaaaaaagguuccuuuugugggaaaagaagaaacaaagugucccacacaccaucacacagauucuuuaaugaagucauuauauauuuaggucugauaauggaccagagggaugccaucauggugaauauacuucaaugguuauuagcaaaauuaaaaugauaaauuggaauuggauccgcugacauauauucuuagguuuguacuucauagaauccaggccacugcaaaucaaaauaaaaguggucagcacccuaucuugcagccuucggcaccaucaagauuuacuagacuggccagugggagagaaggcuuuuauacaucaacccacuggcucuaaagauguugacagugguuccuucuauaaaucaucuaacacuguucucuguuaacacugcucccagauuuucuuggucaggaaaaucagaaugcagguguccccaaguuuauaggaggggccuaaaguaucugagaagagaagcagggggcuuaccugcuggaucgugggggcagagaugggggaggguuggaggcagguuacaaaacagacccacacaaaucuaggaaguuggagaucagcacugcacagaacaggaggccaaaauaacauuugacuuggugguuuuguuaaucuuuuaaguuuuguguguguguguguguguguguguguguguguguguguguguaugugugugugugagagagagagacagacagacagacagacagacagacagacagagacagagaaggagucagagagagacagacagagacagagagagauggagaggggaugggccaugaacacggaaagucaacaucaggagucuguucacuccuucuacugggagccacuaagccauccugccagccauuguuugguuuugcuauacaaaccagggugcugagauuguaggccugcuacaccaugccuugcugaagggcaccaguaaagaagcauauagggucuggagagaucacucaguaguuaaaagugcuugcugcucuuucagaggaccugaguuuggcucucagcauucacccugcggugcucacaaccaccuguaacuccagcucccgggcauccuauacccuuucuccuggcuuccauagguaccagggcaccuguaucuuacaaacaugcaaauauacauacauauacagaguuuuuaaaaguguugcucucuuuacuuuaaaaaauauauauauucucaggacgggcaggggugguccacaucuuuaauccuagcacucaggaggcagaggcagguggauaucugaguuggaggccagccuggucuggauuccaggacaacuagagauacacagaggaacccugucuugacacaaaacacacacacacacacacacacacacacacacacacacacacacacacauacacaccacacacacauacacacacacacacacaucccccccuucagaagauggucguacuguagaugggagucguggagccuuugcuuuuucuagacaaauacgggauuacagaaaguaacuugcucugaaucuacagcauauaauagaaacugggaaacuuuugguuuuccucaucacacagcucauacaacuccucuuucuccagacagcucauccaaaugacagacuagcauacuugggaaauauucuuguuuuuacauaaucccucacucuuucauuguuggaaaaucuuugacuucauggucucaccauauauaccaggcuggucuugaacucagaaagauccugaguaccacacuuggugagagcaauuuuccgagacaucugaagaagcaggugcaauaaaacaaauacaagaugcauuuuucucaucuugaacuugccugucacucuccuaagacaaacuccucuuucccuugagaauucuagguuugauaacuaggguuuugugaaagauacaugagaucaaacacaguguacccccaggcaaggccaaaaugacaaaccguuugaugggaaucacugucgagacaguaccugucugaguuucacuuuuguugccaugauaaaagacccuggcaaaaagcagccuaggggggaaggguuuauuucaguuaaagccaggucuuaguccaccacagaaacuacaaagaguaaaucacaccacauguaguuaugagcaagaucgaggcaugcuaaucccagcacuugggaggcagaggcagguggaucucugugaguuccaaugacacgagggcuacauaguauugcaugcucucaauuuugcucuuuuauagcucaggaacucuacuuagggaauguuucgacucccagugaguugggucuucccacaucaguuaagauuccaacagacuugcccacagcacaacccaccauagacagucuuugagacacucuuugagaaacuugcaaggggacccuggguuguguggacaacuaaagcuacccgucacaguauccgucuguaucauaaugagagaaguuuugauguuagaaagcaggcaagcuugcauggacaggcaaaguuuuaggauggaucaugaauuugauaacaucccccacucuguugauuccuggaccaugaucucuuucgcaccauucucgauaugguacagauaagacuugaguacauucuagaaacuugguacccgguguagccauguuccauagauggagcuuuggagaaguagacuagaaggagguagucagguuuuaggaguuacaccucaggaagugauucaugugugcuuccuugaaugaccagagcagaccuucccucaugcuugaccccacucugccuuuguuucuccaacacauugcaaaguagucugggggucuuugugaagaagucagcuccauguugcugggguucuccagcaaccagaauuaugaaccccguaaucaccuuuacccuaccccucauagucuuuagaaagaggucggguuuauugugugugcugcaaaggacacugggcagggcagcaacgagagugccacuaggcauuuuguuacaguaacagcaggcagacuaaagucucgggacuaacuuugcaacucaaaccaucauuuuccccaagccuccaacucuucaagucucugguuauuauuagacacaugauuuacugcucugcuggguccccacagccacacaaagcugaccuaaggagccaagcuguucaggcagaagucagcuugggaggugcaaagagaagaagcugaagggagauauuuggggccuacagccugccugaggauauggagauguaggaacuauuacagcuuuccuagguaacauccaacaauccacacacucuaaaagucuacagaccagccuggccaaagugagauggaugaagagaacugcaggaagcccagagggccggaaggacauucaugaguaaggaggcaugagggaagugccugggcuagcagaguggagcugagagacuuccuguucuccacugucaaacacuaagcccagaggggaaggggcacugggcaggcuggguucaaaucuagaccucacaaccuugcacaagccacgucccuagccaggcuguaccucagccuccuuucuguaaaaugggaauaaauguguccagacaacaaagaguuuauuagaggaaugcauggaguagugagggaaagaaagggaagcaaauccuggagaacaaacaaacaaacaaacaaacaaacaaacaacaaaggugagguagaaggaguguaaaaagcaaacgaaaaucagagacacugagugccuuagggucuccauugcugcgaacagacaccaugaccaaggcaacccucauaaggacagcauuuaacuggggcuggcuuacagguucagagguucagucuauuaucaucaaagcaggagccuggcagcauccaggcagggaugggacaggaggagcuaagaguucuacaucuucaucugaaggcugcugacagaacacuggcuuccaggcagcuagggugagggucuuaaagcccacgcccagugacacacccacuccaacagggccacaccuucuaaugguaccauucccuucgcugagcauauauacaaaccaucacacugggucucaacuucauagauggcccccaaggcaaggcuuacacuccuucaauaucagcuacagcagugguucucaaccuuccuaaagcugugacucuuuaauacauguccucauguuguggugaccccccucaacaguaauuauuuuuuugcuacuucauaacuguaauuuuguaaacaucuguauuucugauggauucuaacccuuucacaggggucugagacccacagguugagaaccccuggucuagacacaauggaccacacacaaauccuggguagagagcaucugcuccuaugugcaggcucagaauuccucccccgcagcaccauggacagcaaaggguaacaguggguugaguuaagauuuggggcuuagcguaggaagcuaauccucacacacagagaaugucuaugggaagauguuuucagauccucaacaaacugggagcaaauuuugggaacaaacaaaacaacaaacaaaccugguagcccagguugugcuggauuaaaugagaaauguccaccauagguucacgcacuuggacauuuuguguccaguggguagugccaucuaguggguagugcugucuggggagguccuggaaggugcccaucacucaauacaucacuuuggaagcuuauagucuugccccacuuccaguuugaucucucacuaagcgcuugugcggaggauaugaucucucggcucccugcuccagccacuggcugcugugccuacccugacuuuacggccucccacucugaaacuguaagcccaaauauucauaaguuaccuuggaucaugggauuuuaccccagcaacagaaaagugaccaauacaaagggccgacuuacaaacaggguaugccuucugagguugcaccuccucaccacccuaaggcauucucugauugguuuaauaaaucugauagucaauuagcugggcaggaaauggauggcaagacuuccugggagggagaaaggaacuccuggaaaacgaaagagaaagaccuuuugccaggagacaugggaagagacgugucuaugggccuggaagguauagcuaaccgugugucuggauggggcuagguaaucaggucaacuuagaugagcuacuuaagagucuaccuaguugccgggcagugguggcgcacgccuuugaucccagcacuugggaggcagaggcaggcggauuucugaguucgaggccagccugguccacaaagugaguucuaggacagccagagcuauacagaaaaacccugucucggaaaaaaaaaacaaaaaacaacaacaacaaaaaagagucugccuagcuggggcuggagagauggcuaaacaguuaagagcacugacugcccuucugaagguccugaguuuaaaucccagcaacuacaugguggcucacaaccauccguaaugagaccugacucccucuucuggugugucugaagauagcuacagugugcuuacauauaauaauaaauaaaucuuuagaaagagucugcccaucuaaggacuaugcuuugaaacaguaaaaagucucugugugauuauuuggcgaacuugcugguuaaggaauaacugcagccauaucaauuuccauuaauuaauauguacagaauguuaguaaucuuuacacauauggccagcaagauagcucaguggauaaggguguuugcagccaagccugagggcucuuguuuaauccucaggacccacaguaggagagaacucacucccacaagcugccuucugaccuccauggguauacaauaauacauagagcuugugugcacacacacaggggcuuccccuaacugccccuauaaauaaaaguaacugaaaauauugguaagacggggauggagagauaaacucaauuuuugugcauauuguauuuucagaggacccaauugcuggccccagcacccaugucaagcagcucucaaucccauauauaguucuagcuccacagcgaucugauauuuuuggcccccaagggcauuugaauuuaugugcacauaccuacacaggcacacacacacacacacacacacacacacacaaaagguguuuuuuuuuucuuuugguuuuucaagacaggguuuugguguauagcccuggcugaccuggaacucucuuuggagaucaggcugggcucaaacucacagauccauuuaucucucugccuucugagcugggaauaaaggugugugccaccacuuuccagcaguuaauaauaauaauuuuuuuuuaguuuaugcucugaccucucucuugcucccuugcucccccuccccauucccuugccccgccuccacacggucauggccggccuccacauaucuacucucuguucucugccuuucucucugccucugcuacucucuuaacuccccuccccaugcccuaaauaaacucuauucuauacuaaaaacaaaagcacgagagguuucuuguuucauuuggacaggguuccguaucccucaugcuggccuugaacuuguuauauaacugaaauaaccuugaacucuggauucuccugacuuuauuucccaaaugcugggauaauaagcgugcaacaacaccaugcacagcuugaaccaccaauuucaaaguagauaaugacauaggcaagagccaaguggccaauaaauauggcucauagccuaaaauuacuggcuggcauauggaauuauauuuauauacguuccauagccuaaggaaaugcugaaaccaagccaaugcuaaggcuucacccuucaccuaucaaggcaaucaaagcacgcgugacacuggaguucaugcuucaggacggaacccaggacggacccugaaaaucuuccaucuagccugcaucgaggcacacacaaguucagccacacacccuaggaaauggcagcauuaaagacucaguccauaccuucauuuccccaguauauagacccuucccacugagcagcgaggcccagcagcuuaggugaaggagcccucaggaggaaggaacagagacaaagccauuuccugcagaauggcaagcugcugucagugugcucgcucgcaaauacaaacgacagccugcuuagcuguaaagugcuuguuacauuacacaaaauauaaggaaugaguguucuacagaugcaagcaaagugagacuuuuccaagcugacuacagccuagagaaaccucaugcucaucaauggacgccagcauggguggggccggguauuaucuaauaaagaaagcauggguguuaaccauauuuauuuuucuggcagcagacugcuaaggacagaaggaugcugagauuagcaugggcccuaugcaggaaggacacagaaauuugcaaaguguuccacauuucuagauagagucuaugcuaaagagauacuggaagcugaagggguugagcguauucagaggccugacuuguuccuuguuuaacaaguaaauuuggaagagauuuacuguaugaaaaacugggacgguguaacucgaauuuuguauacaaaaguuguuuuccuauugcacgggugccuauaugcccauuuuagcauuuguaauagcaaaacaagggcauugcccuaaaugucgaugagcacauauauuaauaaaggauauuuauaucacuaaacaaguagccauuaaagcuuugagcuggauguuuguguauauguacauguauacacacacacacacacacauacacacacacacacacacacgcuugacagaaauaggaaagagaaggggaauaggagaugguggucugacuagcuuuggcccccauacacucauguguucgaaugagguguaaccuuguuggaaaauuucuguccuuguuggaggaagugugucacugugggggugggcuuugggggccuauaugcucaagcuccucccauuguggaagaggcagccucucauggccgccuuccgauaaagauguagaacucuuggcuccuuuucuagcacugcgucugccuggcuacugccaugcuuccugcuaggaugauaaugaacuguaggcagcuccaauuaaauguugucacuuauaagaguuugacuuuggucauggugucacuucuuagcaauggaaacccuaccuaaaacaagacugucugcccaacaggagggucaggguaggacuugggaagccaccaaggcagcauuggugaggcauuugugcaugugcaugucugcagcuaacuacugaaaucuuuaugcaaaugauacagagggguaagguaaguuuuucuguuguuuauuuuugagacagggucucuuguagcccaggcuggcccagaauucauaguguagcugcgggugaccuugaacucccuuaaggaugugaaccaccacacagagucugugagauacaaaggaugaaagucagcacuucacgaaugccagucaagugcuccaucaguucagcuccaagaugaaguacauccuaacaaagaaugcuuuugcuuugauuuuguacccugugcucaggcuaaccuagaacucacuagguagcacaggaugaccuaaaauccaagagguagagguagagagaugccucuaccucugagugcugggaucccaggcaugugccuagccuggaggauguuuuugagcuggucauuccuaucuuagccaccaaucacuuccuccugcuaacaauaguaccauuacuacagagagcauaacccagcucaugguggacauucaaaccccaggcuucccagaagccacgcucugcucauauucugaugugcugacucuuugauaacaguaagcuacucuuggcuucucuuucauugaaaguuuccacauagcuacaauggaugcaaacaaggagcucaaaagcagaaugugaaauaaagccaugaaacuuuaagcuucuuuuaaaauuuuguuuucuggagacagcuucucuggguagcuagcccugguuguccuggaacucacucugcuagccucaaacucagagaucuaccugacucuaccuccccagugcugggauuaaaggugugggacaccaccacccaccuaagacaggaaaaauguaagaacuauuuggugauacaguuuccucucugaauacuuuaauacuuccaggaugcacccacacacaugccugaguggcuaauaugaauaugauuaaucauuuuguuguuguuuaucaucaccuauaauuccagccuucggaggcugagguaagaaggucucagguuccaauuaagacuaggcuauacuauuaaacuuuaucucacuaaacaacaagccaggaggauguuaauuuuaucauaaaggaugaauguagagggcuggagagauggcucagcaguuaagagcacugacugcucuuccaaagguccagaguucaaaucccagcaaccaccugguggcucacaaccaucuguaaugauaucugauguccucuucuggugugucugaagagagcuacagugucuucacuguauauauaaauaaauaaaccuuuaaaaaagacacaaaccaaaaccaaacaacacaaacaaaaaaccacaaaccaaaaaacaaacaaacaacaacaacaacaacaaaaaaaaaaaaaaaaaaaaaaaagaaccccagaaggauguaaagucccauuaaaaauauaucaugccaggacaaaaaaaaaaaaaaaaaaaaaaaaaaaaaagguuaacaguuguggggcuggugagauggcucaguggguuggguaagagcacccgacugcucuuccgaaggucugaaguucaaaucccagcaaccacaugguggcucacaaccaucuguaacaagaucugagcccucuucuggagugucugaagacagcuacaguguacuuacauauaauaaauaaaucuuugaaaaaaaaaaaaaagaggcaguuguguguguguuuuacacacacacacacacacacacagagucaauuuucugacaaaaagcucaucuacuccaggugggcuucaggcuccucaccucccccuuucaucugcuaaguucugggauucuggucagugccaugcagacuuuaugugagaugagaaacacguguauugcuuacuaaacaguccagccugagccucauuuguaaaugacaaccauuucuuucaguuccauccaucaagggcuccaucccccucuguuguuucuggagaccaguaguaauggaccuaucuuaauuugugcgugcguguuugugugugcgugugccugugcgugugcguguguguguguguguguguguguguguguguguguguguguaugugcuuagugcaugagucaagguggcaaggucaaagaacaauuagcaaacacugguccucuccucccacccugugggguuggggaacugaacucaggucagugucaaguuuggugacagauaccuuuucuagcugaguugucucacagggccccaaauaccuuuuuaaagugaugcugcagucacugagagaugcauccaaaacuaggggagcugcaccccuccagagcuagaguaaaugccucccuuccacuggguggggcuggcugacucugcaggggguuuaaugagccgcgcuuuccuguuccacuaaagcccuaagcacaacuguaagcgggcacucagauauuagcaacaaugacuuaauuccuuacaaguaugaggggaauucuuagagagagaauugcaaaaucuuaacuuauuccuggauccaacaagucauagcaacaaugauacuucacagcagcacugugagcgacagaauccccucggaggcugugaaggagacgccacagguacugugcuagcugugcacauaaagaccuggaguggguuugacuuaguucuguuuguauuuuaauguuaauuugccccccccccaaacuguuugcaggagagaguccacccuugaaacacugagggaccagcccccagcuaauucugaaugguaaauaaagaugccagcagcucauagcugggagaagagacauaggcgggguuuagguuuccuggacggaggaaagaagcagaagggggagacacucuuagaagaguaugcagguguaaccucccccagccugaagcaggcuaagccagaccuugaccuugaugccacaaagauuaccuagggaggagccuuccucccuagaucacucuauuguucagccacugccucuguuccccuucaagacacuccuaccugcugggaggccacuauuccggagacuacacccuaucaugcacauaguuaccugcagcugguuccaggccccaagaaugaauuggugggaaugggccucccccacuuuauaagggcauuugccauuaaacauuugagcuuugaucaggaaucuugacuuagcuccauuuuucucucgaccgccuaguuccccucccuuuucagccccugcuugccucccagguguuucuugugagccacaggaaggcuuccaacaggcaggagagagauggaagucaccauggaguagagaagcaaggagagcucccugggcucugggccaagagaacguggcccagagggcugacuaauuggaauuaagagcagccaggaugaaaccuagaaauuaguaaguagucacuuggaguuauugaugggaaaguggucucuuaacagcauggaggggaggcaguugcccagcuauugagcuacuuaaggcauauuaaaauauaaaggcugugugugucuuucauucggugggucguaaccccacgccaggauuuauucauuuuuaacuacaaagacuggagcaccaccgaaaagcugaguggugaguaccuguaacuccaacccugggagggauggaggcuggaagaucccagcugauugcuagccagucaguguaagcugaccugugagcuccagauucgggaagagacucucaaaacuaaaauggagcggucaacaacauggcucaggagguaggggggcuugcggucaagacugacaaccuaaagaccgacccaaaauccacauggcagagagaaguagcucccacagguuuucuucugcccuccacauaaacaccgugaaacacauacaauaaaaagauaaagguaaaaagcauuugaaaaaaaucaaaacccaaucaaggacaagagagaucaaggacacccaauaucaacaaacacacacaugcauggauaaccacgcccacgcaagcaccacccucugucacacacaaaaccaauuccuauaguuuuuuguauuacaucuaacuuucauucaauaaguuuugguuuuguuugccuuuuuuccagucuaagacaggguuucucucuauagcucuguaucaccaguuuugguuuucaaaguucaguuuuucagcaggucuauucccguguuuuccuuuuccaugugcaugguguguauauguguauguuugcauacaggcacaugcauguagaggauaaagguugauguuuaaaaugaugcccugaggcuagacagauggcucagcgguuaagagcacugacuacuuuuccagagaucaugaguucaaaucccagcaaccacaugguggcucacaaccauccaucaugagaccugacucccucuucuggugugucugaagacaacuacaguguacuuacauauaauaaauaaguaaaacuuuaaaagaaaaaagaaaaagaaaagagagagagagagaaagaaagaaagaaagagagacagagaaaggaaggaaggaaggaaggaaggaaggaagggagagaaaagagagagagaaagaaagaaagaaaagauucccuggaacucaggcuggccucaaacucagaucuuaaugcuucugccuccuaaaugcugggauuaaaagcuuuuguuucgguuuguuuuuuuuuuuuuuuuuuuuccgagacaggguuucucuuuauagcccuggcuguccuggaacucacucuguagaccaggcuggccucgaacucagaaauucgccugccucugccucccgagugcugggauuaaaggcgugcgccaccacgcccggcuucgguuuguuuuuuguuaucuauuuuuacuuguaugugcgugagugcgcuguacuguagcuaugugcaggcuucuagagaaggcaaaagagacaucagagcucaggaagcuggaauuacaggcaguuauguaugagccauggacauauggguguugagaauguaagccagguccucugaaagagcagccaguacucuuaaucacugaaccaucuuuccagccccaucacucaaaaaaaaaaaagauuuguuaaaaaaaauaacauuuaagccaggcgugguggcgcacgccuuuaaucccagcacucgggaggcagaggcaggcggauuucugaguucguggccagccuggucuacaaagugaguuccaggacagccagggcuacacagagaaacccugucucaaaaaaccaaaaaaaaaaaaaaaaacaaaaaaacaaaaaacauuuauuguuguacauugaaaauuauauuucaaguucucuaugcugaacauuaccaaaaucaugcuuacauauaaaauuucacucuggccaauuuguuaaucaagaacuauugggaucaggcaaauacuuaguggugucaccaaguaauuuuuacucacacuaauguuuacuuaaagcagcagacucccuucacacacaaaugcuaaacaauuaaaagcagucaaaaugagcagaaaauaacaaauaauucuucaggaaaacaaggaauucuauugauuucaucuauauaaagacauuuaaaaaaauuaaaaccacccucucugcaccccucaguggagaggaauauacacaaccugcacuuauccaucuucagcaagaaaugauguggugcagguggucccaggccaaagcagaugaaaagaaaauaacccuguaagucuuucuuucugccuugccagcaugccauaaauaagauuucucagauuugccaggcaugguggcgcacgccuuuaaucccagcacuugggaggcagaggcaggcggauuucugaguucaaggccagccugguguacagagugaguuccaggacagccagggcuacacagagaaacccugucucgaaaaacuaaaacaaacaaacaaaaagauuucucagauuuaauguucccaagucaauauaauauguaaaaaauauucugauuuaaaaaaaaaacuuauaauuuuaacuucugugugugugggggcaggguguacaugcaaaguucugaggacgacuuguagaaguggaauugcuucucucuuuccacuggguaguaggucucagggagaggaggaagguugguuguaagguuugcugaacccucuggccaacgcccaaguguuucagcagguuagugauuuucuuuuccuuguguauauguuugcauauucacacaugcacauacaugucgaagcuagagguugauguuagauaguuuccucaggugcucuccauuacuuaaugaggccgcaccucuucaaagaaccuggauacaaguuauaaaagaguucuugaugguggugguacaugccuuuaauucuagcacuugggaggcaaagacagaucuuugaguccagccuggucuacagggcauguuccaggacggcuaaggcuauauacagagaaacccugucucaagaaaccaaaaaguucggguuguuauaauucccaagguaugguuauuuuucuucucuaguaaucaaacuauaacgcuuuaggugaucagacucaaggcaaaaacaaaucagggccuucugaagcuccgacuuuauaucugaggcugaaauaaagcagcuggucaacucccagcaaagggaucgaaagccuuggagguuuuccuucuucaugaccauaaaaagcaacaagcgggugacauuucccugcacucgaguuugccagcagaggaauuugcaaccccauucaagcaggcugucugacccuucccugcucuuccuucaaguucacacacaggcacaaaucuaguauucacucugcaggaucgggcaagggcuugaggaacauaguaauuuauagcuuuuaaacuccacaguaguccaauugucuccagcccuagaaaacggggugagggagagugcgaaggcuuaaugcggggcuugaaauuaaaccuguaaacaguuauuauugcagucagaaagucgaaugaaaucugaagcagguuaucuggauucuuugaacaauaaggucaacucugagaguucuggaaacuaaauuuucuaaaccaucccuauuguugccccauuuucugcuucaucuccuaugcgccucgcccuguugacuaucgccacaucuggcugcaauuaaauaagaagauaagauuuuuuaaaaagggauagguagguaggguggcucugggcuccaaaccucagcacuugggaggcugaagcaggaggaucaagagcuccuaccuagcagggauagccugucucaaaagaggcacaggacauagguuugauuccccagugccauaaaaaauaaacuuaaaagccuggcgugguggcgcacgccuuuguucccaucacucaagaggcagaggcaggcggauuucugaguucgaggccagccuggucuacaaagugaguuccaggacagccagagcuacacagagaaacccagucucgaaaaaccaacaaaacaaaacaaaacaaaacuuaauccauuacuuaaaucaaauccugguggaggggcgagguggcugcgguuaaagggcuugaaggucugaauucagucccaagaggccaugggaagucaaaaggaaagaacagacuuuguuaggucucaaagaaaccugggaggaacggcaaggucccuauuaacauaucagaacagaucucagccaguucccccaaacccagagcuuguggcuccucccacuucucccagcaucacucagugccuguggcuccucccacuucucccaguaacacuuugaacuuguagcuccuuacccuaaacuucuggggggggggggggcugggcuuccucuuccuuuucucccaucuucuguacacuagggcaccucccacuuaaauagggucucacugugcagcucugacuuuguagaccugcuuuguugaccagguuggccuugaagaucuucccaccucuuccuccccaaguguugggauuaaagguuuacacaaugccuggcgauaaacaagaauuuaaacguaguaauauauauggggauaaagucucacagugcagcccaugcuagccuuucuuucuuuucuuuuuauaagauuuauuuauuguugugaguacacuguagcugucuucagacacaccagaagagggaaucaggucucauuaaggaugguugugaguuaccacgugguugcugggauuugaacucaggaccuuuggaagaacagucagcacccuuaaccacugagccauugcucaagggccagccucuaacuuucaaucccccugccucagagacuuugguguucaaauuacaggugugugccaccccaugaguccugcagaaaacuuacuuuuacacaacaugaaaccagcccucccuuccucuacucaaagagauuuucuuuuuuguuuuuuguuuuuuuguuuuucgagacaggguuucucuguguaguccuggcuguccuggaacucacuuuguagaccagucuggccucgaacucagaaaucugcuugccucugccucccaagugcugggguuaaaggcgugugccaccacaccuggcgagauuuucuuuuaacguuuaaaaauuauuucaguucuagcugugagugagcauggugggagagccuggagggcugaagcaagacugaaugaauuugagucagugugagcuacccucagagaccuugucucccaaauuaaacacacauuacuacauuugugugugggcaugcauaugccacagaauucccuuaggggccaggggacaaauccuagguguuacuucuuuccucccaccaugugggaccuuaaaaaucaugucaccagguugagccuuuuucuccuuugaaaaccuugagguuuuucaguagaguauaugugugugugugugugugugugugugugugugugugugugugcgcgcgcgcgcgcgcgcacaugggggggggggucaaccguccuggguuuuaucccauuacagggcaggccucucucacuggcuguauucgccguuuuagccuuuaugguggagcacuaauuuacaauucugggcaaaguacaguuucccuaagcacaaguucuccauagaccgcaggugccguggucaucuguaauucuacccggucaaguucagucccccuaaagugccuaacaucaccagagaggauccccaguucgcuuuauguguauguuugcacacaggauuuccuguaccccaggauagccucuuauucuguagaguaagcuggcccaagugcugagauaacaggaguuugcuacagaugaaacccagggccauguguaaugcccaaguguuguaucaacugaacuguauucccagcagcccagauccccaguucuucuuaaaggacucuccuuccuuuucuugcuaaggguacuuaacuccuguuuucucccccuacuccucuucucuugccuaugacuauuacuaguuuauuuuaauauguguauuucucgucuaugagaguauaugucaccuguguguggguucccaaagaggccagaagggaccaucagaucuucuggagcuggaguuauacgcaguucugagccuccgauguggguucugggaaccaaacucaggaccucugaaagagugggaagcuccuacuuaucaaucuuuaaaauaaaaucuauuucagguucacacagccacaaauauauauaucucaaucccacauaugacuuuccuuuucuuggagacacaggcuuuaacagugaaucugaacuuugaauccagcucuccagagauggagauggcaacuucauccugccugccgccuaauuugcuuaagauggcagcauuagagcuggagagauggcucagugguuaagagcaccgacugcucuuuccaagguccugaguucaaaucccagcaaccauaugguggcuuacaaccauccguaaugagaucugacguccucaucuagugcaucugaagacagcuacaguguacuuagauguaauaauaaauaaaucuuaaaaaaaaaaaaaaaaaaaaaaaaaaaaaaaaaaaagauggcagcauucugggagagggaucugcuggguuccagggcucagagagacugccugagaagcuuucucuggccaguguaauacuuuaaaccguggccuacuucccugauuccucgcauuccucgcauucuuucaugucauaagggacuugacuugaaaucucacuguuuucaagaaucuagauagcacuguugggucucagucugucaccacaaaaaucuccacauagaauagcaauuuaaaaaaaucuuaucuaaagacuccagcuucuacuaaaagaaguacugguuuucauguugaucaaagcaaacaaguuuaguuuauuauaaacaaaacaaaaggcuuacuuaagacuuacuugaauuucuuucaaggaaauuuuagcccuugaggcuuugcaaucaagaguauguguguauaaaacucaaccaaccuggguuuuguuuccauuacagcccaguauucucugccucacuuuuauuuaccauuuugugccaagacugggagaaacugugauaauaaggaaggauuugacaacauuuauaacauucccuaccgugugagugacuuauuuuauacaaaacagagcagagagauuucgaauuuccauuuaaauguccacaguuacaauacagaaguuggagcucaacucuaaauacugauuugcuuguauaugucauuucugaagcaauuaaaaaauucucagcucucgggaggcaaaggcaggcggauuucugaguucgaggccaaccuggucuacaaagugagcuacaggacagccagggguauacagagaaacccugucucgaaaaaccaaaaaaaaaaaaauucucauaacccagguggugguacacacuuuuagucccagcacccaggaggcaaagucaggaagaucucugaauuugaggccauacuggucuacaaagagaguuccagaaagccagggcugcacugagaaacccuguuucaaaaaaacaaaauaaccaaaccaaccaaccaaacaagcaaacaaacaucgaucauggagaguggauguguaaugguacccaccuguauccucaucauuugggagacugaagcaggaaaacugccuugaauucagggccugccugggauauacagugagacuucgauucaaaaauugaaacaaacaaaaguggccaguuguuagugaucuagagaccaucuuguuccaccucaccugucauuugcacuguagugucaaaccaaguauaaauucaggguagagauggcacagcauggaacugucuacagaauuuagugcucacccccccagugaagaauaauuccaaacaaaagcuucuaaaaaggcauucuccaaaaugucugcuaggacuuagcuuaaaugauugcuaagaaccaaauguauaaaaucuaacaaucauuaaagcaaaggauaagggcgcaaaccugugaacccuggggucaggaagcaucuaucuaaauacauuaauucagccaggaaugguggcccaugccucuaaucccagcacuugggagacagaggcaggaagauuucucugugaguucaaagucagccuggucuacagagugaguucuaggaaagccagaaugauauaguaagaccuugucuugagagagagagagagagagagagagagagagaggaaggaaggaaggaaggaagggagggagggagggagggagggagggagggagggagggaggaaggaaggaaggaaggaaggaaggaaggaaggaaggaaggaaggaaagaaggaaagaaggaaagaaggaaggaaagagaaagagaaagagaaagagagaaaaaaaugaauauauuuuaaaaaguuaagaacugggcuggugagauggcucagugguuaagagcaccgccuacucuuccuaagguccugaguucaagucccagcaaccacaugguggcucacaaccaucuauaaugagaccugacucucucuucuggagugucugaagacagcuacaguguacuuacauauaauaaauaaauaaauauuuuuuuaaaaaguuaagaacuacaaaucaaacaccaccacugcacacugcauaacaacauacccuucaugaaggaaaacuaccaagucacaaugaagcaccuguaugugugugugcauguaugugugugaacuggugguacaggugcaagugugugaauggaagcuaggucuucuccaauugcucaucuuucacaaauuguauuacguguauuucuuguguguacgagaucacgugcacucauccacccauggcauggggcacguguccaggucagaggacaacuucaaggagcaagugaucuccugcuacccugcaagcuucagggaucaaacucaggccgggugcaagugccuuaauacaucaagcaaucuugcugcccugaacuuauaucuauuguuguuguuauuuguuuguuaugacagggucuuacuaaguagcccuggcuggccgggaacuggcuauguagacuaggcuagcgucaaacucagagaucucagcuucugcugagauuaagggcaugugccaccauguucagccccaauuuaaguuuuuaagcuauagucuuucauaaaaccugcaacuuaacaauuuggcuggaccggcuagcuagcaagcccuaaggaucgauccuguucauucaaccccagggauagaugggauuguggguacaugccaggcuuucucacuuggaugcuggggacauggcucgggccaucaugcuuguaugagaaacacacugcugacuaagccaucucccuggcccuccuuuuuuccucaucccucuccuuaggagauagguuuacuauguagcccaggcuagccuuggaguugcucuccugcugggauuuauaggugugugccauccugugugggucaaaguacacuuuaagagaggaucgccaauaucaaggagaauuuagccaguaugacggcacauaccuccaaucauaauacuuacgaggccgaaucaggaagauuaucacaugcuaaaggcagccugggcuacauaguaaguuccaggacagcuuucgcuacagaaugaaacugugcuuaaaauuaaaaaacaagagaaguaaaaagugaccugagcugcaagauggcuuuaacgaaaagcaagccuggguuaggucucugcaaccuaaauuaaaaaagacuuuaauuacauccgggaccccaacaggcccugugagauggaaggcagaaacaggagagaagugcuuggaagcuccagugccagccggccuggagggcagcacaacagagacaagacagacucucuaacacacacacacaaaauaauaauagcauuaguaggaauaauaauaauaauugggacuuucuuuguuuuguuuuguuucuguuuuuuaagauagggucucgccggacaugguggcgcacgccuuuaaugccagcacucgggaggcagaggcaggugaauuucugaguucaaggccaggcuggucuacagagugaguuccaagacagccagggcuacacagagaaacccugucucgaaaaaccaaccaaaaaaaaaaaaaaaaaaaaaaagacagggucucucuguguagcccugacugucucugaaauucacucugcagaccaggcuggccucacacucagagacccgccgccucugggauuaaaggcgugugccaccaccccuggcucaucagaacauuuggaaaagaagcuugcaccggauccacugauaagcaagcacacgcucagacacuaacaaggagagcaaccaccaaaggccuuguccucagcacaagcccaaaagcaggcacgggacaugcacauuacacuacagacacuuuuggaauuuggguuucuuuaaaaacacagaaauauuauaagaauaauaucuuuuguuuuaaucccaggugugggauacaggcugcuucagguggucugcagcagcugauuaugaguugccguaugcucuagcagaguuuuuuuuuucugugauugugugacguuuggaauucugagaacuuuucagaggguauauaaaugcuaaagcccugauaggcgguguugcuucaaggggguugguuguaguuuguuagcagucaugcucagagaagaaacaagacaaaagaaauuagauuuaaggauugcccccuucuuucuuuccuaucuagugauggaaaaagaagaacucacaaaguaucaaagaccaguacaagcaaagaagaaacaagaaagaaauuagacucacggaccccuaucucuuucucccucugucauuucucgccuaucuagugaugggguggggggauaaaagguggaaaaaagaacccacaaaauagcaaagacuggcaacaauauucccccaaagcgagucaucccuaagacaucucuucggccugcaaacagaagggguguggucaacccucagggaccuugucucggauggagaagucuggcuggcuggaguaagugcuguucuggcagcugcccagcucacugccuuuccauuuuaucuucuacuuccgagcucugccccucccuucagguuccacagcauuacccacuucuauugaugaccuccgugacacaccacacccagucuuuauucucagggaaacagcacuauaggagauauauagcuaaguauaagaugccugggccauuacugaagcccccacuuacauauuuauauaccugugacaggcgcuggccauauagcugaccucaaacucaaaucuuugagggugcacccuccuguaaaccaaauuuuauuacuuacaagugauguccuagcuucauuucuguugcugugauaaaauaccccgacagaaaggagcugagcggagaagggauuauuugaucuccguuccagguuacaguccaucacuaguuaaggcagugggagcuugaaguagccacauccacagccaagaauaaagagauaucacugcgugcauaauuacagcucagcuaguucuuuucuuagaguuuggggcuucaauccagggaaugggaccacuccccuucaggcugggucucuccccaucaaucaagacaaucucccagauaugcccauaagccaaccugcccuagagaauccuucacggacacucuuuccagcugauuuuagguuguaucaacuuaacaguuacaagugucucccuucaguggggcagugguagugcuugcuuuuaaucccagcacucgggaggcaaaagcaggcaggucucuugugaguucaagacgagucuggacuacagaaggaguucuguguagccaaagcugccuagaaaaacaaauaagggcuggagagauggcucagugguuaagaacacugacuguucuuccagagguucugaguucaagucccagcaaccacaugguggcucacaaccaucuguaauggggucugauguacucuucucguaugugucugaagauagcuacaguguacucauauaaauaagaauaaauaaaucuuagaaaaaaaauaagcaaaaaagucucccaucuaagugacucucccuuuaggugaagccacuccuucgacuugagcucaaaugccugggaggcagagccagaaccaucacuugaacccggauagccuggaaaacacuggcaguguuguguuuugguuuucggucuuuuguuguuguuuuugguuuugguuuuuuggggguugguuucucuguauagccccggcuguccuggaacucaggcuguugggagaggguuugacuuaacuugguuuguaacccaaucugacuagcacaucauuauucuccucugucgaucuucuccagggcugggauuacaggcaugugcuguaacuguaauuuuuaaauuuggagaguugguugcuuucucuuguuguccuagcuuucaggucuuuauuauuuuauuuauuuauuuauuuauuuauuuauuuugguuuuucgagacagggcuucucuguauagcccuggcuguccuggagcucacuuuguagaucaggcuagccucgaacucagaaaucugccugccucugccucccgaguggcugggacuaaaggcgugcgccaccacgcccagcuucaggucuuuauuauuaauggggaaggggauaugugcuguuucuguguuaagucugggcacacaguuaccaccgcauguguacagaagucagaggaugaguuuuagagucucuucucuccuucuguuguggguucugggucaaacuuaagucaucuagcuugggguggcaucaagcaagugcaguuaccugcugagccuuccugcuuguccccucgcugguccugucugccccgugccaagccuguauccugcucaaauuucacugaccuggcagagaucugagccaaaaguguccuuugaaaaugcucgcuggcagucucccuuugcagccucccuacccaccugucuccagcccacacugucccccagauggacagaucuaggguguccaucgagacggccuucucgggauggaaggcagacauguucuccgucugugcuuugcugcgucagaagcuuucggcgcgucucuaaagccucuccaccucccggguggcucuuacgcccugggugaacugagacuuuagcaucccuuuuccauuauccccuuaaacacauccaucucccuaacaagucucaucucuucccgucuccccaccaacggccuuggacgugacuagaauccuuuuccaaaaauauucuuugcuuuucaaaguaguuaucuagaaaaucgucuuuguggaucuggaccaacugacggcaggucuccgacccucucucucacuucccugagucugucauugaacacugcgccuggccugaggagggcuuccaagguugaugagcgaugcugugcacuuuccugucacacccucaccggugaacacuccaugcuuaagaauuaccuguuugauguacgugauacuggguauccaacccagggccuggugcacagcuagacaagcacuguugcugggcucuaauccaagcuuagcuuagaaaauacgcaugcacuuugcuguuagaaaccagggccucuccguguuagcccaagcuggcuucagccucuggaagcacugagccuacagugcuguacagccaugcccgcaucauacuuggcucucuugaauauauuaugguaucauuugcuaggacaacaagugacaaaucuccacuuccuuucuuuuuuuuuuuuuuuuuuuuuuuaaagauuuauuuauuuauuauauguaaguacacuguagcugucuucagacaccagaagagggagucagaucucauuacagaugguugugagccaccaugugguugcugggaucuugaacucuggaccuucggaagagcagucgggugcucuuacccacugagccaucucaccagcccuccacuuccuuucuacacucagauaaccacagccucaacacucaccucagccuugagaaacaaggaaaauacgugcaauaggaaagaggaaaauacuuuacaccguaacguuuggcgcuauaguugaccagauguuuuuaauuuauugcacaaauacagaggaaagucgucuaauuuuuuuaaaaauugaaacagacauacccauauguagaaaaagguacaagagagacuacgugacccauggcacaaggguaguaggaaauauacauggacaauaaaaucagauuucuccuuuuaggcaugaaaauaaaccuuguggauuaggaucuaaaugggauuggaguugggggaugggaggaacaccuuuaaucucagcacucuaaagaagcagaggcagaggcugguggaucucugaaccuggucuacagagcaaguuccagggcagccagggcuacaaagagaacuccuauggguggugggagggugauuuaaaugggauugggcagagcccugcacucaccugugugaagcaugaggcacuggguucaaucugcagcauauaccuauauuccuagcaaagcugugucucgaaauaaagcaaaacagccagacagugguggcgcaaaccuuuaaucccagcacuugggaggcagaagcaggcggguuugaguucgaguccagccuguucuacaaagugaguuccaggacagccagaucuacacagagaaacccugccucaaaaaaccaaacaaucaaucaauaaaauaaacaacaacaacaaauugccccugggacuuugugugugguagacccgcuucuucuaccccagaaccuucuccaccaagguguaugauguguauacacaacaccugaccuggccugugugcaccagccucccccagcgcaguccaggcacagcagcuucaacucccacuacauaggagaauaguuccuuuauuuucuucuccagaccagugagagggaauaaaugccuuuaucaucuuacaucuucccuuccacccacgcgagcuccaaccuuagugauucuuaaguugucaccuaagccuuaaacaccagggggaggaggggcuugugugccaguuccuuuccucugaggccacagggcacacacugaacaauuagaacacacaauggccuuucaagaauccagacuguggugcuacagugugacucagucucaaacacauaugcacgugaacacacacacacacacacacacacaccucccucauaucaugcuaaugcauaccuaccauuccagcacuugggaaccagaagggucaggauaccaagagcaaacuugcauacaaugauuucaaggacaauauuggucauuaagauaaauccuaucucuaaaaaaaacaaagacaaacaaagcaccaaaguauaaagaagcccaaagcccuaucugcauccuccagcagguucugaucagcagggugacccaaauagaggugcacaagucaaggauggaugugcacaagcccugaggacccguuccucgggguagguguucugcuccccaagcgcugaaaaaauauauuaaaacucacagaagacaaggaaaacagucaguuccguaguguugaaaacaaaacaccuuugagugugcuguguggguggaaauaaaacccaggucuucccaccaguaguuaagaacagcauaucagucgggggugguggcacacgccuuuaaucccagcacuugggaggcagaggcaggcagauuucugaguucgaggccagccuggucuacaaagugaguuccaggacagccagggcuacacagagaaacccugucucgaaaaacaaacaaacaacaaagaauggccuaucauccucagcuaccccaggcccaacacaaaaucuacaacuuccuuuguguugauuguccuaaaauucacaggguugaaagaguuucuacagagcuccuccaccaggcccaaaggaucagaacaaaguggggugacuugcuaaaguuccaggccaccaagcuggaaccaaauuguuuaucugaccuuucagauaucaaaagaugaaaaguuagguaauggccaagcccagcuaugugugacuagagucaucacacaagaaucugagguaagaggacugccuguuuugagccuggguuacauuaagagacccugccuaaaaaacaaacaaacaaaugaauaaaaguuugggcuguauaaaugaguucccuaugcauuaaucuuuacaagaugaguaacuuuugucucugguuuccuuagccaucucuuugcuacaaagucaaccucaagucaucucauccagacaacuauuccauuuuauaaaaggguucuagguagaggccugugagagcagagcacagcccugcaugccuggaaccccaguugcugagagcugagacaggagagugacuccagcccaggcaagagugagaacugugcuucacagacacuggaagacugaugguuuuucgagacaggguuucucuguguagcccuggcuguccuggaacucacucuguugaccaggcuggccucgaacucagaaauccgccugccucugccucccaaguucugggaucaaaggcgugugccuccaugcccagcucugauuaaacuuuuuuuuuuaaagauuuuauuuauuauuauacauaaguauauuguaugucuucagacacgccagaagagggugucagauuuuguuaugggugguugugagccaccaugugguugcugggauuugaacucaggaccuucggaagagcagucgguguucuuacccgcugagcuaucuugccagcccccugauuaaacuuuuaaacuggauaaauguacauuuguauauuucaaaaguggaucugcgcaaagccaaaagaggaaaaguucaaaaccagccugggcuacaguuccagguuagccugggacauagaguacaacaacuuauaguccccaaggcucagccuuuccguuuuauaagaggucccggauucuggagacucagucuuccaacugcuggaaugaagcccugggggcagggugcuggggaccuagcguagccucucaguccuagcagcccaaggggagguguuggguuuugucucugauguagugaaagaacagcaccuucuauaauagggacaaucuauuggcauauagguaaccacgcaggcaaaaccaucacuuuacucaggaguagaggaagguugaaucugauguucaaggacaggauccucaacacauugaguuuggggccagccuggacuacaugagacacacauuuaccaaaaacaaacaaacaaacaacaacaacaacaaaaccaugucauuaauaaagaugacuuucauuacuuuaaauucuagaccauucaggguaaagacagaugacuugggccuuaaaagccuguuuuauuauucuacuucaauuucucagacacaguagcucaggguagucauuuuagaauaauggcacccacaauaucugucucaccacagacacacccuuuaaaacacuggcucaaggagcuggagagauggcugagcgacuaagagcacguguugcucuugcagaggaccuggguucaguucccaacacccaucugguggcucacagccauuuguaauuccagugccaagagaucuaaugcccucuucugaccucuggcaacaccagaugugacaacugugguguauauagauauauauaugggcaaaucacuugcccauauguacauuagaauaaauuauauguuagugacucauaacuccugcagucaaauagaagcacguccugaaagacuugacaagggucuccagcucccuaccuccuggggacacuagccucaccuagcuuucgguagcccuguuguuuucagcuuuggacucacugaggaggagaaaacauagaaagguuaauucagggcugccaagaaggcacagaaugugaggugcuuguggccuaaccagaugacaugaguucaauguucaggccccacaugguaagaggagacaacuccuauacuuguucucugaccuccagguauguauaugcaugugugcacaugcacaugcacacacacacacacacacacacacacacacacacacauacaaauauguaaucauuuauuuaaaaauaaagguugggggacuggagagauggcucagcaguuaagagugcuggcugcuccuccagguucugaguucaauucucagcacccaugugguggcccaucuguaaugagaucugaugcccucuucuggcacgcaggcauacaugcagguagagcacugcacacauaauuaauuaauuaauuaauucagaggcauucugauugcuaaacuuggucagcauguuggcugcagaaaccaagauuuaccagagcaacggaagucuauuagucauuggucacccauggucugucagcaacugaaugaaaauaaaccugcagagaccagagauuauagacacacaauugagaaaaagagaagccaaucuuacuguccccaggagcagucuuaaaccaggaacuagggaaauaacacaggaagccauuuccccuuacaauuugcauaugaagaauaacuauaggacuucuaguuuuacugaaguacaacauagauaaaaccuaggcuggggcauuuaaauguuauaacucuugggcugagucugcaaaaguccggcuugcucuggcaaggcccuggguucaauccuaggcaagaggaggaggaggaggaggaggaagaaacagaagaucagcuuuaguucccagaggcuggagagaugacucagaggcuaagagcacuggcagaggaccagagggaucccagaacccaccgcagggaacccacaucuagcuuccaccggcaugaaugcuggagggugaacacacaauuuuaauuuaaaacaaacaaaaaagcuuaccucuuaugugaccucaugacagaguucaacagaagaguugcuuuggggcacucuuagaaauaacggcuaacuaaagucagcagaacgaggggcucaggacuguagcccagcauccugcccaaaacucuagguucacguucuagcauccaaaaaaauaaguaaauaaaaauuuggacaguauagagaugccaugauguuaauacauauaacauguauuucaggaaaaaaaaauuaaacugaauagaaugguggauccuaacuguaauuucagucuucagaagaucaccaaggguuugaggccacccuagguuuaauagugaguuugaggccagccugggcuaaugaguugauuucuugucuaaaaaaccaaaacagcaaaaaccccaagccaacugauguaccaaauauguagcaucugauauaaauauuugaauauauauauauauauauauacauauauauauauauauauauguaaggauccuagcacucgggaggcacaggcagguggauuucugaguuccagcccagccuggucuacaaagugaguuccaggacagccagggcuauacagagaaacccugucuugaaaaaccaacaaaacaaaacaaaacaaggauaaaagucuuuaaugaucaauucuauaauaagaaggaaaaaaggauaucauucuaucuaaagacggaaaacugucgggcaaugguggcacaugccuuuaaugccagcacuugggaagcagaagcaggcaaauuucugaguucgaggccagucuggucuacaaagugaguuccaggacagccagggcuacacagagaaacccugucucaagaaaaacacaaaaauaaaaaauaaaaaaauaaaaaaagaggggaaaaacuauauacuacauagcaaaccuccucaaaaugucuacagauccaucaagauuauauauucaugauguaauccauaaguaacucugugaauguuucaucugaccccaccccccaauaggggguguguguucauguagccuagauugaaucagcuucaaaaucacagugguccucagacuccugaaugcugggauugcaaaugcaagucuccacacccagccagaccucucucuuucuaaagagcaaacaggucuucaaaucugauuuuccuccuaaaucauuugcucaaucuacuaaguacuagagagacugucauuaucugauacacaaaacgaauccucaugagguuaaaagugaagccggagaaggggacagcuggcauucaccaaugagaucccaagggccaggaccaccacuucuuccaucagcucuugccaaguuccugauguuucgcgccaugcaccuugccucacacaggggacaguuugucaggaaaucggguaagcccuucgccuuguggagcaugguaguuaaaaagccccuaaguccacaaagguagaaacugcggauaggggacaaggggcuaaggagacgagagugauggaagccucuaaggucaggcauuggaacuuaagauaggccgggcgugguggaaagaguaagagaggacuuagaggugcugaaucauucuuaauucugagauccuacugaaaagucuuaggucuucaacccuagguaaccuguggguggaaggaaguaacauacacguaugugugcagcaagcacgugcauguggaucgauccaucuucaaauugauaacugggaagcgggccaacaaauuaauggugucaccaagucaucuuuuaaaagagacugcuuggauguuucaagauggcgguugauggcgagggggaggggggaugcaggcuacgggauggcguggaaggaagaaaagaaagguucauaacuuacuguaaacagauaauaaaccuugacgucauauaaaaaccaaaguuaaaaaaaaagucuccugacugcagauuuuuagcaauuauaucuuaaaaugacuauauuuccaaacuggagcuauguugauggugaucgccagcaaagcaaggugaggggcagugaggugaugagucagcagauacaggugccugcugugcaaagccagcagcaugaguuccagccccacaacccacauaaaggcggagggagaaaacuaaccgcacagagcuguccucugacccccacgcacgcgugccaaggaacaguugcccugaccaccaccugcccaauguacccacaaacuaagcacuaagggcagguguacucaaagaaguuuccaaagaguguuacacggaguauuaaaauguaaaugaggcauccaaaagauggagacugacuggauggcagaagucucucagaagaccugcgcaucugaggcagugaggacuuuggacuuuauaaguggugaugaguuaaacacuggaggcaggaacuguuaagagaggccacccagccuacauuauacuaggcaacauaaagagcucaaagccaucaggucccaccucuguuagauuuaccuggaacucaguguuuuauucucacacaaagauguuuccacuuccugacccauuucuaaagguccucgcugcucucuaucaccaaauucugaaauugguugguuuuuccuuuaaguuguuugguuguucaacacguuucuguaaaacuaucuuaaauccacccgagcgaacucuugcucacaaacacgugcuggaaaacagccaacaggcaauguugccauccgggcguggcuaugaaaucauuugagaggcugaggcaggaggacugccacuaguugggcuagcuagugaguuccaaaccagcccugggcuacagagugagacccagucuuaaaacaaguaagcaaauuaauuaauuaacaacccuaaacaauaacaaaacaaaaggaacagaaguaaaauacaauaaugagagcaagacacaaagguaaaggcugugaugggcagggcagggucaaauauuccagucucaaacuaagcaucccuauaaaaugcaguauaucuagagcuuuacaguggacucgacagaaagagugcaaggaacgcuuacuuaagccuuuuccuacauccgugcagaacuucuaacuccaauguuuguuuauccaacugaguccacaggcaguaaacugugagaaagggagacaggacuccaggagcuuugccuaucccuccauucgugcuucugcuccgguucucucugucuggaagagagcuacaugcauggcucucugcauuagcuaggcggugucccaggcgcugccgcaggacucuggguaccagaccugguggcccggguggaagcugguaucaaggccaacacugggcggggaaccuagaaccuagguuugcccugcuucaaagcaggucccgacuuccccacucugggaccugggaucuagggguguguaaaguggcuuaagaagccuggccguggucaauucuuacggaugccccaccggccaucccccaggcugccagcccaccggaagagagaagaaagacuagagaacggcggucagggcagauaugaugguugcagaagggcuggcuaggucgccgcccuuagagacccuccacaaagaugccagccccgccccggugcaaaagaccccagagacugcacagggcugcgcucgaguuugcagaugggcuguaccggcgggaaguuguggcaggcggaaaccgccgggacgccccaucuccaucccgccccacccgggcagguggcugcagcuuaccuugguggcgggguccgcgucagcgggaucuccagcugcucccgacgcuuccgcugcgggcccauggccacugagcuccagcucgcucggcgugucgcucuccgccggcugcucggggcuccgcugcucgguggaacugccugcacccauggcucaguggcuuuccuacucucgccggcuagccgucuuccugggaccgcggagaagcagaggggcgaggagaugugcgcccaggaccacagggacuaaggggugaggagcacccgcucuccacgauccugcugagaacacacccggacugagaaugaaggggacgcgcucguggcaaacuccuuaaaagaaaaaaaaaaaaaaaaagccaccucguagccuccuccccccuccuuguuuuucccucccuucaucacaugagcacagcccagacacgccuugcagcaucucccccuaggcugcuaggaccagaggcuccgacaccaggcccccagcagcccaccccgcccccagggcuucucgggucauuaaagggggacgagggguuuggggucugucccagggcugcagaagguucaggagcagcaaagaagggggcgggggcaaaagcuuuguuuuuuuaauguaaugauugauaacccaagguuggaucuucugcagacuaaggauuuacauuugaccaggcgggaacccaaauccccauuugcuuuucuucagguuggguuugacuuuaagcauuuguuucuagcuuucucuccuucagccggagaaaggaagcccuccugggcugcuccugagccuggccauauuagggcggcucacguggcaggagcugggaaacccagagguugaugcagucaggccaccgcugaggugggcccagcguccccaugaucccagccagugaugucagcugaugccaucaacagaacucgccgcccucuuuccccggggaacgcgcggggaaaugaagcuguuacuggaaaugugccuguccuuugagcgucugaugcugaagguuacacauccaggccauucgucucucucccgacgcuuaaacaccacauuggcuuaggucugcuuagucgccaucggcauuaucaaaacacgaagauuucucucguacuagcaaagaaagggccugucuguuuucuuccuccacuugauuaaauacucauuguauuaacauggcagccaauaagucuuaaauugaaauuuuguuagauuacccgucacuaagcauuaaaaugcuagggggaaaagaugaaaugaugucaggugagcccggugccaugauucgugucugaaauccugaugcuucaguggcugaaguuggaggguuagcuugagccugaggccugcaugggguagguagugagugaguuucagccaagucugagagccacaaagcgaggcucuguggaugagugaaggaauuagugauuuaaaaucaguaagagcauugaaucuagaugccagauaaauaucuugucccuagauuugauacagguuacuugaguaucaaugaaaacauuaauuuagcuaauaacacuugguccuuauucauggucauuuaaguguuuauugggaacaacucgguuuuucaggauaaaauuugguuucuccacuuauuucggaaggccaguuucuuugggguucauucauuuagaaacagacuuucaaguugcuuuuaguuauuuguaagugugucaccuaucucaauuugucuuguuuguugagaaagaauuucucacaaucuaguucaggcuagccauaaguguuguagccaagucucuggagggaagacaguauagacuugugagacugagaccacacccuacuucaauuuaauuuuugaauauuuagagaacauuagcaucuccccucccccaccccuuacagugcugaggggugggggauggaacccaaggccuugugcacucugagacaaacacucuagcuuugaaccaugucucuggcccaaacuugaaaguucucauuuuguaucagguacuauucaaaaaacaaaacaaagaacaaaaaaacauugcguauaucaucguauguaauccuuauaacaacccaauggcauacagauuaccaauagagaaagggaaggggauuaaccaaagaaggcaaauuuuuguguauccaaggauucauagucgguagauggauaugagggagggauccagugagcaugugacuuuaagguccacccuaguccuuccucaggaugguaggaacuuaaaaacgcugcugaaacagccuggguguggcuuugaugcagagccuaggauuaagggcauugaguucuauccccacagcaaaagcaggggagaacaauaaagucagcacauuugaaaauagaggaggaggcacuguuugucccaccgauuugauacaaauaguaucaacguucccccauuuugugagauuguauuauucaaguuccugggaaauucuucacaaagcuuuucacauccacuagccuugaaauguucagaaagauugcaaggucaaagauuuccagcuagcaguauccagucuagggcugaggaaggccuugccugggccugcuuggagcacaagcuguuucccuuaugcuuauuguccaggcuauaaaaauguguguuuucuuacuuuugaaaauuaaaaucgaggggaugaagaauugggccagucagguggugcaggaguccacaggacaugaauucagauccccagaucaugacaucuagugaggugggcuugugacccgcagucccagcaaggagaauggagaaacugggggauccuugaagcaccuuggccagccuggacaaaucagugagagaccauguuuaaaacaaaaacagccaggugugguggcacaugucuuuaaucccagcacucgggaggcagagacaggcagauuucugaguuccaggccagccuggucuacaaagugaguuccaggauagccagggcuauacagagaaacccugucucgaaaaaccaaaaaaaaaaaaaaaaaaaaaaaaaaaaaaaaaaaaaaaaaaaaagaaaagaaaagaaaagaaaagaaaaagaaccaaucauccaaaacaccuggagaacaaaugagaaaggcaccugcauagaccucuggcccuacauggccgcacauggccccaugugcaugugcacucacacacacacacacacacacacacacacacacacacaccacacaccacacuuaacacucaauaaaauaaggaaaacacaaaacagcuagaucagguggcacaccccuguaauccaagcacuugugagacugagacagauugugaguucaaggccagcauaaacuacauagggaaucccugguuuaaagaaaaaacaaaacaaaacaacccaacaagacaaaacuuaaaaaguaagauuguauuuuaagggaccaggugggcuggugagauggcucagcggguaugagcacugacugcucuuccgaagguccugaguucaaaucccagcaaccacaugguggcucccaaccacucauaaugagaucugacgcccucuucuaaugcauuggaaaacagcuacaguguacuuacauauaauaauaaauguuaaaaaaaaaaaaagggaccagguguuugguuuaugaucccaggaccugggcugaagugcauauuuaacaucuccagguucugccagcaucccucagcauucccaccugucauaccuugcccccaacucugaacuuuccagcccaggggcuggauugcccuuccccccagaggcuccucccuacauuauucaggcauuuuguucccacagauccccuucucaugcccccuucuacccucaccugagucaguccacacuuuuuuuguuuuguuuuuuuguuuuguuuucuuuccuuuguuguuuuguuuuguuuuguuuuguuuuuccaagacaggguuucucuguguagcccugguuauccuggaacucacuuuguagaccaggcuggcccggaacucagaaaucugccugccucugccucccgagugcugggauuaaagacaugcgccaccacugcagggccaguccacacuuuuauuucucucucuuacucccucuccuuucccuucccaaauaccuucaaggauacugguacaguaaacaggcucagccaggcuugguggcacauaccuauaauuuuagcaccaggcagccugaugcaggaggauucccacgaacccaagguuagccugggccacauaguaaguuugggguuaguuuggguuacauaacaaaaccucagaguuagggggguuuuguuuguuuguuuguuuuaaggcaggauuucucuguguaguccuggaacucucccucuuguagaccaggcuggccuugaacucaaaggggucugucugccucuguccccggagugcagggauuaaagguacacagcagcacuacccaguuagagaguuugccuucacugguugcucuggguuuuuccagguuagcucaggcuagccugggaccuuuaugggacacgaccuagaauuucuguuccucuugccuauuuagggcauacaugaaucacuaugcucaguuugguuuuuuguuuuuuauucagugcuaguagaauacuuguuuuguuuuguuuuguuuuguuuuucgagacaggguuucuuugugucacacugucucuccuggaacucuguagaccaggcugcucucgaacuuacagcgaucagccugccucuaccuccugagugcaaggauaaaaguuaugugccaccaccacucagcagguagaauacucucguaucuuaggguuucaugcgcgcuaggcaggcccuuuaacaaagugugcagcauccccagcccccaauacacauuuaucacgugccuauccuaugugaaacagaggugcuacuaugcugcccacccaacacuaagaugcaagucuacaaggucuccuuguguuggguuuuguuaauaucugaagauuugcugucuuguccuuugugguggaacaguaaggcagcuggcccugguuuccaccccucccucagaggcgucaguuacagauucugucuagcaggcccaggcagcacaggguacagggcgcagguguccuccccgacacucucccaugggacagucagagacuaagauguuuccccgagaggguuaauucucucaucaaaaacaguuugagaucacucaaaaacaaaugcacguugcaggaagagcaggcugaacuuguccuuaaguuuacuucuucagaaauucuggucacaugacauuuaaaagacaauguugaaugcugccugaacaccuugugugugcacucacaauuuuaaaggagguacaggccgaacgaagaagcuugaagcacucaguaccauugcgcuauucaauaggguggcaggcugagcgcaguaaacaagaauacauugcauagcuuaaaauagaggaaaaugugaauguacucaccauaaagaaaugauaagacguaaauuuuaguuuuaaacauggucucaagacuggggcuguagcucagcacuugccuuguaaauucaauucuuaggacugcugaaggagcagagggggaggggaaggagagagagggagggaggaagugagcauugccucuuguagcccacacuggucuccaacucgccauaucuaaggcuggcccugucucaccuuccugcuucuaucacccaaaugcuggugacacaggggugcuguaucauaccugguuuuaugcagggccacgggucaagcccaggauuuuccuauacuguagauaagcauuccccagcccagaacugaugaaaguuuaaggugagguguauacaaauuauccugaguugguuacuugaacagguauucacaaaucaaaauaucacauucgacuucacagacuucacaaauauauaaaauaaauuguauguaaauaugaaacuauauauaugaaaacagacauauuuuucacguuuuccaacucaagaugguuuucaaccuuucauaggaucaauuauuuacagagaacuaauucagucuaacugcaacuacuuuguccaaggacaguuuaaacugaaauaaauuaaauaaaugcuguguagggcucaugccuggcaccucagcacuuagacugcuaaggcaggaagauacccagagcuguaaagcuaaucugagugaauauaugagagaccgaccaucucaagaaagaaacaaggaaccggagagaugucucagccgguuaagagcuucuggcucuuguggagaacauggguugaguucccagaauccaagccgggacucucugcuaucuguaacacauauguaggcauacacacaaguggguacacacauaguaagugauaggugauucaaaauagaaugcauuaagaaaauuaaaagcaaaacaaacccaguagcuauucacaguaagggagaauuacuuuuaacuauaacagcucaugugacucuuuuguccuaccuguuugcuuucccacccaaucugucuccugauaaagaugcauuccugugggcggaucucuuuuuuaccaacuaguuuuaauucugguuuuguuguuauuguuuuucuucaaugacuucuuaucacucucacaagaauaaaagagaucagggugugguaccacagccagaaacccuagcccucgagagaaugaggcaggaggaccaaaaagcaagaucuuugucccaaaacccugaacuaggacuggagaaguggcuuggcugcuuaagagcacucccuguccuuccacaaguccugaguucaguucccagcuucaccaagagcaccucaaagccacccacccagaacccaguuccaggggacccaaugccucuggcuccugcacuuuguaugcauauacacacacagacauguacacauaguuaauauucuuuccagacagguuucauuacauuacucuggcuggccuagaacucauguguagaccagccuggccuagaauuuacagagauccacuaagugcuguaauuuaagggacucaucauuacauucagccuauaauaauuuuuuuuuccgagacaggguuucucuguguagccuggcuguccuggaacucacuuuuauagaucaggcuggccucgaacucagaaacccaccugccucugccucccgagugcugggauuacaggcaugcgccacuaccaccuggcuaaaaauuuuuuaaauguaaccauaacuacacuaaaguaaaaaaaaaaaaaaaauuaaauaauugggugugaugggucgugcuuagcauauucaaacuggaguuucaucuugaacacuauauacacaggcgugggguugcucaccucuuauccuagcaccgaagagguagaggcaggagggucagaauugagaaaccaggcuggugagauggcucagcucuuccaaagguccugaguucaaaucccagcaaccacaugguggcucacaaccauccauaacaaaaaucugaugcccucuucuggggugucugaagacagcuacaguguacacacauauaauaaauaaauaaacaaaucuuaaaacaaaacaaaacccaaagaauugagaaaccaucagcuauaagccaaguucaaagucaacuaguguggcaagacacccagacucuaaaaauaaauaaaauauuuuuuuaaaaaaucagguuuuuagccaggcggugguggcacacgccuguaaucccagcacuugggaggcagagacaggcagauuucugaguucggggccagccuggucuacagagugaguuucaggacagccagggcuacacagagaaacccugucucaaaaaaccaaaaaaacaaaacaaaaaaaucagguuuuuauggcagcacauaccauuaaucccagggggaggcaaagauaggcaggacuuugugaguucaaggccagccugaucuacauacuaaguuccaagcuagccaagucugcacagugagaaugccucaaaaaaaaaaaaaaaaaaaaaagcaaaacaaaacaaaacaaaaucaguaauaaaacuagauuuuccccuggccuccuuucuccccaucuuggacuucaucacaauaucccugggagcccaguuacaugaccccccccccaaaaaaaaaaccaaaaaccuccaaaauacguaucuuuucaaugcuacuguguucuugagaguugugugaaagaaauuauuugaaauucacuuucauuuuauuuuauuuuaugcacagggggaaugaauucaggacuucacaaauacuagguaagaacucuaccccugagacugaaacccgcagacgacgacgacuucuucuucuucuucuucuucuucuucuucuucuucuucuucuucuucuucuucuucuucuuccucuuccucuuccucuuccucuucuucuucuucuuuuucuccuucuccuucuccuucuucucccucuccucccucuuuucccucuucucccucuucuccuucuuuuuugcugugucauuuuaaauuuugaguuuauuagcuggcaugccaucguguucaggguggagcucagaggacagcucuguggacuccauucucuccuucccucuuuauggguucugggacuuuaacuugugcugucaggcuugaggagcaaguuccuaccucuacccagagagccaccacauugcuggcccuguuauucagguauuuguuuguuugugaaacgagaucucacucaggggaaggcugaccucaaacucccagugauccuccugccucagcuucucaaccuuucauuagaauuauaggugagaaccucugggccgaguuuggauuuuucuuucuguagcagaacuugaaaugccaauuauuuuauccugggaacuuaaugggcuucuuuccaagagcaaacgacucauuguugacaguaguaccuaccaugugguuacaauauccacaguacugaacacguuuggugguuggcagugccucacuaauguauuagugcuacacuguaaaugcagaauuaacauaguaggaacugcacuccgcuggaauggugcacucuuucuauucuggcacucaagaggcugagguagaucucugugaguucaaggccacccugguccacauauaaaguccaggccagcuagggcuacauguuaacacccuaucucaaaacagaacaaaacgaauaacaacaaaacucccaaauuauacaaaggugugguggggcucaccuguaguuccaguauccaggaguaucuugaguucaguuuggggccagucugggauaaccagcaagaccuuaucuggaaacagagaaaggugacccuuaccauugccucucugccccccaaucacugugugccuugaagcccaggucuuugcucccugaaaucucacuuccugucaaguagcugaugacuugcuuugggucuagauuaaggugcuacaucgcucacccucacugguagaaugcuuguucuacaacacaggaucaauucccaguacugaagaaaauguaacugugaaacacucacucucuuuguagaccaugcugaccucuaacucacagagauccaccugccucugccucccaagugcccagcugaauaucuguucuucaaugaggaauaauuaucagaaacauaugcagagacaguaaaauggcuugguggagauuuuuaaauaaauaaauauuucuauuagggccaaagaaaugguuuagcuguuaagagcacugauugcucuuucagauguccucaguucaauucccaguauucacauguggcucacaaccaucuguaaugggaucuuaugcccucuucugaugugcaugaagacagaguacucauauacauaccauaaauaauuuuuuugagacaggguuucucugugugacccuggcuguccugaaacucauucuauagaccaggcuggcgucaaacucagaaauccaccugcuucugccucccaagugcugggauuaaagacauguguccccacugccuggcaaaauaaauaaaucuuuaaaaaauggcuuccaaaaaaggaauugccaucaagacuguccggcugagugcucucccugacaccuacgcccacauguccucugaccuucaugaguaaaaucuaauagaaaauuuuuaaaaagauuuauuuauuguauauaaguacacuguagcugucuuuggacacaccagaaaagggcaccaaaucucaucacggaugguugugagccaccaugugguugcugggaaucgcacucaggaccucuggaaaagcagccagugcucuuaaccacugaaccaucucuccagcccccagaaauuuuuuuaaaaagaaaagggaaaugugauuaaucaaaguccauuugccuuuaaucaguuguaauuagucuaugacuugaccaacuuuucuuucuuuugagauugugucucaaacucagauccaucugucugugccucgccagugguaggaucaaaggucugugucuccacauccgguugugagcaguguuguuuugggucucaaguuugacuggaucucauuguauaguuaaauaugucccugaacuuugacccucuugagucuaccucccaaauacuaggaggacagucacaugucaccaagucccaaagacccauuucuuggguaugucuuuaaauugacuuguaaacacuuaaaaaguaaauauaaaacacuucggcggagggacagcaaaccauuaaaauaugcuuuuuuuuaacagagaaauaucaauuccguugaggaagaaaugcuaccuuuuaacacauugcaggggccacauuggagcuugguugcucgggauuauaauccuagcauuuaugaagcagaggcguaaggaauaucacaaaugcaaucuggucuauaaaaggaggugggggaccguauucuguauagucaacaacaagaggaaacaaguguuuuuuauaugcaauaaucagagaauuugcuaaaacaaacccaccaauacgccaaaguucuauuuguucuaugacaaccuuaaaaugacaaauuauagaaacuacaagauugguggugucugggaggguagggcuaggggauguagguguggcucuaagauaacagcaggauggucuccuuggguggagaacauuuaguuccaugguuguaucaaaguaaaggcgcuggcugcaguguugcuggguuuuuguaaaauguugccauugauggaacaaaagggugaguuagagcucucagagcuguuucucccaguuacaaugaacacaagauggaaaaacugucuauauauauuuuaucuauauguacauugcccugugugagcaugugcguacucaugcggggguguguguguguguguaugcacucaugcaggugcuugugaaugugugugugugaauucgugcaaauacacuagcugggguuguacgucaggguuacagaguauugcucuccauacccaacccugagcugggaugugaaccaagaugggugucagcagaguauuaauagguugguguuuguuuugcuuauaaacuguuaucucugaaacaaacagauuccauccaacacaaaaacaaugguuuuccugcccgguuguuacucccaggcuuggaguuacaauggccaccaagucacacaccugcaauuucccuggucacuauuuccacauucuccugcccggaaaggccucaaagggaugagacaaaaucaaaagcgaaggcagcuguggccaugcaagugccuauagucagcuuagaggcaucugaggcaggaggaucacuacuaguuggagggcagccugguuuagguagagaguuucaggccagccuaggcuacauucugagagccugucuuaaaaaaaaaaaaaaaaaaucuggaagucaagaaaccuugggcugccucuuugaaaucagcugacaucccaugcccagaacaguuucuucuaguucuuucuauaagacuaacucccuauguacugugcuaaggcggcaccucgguucuuuguaacauuucaguuugcauauucccacccuacccccaccucauuccaggcucacugugagaacugacgcugcaguuggaagcccauuaagccauccaccccgacucuguacuguuuugggcuuccuuucccucuugguuuuguaccauuccucuggggccugagagacuccagggcaaacaccaggucuccccugggggcugaccugagaaagcagacccuuuuuagaaacucgggcuuuucuugaucucucuggguccuugguagcuugagcagaggguccuggacucccaccucccccaagaaugguacagagaacuaaacccagggccuagcacaugccagcuggucaaggcuacuuccuuuugcuaugauaaagcacagaccugggcuggagagauggcucagggauuaagagugcugacugcucuuucagaggacccgaguucaauucccagcaaccacaugguggcucacagcaauuucccuggucacuauuuccacauucuccugcccggaaaggccucaaagggaugagacaaaaucaaaagcgaaggcagcuguggccaugcaagugccuauagucagcuuagaggcaucugaggcaggaggaucacuacuaguuggagggcagccugguuuaggcuucuggugugucugaagacagcuacaguccccuccacucccacccccaccugcacccccaauccccaccgaacucuuucucaccucuggccugcucagcuaccuuauucagcccaggcccaccug

SEQ ID NO: 5405 - RNA, 194179 nt, Mus musculus
uaugaagaccaaggguggcaucagguuuugaggcagaagggcuggccauacaaucucagggcaagggcucagcaccacgcugaugccccaccuccuaugccuugacuuucuggcaacuccaaccaaaagcuucacguccgcuggcccccgcccuguuaacgucacggccacuugguacagugcccccuaggggccucaguuccucccacgaggaagagucuagucuuuccugcugcuggcccuuuacugugccgcuuggcucucuggugccucccacgccagcccggggaagaacuugcagccgcaucucggcgccuggggauaaccagucaccccgcacucugcagcagcaugagcguccgccucccucuccugcuucgccagcucggccgccagcagcugcccucgggcccggcgugucgccuccgugagcugugucgcucaggcagcagaagcagcagcagcggagguggugaccccgagggguuacgcgggcggcggcugcaggauggccaaaccuucagcagccauggcccaggcaauccggaagcccccgggauggacuccaucgucaggugaguguccuguuugucuacaggcaggucccuagccagggacccaaggacccaauggcacucucggccgcugggagacccgagggaccguucguagggcgggaaacagagaaugcuugguuccgacuugcuagagacgccuugcgauuggcagagagggcgugggggcgaaggggaacguccggaguaugggacccgguagaugagggcaucccccccagccggcgcgcgccucacggaccgcacgccccgcuccacgugcaccgcccgccuccggcucugaugcaaccgcgccgggcguggcgccgacaggaaaagggcggugcggcccugggcgggagagaagcaaggaggauggcccuacaaucccgccacugcugaugucccacuacugaaggaggggcgggcuaaaccccuugcggaagcccucuaggucuaggcguacgguccgcuccggagcaucgcugcucagagagcacacagguuccggugcagcaguaucuggaaaguucauucuauauccgguggugaucugagcagagucaucuggucagacccuauagugaguuugcuaggccacugcugugcagaggcaccuaccugcaaagggcgggaaagcccuuuucugcuuugauucccaacuggggcuauggaaacaaaugagcaaaaauaaucugcccccaggggcugucacacauauaucccgcaacaaguagucauuauuuuuacaauaaacuaaacuaagcucuacaaacuugguguaaugagcaugacaguaaauacuuaagguucagugaacuaaaaagcagaauuuaaaauguuacauggguacguuuguaauaaggaaaaacguucucacaguuuuuugauaaaauccaacauuuuauggacacugacauuucaauuucaugugguuuucacgugcuaugaaguauccuuauuucuguuuuucuaccaguuguuuaaaaauggaagcucaggcuagggagacugcucaguuaaguacugaguaaaaguacuggcugggggaaacaugaagaccuaaguuccauccccaguacccaugugggcaugguggcauacucuugacaucccagucccugagaggcagagaaggucagaucgugaagcucacuggccagcccacacagcauaauccagaccaaugacagguccuguauccaaaauuaaagugagcaacuguugagggacagcauccagaguugaccuauggcguguacacacaacacacaugcaucagaacaugcauccuugaauauauaaguaaaaacauaugugugcaugcacguguccuuagcuaaauggguggcucugcuucagaaccagaggucagugcuuaggaaucggaugccuuccuucugcagugugccugugucacugggugugugagcagggacaagcuauuggucuuaccauguucaacugcaaauggagaucauaaugccaccuacuucaaugaagcaauucuaagauuuauacuaacccagcaaucugaaugugugugcuggagacagucugggagauccaguggucaugugagcuugaaacccagagucuuauuacugaaaaagaggaguugggaagacuaucuggaggaagcagcuggggucggcuuuauuuucacagcuauucuguaacauguaucugauaauggccaaagcaaagaguuuuaaaacagcucuccacuucuuugaccauggacccuuucucuaaacacuucuggcugucuuguguggagaugucuguagagagucggcucuguauuccuagaaggauccuuuuaccuaugaaagggcugagaaguuaaaugaggacuuuaguuaacaagugcucucggcauucugcaucggggaugaggaugagugugcauugaugauuuucuccuguuuucuccuacacuuggguguggucacagcuagccucagggagaaugaggagaaauacaguuguuagaacaaggcagcuuugugcugagcuccuaggcuuaaugcaguuagccaggcggaggugacuaagccggugguagaggcagaaacugugacaguaucacuaauaggggucacgguagugcaguaucacuaauaaggggucacgguagugccgagcuaagcuuaaaccuuuacccaccugucuucaguaauaggaaaauuugaauuuuagcuacacuguucccagucagaauugaaguuuucuuucccaagggcauagacucaucuuuggaaacauuucugcuacuuuuuggauguuuggggccuaggaauguucccguauuguuuaucgcggcaggcaucacagcaagaaauggaaacaacauguggccaguuguggguggccaauuauugccuuguugagccccuuuguguagcuauaacuucuuucugccccuuacuucaacuauuuuaggucgguuuauuucuauucuguguguaugggaguuugaucugcauguaugucugugcaccaacaaugugccuguugcccucagaggccaaaaaaggaggcaucuaaaccucuggaacuggaauuacagauaguaguuagccucuaugugaguguuggaacuggaacaguggcccuuuagaagagcaaguaaugcccuuaacugcugagucauuucuccaagcccuugacagcuaacuuaaaccaagugauaauuugucuauuggaauaucccuuucauuuuuuaaaaauuggggcuagcaauuuuuuaaguguaguuuauggagggugggcaaaacuggagggguuucuguuacaaauucuuauguuuaagaccaugaccaguaccugacagggagcacccugagggaaagguuugaguuuauaguucaaguggacacucccguagcaaaagcuugcugcuaggagcagaaggcacuugggcacauuguaucuggagucaagggaagcaagaguaaacagaagucggaccaggcuauaaaaccuucaggcgcacuuccuccagcaaggcuccgccuccuuaaauguccacaaccuucaccgacagcagcagcaacagcaacugguugucaaggguucaaacacaugauuauagagagguugcauauucauacagguaguuuuagucaugggaaaaaaagaaaaaaaaccaucccaacaauaaugaaaagggaaagagccaaugaaaccuauuauacaggugagaaagucggaacccauagauugccccccacccagcaguauacuggaggguugagugccagguauggcuguuauccacagaauauccacagggguuccagaacccccuggcacuuauuuaaaaugacacauuccuggaccccagccaagcauauugaaccagaauuucugagauggaaucuugauuuugauuaugcuucccaggggauucuuagagucagaagugcucggugcaguaccucccgcagaccaagccaacacauagacccagcuuggcccagagcucugccaggcugggcgacagugcagcaaagaaaccucagcacccaucccaggagccacaaucucagcuuuucagaaugguuucaccuauuaggacaacaacgagguuccacccccacccccgcccccacccccgccuccacccccaccccagccuccacccccacccccacccccgccucccagggauugaacugucucgucccaagugucuaagaccaaaaccaaacaaaugauuugcuaacagugcacaguugccuggccacuggcucucuuagccucuguggcauuaggaaaguugacucccaugcaaguuuuaaacucucuguggucuugugaguacccuguucccaguaucccuuggcacuuuccacuucacaguuccucagccaccacacugcaagguuugguuuucuaauggcaucugccugaggcuaauucauuuuugaaaguuguugggugcauguagucaauaaaggcauccugaagccaucagugacuugcaauacuugucuagcucaugugagaccccaggcuuacucugccaucauugggggggggguggcugaggggaauaauguguuaacacugaaacugggcacugcuugggccuuucaaucugcucugagagguggaaacgaaaagcagacugacugcuagagaugugccagugaggacauagcguagaggugaugguagcuuucagaaugacccaucuagaagguucuagaaagaaagucugucucugccauauuuauauaggucuguuucucucccagcccucacugggcgaggggucaagacuacuuggagaagaacaagcugccccagcaggguaacauugucuuuuaaaagauccccccacccccauuggcuacagcauccuaugccuuccacaccugcaacuuccugcuguccucccuccucuucugucuuugaauccuuucuuuaaacucugggagcuggaaucuaacuggaauuuagacaccauuucauugucccacacucaccguccacuuagccaucaccauuuucacagaccccucuccacccccaccauuuguuugcuuuucccuucagacucguuucuccugagggagaaguaaggcaacguggugaaagaaugagauuguuucgaauagaagcccagacuuucucuuccuucauuacauuuauuuguuugugugcaugugaguguguaagucagaggacaacuugggggaggagaggucaccucaguacucuucuuuuaccaaauggauccagggcaugggcaagugacagauugucaucaagcacuuuuacccacugagcccucuucacuggcuccaagcuugucauuauaacaaacuuggaaaacacaggagauaauuuuaaucuccucagaaaugaauggccacguucaguucuucugagucaggguuucaccguguagucuaggcuggcuuugaauuuacaguccucucaccuccaccucccuagagcugggaccacagcucugugccaauacacacugccugcaucaggaguucuuguugccugggugcucugcuuucccucacacucugaucagucucccucuguugucugauucacuuacaucagcaagcucuguaaggacacucauugugccuguccuaacuaaucauuaacaaggacaugacugugcuguguuucucucuccauauagagacgucauucacaauuccaaggaagugcugagcuuguugcaagaaaagaacccugccuuuaagccagugcuugugguuauucagguaaguugucagcguagcacucuuuuagcuuuuuguuuguuuguuuguuuuuuguuuuuuguuuuuuucgagacaggguuucuccauguagcccuggcuguccuggagcucacucuguagaccaggcuggauguaauuuagcaaaugcuuauaaacagaggccagacgcauggccugccaguggccagugcuguuacgugguuuucuucagcagaguugcagguuagacacaacucuuuuguagucaguuaucuuucugaggcauagguuacucauugaggucaggagguaggcaccguaaaucacaggacacagaacaguuccuaacucacauguacuuaaguguacuugauauggcuggcaagucuguucucucuuguuucuggggaagacaagugggcaauggcaggugcacauuaauguuugacaacuuaugugucaaaagccaugaguguaucagaggacuuggcauuauguguuuguccuuuggcugcugccccuuaguccagagcugcaguuggcacugugucauuggcauccuuguaugguggcaggugcagggaaauaacaggaugagccaggccuggaagcgauuuggcccaguagccggccuguuauugugaugcuuggcaggcugguccaguaucaggauagcacaccauguggccaaugguuccuugguuugugagauuguaggacugugcucaugugaccugcauccuuugggaaacuuccauauccccuccuagcaaggggacuugguuuggggacuuggaauccugggaaucuguugccauucaaccuaaguacaagcauccaaacuccugucuuuggugguucacacagcaugaugcuggcuuuguggccguuaugauguuauuuuuauauaucccauguuuuaguuacuuuucuauugcugugacaaaacaccaugacugacccuggcaacuuauaaaaggaagcauucgguugggguaugguuucagagacuuaaaguuuacuaccaagcaaagacauggagguaagaacuacugggaaauaacaucuugauccuccacuaggaggcagagagagacacuggaaaugaugcaagucuauugaaaccucaagcccacccccagcaauacaccuccuccgacaaggccacgccuacuaauccuucccaaacaguuccaucaacaggggaccaaguauuaaaaucuauaagccuguagggaccauucucauucaaaccaccauacccuauaacaugcaaucuaucguuuuuuuuuaaaggauauaauguguuagucuaagaaguuuauauguacauaacuccagcuguuagcccaguuuccauaggcauuuagagucuuuucaguaauuuuuugaucaucuuuuuuauucaggcuacuuguguucauugucuuugcaagugugaucucuguguuguguuugguacacauugugaagguaucucacaucaugacauucuccuuucugcuccuuuguccuuaggccggugaugacaauuugaugaaggauaugaaccagaauuuggccaaggaggugagagcuggcgauucuagcaauccuuuagaauaccuaaugauuuguucucuugugaugacagaaucuuacguuuccuuucaggcuggucuggacaucacucacaucugcuugccuccagacagcggagaggaugagguaaugucagccuagcucauuuccuuuccucaucgggacuaugggcaucuucugggguggugggcacagauccagccuucucuuguggcugaguuuccauggagaucagacaugaaugauguuuagacaucagcagucauuggcuaggcaaagcaucccaaagucaggagagcugcagcacuuccuuccugcuagcuucucugcaguauacugccaaaccaaagaugguaggucagcucuaccugucgcagucacauuugcaguagggucaaaagccauuccacugauaauggggguuguucaaaaugauuaucgauggauacagagacuauuagauggggaaugacacccagcagauagauaaaguugcaaguaguauagacccuacagcacugcauggcuucucucuggcuuaacaaagauugcugaugcucuuagguuuuggcaccacuauucagucaaagaaaaguuacauaagcaccaauagugugaugcuacugucaugcugauuagggagcucgugacuccuaagugacaaaggagcggccccauaugcagguguaggugugcuagacaaggggcugauucauguccgguugcuucuagaucucaccgugcuacucagugagguguacaguuucaaacuaaugaauuguuuauuucuggaacuuucccuugaguguuucuuuuuuuuguaacacaguugaugaagaguaacugaaaccuuggagugugaaguaaccuguagucuccugcagggcugggcagaaagguuuucauuuauaaagaggaguaagccuaggugugagaugagaugagggagcaccuuggugguaaucagccagccuguucucagggguuacugucuguguguucagccugagggugccccaggguucaggcaucuggaaagagaaagcuugaccaaaaguuugcuuucaaacguauuugguuuugcuugguuagugggaacuggcaguugguccagccagugaggaaaugggguugugcucuuguagucugucuuucuauguccuuaggaacuguuaugaacugagucuucucuagauccuauggggaaagguaauucucugaaguauacagagguugugggugaaggucuccacugccucuuuuccccagcaucucaaguaaaguuuauugaccugacuaauagggaaaagaauaaaggcaggcuccaugugcgugcucuucccucuaaggguguuuucugcaaaccaaaaauuugcucugcugcaccacuugcauugucuggcuacacugugaaagggaggaggggagaugaagucuuaaugccauuuagaucauuucuaaggaagaagggaaacgaaauauuggacaaacaguuaauacuguauuugccaguuaugcugugugccaaccaugaaggcacaagcagagacagaauccaaagaagcaggucggccauguccaggacacucaguguauacaggcacaucuucauuucuuuauacaguuucaauuguguagcccaggcuagccaggaaacacuaugaagcccagucuggcuuuaaacucauaaucccccugccccagccuccuaagugccaagauuaugguuguacacccaacauauuuuuauaaggauuuguccacuuccacugcuuuguuguaggggcugaaauuucaaugagucuggcauuauuauguugaacaucuuaauugauuaagcuuuuauuuccccaguuuuguuuugcuuuuauuagugcuuucccauucucgguccagauaaagcaagauccuuacuuuauccugagcucugcuuccauggacccacugaccacccucauccugugacucuucucccuuugaccugcucuguuuucuccuacauuaccgaucacuuucaggacauagauuauuacaacaauuggagaaggggcggggcuugccgauuagcauaucaugucuaccagaacaguuuugcucacagguagcugguaggucccuugcuuagaacucguacgaagcugaugaucagaacauuuuguuuguuuguuuuauuuaaauaugggauggcuggguauguacacaugaguguugugccuagggagcuccgagguaccugaucuccuggagcuugugagccaucugacauagauacuugggacagaacucuggguccuccagaggaacagcccgcugagcuauuucucuggcucccagcuucgcugaguuuguuuuaguggcagaacagcaacaacaacaaaaagucaucgaggcuuuaaaauacuuuggugaagacaaugggccaggaaugccagucucugcuauagacaucagaggcucccugauggcuguuuugagaccucuguguugucugcuacaagacucugcaggccucugggguuguuggaagcuccugauguguuacuauguucugaaugaaugucaccagcuagucaggaggauguuagauuaaauaaaucaguaggcagcaaguggcuauaaagggaauuagagacagcccaggaucauuuauucccagaucuccaacucuccacgaucaugauguucuaaccagccuuguagaaucuuuaacagguuccuuuuuuuuuccuagaaacuuccaguucacagcuaaaugaaugaggcaaauauucuuucuguaccaaauagcauuuuccuucucuaccagaugguaguaauaacguagauauuguugccaagcaauaaaauaaaaggggcaaagugacaccgucuuugagugggaugcacaugcaagggaucuuucuacuccugggucagugguucuguuaagugaaaugaaucaguccgagugaguuucuguccgaugccguaggaaaggcuccuggcacgacacuuggaccuagugaaccagagagcugugacugguuagaguuacuguugggaaaccuuuugaguaugugauugcuuggacccccagguuccauuggaccugguugagguacuuggcugcuuccagaccucccuucacacugggauguuugucucaaauuggucaucgucagggaauuggcuuuugucugcuaaccuggaguaacagugacgcuuuggguuuuuguuguaguuguucuuuuccaaugcauuggcaggaccucaggaacuaugaagcugucgaaaguuuuauucauccagguuucucuggggcuucucuaagcuguaaagagggaacaggcucuuugcuguaccucaccccagagucuucaauaagaagugaaaagaaccuaacagauaacaguuuuaggaaucuggguauguguguauacacgcacaggugcuugugugcacaucuguaugcagaugcacaggcguaucauagccagaagacaaccucgggagccagccguccuuuucauuugugguacagggucucucauuggcagggaacucacuuugcaggcuaggcuggcuagucaggaagucccagagaucuacaugucccuacuucccgagagcugggaucacaggucuauacuaucaaggccaaccauuuuuuuauagguuuuagagguccagcuaaagucaucagugagcauacaugucaccaaugugccaucucucugggucuauggagaaaucccuuuccuaccccaucaacuuuuuuuauuuuuacuaguucucacuuucacaaagcuaauguuuuucuguuuagaucauagaugaaauccugaagauuaaugaagaccccagagugcauggccuuacccuucagaucucugaagauucauugagcaacaaaguucucaaugcuuugaaaccagaaaaagauguggacggguaagaaauauaaaaggaaauaauuaauaguaaucaaucuuauugauaaguaacugaagugauuuaucuaaauuucaauuuuuuuguuacucaauaauuaguuagacaaucauuuuaaauaggcuuaggagguagagaauguuuaaaauuccgugaaugaaaguccuguaucuuggaaaauacgcaucuguuuggagagaauccugcacuaucguacuuacucaggaagcuccuguuugucugacugagucuuuggcuaggaauaaucuucccuggguaauucuacggaacagggaaaggaagacugagauaacaacacauguuuuuauuaauaauacgaguuucuaauuaaauguagagguggggggaauugugauuguuggguguuuuguggaaugccaugguaagauauaaguaucacaggagagugaaugccaucagccuacaguguggggagagaguguuuccuagagaguagaaacuccauuuucuuauauggaagcauaggaaauaauuuguccuguagcugaagcaauagggcuuauuugggacgauaaggucgggaacaaauuuauaaaguuagauuucugucuaguguauccuucagcagcugcauugaaagcuugguaauccucugaacuaugcuggauuauugcagucucucuuuucuuucuuacaaggggaagacaggcucaaacaagagaauguuauguaagggcugggcuauaauucagggggaggguguguguauagguaagacacuugaguucuccggaauauagauauggauggauggauagauuggauaguuagauggaugauaaaaccuccaauucuauagcagaguaaucaaagaaagaagauguaguuguggaccaggaagccccaaggucuuaugaggauauagucucagacauuucauacaaggacagagucauagaaaccugagugucuucauucugcuacuacagaaugagguagagggcaucaucuuguaaguucuuugcucuagacuugaguggaagaaagcacacagaagccacuguauagcaagcaugugcuuucuugauguucuccccucauuucccaaggaaauaaauacugaagccaaguggaaguugaccugcgagucucuagauugauagacucaguccugaggucugaaaguggacagcugauuucggggacuguuggagccauugaaagugucucugaaacuaggacgugaaacauggccuucugcuggguccuagggaguuuccugcauccucccagucauuccguguuccauuucagucaugacuugcugucccccuggaugauuugugauucacuguucucuugcguucgauuucagggugaccgacaucaaucuggggaagcucguacgaggugacgcuccggaguguuuuguuucacccuuggccaaagcugcuguagaacuuguugaaaagucaggucuggaaugaucaguucuguuuaucgggguuuuggcuuuguuuggguuuucaauaaggauuuguugcuggaagauucuaaaugaaacauaaagagaaacgcuauuuucucccuacugcuauuuagauaacuuuuuaaaaauaauaacuugcuucuggaaaauucuaauugaugucuuaaagugcuaucuaguguuggcuuuguuucucucagguuuuaauuugcauguaaauaagcuaacugaaaguauuuucuuuuuuuuuuucuuguuucuucuuuguuuuuuuuuuuguuuuguuuuguuuugguuuuuucuugacauuuuuuuuuaauuagguauuuuccucauuuacauuuccaaugcuaucccaaaagucacccauacccucccccccacuccccuacccacccacucccacucccacuuuuuggcccuggcguuccccuguacuggggcauauaaaguuugcaaguccaaugggccucucuuuccagugaugaccgacuaggccaucuuuugauacauaugcagcuagagucaagagcuccgggguacugguuaguucauaauguuguugcaccuacaggguugcaguucccuuuagcuccuuggauacuuucucuagcuccuccauugggggcccugugauccauccaauagcugacugugagcauccacuuauguguuugcuaggucccggcguagucuuacuacagacagcuauaucuggguccuaucagcacaaucuugcuaguguaugcaauggugucagcauuuagaggcaaauuauaggauggaucccuggauauggcagucucuagaugguccauccuuuugucucagcuccaaacuuugucucuguaacuccuuccauggguguuuuguucccaauuguaagaaggggcaaaguguccacacuuuggucuucguucuucucgagauucauguguuuugcaaauuguaacuuauaucuuguguauucuaaguuucugggcuaauauccacuuaucagugaguacauaucauuugaguucuuuugugauuggguuaccucacucaggauaaugcccuccagguccaaccauuugccuaggaauuucauaaauucauucuuuuuaauagcugaguaguacuccauuguguaaauguaccacauuuucuguauccauuucucuguugaggggcaucuggguucuuuccagcuucuggcuauuauaaauaaggcugcuaugaacauaguggagcauguuucuuucuuacuaguuggaacaucuccuggauauaugcccaggagagguauuguaggauccuccgguaguacuauguccaauuuucugaggaacugccagacugauuuccagagugguuguacaagccugcaaucccaccaacaauggaggaguguuccucuuucuucacauccucgccagcaucugcugucaccugaauuuuugaucuuagccauucugacuggugugagauggaaucucagggguguuuugauuugcauuucccugauaauuaaggaugcugaacauuuuuucagguguuucucagccauucgguauuccucaguugagaauucuuuguuuagcucugagccccauuuuuuaaugggguuauuugauuuucuggaguccaccuucuugaguuuuuuauauauauuggauauuagucuucuaucugauuuaggauagguaaagauccuuuuccaaucuguugguggccuuuuugucuuauugacggugucuuuugccuuacagaagcuuugcaguuucaugaggucccauuugucaauucucgaucuuacagcacaagccauugcuguucuauucaggaauuuuccccugugccaauaucuucgaggcuuuuccccacuuucuccucuauaaguuucagugucucugguuuugugugaaguuccuugauccacuuagguuugaccuuaguacaaggaaauaggaauggauugauucgcauucuucuacaugauaacaaccaguugugccagcaccauuuguugaaaaugcugacuuucuuccacuggaugguuuuagcucccuugucgaagaucaagugaccauagguguguggguucauuucugggucuucaauucuguuccauuggucuacuugucugucucuauaccaguaccaugcaguuuuuaucacaauugcucuguaguacaguuuuaggucaggcauggugaucccaccagagguucuuuuauccuugagaagaguuuuugcuauccuagguuuuuuguuauuccagaugaauuugaaaguauuuucuaguaagauugcauauaaaagcgauggcuccaaacacuagcauuuuaaacauugguuucucucaaggaacagucaaaauaaccgcagugaaaaugucuccugguuuagcaagccugucacugcaggugcagcuaaaucacagguggaccugacugaggagguggauuuugcacggaaagaguccaucugagaccuaguaacaagugggucugcuucgguaauuucuuacauucuuuuaauccucacauuccugugccaggaaaacggacacaaaugagucgccuuuuugauuaacuaauaauuacuguguguccuggcugguuuugugugucaacuugacacaaguuggagucaucagagaggaagaagccucaguugagaaaaugcuuccaugagaucuaacuguaaggcacuuacuaauuaguaaucaaugggguuggacccagcucaugacagaugcugccaucccugggcuggugguccuggguucgauaaaaaagcaggcugagcaaaaccaugggaagcaacacccuuccauggccucugcaucagcuucugccucuaggccuggcccuguuugaguucuguccugacuuccuccagugaugggcugugaucucaaagugugaacccaauaaacccuguccuccccaacuggcuuuuuggucacaguguuuugccccagcaacagaaacccuaacugugagauagaucauguauuuaacagcuuagcuaagacacugugagauagcugguguauuuaaugacuuaacuaagacacugugggauagcucaaguauuuagcagcuuaacuaagacacugugaguuaguuccuaacuugagaucacagaagcucaacuuggccccaguuugcagagaaaagaagcagaugccccucccuuagccucaaacauucaacagucaaaaguccaaagauauuucggcgaaguucuaauaaaaggcggacuuuccagauguaccuuuuagucagcagacaccagaauaaggucugugagaugaucugauguguccugcccugcaggucuuucuagaaacuccuagaggcaacuuacagcugguccuauauuuauaaggaacuguagaaacagagggagccuuaagacucaggaacgaaggguggaugaggaaacucuggauagcuacggccuucuugccaagugcauggucagcgccuguuuuuguuuguuuguuuuguuuuguuuugagacagggauucucuguguagcccuggcuguccuggaacucauucuguaaacaaggcuggccucagaaauccgccugccucugccuuccaagugcugggauuaaaggcgugcgccaccaccgcccggcuacuuucucuaauuuuuuaaugcuuauucuauuuuguucaagucuaccucuuauucugcucuaacuccucucagacgcuccacccuucaaucuuccuucuaauugcauguucuuuaagaaaagaagaccuacugaguacaauuaguguucacucaaaugcaugugugcuguccacuguagcauggccagccuaccaggggccccacuccugaagaauacggacuugcucuauccugguagcuaucaaccgccuguggcuucuuaacuagaaguggggccuugcaagaccccguccgugcuggacuguugaguggauugguccugugcuagcaaccacagcuccugggugaagccgucugucaccuccagaaggcacuguuuuacagcaaucuucccugaccucuaauuuuuaucauauucccacucucucuucugagguguucuccaagaaaagccacuuagaagauguucuuucagcuaaagggaccugggaggaaguuuucgguggugugaguuuuaauaucagcuuuucuuuggucgguagggaucacuuuggauggaaagaaggucuuggucguaggggcgcacgggccccuggaagcugcccugcaguggcuuuuccagagaaaaggaucuaugacaaugagcugccccugggcaacaccucagcuuccagacaagguaggucucucgugggccucuacgaccuuggcauucuacacuagagaagagggaaggcugggguguguaaagugagcacuagacaggaagcuagagguagagguagaucuugaaggaggaagacaguaaaaagcaaagucuguuaucguggcucguuucugcagucgaggcaggggcauaacaaaauugcagagagagucaaugcucggacccuugcuugccagcuuucucuucuuacacucuucuggacucccuuccacucugccuagggaauggagccaccuaugaugggcugggucuucauacacuaagacuacauuaaaaagcagcaaaagggugguuacaaauuaggggugguuacggcaaacauuuaguuagugguugcugucugguaaaaggcuuagaaaucaauaagacagugacaaucuauagaaaaacagcagauggccauuuauaggcauaugguaauagcugccuagcuccuuaugcuuaucagccaugcuagcaauaaguaaugacaaguauugguguuggcaaguuugugugaacacaagaacugacauaucgccguaaagauuucaaagagaaauaagcuuuuuaaaaaguccucuaggggcuggugagauggcucaguggguaagagcacccgacugcucuuccgaagguccagaguucaaaucccagcaaccacguggcucacaaccaucuguaaugagaucugacucccucuucuggagugucugaagacagcuacaguguacuuacauauaauaauaaaaaauaaaaaauaaaaaaauaaaguccuuuaauagaguuuaaggaacuuuuuugacccugacauuuuccugucugaaaaugucauagaaaaauucuuagucauauaaacaagaggccauagucaaggguuuggggagcuagcuuaauaguuaacaguugcauagugugcacugacccuagagcagcauguuuacuauacgaaauaggaaaucugaaagcacacccagggccaagaggagaaaggaggggcccaaggggacuucuuccuuuuccuuuuaguaauaaacuuacucuuguuuguucuucuguauugaaagcucagcucuaagguuggagagguggcucaguggguaggacccauugcuaagcaugcaugaggggcuaaguuccaaguuucagaacucacuuaaaaaucugggcaugauccugugcacccaucaccccagcgcuguggugguagaaacaagaggguccugcagccucgcugcagcuucauagagagacccugucugaagggaauaaagagcagcaggauggagugggacagcuauccagugucccccucuggguccaagugugcacaacugugugguugagcccgcaugcacacacacaccccacucauccuagaguaccagagaaaggaauggcauaacaguucugugggguuucuguaguccuucacauggcgcugagagugaggaagggagugacaagcgcucacccuucaguuugggagggagggcuggaugagcugcaccccugaggacugcgccccuccucuugcucuccaccuccaucucuguuccucccagagucagucagguacucaccccaggggaaucauugcugagcaugcuuccccggguuacaugauggucaggggagacagucaagucaguggacggcacuuaccagacuaccuggcucguaauuagggcucagaggguuggaacaaucuaucuuuuaaucuccuauuuucuuuccugucuccuuccuugacuuagagaguuccauguguaguaccuuuaauauuuaauguuuauguuuuuuuacuuguucauacugaaggaaaaugcugagugguuuuugcauaaguuugucuaugucuggguugggugaacuuuaaugaaauaauaucuauuauaaaggaaaauaagggaaauauguagcucaguugguagagagcuagccuuagcauacacaaaggccuggauccagucccuaguguagcaugccuaguggugcuggccugccugcaauucugaugcucuggaggcgggaacaggaagauuagacuucaagaucaguaagagaaggagcaaaagugggucuucgugaggcgauggaggcuugcuugagugggucuccucagcggcggcuggagucgguacguccuugccugagcacaucagcugaggcgucuggcagcaaacuccagcuccagaauuuggaaauacuacacaccugguuggcaccaaauuguaaaccacaggauggguauucagugggcaugagagauugagaacauccuaccacaccauaaaccuggauguagaucacuuccuuuucucuggauugaagucagagagcacaaugaggacaagaaauccucaaagaaagcggcguggugcagccuuaaauuccagacaaacccagaagcgaacucgggaaacaacuucaaccccugagguugccuuggaaacagaacccauagaacuuauggaaacuguuggagaugaaaucguggaccucgccuguaaaucuuuagagcccgugguuguggaccugacucacaaugacucugcuguaauuguugaagaaaggagaaaugggaggagguugcgccaagaccaugcugacagcuguguggugagcagugaugaugaggagcugucuagggacaaagacauguacgugacuacccauacuccucgaaacaccaaggaugauggagcuccuggacccaggcgcucagguacccucagguguccgaucugcauggauggauacucugagauuguguagaaugggcgucucuguuucuacagaauguugccacgucuucuguagccagugccuccgugauucccuuaagaaugcuaacacuugcccaacuaguaggaaaaagaucaaccauaagcagugccaccccauucauauaugagauguucacaacugcucaggauagaccaauggacagacagacagccuggcuuuucugcuugguaucugccuccaguuuccugagcucaaaaagacuuucaaaaaucaaugucugauguaaacuggucuuuuguuucccaaccccuuagauucuuuuguuaucucauuugaugcuauggagcacgguccagggaugcucccagaucagaucagcaucucugccccuuuggguggucugagcccagagugggaaaaaagaagucgggcauauuggaguugagcaucauggcuccagccucuuuauggagcuuacauguuggccaagaaguuucccuguugggaacguuugccccagcucuugugggugcagaaccuucccaaggcaccugucuguuagcuacucugccugccaaacagugaccuggccagacagcccaaauagcccaaggauaccagugcauaaacugcccaugaaaagccuaacuggugaacuuuuaguuuuccuucccaugagagcagaggagaccuaugacucugccugaaacuuaucauugguguacagcguuuucugcaaauccagugacucugcagggcgauccuguuuccuaagaaugagaaagugcaguaaaacccguucuucaccugcucuccagcagucuggaagcuguagcacugcugguauccucagcccagugucgccuaugggaacagugcucaucccaccccauggcuguucaccagcuguucucagggaccuacccaugcuccaaaguucguuuacuggcacagaacauucaaggcuaauaggacaagcaagcguuugaguguccucucuuuucuacaaagauguguccugcguugucuacagugcccuccaacccucaguuuuucaguucccacugccuaaugucugcccaagcauagauaacaggaggugguagcaguagcaauggccuuaucagcuguucacuuacauguuuugcccaagucaccguugcccaugugucagaggaguugcccuacucaaccuacacugcccuagcuuucccacaccccuugaauagauagguauucccaaagcugcuuguucuucuagccaguugagcuuugauccucuggacuuuuagucaaaaguagguuuuggucagcaaagcaugguggcucuuccagugggaccacguaacaaugucugcuccacuauauaugugugggagacucuggugcucacggagacagguggaaaauugccccuggggacaccaggcacagggcggcuuguaagggauaggccuugaaugccagccugccuccaccuccacacuacuuccuucaagccaaaccaauagccuuuuugugugaaacaucuuugaggugggaaagggaccacuggagcuuugcuagcaauaacugacuuucaguguaauguucugaaggcgcggggacucagcacagaauucacuuuaaauggagcugaaggaguggcccuccucuaugggaaaagaaaauaguuuuauucuucauucuggcuuucuagcuguuugacuucaguuaguuugagugagaguaauagguuuuucuacauggacucagaggguaagagcauugcucucaucauugugaugugugguauguguucuccucucccccuugcaugucacagccauugcgcucccugugggccucauggacuuggucuuguuaguucuaaugauagccagacuucgaagagacaaggcaaccaggcagccaguucaccaguaaaugugguaacacccacuuaaaaauguguuuucuccucaaggacgguuuaugaaguugaucauaaaaguucuauuacuucauccuaaauuaaacugagaacaagauguguucuucuaaucagaaacugcauuaauaaggaaagagugguauagaaaagauuuucuuuccuuuuuucuuaauguauauaguuuaacucuuuucuuuguuccguuuaagcuaugcucauagguaucagucuguuuuggacuaguauuaaagauggaaauaaaacaauucgaacuaaaaaaaaaaaaagaucacuaagagaaacuucccaacugcuauucuugauacucaugaguaaccguuuuagaguauaaaacuggagcaaaaagguugccaaccaucaacccuuaaccugauggugauugucaucuuagccaagcucuuuaccaggcugagucccacaucuaaaccuuugggguagcaguugacugccuucaaugagaaagggaugaagaaggaacuuggccaggcacugugaccaugacuguaacuccaguacucaggaggcugagucagggagacugguucaaaguuagcuuuggcugcauauauaagcuuggagguauuguuuauuuauacauuuuaauugagacuuuaacauuacuagaacauauauauucagaaaggaaacguggcuuguuuuuuuuguuuguuuguuuuugcuugaguguaugucugugcacuccaugcacauggugccuucagaggccagaagagggcgcuguguccuauuggacuggaguuaccgaggguugugaaucuccauguggguccugggacucuugaacccaggaccuuuagaaaagcagccagcaauccuaauuacugaaccauccuuccaacgccaagcauuuggguucuguucuguuuuguuuuguuuaagaaguauuuauguauuuuauguauaugaguguacuguagcaucuucaaacacaccagaagagggcauaggaucccacuacagaugguugugagccaccaugugguugcugggaauugaauucaggaccucuggaaguacagucaguguguuuaaccacugagccaucucuccagcccugcauuuguuucuuuaucuuaagaaauugcuuuaaaaucagguauggcccccuuggccuguuuucuuaaucuggacauucgauuuguguuauccucauguagugagugacuccaucaaauacaguagggacagcagagucuugauuggaaguucuagcucucugucaguuaccgggaucaguggcgccugccgguauucagugggaaaugccacagcaagcucuuggaguuauagacggcaccauccugagugguacagugaaccccugaaccucccgugcuuucacucuugcaucccacccgaggugaauuaucucugucuggcauagcuucacacugugagccuacccaccuguuugucacucagaggcucuguuggguccgaucuaguguggcaaugugauagcuaaccauugcuuuaauugauaagaaccccaagacaugagaguggucaagcugguaauuuggaucuagcagagaagcccaaagagaaacucuaaauggcuuccuuugugugaaaaagugcaguuauacgugugccuguauaccgcggucuacauaccauggucugauacccauggucuagauguaauuaguauaaucuggcuuccagaaccggucaggggucuuggaauauacucuugucccagaauaaugagugcugcuacaugcagaaugauaacuaaaaauacauauuacuuguucuaagggauagggaguaaggggcagguuagagagcccuacacggagggcaggggucuugcugcuuuuaagaaugcgcucuuugacacacguggaagaaaccuguguauguuuucaguagucgccacacgggggcagccuacucaagcaaauucaagaacaacugacuugccucgcccugccucucccucucucauagacucaaaccuugugcuugcuuagcuuggcuaugacugaguuacagccccuauuuugcacgcuaagaccuagaguuucugguuuggaagcagucguggaagaggaaaauaagccuugcccaguguuggacagcugcggcaggcagagaagaugccuucgauguuuucacagcuggccggagacuuuggcugguuguauccguauuuuuugaaaaacaaagacauuuuuuaaaaguccuuuuuuauuaugaaaguaaaucaccuagaggcuucuguggagugaagcucaacccgacucugagaggauuccaaagcagugguuuuucuggagaauauggagacggugaacguuccguuuucugcauaucucagaagcuucuguucaguaauugcuaugcauuuuccuccuuauuccuucacgugacggcagaaucguggagaaucagaaacacuugauuuuagcccagaggccgcauguguguugauguguaugagugcgugugugugcgcgcgcgcgcguguguacgcaugcgugugugugugugugugugugugugugugugugccugugugugcgugcguguguguguguguguguguguguguguguguguguguguguauggguggguguguguacagacaagaguacaaccuuagguguuauccucacaagccaucugcccuaugagacaguguccaucacugaccuggaauucaccagauaaucuguucuggcugaucauugagcuccuggggagucuguccgucuccaccuccuccaugugggauacaagcacgcaugcaccaccuuaccaggcucaaguacucaaacuuaugagccuaugggagcccuucucauucacaucaccacagaggccuucaauagagcuaagcagaagccagcaccaagcucuugaaccugaaaaacuagaaaccaacucaaccaaucuccagucucggguguuucguuacaguaacaguaaaugaacuggagaaugaaacugaaagguaaugcccugcauccgcuccacgcuuucaggugcauugagcauugcacagauaucagagcaagggggggggggucagcugaaggcuguccacgcugcuugugugcuaaugaguguagacccaggucuuggccauaugcauuuuagucaggccaaggggcucccuucaccccagccccgccuuuucucacuuuucuccacacaaguguaucuucccaggucccuuggcagcagagggacagaucagacagacaaggcauguguguuuacauguguguugcauguguguaauccuauuguugggaauuugacugguccccucuuccccacugagggucucaccuugguccccaacgccauccagagcaagagaugcuucugccugggugcuuaugugcaagcggaccccggugcuuggaagagagaaauuguugggcacugcagacucugcucccuugagagucacacugaagucggggacagagaacagcuggaaguugcaauuggagucaccuccagcuggguugaguccacuggaucccagcugcauacggaagaaaugguguagacgucagagauggguuugaauuucauuuuucucugggagucucauuucucuucauuucacagagacacuuaaaaacaacaacaguauuuauagaaaaaagaaaacaugagucuuucacauuugaagacucaaacucuuaugucugagauuuugaacccaaacuacauuauuacauagcuuaaauuuagcgcacaguaugccuaauaaaggggcuuuaaagugagcagaaauuucuaaauguauuguggaguggguggauguguguguguguguguguguguguguguguguguguaaggauagggauagauagagcugggaacucccagccucaaguggacugggucacugaauuuuacuaacugaucuuuucacauguagggcaacacuguaaacaaauauaaucaguaugcugcuugcuuuuaguugaguggcugcucucacuuuacuugaguggcuggugacagccaugcacuguccuuugccuagauugucuucagugauuucgagguucauacccuuuuggacaggacuagcaugcccaccauaaagaaacugagacucaagagagacuucuccagaucguaacaguuaagaacagacacuuggggcuggcaggauggcucagcagguuaaaagccugaggacccagguucgguuccccccaccccacacucuucuggcccacacagauaccugcaugcaugugguauuugugaacucaugcaagcacaccuacaggcucauaaauaagcaaaucuuucggggaagagaagcuaccauauauacccccucugugcgguagcauuuauuccagauguuucuaugaguucaaucucugaacccaaacacugcccaacucagccaccaggacccaagccuuggguugagcuuacuauuuuaucauuccagcucuuuuuagggggggaggcuggggguugagacaggguucuccguguagcccuggcuguccuagaacuuguuuuguagaccagacuggccucaaguucacggagauccaccugccucuaccucccgagugcugggauuaaaggugugugcugccacacccaacuccccuccuuccaacuuugugauuccccagagacaaucuuguaacauacgcagucugaaguagccugaagguaacuccuucccccaggcuuugggcuugccagagcucucaggcucucucuauuaggaaucagugguaugugcccucugaagggguagagauggcaccucgucaggggugcugacguggugccggugaugugcaggacgggggccauauaacuucaugcuaagugaacauccgguuucucaggagcaugcguggaccccugggaugguggccacuaagcuguguuuagcgaagugcauucagauguuggcauccauacuuuucacggcgauggcggccuggucacgugacuugucaacaccaaagaaggagcugauuggacuucuuaagccaauauaucagccuguguugggaaggggauuugugagagcacauugaagcgaguaagcgugggcucaaguggaacccuguaaauuagguuugaucagcuuuggcugggucagaaugugagccgagacucugaaaugcaggcaggauugccacauugaccucaugaggaaucuguggggcaggacccgcuuuacagucacccccuacucaaaugcccacccuacauccuauagguaacuuauucugacuucagucuugguggguggugccgcagaggcucgaacauggaaugccuucuucucagacguagaguuagaaaugucggcauaacgguucgcuggcuucggaauacaguuuaacaaaucaggaguggaauuguguugcuagcgguugucucguucuccgugggaaaccuggaucaggaccgagauguuucuccaggccgugguuuugguucagcuuucagacagcccgugucacuuugcagccaccugugucacaccccgugucaucagagugcacuguggaaguggggcauacacagcacugcagagccccacugcaucaguccugcagggcucugagccugugaucugcagaaaacagccugggugugucaccuucagucuacuggcacauggguuguauuucccucauccacaaagcgagugguuucugaggacaaaauaagaaaucuaauggcacacucuugucuguuuguauggagaguccauguccuagucuuuucuguaugcauguaagucacuagaaaccagagccuggagccugaccauugcugguaaagcagggucuaggcccaaguccaggugaugugacuccaccugcccugagucuggauuccucaccucucaggggaagcagcuaaggcccagagagcuccuccaagagagcagaugcagaaaugugaucugcagaugugcagugggagacugggaacuagaaaguguaaauguagaggcucauuccccacagccccggccauguacaugugccucgugugugcacgaagacugugguccauguaccaggccauguacaugugccucgugugugcacgaagacugugugguccauguaccgggccauguacaugugccucgugugugcacgaagacugugugguccauguaccaagccauguacgugugccuccugugugcaugaagacugugugguccauguaccaggccauguacgugugccuugagugugcacaaagacugugugguccgcaugaaggugcaucugaggcccacccugcucugaagagccuucaccacaacacacucccucuuccuccccuaucuuccccucucccucccuccccuucucccucccccucuucuucuuccucucucccucucucucucucucccucucucucuuccccuuuucccucucccuuccccccuccauccuuccuugucccucuacccuucccucucccuuuuccucucucucccucucaccuuccuuuaccucucacccucccucuuccccuuuucccucucucucacccucccucucccagucucucucuuuccccacccuucccuccucuuucuacucccccuuucccuucucugcacgacauuuuuuuuuuccucaagaguugaagaaaauaaucauuuuuaugaucucugaaagcauaucuauuacugaauuugugacccguuuuccuucuugguuuacaucaucucgccugacuuuuaugguggugguggugguaguguguguuccuguguguguguucguguguguguguguguguguguguguguguguguguguguguguguuuagauucauucuuauguuucccaggcuggccccaaacuugcuuuauagcagcaguucucgaccuauggguuaugacacccuugagguucaaaugacgcuuucacggaagccaucuaagaccaucugcauaucagauacuuaugauucauaacaguagaauuacaguuaugacuaacaaugaaaguaauuuuaugguugggggucaccacaccauaaggaacucuauuaaggggccacagcauucgaaggguugagaaccacagcucuauagcgaagggugaacuuaagcaucugguccuccugccuuuacaucccaaguuuaggguuggagaugugugcuacuaugccugauuuuauggaacguggguucccuguaugcaggacaagcgcaauagcaacugaccuacauccccagcccugucuuaacuuuuggauauaugacauucacuucggaagagaguaauugucuuuucuagcauuuuugcacauaacugaauagccuagauauguaauaaaaccaugaaguaagaguugaauuugggaacgcuuaggaaaaggaaggucauuucuuauccuucgggagauguugcuagauaugucauaauuccccguuguccguuuggcucacagucauucugcuuuaugcaauaagucuuaagauuuuuaaaagccaguaguguguuuuacugaucacaagagagaguagacaacugaaauaaacucaauuccugaaaggaagaaaauuccugcacagugagaucacugggugggcauggagcggcggacaaauagcuucugcucgcucaguuuccauccucuguccugccgaagccugacccugaacggaaccucuugcacacugacacccugacaucugaacggaaccucuugcacacugacacccugacaucugaacggaaccucuugcacacugacacccugacaucugaauggaaccucuugcacacugacacccugacacuuuaagucguuucagcucacuucaggauccuuguuuuacuagugcaggaaacauggucgcugacucacugacugacguagggcauagccuuuugguguuugaucagccugcuucaggugagaucaggcacguucaggguggaauggugcuggacucagcuaauuucagauguuaggcauucuaaguuuaaaguuuugugaauagucagggacucugcuaaugaacucuccauauguagccugcgagugagaagugugccagugugguugccaugguaaaauuacccaucaguuccuaguugccaagaauguauuuuuggcuucuagucugugugacuacuagggaugguacacaccucggccacgccccuuucucuuacccugcaaggccacaccccuccuucauaacuccauccugcaccacacccucuacauuuucccauccuuagcuccucucuuacuaauuagcaucagugacccccaaagaucagccuucuaguucugccuuugcucuguguggaggugacucccacguuucccuccguucccuggagaaucucaguccccucagaugucucagugucaccugauucuacuucccuccuucugcccauccuaauccugccuccugagaaaucucccugagacccaucucauacacuguauaccuguccgaccaguuucuguuacauuuucuaugcaacaaugaaacauuuuagaauuacaccuuaaguggaaaagaagcgaguuucgauacuuugaaaucccuggcuugcugcucuuugagaauagggcacaauaagugaguauucauagaaauuucaaaauuguuguuuuaaagcaugagaguugacaaggaggcucaggucacaggucucaaagcaacaacaacaaauuuuuugucucuugcuguuaucuucucuguccugaggagauggagcaaaugaauuguccaucagcaggugaaugaguaaugaaaaucugguguacacucacacacacacacacacacacacacacacacacacaggaugggggagggugauuucauuucuagauucaaagaaaaaugaaaucacaaaauuugcaggaaaauuuuggauggauuuagaauauauaaagcuaacugaggucauccaauuucagaaagaaacccuacauuuccucgcaugugaauccuagccuauaguguauacauguauauguaauguauacauguauauguguauauaauauauacauguauauguguauguaauguauacauguauauguaauguauacacguauauguauauguaauauauacauguauauguaauguauacauguauauguguaaacaaauguaugaggagguacuguaacgcuuagaaaggagaagaagaaaggguaacuaaaaaaaagaaagaaaugcauacuagugaauucacggauauaauauacguuguguauccaaaucccugucuguuguugagaaggcaauagcaauuuuggaaauauuaauguuuucuaaaauaaaagugacacuuuaaaaaaacaaaaaacaaauuuggaguucuuuucaggauagugcuaagagguaaggagggcgugcccauaccacagugugcggcaggaaugcuguggucacugcuugucuccuuacaauggagagucuaaaguggauccuuacaggauacgaucaagucagaggccauauacauuuggcuggcccucccuguccccuuggugugugugacaguugcuggcugccacaggugcugacuggacaccaaugccuguccaaacauuaaauagugguaggucuuacauugcaaaugccaaguggaaagaagucucuguugaacaccuguguuuccucccgucucagugguuugcccuacguccccagccugaagaccccagcucugcccugggcacucaggggcagguucuuaccuucaugcuaccuuaaaaaaugaaauaagacgauuuucaaugaagauuucuaagucccauuuagucacacuauucguauaauuugaaaaguauguuuuuguuggggaaagcgguuaucuuuuaaaauaguggucuucauuggaacuuuuauauucuuccccgccccccuugcuuuuucgagacaggguuucuuuguguagcccuggcuguccuggaacucacucuguagaccaggcuggccuugaacucagaaaucugccugccucugccuccuaagugcugggauuaaaggcgugcgccaccaccgcccagcaaacuuugauauucuuaauuacacugguaacauucaagugauguagaaggauauuucauaacucucagguacuaaaaggcacaauucuucuuaaaaaaaaaaaaacuuucaacuuaaaaaauuacacuccuauuugcuuauugguggugccaugguugggggauggggguaggaggaaguggcacacaugccccagcaugcauguggaggucagaaaacaucguacuggagucaguucucuccuaacaucaugugggcaccaggaauugcacgcagacuucaggcuugcuggcaggaggggcuacccauugagccaucuugucagcccaucagcuguuuggggcuuuuguuguuguuugggguuggggggcuuuguuuuguuuuguugcagggagggcuaggggagggggcagcuuguuuaguuuuauuuguucucaccuuaaucuaucaaacccaagacccacauuuauucuccuucaaaacacauugcuagaaagaccugaugcgucccuucuagcccaaugauggcgcugugguugcugugguccccugccuuuaaauguauuacgucugcuaaagagagugaccaaacccucauggaaccuuccagaucacaucugccuucuucccuccuuauuugaugccccuccccacagggaucacaggaauaguuuccguguuaccuaaaccacacggcacccacaugcuccccguucauguccgucuaucugugucuugcuauuguuuuaacauuugguccucugccuggggagugggugguucucuaagcuacaccacuucagucuccacagagaaagcaauauuuuguuaugagguaaaguuucaagccaggcccuggccaggaccuuucccauguggggagauggaagggacagccagggagacgguaauucuccuugagucugagcucauuaaaaccuuacccguccucaguggguuauuuauugaucuaagcaucuagcacuuuuucuuuccagaaacaauuagcaucuaugcugugauuguggcuagggguggggguggcuuugucccaucugugcgggcauuaacugcccccugguugcuuauuggcacagcugcuuuagagauguauauagauguauauauguagauguauauagauguauauauguagauguauauagauguuuauauguagauguauauagauguauauauguagauguauauagauguauauauguagauguauauagauguauauauguagcugaggagcuggaauaagauucccaagauuuauggguaaugaagagaacggguuauaucaaagacaccacguguaggaaucagggggcuuuagggggcugguaugaagcuaugaucccuggcuucucccaaaaugaacacuucacugugcuucuacacauccuuucaauagguguuuuaacauauucuggucuugcagucuuuuggcaagaacgccuagcaaaaugauguuucuuaucugcugcucuggagccaggcuuaaacguuugcauugccuuugagaaucacugugguugaauuuaugacagucauuuaaguauguaaaugagaaauggcuuuucagaacagauguuuacaaucgucuuuccagcagaacacuuccccuacacauaacaucaccagcaagucuagcugcuucucagaucugucugcagggaucaugcacagcuugaaccagucagacugcuggggcugcuggcuccacgggccuuggugcuguuuaacugugucaugacuguguagccuggaggaggaagaauggcuaguuaggcaauuguuucagcagagauaucucuuuuauucuuucuuuuuaaguuuuucucacuuucuuccucuuccacucccucccucccuuggugagcaugcauguguggguaugugagugugggugugucacuagaguguguugcaugcucaucugagugugaaugaagccacagaaagcaugugaaggucagaggcucaguuuuccccuuguuugacauagaaucucuuuggucguuugccagugcaugccccagucucgcucacccacuagguucuggggaccucgcccugucuccaccaccuuacuccucauuggugcgcuugggucacagccacauuagcagggccaguuaugugugaguugggggauuugauguugggucccagguuugcauuacaaguucuuuacugacugagcuuuucucccaauccucuuuucuucugaacauagauaauccauagaggaacaauucauuaaaaugaugcauauguagccuauacacugagguggcuaccgugaugauauuuuuaaagcuccguuuucuuuguaagacacguuagucauguucugcuuauccuaagauaugcuugagggcuggagagauggcucagcgguaaagagcacugacugcucuuccaaagguccugaguucaauucccagcaaccacaugguggcucacaaccaucuguaaugagaucugaugcccucuucuggugugucugaagacagcuucaguguacauaaaauaaauaaaucuuuuuuuuuucuuuaaaaaaaaaaaaagaagauacaagccugaauagaauugguccacaauuuuaguucacguccacaguuuggaaugaagcucagggucuuuuauuaaaauugucuguuacagccgggcagugguggcacaugccuuuaaucccagcacuugggaggcagaggcagguggauuucugaguucgaggccagccugaucuacaaagugaguuccaggacagccagggcuacacagagaaacccugucucaaaaaaaaaaaaaaaaaaaaugucuguuacuuuggcaucaucggacaucugaaguuacuccugucuuucugcuauagauuaaugugugugauuuuucucucuuuuaugccuuuuagcuucgagaggcagacauuguggucuuaggcucaccuaagccagaagagauuccugcuguguggauuccaucaggaaccaccauucucaauugcuuccaugacuucuugucagguagaugucuucaccuugauggggcaggacagugacuaaggcaggucagaugacggaccuugcuucuuugggagaccacauucuugagaugcuggcugcuauaggcaugaggacaagagacuggauuguuggugugccuaccuuuggggcagagguucucaaccuguggaucacgacuccuuugggaguccuaugacacuuuuugaaucucagauaucuugcauaucaaauauuuacauugggauucacaacaguagcaaauuuacaauuacaaaguagcagugaaagucauuuuaugguugggggaucacuacaacagggggaacuguauuaaaggguuauagcguuaggaagguugagaaccacuccuuuggaguuuuuugauaccagguucauauuaugagcagagagaaaccaagaagucagugaggugucugccccaaaugccucuggugaccucugguacugacagacaugacaacugggaccuuaaggacacgcgugagguagacuagaaaugguguucuuuauacucuaaagcacgguggagucuuuucuuguagaguauucuuggcaacagcuccuugggaaaggguuggaggaaauggagcugccaggaggacuagcauggugauaaacgguguguucucagagcucuccucacagggucccaugaaacauucuaccuuuaaaagcacagagagcaauggagaggguagaggcacaggagagagacagccauguguguaggagccccucaguuucuucaaaacacacuccuguggcgcaagggcacucgccaccaagccuggugaccugaaagcagucccaaggcccuacuuguagaaaaaagaaucacaccuccacacacacaaaccacagccauggugcacgaacacauaccacacacacacauacuaaauacauaaauguaauuuguuuguuuguuuuuuguuuuuucgagacaggguuucucuguguagcccuggcuguccuggaacucacuuuguagaccaggcaggccuugaacucagaaaucccccugccucugccucccaagugcugggauuaaaagcgugugccaccacgccuggcuauaaauguaauuuuuaaaauuaaaaguuaaaagaauaaaaugcaugguuugcaagacugggggguuguagcucugugguagauggcuugccugacaagcaugaaacucugagucccaucccuuguaccccaaaaacaaaagcccauaaaacacacauccuauuaccugcagacaugcauacagcuuuuauuuguccccuaggaaagcagucucuagccuauaaaucaugacagaggcugauugggcucagaguccgaguuagaugaagaacuugguuauaauacccuccuucucaaagauuuuacauuuucugcaagauuauuuaccugcugaguuuuguuaguguuuauauugagaacaguuuggacacaauuguagcuggagacagaaaucuacuucaauauucuuuuggacuaucuuuaagcucuguaaaaaaaaaugauauauuuugugucaugaaaacucuuuauuuuuaauguuucuuuuagagcucuuggucuugauaaugcuuuuucuaaagauauuacauuuuuaaucccagcacucaggagacagagacagguggaucucauacuuguaggcaugacuggucugugugccaagccaaaggccacccaagaacuauauaguaagacccuguuucaaaccaaacaaaugaaugaugaugaugauaauaauaauaaauaacauuagauuuuguuggagaguuggcaugagguuaauuauaaaauucucuaagaauaaacauuaaauauuuuauuaaaaaaaacauuaguuuucaauguuucaguacuaggaaggacauaaaagacuagaagccuucuacauugauuuaauuuucuauaaguagaauauuugcagcuaguuucuuuuuaguuugucuggucccuuuguaauuguuuccuuguugguuuuggaaugucacgugaacaagacagcacuuggccccguagugaacacacaguggaggcugagcagugaccaugagcagguaaagccacguaaaacuaauggauggauuguuuggagucauuuuuaaaaaguucuuuuguuugagcgcuaggccagaauuuugaauacacugugguugggugaaggugagcgucuuuaaugagguuuucauccucauuguuaucauugcagaccccccuccaaguccccacauagacaggaucuggggguuauggugcgguaacucugcagaggcaucgauaccuaauugauaccuaccccuaggagagcuuuuuccugaugccugaugcuggugacauuguguucagaaaccagaccugacaaucaggucuuucauuccacuguccaaugaacugaguaugugaaauuuagacacagaaauucuacguucuuauucaggcuauaaaaucaacuacuuuauuuauuacuuaaaacuauuuuuaaaagaagaaaugcugugaucuugaagcacuuugacugugaaaaaaccgacuuugcccuaaguauggccauuuuguaugccauguuggaagauguaggaaccuguguacugauugggauggagaagcuggucuuuaauuuugggcccagagagcaucaaacagcagcaucuuuggguuucaguguuauuugcagagucuccucuugcugagaaaggaguaucuaguguggagugagagaagccaugagcugucuccagggcucgguaagaaaccgggugauccagaggaaccaagaguuuuuuucccuucuguggcccugaagggugacaguuugauguacaggaaaggaaagggcauauauggauuuaagguuaugccacucaaagcaaagacaaucauuuuguugguugugagguuuuauuuuguuuuuaagacagagucucauuguuuagccgaggucugcuuugaacucucaauccuccugcaucagcuuccagaggcugaggguauaaggauauaccacuaccaaaccagacuuagugguuuggaucuuuuguuaagauuuauuuguuuuucuuuuauuugugugugugugugugugugugugugugugugugugugugugugugugugugugcgugugcaggugcucccugaagugugagacuuuagauaucccuggagccagagccacaggugguugugaguuauugugaguucugggugucaucaaaacccggucuucugccagaguaauacauguucuugacuucugaguuccaccugcccaccaccuccauacccugauuuuuuuuuuuaacucuuauuuauacugacccucuaggcuguguggcuuugaggaaaucacuucaacuuuccacuccucauagauaaauagaacugagaaacucagcugggaaggacaaaaggcguggugauuugggggcagugacuuuagcauacuagcuaccagugaauguugguucacgcucugcaccccucccucucuaccauauugccagcacacacaggccgugacuucacagcugcagaauguaugcauguucuuagaaguuauguccagggaaguaagcagggugggagauucuaaaauacugugguggcagcuucugagaaauugggcagagucaggcaggcuucagucacccuguguguuuggaaugagaugaggaugcaggcuucugacccuugagcuuuauucugagacccaugucuguauuagcuggcucuccucuucuccuaggucugucccugagguaucucaccaauuuucuaguucaaauuucaauuuguucucaguacaucuauuuacuuuuaagggauggggacguagcucaguuuguagagcucuuaccaagcacacguaggagccuggguucgauccucaccuuggcauaaaaucugaugugaugcacacccagaaucccagcacugggugguggaagcugaggaccagaaguuuaagaucagccuuaaauacauaauguccuucuccaaacaaaacaaaacaaaaaacaaaaaugaaauaaacaaaaacaaaaccauucagguuaugcauguaguguauugauuccuccuuaguuuguuuggucuuagagguugcaaaguuauauaggauaauuguaauguuuacauuauuuucauuucuucagagcuuucucuuuaaagagugugaguuguaugcucugaugugaugggauucacauggugggaaugaugguggccacucucaagggcacugucucaaaauggggcuagaggguuucuucagaggcaacuuuggguauuuguugcguguauuuagggucagggccgguucucugcagaaggagaggauuugaccuggucacaggcuucuguuauguuagcccugggguuaaggcgcccuccacucaggccucucauccuuucacugaucccugcugcuuucuucaaaaauuccucccgauuucuggucccaucacgccauuguagucuugucuggauucauuucucuucauuuagcuguccggagacaggaaggaagagagggaaggagggagggagggagggagggagggagggagggagggagggagggagggagggagggagggagggaggaaguuaguucugcucauaccuguuuuucacaguguuccucguaccuugaagucaucaacggguugguuuaagcauaccaacacuuuuccuaaccacaucacagucucucuuucccugagcccuguguugugcaagauccuaaaaugauaaaaauccuuuacugugcaacugugucccuuauguucugggaccaugcacuuacagauugauagcaguccccggaaugucgcugucuuaauuccccauugcuaaaaggcaggagaacgaacaguaccuguuuuucuucuucuucuucuccgcaguaguuggacaggauuuuaagaacaggucucuagugguuaaaggaaagcaaaacaaaucucucccaucuucugacucuucugcccagaugugaguuauagagcugaaauauugcuaaucuuuaaacuauagaugggggaugugguuuuuuuccuacacccugauugcaugugacaacagaacauuacagagcacauacucuuaaguguuuugugcaauuucuuguaaagaacugucagcauaguggauaauuuaggagucaaguggucccgaaacccaagaaaaugguuucuuaauuaaaaaauguugcuauuaggaguauuuauuuucccauuaagagaugauacaggccaaagcauuuuacauguguguuuucuuuuaauaaauguuauaauuguuaacuaaaggagggaaaaguaaaauucuuauugaugcuucccaaauuugaaaaacagauguauuugucagcuuucugccccugugaaaaaugacugguaaggaagaaagucuauuugguucaugguuucuaagaguuuaugccauguagcuuuagcccugugguggcacacuacauccuggcuggaauggggacaaggaaaccaacagaaacuggaagggccuggugucccagugucuccuucaaggccaugaccccagcaaccucgcuuccucccacuaggucccaccuucuuaaaaugccaacacauucauuuuaccagagccacaggcugaugaaccagcccagaccccagaccugaaacagcaucacguaaucccuaagauuaauauccuaaagcauaauugcuuuugauagaaauuaggccguauuucugacaggaauuuucuuuugauaauucaagcaaacaaacaaacaaaacaagcaaucuauggacuggggcuauaucucauuggauaaaaugcuugccacaaaagcauacaggccagaauucagaucuccaucacccacaugaaagccaggcgggcacagcaggcaccuguaaucccagcgcucuggaggcaggacgcuagccccgcagaacgaguagcucuagcaucagcaaugcgcccugccuccacaacagagagugaccaaggaagacacucggugucaaccaagcucacgugugcuugaacacgcacacucgcauacccacauguggacacauaugcacacacacacucuugcacacacaugugaauacauauacaugcacacugaaaaaaaaacccacaguuacgauugguauaguggcuuacaccuauaaucucagaaauugggaaguagaggaaagcagaucucugugaauuugaggccagccuguucugcauagugaguucaaggucagccagggcuacauacugagucccugucucaaaacaaaacaaaaaauccacaguuauuacuuugaaaacaugaauauaaauauaaaguguauauauauauauauauauauauauauauauauauauauauuuuuauauaaugucuucuuccucugucauuguuugauaaagaauucacuacauuugauuucauuuaauugaauauauuuuacacauauuauauaaaguuauuguuauuguuguuguuuuaugaccaaaggaagcuugcucucuucacagcuuuaggguuuauccuguaguuguuuuuacuucugugugugccgugugcuugcaaacaacuucacuucugcuauugcuuuacggcgauacuguaaggguucuagguucugaagccccacugugucccaaauucaaauguuggguagcacauaugucugguaguuaaaaugaauauccuguaugguacaccucguggacccugcuacauuucaguucacacaauccuggccaguugauuuuauucuucguaacuaacaacccaaguggggcugggucagagguagagaugugagucuguauaggccaugcugccucuacagugaauaucauggaugucuuugggugugggaguggcagaggugcggggccuuggacccagggccucaagcaagccaaacaagcacucugucacuaagcuguaucuccauuccucuuacuuuuaaaauuuugagacagaguuggacucucuuccucaggcuggcccugaaccugcagugccccugcuuuggccuccugaguaacuaagaugacagacuaccagaccaaacuagaguugucuaaagccaccauuaucuuaauaucucucuauucauucuuguguauguuuuugagacagggucauacuguggagccuagacuuugugguguagucuaagauaguuucaagcugucuauuuuccugccucaguuuuucaaguguuggguuuagaggcugggcugccucauccagcuaauuguaucuuugcuuuuguaggucacagugucacacuugggguacuugacgaacccaugccuggauguuuuuguguccuucagugugugauaucugucaagcauagugugccuccguuuauccccagguuaacagcuuagagggacauugacaucccucuaauauaaaaauacaaaauagccccagcugagagucacaaggcugugccagaggugacuugccuauagacauugauuuccugaccucccgacuaacuuuuuuggugauaacugauggacaccgugauuccgugugugggauuuuuacagagggcaauuguuuauuacugaaaauauguuauaagccuuuuuccauucaauguguuugcagggaagcugagcggagguucuccugggguccccguggacaaacucauugcagaagagagcgugagucuccuugcugcggcucugcgcauucagguucguuggacgcagccauuugaguuugggcuuaguaguaguugcuaauguuuuccaaguguuuucugccugucggguggaguuuuagacacugcacaucuggggucaaagagccuucugaugggaggaaauggguacuuacuugcuuuuuacuugccuaccaucgcaugaugugugcauggcagaugcccaaagucgugucuguggaaugcauuaccucucaaauggaccaacacaaaaacuugaagcauguauugacagagaccugggagcuggcuagcuucaagccuuucaagugguugaaaucaagaugccagacggggcuuggucgaggguugagaugaagaaucuauccaagaggcuggggagaugguucagucaaugaagugccugguccacaagcacagggcccggacuuugauccccagcacccacauaaaaaagcugggagcagcggugugagccugucuucucagcacgggggagacagacaggaggaugucugagacaguacaguuguagguucaguguggaccagagagguggcucagugguuaagaggcugggcugcucuuauagaggaugcagauuugucugccagauggcagcucacaaucaucuguaacucuaguuccaggggauccaaugcccucuucugacauuccacacacauggugcauagaugauacauguagggaaaaugcccaauuccccccaaaugcccauauaauaauaauuuaacaacaacaacaacaauaauaauaauaaugaugacauauuauaaacauauguuggaaaacauuagaagccauccauguugccaguucugacuuuuauguauaaacacacaauaaaucuuuuaaagaauaaccauaucuauagucuugguaucucuugugaauaguuaagcuguuuuaacagugcaugugucuacaagcccauaaacaaagucuauaaggcuaauugcauguguaucacauuguugcuuauaaccugugauaacugucugacuuggggguucuuuggccucuguaagccccuugcagucuuccuguaguugaugugggggcccugucacccucacgucuacaccaucucuuucccccucucuccugaagaacauggugagcagcggcaggagguggcucagagagcagcaacaucgaagauggcgacugcacugcuugaaacugcagccucucucaccugugcccagguaggugaugcugugcuuggcugguacuaauggcggcucaccccagggacacguaucuuuggucaguugcugacuggcauaacacaaggcuuuugaguguuucuuuaucugaaacauggucccaggcugaucuugaggaagccauaggaagcaagccagugaguagcaccccuccauggccucugcaucagcuucugcuccagguuccugcccuguuugagucccuguccugacuuucuccaaugauggauuaugaucuggaagugcaagcugaauaaacccuuuccuccccaacuugcuuuuuggucaugggauuuugucacagcaauagaaaaccuaacuaagacacuuuagccacgaagaugagauaaaacaagauucuagaagcuaaggggaggugagaagagaaauagaaaggucuaugauggugaccuuggggggaggggagugggaauugccuuaaaggaagcucagaguucagccuacacuggcuugaagcaucacuuucuccucucagcuucucucauacccucuggagcaggagggaugcagcuucuuuaccaauuauccccuauaccaaggucagacugcccugguccucuguucugaagagaauuauagaguuguauuggggcugagcaggaugucaacaguagcaacagaagaguugcgacugaagaguugccguuagcaguguguguguguguguguguguguguguuggugggggagggugguuuccuuccauccucaaagacuguugugucucaaguucaaguucauugcccucucucgugcaauguucuaggcucuaggaauaagugugucuucaguccucccucucaggcagauguucaguggguuggaagaacaggcuggccccaaauaagagagacagggcauguuggccacagcaguguucucugggugguccacaguacacacauuggugcugagagccccuguaauaacagcaacgguguacucaccucagucaagucugaugcccagccauccuccaaaugaagguccugacuuuuuucagucugagauugaguuucgaguacugcauccuuucacgagccauuacauaauuaauaaaauauucugaacuauuauuuuuggacugaaaaugugaaagggagaaaguauggauggagaugaaacaaaaaagcauuuccauauuucugaauagccaagagacacuuuggcuagccaggugagaaagcaucaugugguagccgaucuagccucugccucacagaacugugugcccaauaauggguuuaccauagccauaguaugaagaacacacuuggccucugccugugacauggguguuaaauuugugccugacaccauucuagagucuuaauacuuuaauaauauuuuguaauacuaucucacaaagaaagggagggaagagucacuuucucaugcaucuuaauuguuagcaguuguguuuaauucugccugggaaaagggaccgcaaagcaauuggguugauuuaaugguuggcagggugugcggaugcuucucccucgagcgccgaccaccuaagcugaagcgaccaccuccgucacgcuucuucucucucccuccagugauauugagauuucucgaggacagacuccaaaagcuguggauguccuugccaaggagauaggauugcuugcagaugaaauugaaaucuauggcaagagcaaagccaaaguccaauugucccugcuggagagguuaaaggaucaaacagauggaaaauacgucuugguugcuggguaagacucuacacugacucuaccaaggagacguguuucuagaacugucuuccacauuuauccauauuuaucucuguccacacaccccuuaaguacauugcguucuugguuuugacccuguuccuuuuugcgucaauugacaagccucuguuugucaugagguaaggcuccucacgccagcagagcugagggaaguaaucucuauucuguacauagaguaacaagcugcuaaguuugcuguuuugcuuuuuaauuuauuuuuuagcuugugaugcugagacucacacccagagucugguauacgacaggcaaggaaggucucuaccacugacccacaucaccaccaaaacaggagugcgguggcuucuuuugacggugcugggucaggacuucauguaugcuaagcaagugcuguaccacugagcuacacucucagcuccagugcuuuauuauucuugcccuauauccaguauugcuccucaggguucuuccaccugcuaccaagucauguucuguagcucaggaugcccuugaauucuucaucccccuuccucuaucuucuacgcgcaggauuacaagcauguguggccagucccagcuguccuagacguuuacauuuaguuuuccaugauuaaaauaacaauuagaagcacauuauuuugaacuguguaaggacuugaggaacaugucauuucauauucuacuuaaaauuuaagauaauuuugggaaauauauauucccuuguuaauguccuugguaguucauugucauauguggaccuuacaaaacauuucaaacuaagguuggccauuuuccauuguauugauacaugaaaaacaaauugauacuuuuuaugaaaggggagguuuuuguuguuuccuuuuuaaaaacauauuugcuaccugaauuauucagccaagauauuugaacuauucugacauuaaguuacauauacucuuguguggucuugcaauuuugugugauugacuguugcaaaugauggguacguggauaaguagguggguggauggauggauggauggauggauggguggaacgaugcaugcaugcaugauauuuagauagauagauagauagauggauggauggauggauggauggauagauagauagauagauagauagauagauagauagauagauagauagauaauggugaggcgugaagcacaaaauccauuuaucagggagcgacauuucuuugcuguggauuugacuucuaguuaacuuagauugacuuaguuauccacgugauugcuuucugcuuucauguuguugguuguuguccuggucgaguugguugguuuguuuguuuugggguggggagguuguuguuguugguugguugguuuuguuugguuuggggguuuuguggggaaguuuacuuuuuuuguuuguuuuuugucagcuagagucaucugggaagagggaauccucaacugagaaaauguccccaccacauuggccuguaggcaagucuuuggggcauuuucuugaugaauaauugauguggaagggucuagccucuugcacgugguaccaacucugagccauguaguccuagucuguguaacaagccagcugagaaagacaguaagcagcauuucuccauggucuuugguucacuuccugucuugagguccugccuugaguuccugcccugauuccucagugauagggugugccugagagcuguaagaugaaguaacccuuuccugccccaauugcuuuaggauuuuaucauagcaauagaaagcaaacuaugacaguuauaaaaauaauguagucucacuauaagauuuuaaaaaaaaauacugaacauaaacaagagaauaaaauaccacaauuuucaccacucagagggaacaguucuucaggucaggauaguguucacacugauaggccccuccuuaaaugaggucauaccauguguguucggugguacacuucuaacagugagcccguacacauuacucuucucauggcccuguggcaagcaucccaguguuuacaucugaguuccccaaaugcaugugaugcaucuuucuauugccucuagcuucauuguucccccauggugaacacguauuaaugacggcucacaacuacuaguauagagugucucuaauucuucuagugcagggguucucaaccugugggcugaggccccuuugggagucaagcaaccccuucauggggucaccuaagacuaucagaaaacauggauauuuauauuacaauucauaacaguagcaaaauuacaguuaugaaguagcaacaaaaauaauuuuaugguugggggucaccacaacaugaggaacuguauuuauuuauuuauuuauuuauuggguuuuuuucaagacaggguuucucuguguagccuuggcuguccuggcacucacuuuguagaccaggcuggccuugaacucagaaauccgccugccucugccucccaagugcugggauuaaaggcguacgccgccaccacucagcuaaugaggaacuguauuaaaaggucacagcuuuaggaauguuacuaaccacucuucugguuauauugagacaggaaaauggcuugacaaugugacaaggaugcucuacaauugacaccucuacugauacacauuuccacuguuuccaaguuugaggucacuauaaacugcuaaaguggauaacacuggauaugccuaucugugccuuugcccccuuaggaauauucuucagaaacuucuggauucuccagaggggaaauaaguuguagucaacuuuuacagucucccaggggauuaguuccaggcagcuaaagacauggaaaucugaaguucacgucccucccauaaaaugucauaguguuuguauauaguuuacauguaaccuuuuauaaacauuaagccaccccuagauugcuuacaguaguuaauacaguauaagggcuaugcagauauuuauuaaacucucuuguuuagcgaauaggacaaagaaguuuguacuuguuccauacagauuuucuuuuucuuuuuccaaauaauuugguguagccccucauuguuuguggcugcuuuggcugccagcguuugcacuaccuggguuccuuucuaaccugagagcccagccuucauauucguacaucugggcauagagaugucgauccuacccucagguacccuggauacccuaccauugagaggaguggcaggaaggacucggucguuccuuccuccugcuucugaguuuggagcaucuucuacucguuugcuuuuaggcaagugugcuugauggaggcuugcaaugaguaagcacauuauuggacacugagauauuuaaaagcaucuuagagauaggaaaggugacauguaccugcgguauauacaaucauccgugaucaaaugcugcguucuauuaauuguuaugcgccgcgggaggagcagaaauggcagaagcauauugagggccauugcagaguugauagaaauucuguucuaaucccagaagucuaaugacuguuuuuaaaugaaacucaaguuagcaacucaaauagcaauuuuaaaaagcaaacacagggcuggagagauggcucagcgguaaagagcacugacugcucuuccaaagguccugagaucaauucccagcaaccacauggugguuuacaaccaucuguaaugaaaucugaugccuucuucuggugugucugaagacagcuacaguguacuuagauauaauaauaaauacaucuuuaaaaaaauaauaaaaaaagcaaacacucuaacacaauacaaccuaaagauacaccgacuugauacuuaugcuaaaaaugaccacugaaguacauaacuucccuaaagaaacacauacaccccuuuaaaaaugugucucucuaauacauggauuugccuccguccuccagaauuuguauagcuuugguggguuucacugaguuuucucgccaugguucaguucaggagacugggggcaggaguuggcccacaguucuagagcccuugcccagccugugugaggccuuggguuuacucuccagaaccuucgggguaagauccaaggaucucaggaggaaugugucgucugauaauaaaggaagauucaugaagcauuguuuccucaugaaguggcagugauacacuucaucugggacuugucuaauguagaaauaaagcccagcucuagacguggcccugccuugagcuaagaacggaguugacaugucuuuaaccaaagcuaugaugauaucguuaucaaguucccaacgagggaguuaaaccauuagggccuggccuccagccacaugcuagauccagcuucuuaagucuggagucaugucucaaaauguggcuuaagaaaacaggacaauaguaagggauuuucgaaugcguagccaucagaaauuaauucagcauaaagcacauaauauaccugacaugucuuuggcagugcgcauccuugcuccaucgugugucuugaauguacgacaucugugcugggcacaccaucacaccacacaacaccaguuaaaauuccugaaacacgcgagcucacacuuucagcuauguauacagaguuuagucuuaugauagaaaugugcugguuuaauuacuggggaaaguagacuuuugauauuuaauauuuucuucccauaauuuuagcguauaaguaccaaguugguguaucuuuaguuguauuguguuagaguguuugauuuuuaaaguugcuauuugaguugcuaacuugaguuucauuuaaaaaacaaucauuagauuuuuggauuagaacagaauuuccacuaguuucuacaauggcccuacauacccugcugccagguguuuuguaugacauauuuauacaaaguaccaugugaucacugaugauuauuaaaucaaaaugccuuucaacucugaaacauauuaaagaugcuuuguguucuguaguauuaaauauucauugacuauuuuauauaaaaauuggcacaucacuuuccuuuuuaauaaauuguaaauuauauauucuaaagaauugaguuuuaaguuuauaauuuauuauuaauguuugaauggcauacucguuuuauauacauaagauugcacaaaaaagucuugguugaaagaauucacaacaaaaguagcauuaagcagccuuguguuaagccaugcuuaguacagugcaccuuuaguucacugcuuggaaugcagagguaggcagaucucugagugaguuccaggacagccuggucuacagagugaguuccaggacagccagggcuacacagagaaacucugucucggacagaaaaagagacagagagacagagacagagagacagagagagacugagagagagacagccagagacagagagagacaggcccugugccagagacugcugaccagcauggcugcucacaccuucacuucaguccauccucaguacacauugcucuacuccacacuagccccuugcuggcaugacucuguguagcccaacuggagcuagcauacaugccauguuguaaauacaacugcaggcugaacucugaguccucaagagcagauuaagcagcagaagagcaacuguucuuuuucggaaacuaugucuuaagcccucucacuucauacaacuguuagagccgcagugaauggggucuuccuuucuccucuauucaaaaccaaaccaaagcacaaaacagcccaugaacugauagugaugagugcagagcaucccaggcagaaaucuacugccucuagagagccaacaccacacuguauucuauaugaauaaacaaauucaggagucaggugugcugcaugccuuucauccuagcccuugggagagagauacauagagaguggaaguuuagggccagccugcuccacacagccagucccaggccagccauggcugcauagugcgauccugucuuaaugaauuaauucuccuucagauacaauacacaauguauucgucaauguguuaaauagcuuuggcagcugacugacauuagaccuaguuauaaucuaaaauagaaacuaaauuugacauaaaagucaccgcccuaauuuuacuuuuagucagaugaaaagccagaggaaagugauauuaucaacuauuacaugcacuguugcaguuuuuaaauauauauauaaaugaccccuaaauuuagaagagaauuauuucccccuuuuugaaaaucucuuuuuauucugaaaaauaauguugacguauugcauaaauguagcauaaagaaaaaucagaaggcaauaacuuaucucauuacucgggaguggguuuuuucucuucuauuuucucucaguauuuuaccuuuuuacccauccuguuuacacuuaaaggucgaccuauaaauaauguuuguguccugucuuuuccacugaauucuauaaugugaauauucucccacacuuuagaaaauucagauacccagggaaauuuucaagaaaccuaaauugccauacaucccauacuguacaucucaaucuaauguaaauguggguuaaaaauagcaacacugagaugcaaauaugagagucaagguuuuauuuuuuaaauuguuaauaacucaaaugcagaacagauucacacacacacacaucuaucuaaaccauccuucagacuguaguguucaucuucucugggaaucaucugucucucaucagauacacaucucguacuguuuacaccuacauguggcugccucuauuugcuucgccugacaaaauuaaaagucuugggcgcccacggaaauacgccagaagauucugagaugcugaggcacucuugaguuuuuaguauuuucccaguuaccuuagugaaaaggaauuuuguguaaggacuugacauggguugcagcugguggccuuuugaguguaucuugggcccuguagaagauucuagaguuuccgugaauucaucagacagagucguuuuuaaaaguccaaacugcucugugaauuucucacuggaggaaaauaaagauccauugccaaaguuuuguuuucuuuuuagagugccaaauaccugauuuaaaugucuuuagugcuucaaccuguguguugcaauuuagaaauaacuacugacuuuguaagagguucccuuucucccuaaguagccaucuaagcaucugugcgggguuuuguuguuguuguuguugucguuguuguuuguuuuucaaguugaacuaauggcagaagaggagucgggucacuaggagaaaccaguaccaacagagccuuugaacucuuccccuccgucagcuguagugggaagcacaagcaaaugggcugucacguuuauugucagauaguaaaggcuuuuaaaacccuuccaaaucauaaagaugccuggggugagugauauauuauauuuauagcuguuugcacauguaacuuuggaguucauggucaggcuauggcuggcugguggugcccuguuugauacuguuugacaacauucaagauuuuaauugugcuucaaaucuucaccuccugucucugcguaagaagucccucugacauuugaauaaauguccuuccaguugccacaagagcaucuugauaagucucuccugucguucacagugaacaguacuuaaccaaagaaaaggcuucaugguaaugucagaugcuuuuuguuguucacgggugcccuaggcaggggacagcgaugcaggaaguguggccauuuuccuccccuuagcaacgggacaugucagaauucuuauuaucaugucaucuggaaggucauaaaaaucaccugauaacuguuguagauuuggucaagcaacaagaacuuggagccguugagaagaacucacaguuaaauucccauauaaaaaagaaccuucacagaggcagaaagaaaacugagcuuggaauuacuccuuuuaagacaaacuugaugcuuugagcucagagcuacagauauggggaaagaauuaaaccaaauuuugauaucaaauacagagauggggcaaauaaauuuguguuauagcucuccuuuuauugcuuccaauaaauacuuccuacuuugugauuuuccugccuuguguucauuggcagcaaacugagcaauccuguguuuccaauuaagaauuggauggauggcugaaguuugaggucaucccugggcgugucuccuucugcucugccagcguauccuugggagagaaaauggaaucccccaugugacauaaggcacagcacuggucccucccuugcagaaucuuuaggugcaugcagcaucuuugcaggaucuuugauucugugggcuccucaccacuuucauucggguuguaucuacaaaaguaugaaguugacucggagucuuguguaacaguuuccacuuugacuucacucaaugcugugcuauuuagacugugaccugggcauuuccagcuuaguucaucaaguagcauguaauugggucaucaaaacucucugccauguagugguucacaguggccaccucgucauccuccuccugcuuuaguccuggaugacucuucaccucuaaauguauucugucuuucuuagccuccuucugagcuaucaugcccugccuccuucuccauguuucugucuuugacuucuuuuggucucuucugccuauuucccuaaaggaaaacccauccaauggcucuagccuuacuuuugucauugcugagcgaucucuccccugggggaaucuuguccuuugaacuguugacuauagucacaauuucacagacaagggcauagagagcagaaccuugucuucagcucgcuccgcauuucaucuaggcaccauuuaucugguggucaugucccagcuuagaugccaggucuggaggaagcuccccuugauguuccagagcaugugaaaccaaaugcucuuaauacggugccuguccugauuccccaacuugguguuuaucacaguugcuguaaucacuggguuaucucugucucccaucaguuagaaguccugggagggagacauagagucugacaugaucgucuuuguguuccaaggucuggcccagucccugacucaagagagugcugaauaaauauuuacuauaggagugacugacugaucgagucaccgggguguucugagggaucugaaggcaugccuuccuccuuugauaacagcaccagauuuuggagguuggaaaacucugucauuagauuugcuauggcugaguuuccuagacacccugacucauaccauuuaacucuaaauguauucugucuuucuuagccuccuucugagcuaucaugcccugcuuccuucuccagguuuccgucuuugacuucuuuuggucucuucugccuauuucccuaaaggaaaacucacccaauugcucuagccuuaccuuuguuauaagagcugaaccaacucuccccgggggagcuugcccuuagaacugugcuccuuaaccacugagccaucccuccagcccugguuucaacuuuguuaauggcuagcuuugugucacucccaaaaaugaaccucaucaacacuguuaccuaguaacuuuccuuuuggucauguugccuuucauuuuugugccugugacauuagcuugaauguggucugugugcuauaccugggaacacuccaagaaaccaugguaucaaguacauugggagaacgcugcucacugccuacaaacucaaauuugaauuugaaaucucagcuugguuuuacuaagguugucuugggaagacaauucaauucaucccucucccuccuccccaccaaauuaggaucacgcccaccccgcucggagaagggaagaguacagucaccaucggacuagugcaggcgcugaccgcucaccugaaagucaacuccuucgccugucugaggcagccuucucagggacccacuuuuggagugaaagguacuuuccuucacgacuaagcuaguucucguggaaaaauuaggggaaguaaaaauucaaaaucaauauaauguauagggauggaguuaaaugcuuugcaaaagagcuggguguucauuccucuacgccccaugaacacucaggacauagcagauaccccaaguugaaccucugaguguguaaagccaugcagagguugcugcaaggugggggcaucuuccauggagcccccaccuacccaccccggaagcuggucccguggcuucauuacucuggccugcugccuccagcagcgucuccucuaucauccccaccuccuucaccaagcgauuugaaacauugcccaucuuaucaggaucuuaucaucucagccucuuccuguacacauaugagcucuucaggucuggccccaaguugcaguucgugggaguuguucuguggggccaaggagcucuggagacgaagcaacuggcugcguccagggcugugaggaaauuccucccuggcuuagcugaacacuaagucuggcacuucccuccauuacucgcacucugcugauuuaucauuaagucacucccggcccucgccacggcaauuacugcguguucuuggcaguuuguggucuuuaacuguauuuuauuuauaucgcuauuacaaauauuaauaauuccuaacccauuaaaaguacugauuccuccuggugggccaugccuuauagagcugacugaccgugagacuuagugcugaguggccgagguuuuauucguggcuguguaucucacuucugcgaagucgacagccagccuuaaagucuaugagccacaucuguaagugcaaaagggcuucuaguaccaggcauaucuggcuauggugagacuuaguuaggauaacauggaaaggacaggguauaguauaaaauggugucugcuugugagaaacaagugucuucgauauagaguaacuaauauaauuuuugucugagguauucauggccgaguguuuuugguuuuguugugguucgguuuuuuucuguuccugaggauugagcccagcaccuugggcauggucucacugugcagaacagcccagccucagguuuguagauccuccugaucuugucuccugagugcuccaccaucuccugcguguucuaccaagccuggcaggcaguuuuguuuuuauuucauguaugacuuauaugaaacauaaauaucccgauguauaaaaggguuuuuuuuuuuuuuuuuuuuuugguuugguucuuuuuuuuuuuuuuuuuuuuuuuuuugagacaggauuucucuguauaacacagcccuggcuguccuggacucgcuuuguagaccagcgugaccucaaacucacagagaccugccugccccugucucccaacuuuugggauuaaaggugcacaccccacacccagcccuuuccuuuugcuuuuuguugcuguugcucuuguuguuguuguuaauuacauguaugggaaggcuggaguugggguguuagggggccugugcagagguauucuagacuccugaagcuggaguuacagguaguugugacccagcugguggaggugccgggaaucaagcuaagguccucuggaagagagcaguucaugucuccaaccccuucacauauguguuuuauagcacuggcauuugcuauauuguauuuagccuuugggaauguuuuuuuguuucuuuucggaaguuuguuuguguggugcuaggaaccgaauauaggacuucaugaauacuaggccaaugcccuuccacucagcuauaucccagcccuuuacucacaguuuugaaagcagccuucuugcuaaguuggcccacgcuagccucgaacucacucuguugcccaauaggucuugaaucaaugaugcucuucaaagcuuccguguagcugggauuggaggccugcuuucuucagaaggcacaggucuuuucuuuuuaaacaaagaaacagaaggccuaaaauggcaucucuggaaacagugcccugguuuuguuuuauuucuguuccgggugaacagaaucucugggccugagcaggccuccuuguugagugugaguagcauccuuaggucugcaucuguccuguaacugaacuuggggacucacuaaacuguacuugcuguguucucuaggaggagcugcaggagguggauaugcucaggucauccccauggaggagguaaggucaugagaugcccagcaggacaccugacacugguggcuacguacaacaccuaugugugugccacuuggugugaagauucaugucccauucauaugcaucuguuuuccuguagcaaaugggugcuaaccuagucccuuuauaaagugugugugugugugugugugugugugugugugcgcgcgcgcacaagcaugcucacacacauaccaaucauucugccuuucuaaauuccauaacaguuucauguucccaggcuucuguggacucaagcccauuuuagauaagacagugaauguugucccgggucccaucagucaucucuuagacuaccaagaucagaaagugaugcaugguugauucuacccagcgaggccacaauaaaaucaucucagagaaacugggcaguaagaauggauggcacugauucuucuuucuccacgaacucucuucaucuccccugccucccgugccugcccaggccuccuuucccucagccuugcucuuugcaucagccgcaugggucaguuccgaguuccuccuaggcucuggucugagcaagacccuguccuuccugcuaccugucucucaggcauagcaggucuugcuuccugcuccauauucucucuguccuguuuucucuucuguguggcuaccugugagcggaaaugaguggaauuuuggaguaaagcagaaucuugggcaggguagugaggacgaggaagggcagagaauuccgugcaugggaaaagucuagucaagaggaaucagggagccaguucagcucgacauaaugggcuugcuuagugcuaagguuaaagaugugaaacccaucagaacuuuuccuuggagguuugcaggggccaguaagaugguuugaccacuaaaggcacaggccagccaagcccagaacccaaguaaaggugaaaggagaaaaucaauuucgugagguuguucucugacugucacacgcaugcugugacaugcucacuuccucucuccgccauauacacauuauacauacacguuaauaaguaaaaccugaaugacuucauuuuaaaacuuaaagcuuccaaaugauaggauaugucaauucuauaaauaauaaauguguguuaauacacagcuagauuucaguaguguuugcucuuguuccauuuuuacuguuuaagccuuguuuccuucccuuguuugcuauaguacaguuuuccaaauuuaaauaaauaauugauaaugaagaaaucaugagaaagaaacuuuuaggcccaucagaaugugucaucuuuacccagagguuggaagaacucaacucuugaguucuuuaucuauuggcaaguuggaggcccugaccuugauuuucugauguaggccaucuugucucagcucaugauaaagacagauaauuagcauacuguuuuauuaauucaggcaguuccugaaaaugucccuggcuguaugaugcaaauagaaaggugugacauuugauuucuaguucaaccuucaccugacuggggacauccaugccaucacugccgcuaauaacuugcuggccgcagccaucgacacgagaauuuuacaugagagcacucaaacagacaaggugagugggucccuuguuagccaucucuggguuuuauccuggagucccugcauccuuaaggacuccgugagagacucuuagaucccaucugcucucuaaaaucgcauucagaauuugcugaguuuuacccauauccucacuuccaggggaggagaauuagacuuuagucagauucucuguugggucuaugacuguugcagaacacugggagagcugugguaugcugguuaggauguuauucgagaugacucuccucagucucgaagaucaucggcacaagcauuuguuuuuccuguagccagaaacacugguccauucuaacagaaauggaacuuggguuuguuuguuuguuuguuuguuuguuuguuuggggagagguugggacuuccaguagcgagacuugaaccuagagauuugugugugcuaugcaagagcuguggcgguagacagccagccaucuguaagagugaacucacaugcagcaagccugaaccagauucuagcuucacaugcaugauauccaccugaaagugacagaccucugggugcuaacucuucacuggcaucugucauagaugagggguacuuccuccugguuuguaagaaaggccccgacuuccucaauuauaaucuccuaguucaucuuccaaacagaauucggguaacuaguugauaaguuguuaggguacagaucaaguagacuuacacaaagugguaacguauaucauuaccacauacauaaugguaauguauauuauuuccacuaggauuuauuaaaaugacagaauuuaaaucaaggcuguuuauauuagccuuaaauauuaauagaaccuguuugguaauaaauuuaaugaagguuguccaucuauauguaaugaacauguccaguuaccaaguucauggcugaaccuaaagcucuggugggugggugggguuuuuauuuucuuaggcucucuacaaucgacugguucccuuagugaauggugucagagaauuuucagaaauucaacuuucucggcugaagguaagauuugacuuuauagugguguuuuguuuuguucguuuuuuuaagagaauauucuagaaccuugacuuaaucuggguuuucauaugcacccuugguuauuaaccuguaggucagggauuuucaaccauccuaaugccgcaacucuugaauacaguuccuccugaugugacccccgacuauaaaauuauuucauuugcuaguuuauaacuguaacuucgccacugucaugaauagcaauguaaauaucugcuaugcaggauaucugauauguaacacacacccccccccccaugggucaugacccacagguuaaaaaccgcugcuuuagagcauaauaacucagaauaucagagugaagucuguagauaaaucccgacaccaaagagccaagaaaacaauaacauauuuuuuuuaaagaucacacgguugaaaaacaucauuuauauuuuguucuacuuauucuguguguauguguggaggucagaggacggcuuccagaagucaagugucuccuuccuccaggcguugaacuggaguuguuggauuuggcagcaaguaccuuuuccuccugagccguauucccaccccaaagaacucccuguuuccucacgugugcaguaggagggcugccuugcuaacacccuagagcacccucgguaacagacacaucuguuuuuauguagccuuuuccuucuggagagaaaugguuuccuguuuguaaaaguucuaaagcagagguucuggaucuuugggucucgaccucuugggcggggggggggggggggagggucacguaucagguauccuguaucucugauauuuacacuacaauucauaacaguagcaaaauuucagucaugaagcagcaacaaaaauaauuuuauggugaggggcagaccaccacaaccugaggaagaguguuaaggggucucggcauuagggaaguugagaaccacugcucgaaagacugauaaggcagcuuugggucacccucucgcuuguuugguuuuuuuuuauuuguuugcuugcuuuuuuuuuuuccuuccaagucaauugcuacugcccucaguugaaaaagccauuuuuucuuaauucuucccauuuugcuuccugaugcuauucacuaauucugucccauucaucauugcuuucaaaagacaacugggguuaaaaaagaaaacaaaacaaaacaaaacaccuuuauggcauaauuuauacccauuaauuggcauuaaauauauuuuaaguacuuuuuaggauauuuucuuuacagaauuaaauugauuaaaagcuuuguguuguuuuggcguuaauugauugauugauugauugauugauuaauugauugauugauuugaaggguuucauguagccugacacaccugcuucugccucccacaugcugagauugcaugaaaagcaccuccuuccccaacuuaaaagguuuaauuaauuuuuccaaguagaauguauucuuuugaaacuaaacauauacuucauuugguauauacguaugaaacaacugggggaguaacauauucaugaugacuggggcaggggcgggucugagcucagcgugcagggccaucaauaggcaccacaagccacacaccaccaggcccauguguucauugcgugcuccccacuggaccccauuuucagauaagguuuuagggccuucacagauccccaguaccuucugcuugcagaagacauuugcuaauagaauuucaccuaagucccaguucacucgaggccuuguguucguucucagggacuucgcuaguuaaggcgauaauuuugauugggccugucuucuguucuuaugacaucucuccccaaucacuagaaacuggggauacauaagacugauccaagcacacugaccgaggaggaagugaggaaguucgcccgccucaacauugaccccgcaaccaucacguggcagagagguagguacuggggcaaccagaaggcauccagagaauggguuggaacccugucucuuacaugccagucuucgacacucaaccuuccguucacaaauucaaugaauaaaaacuacagucuuacagccgccucuccuggcuucagaaccuuaccaucuggcuccauugcucuucuuuuucaccaccucgcugggcacaaucccauuccccccauccucuuucaaauggcugaggacgggcuguggugggaacucagugagaagguucuugaugggcagaugcaaggcuaaauaccacagagcaacccagccuucgugcaacuguguagggagaauucucucuccccuccucuugcuguuuuuaaggcaagauuacuccuugucucugugaguucucuucccccaagcuuggcuuucuuccucuacuuuuuaaaagagaauauuuuaaaauaauauuuuauauuauuccuuauuuacuuguuacauucaggaucucaaugggguuggggguaauggggaggaaagaauuggggauaaagcauacguuuuuucuuuuuuaagauuuauuuauuuauuauauguaaguacacuguagcuauccucaaauacuccagaagagggcaucagauuucguuacggaugguugugagccaccaugugguugcugggauuugaacucgggaccuucggaagagcaguuggcgcucuuaaccacugagccaucucgccagccccuucuuuauuuuuuuaaucguauguuuugccugcauguauguguaugcaccauauauguacagugcccacaaacagcagaagaggacgucagaucucccgggacuggaguuaaaggugguugugagcuaccauaugggugcugagaacugagccuggguccucugcaagagcaguaagugcucuuaacugcugugcaaccccucagcccucuuccuaauuuuuguuuuuuuuggguuugguuuucgguuuuuugggaggguggacaugagugugucugagugugugugugcacacggaggcuaacauccagugucuuucugaacccacagucagaccggauggccagaaagcccaaagguuccuucuacucuucuucccuggugcaggggcauugcuggguuugauggagcacuagggaucaaaccccgccucucaugguaugugggaaaguucaucaaccgagccaucuccccagucucucuuguuuugaggcaaacucuccagguagagcucuggcugguuuggagcuuuuuauguaguggaaaccauccuuggguuugccuuaauccucuaagaugucuugccaccgugccuggcugucuucucuacccguuccccaguagcucugagcucucuaggucgcauuuacagcauaagcuuuuucuccagggcuggcaagugucucuagcgggguccugggugcggaucacucuggcagucacacugcaggguggcucagugcccucuccagacuucccugccucccucucagcagggacaucccuuccuuuccugcacucucauuaggucacuucaauggaacagugggcaaaggacugaccguggaauuugaccuagagaauggccaccacccugcuuagcuauguggccucgaacagguguuggugcuccguguucuggaguccguggaguugaugguguccguacuuuacagaggugugacagucacaccuaugggacgcagaaaggaugagaugacauauauuuagaccuggcccccauucucccaucuucuuuuagaauauauuuaaccaaggccugaaucagcacguucucaugcuuccguuuccauuccuuaauuuaguagguuccuaaugcagagauaguggcuuccugcuuccucagucagcagccuuggugcucccacccgggcaguaaaaucaccauuaagcaauuugucuuucaggacuaguuuggugcccaguuucugucuucuguccaccagagggccuguuucauccucucaccagccuuuuggccaggcuagucuuccucccagguuuagccaccaucccucacuuccugaguuuuuuccccaauaccccauucagucaagccaguaagaacugagugucucccugcagcagaucuuacagccaauagacaaagaccaagcuucuuuacacaaaccgcuuccuagguuuucccagcauagcccggguggcauagcccggguggcguagcccugaucccgagcacccaagaccagcaguguuucaaacuccagacauuuggugguuugggcagauagcgcaguaaggacagccaagucuaaacacaaaguucauuuauuauauuuacgucuuccacacauagccugaaggauaugcuauagauuuuaaaaaauaaauaaauaacuuuguacauggagcuguuucaggauauaggguuuuuccacuagcaguauuauguuaacacccaaaagggguuggaguuuggaugcugggccuguaguaauacuagucucccuccagggaggcuccacugagagaaaugugaacgcaggcaaacucagaagugccucccugugacucuucgaagguagcagcuguguuauguugucucucugugguuuugucuccuucuaagagugaguuaaaauucccuugagcacucuugcaaggaucuauuuuauuuuuuuaaaacaaauaauguaaagaauuuugucaaagugaaacauuucacaacacuaauaacugcuaaucauaguuuuugguacaucugauuuuucuguuuagcucuguuaccaucugugugugugaauuuuauuuccugcccaauucaauuacauccuaaggacauucuacuuuguuagcucuuucuuagguugguuuuuucuuuuucauuuauuuuuuauuucucguggagcuaaagauuaaaccacaaccuuuggcaugcaaaacauguaccucacccucaagcuauauccccaacauuuacaguggucauuuuaagugacucuagaauauuccuuugcaggggagccaugauuuguauauaccacaagucuaaaauagaccaacaaacaguauuuuaaacagcuaacaugaguguuuucagcauuuugccaggcauuauuuuuuuuuuucuacauuuuuuuuuucuuuuaaccagaaagaucuguuguuaaaacaccauuguuugcaaaauguguagucagccuucccaggccucucugagcucguguuacucuguaaauuggcuuaaggggccuuuuugguaaaaugaaaaauuaggcaauggaaauuaguguagguuuaaccauacugaaagagaaacuuucagaccagcuggcauccucgcaccucggccccggccucagaaaucaccgcauagugccucuucagggagggccggugugcgaucgguuucuccaugagaagacaggaaaggacuggaauguucugcgguuacaaaucaauuuuaaugaaagugacagcuuuaagaguuaucccagaaaaauacagacuuacauuacuguuugcaauguuaaagggaagcaaacuuuauugcuuaggacaagccaccugggccagaggaauucgggcugaaauuugauaaguaguuuuguuccgauuaacggguuaguauaauaaugaagacuccucauggaugaagguacagguagcguuuucugacuuugaauaagaacuaguauagccuaggcaaugaucgugaagguuaagacacuggauuauuccggaaacaugucacuggccuggggcggggcgggggggggggggggaggggguaucuccagacauguauuauccccuaaaggacaagaaauaggcuuuaaaauauugaacaccccaaagcuccagucuuuuagggagcccaacaccccagaaaccucuuccccacauguccaucucuccaucacaggccaaggccaccaguccuguucacugccagucccuggugucugcuucccaccacgagcccagugccacucugacaucaggaugccguagcuucuguggaagccaaauacugggccugccgugguccugcaccugugccugggcucuggcuccuggcugggauugguuaaaggcucaggugaacucuggguguuucugugaaccccaccaacaccaugggcuaaagaaacgacuuaggacaaguuacaaguaaaggagaccaccccaagccccacugccugccuuccucccgugcaggcacucuggugcccucgccaucuccucccgggaaaugucaggagucaaagaucggugccgcaugcaccuucgugacccugcccaaccagcacaggacuaagcacagaaacaguccucagaaccugcuccagauagaagcgaaucaggauguagccaccguuagcucugccgcuuagaugccagcuguguguuucuguugcuuucuguggcguuggccacaucucucuuguagaguggguagaaucuggcgcugaauucacacagcucuuuuucccuguguguauauacccugguaggucacaaugcucuacucuggcauugugaaagacaccaaauccaagugggauccaaagugccauuuggaugaugcuguaguuugaucuuaccucguuugcuuaucuucccuuugucaaacuaaacuuugaaugguuugcuauagacuuaaaauacaucugauggggaagugaccucaaagucuguagccaaccauguuucuauacuacacggcaaaagaaaaaaaaaaaaaaaaaaaaggagaugguuuauuucaugugaccgagugccuagcaucucaggagugaagguagcuguuagcgcuacugaggugcagcccguuaacuuugcaaguguuauucugucuuuaaaaauaaaaguugggggcuggagugauggcucagcaguuaagagcacuggcggcuccuucagaggaccaggguucaaguccuaguauucgcguggcagaucgcagcugucuguaacucuaauucauggagauuugacaccuucauacagacauauauacaggcaaagcacuaguacacgugaaauuaaauaaauuuuuaaaaacuggaaguuuauauguauuuggcugugugcgugagugugugugugugugugugugugugugugugugugugugugugugaguuugggggcgggagcagagacagagaggcggggccacggacauggcaguggcagcuagggugagagacccaaggguaauuuguguauuauuaggguauuaugcguuuaguaaguuggauggcaauugucacuguaaacagcccugagguuuuuaagucacaaagauaaaggaagugucuaaccugccuuuguuucuuggcauuauaaaugugguuuuucaaaggcaaacaguuucacagacaaaagucuaauccaggacaguucacacaagaaagcacuuuaccugaccuuuagucagucuccuuccauauugcuguuuugccuuugguuuccuuuguauuguagugaacugcacgcaagccagcagucaccauguuaaccacccauagccguacaacugauagcacuaacuccauccaccaugauugcucugucaccauugccuguacccaaagcuuugucauccccuacacaaguccuagaccagcaggucugcaucuuccugacgcugcggcucuuuaauacaguuccucguguuguggugacccccaaccaauaaagcuuuuguuguuacuucauaacugugacuuugccacuguuaugaaucauaauguuaauaucugauauucaggguauuugauaugugaccccagagggguugcaaaccacagguugagaaccacugcccuaugccccugauaaaauaaugucccucugcuguuggccguggcugcucuguggauuugccuacuuuagaucccccauuugaccuccuagaucugcauaacauuucggaugggaagcauauaucaaaacacucguuuguggcuguguaaugucacauugugaguuaguccauucaucgauggaauuuccagucaucucuaagucucuaaguucacauugugaaaggagcugcuaugagcagugcgcuuagggguuuugaacaacaggauuacugggccauuuggcugucauauguaugagaaacuaacugacgucuccuugugacuuaggugucauuguaaaauacuuucagaacuacuuguacucgauacccgaaucagaugccacccagcccagcccacccucaccugacacaccgucauuaagacacucaccacuagcaugugcugugaacugcacgaaagccagcagucaccauguuaaccauccauagccguacaacugauagcacuaacuccauccaccaugaagccaaaccuucacuuugguuuucagcuccuuucucagcauuucccagcacggccugucuauauuuguugauuaaauaaccugccuguucucuuucaguauuggacacgaacgaccgauuucugagaaaaauaaccauuggacagggaaguacagagaaaggauauucccggcagguagguggcgccaucuucccggaaguaucugcccuuuccucaccguggugugcacagucuuugcuuuuuguuucugguccccagcugcagugcugguggcucucccacucucucaggguggguuuccugcugcucugaugagcuaggacuugggagaguaucaggauuggucuggaagugacagguucaggagacaggaagguuccaguguccucuuccguguguuuuuggcuguguuucuggguagacucauucgggaaagucccauauaaaaguacuguauaaugauggaaaagugaaagucucugauauaucacuccaguuucauaagcccaaggacaaacaccuacuuauuagauuuaauaguacuguuaaagacaacauguguguggggagguguggggggacuuaugagcucuuccauuuaauaggucuaugauguggaauaguggcacuuaggaaauauaaauucauuccauaauuuuuuagccaggcacaauagcucucugauuuuuuuuaacaguaaacucuuucuuuggaauuuuuuuuuaauuuauugccuuuacauuaaauuuuuauuaguggaaaaaguuacuguuauaacagccauuucucauaccaaauagguuuugggaacuucugauauucucugaauuaaacgguaaauagggggagauagcucaaugggugaaacacuugcuguccaagcgugaagaccagaguuuggguucccacacccgcauuuauguuggaugggcauggugacccaccugaaacccaagcacuuaggagacagagaugagauacucugggccagauagcucuaguugauaagcucuggguucaagugagaggcucugcuucacuguauaagauggagcgugaucuacgaagacacuccuucuuuaaccucacacguauguacacaugcauaacacacacacuugugaaaggaagccgaauaugggcuuggaucaagaagcuugaaccucccuccuugccccagacucuaaaacuuucacacacaaccagauuucauacaaucagcauucucuguaccagaaaacaacagucauucuugaaaaguuuggggaggaauuggauaaauggagagaacaaccuagaauauggaggaaggaccucugaaugcaaaggugagaggcacccuagcucucagaccaggagaaaccagcaacccuuugggguuagugauuugggacaacaccuggaugcugcugggugaugcccuaaccguggcacuuacacaccuggucacagccuggacaugguguaacucggccuugcgguuccugaguaggaguccaagguuagggacggggcacugccgaacccauagggaaccauucauguaguagucacagacugugagucccaacaggugucagucaagugucacauuuagagaaaaugaacacauugugaccccuuauuugaagagaaccuuugaaaugugcguguuaagcaccuaaaggauagcaaugggccugggaauggcuccauugaaggagccaauggcaggucacccuccuaggagauguagguacagaagcuagacuugucugacauuguguccucacauauaugagagagagagccucaagcuagccagcaccucacaucuaaagaaauacauagcaugaaaacuggccaggccugggaagaggagcucacauauccacggaaacaaaauaggagaccaguugacagagacugagcagagggugaauucucaaagggguuaaagagcuguaggcccaaugagagcucacugguacuucaagaccuguauuacgauauuaaaacuuauaacauggcuauuaaaaacugagauuguaggauuaaguauacuagaggugcuucuagcugaggaaaucuuuagaaaugauucucagaggaaaccaauacaaaagcuugagaaacagaaagcacauaucuggaaauccugaaggccauagguuugauccccaaacccacccaccuuugauuacaaagauucuagcagggcgugacaacgcagaacuauagucagcacuacuauaggaggcuaagacaggaggagugcaaguuugaagccagccuuggcuacauagagagacccuagcucaaaagaaguccaaguggacuagggagguggcucagucaguaaagugcuuguuaucuauuuaagcaugagggccugaguucagguacccagcacccauguaaggauaaucagggguggcggcauggaccuguaaucccagcaccggggaggcagagacaguggaaugcuugagaacugcuguacagccaguauagacuagucauggguaaaaaaacauuugaggaaaacauugaugccagccucuggugugugcacauguaugugcacacacacacaggcaaaaagagccaccuuuuaguaggcgucuacagagcacuggcccucagaacagugggcaaucuauucaaagaagggaacuucuuggccugaggaaagcaacauuuuuguuuuaaaaacaaauacagagcagaaagugggaaggaaaaagaagaagaagaagaagaagaaaaaaaaacauuucugccuggaaacaucaggcugaaauuucagaacaugagaaauaaagaauaaacuccuaagugcugccaacaagaaaaggucccaauuacucacaaaggaauaaaaaaauucuccaucaacaacaccaaacgccagguggccuuggggaaauucauuccuccuccugcaggaggaggauaauagaaguuucggcaggacgaggaaaccagcagugcuaacaugaagcacaucaagaagagcuuuagagagcaggaaaaauccucccggacugacagccauugacggccaccauagagcgaggccaucgcugacaaaaggcagagacuaugcaggaaacaauacaucauuuuugauauguuuuaacaucaagaucuucaauauaaaacagaaacauuaagacuaguggucaucugggacauaugacccagagauuauugugccuaaaauaagauugcucaaccauuaauacucagauauggcucuuccccuggccaccuuauaucccaccacaguguccuguccccaaauucaccucgcuucagcugaauccugcaccugaaucccuuccugucauguucuauccccuccuuaaagcagaguuucggguuauguauucuauacuuagggcaaacauuuaucacagugaguaguuggugccaguagauuguugaacaaauaagacaaaugaaaguugaaagauaugaaaauaaaauaccacuguaaaaugguaucuauguugcuacaaaguaagacaguagugcugcuagcaccauguggggcaucgcuguaauccuagcgcuuaggaggcagaggcaggaagguccgucccgucccccggccccguccuccccccguagguuugaggacagccuaguguaauaaaggguuauguuagagugcugguugcuugauuuagcccucagacucuauagaucaucauccuauauuaauaaagguaaaacuguaugucacugguuucauuagcucauauagauauaucaaccagcucaccaauuucuguuaaggaccugugggcuauuuauagugauuaucucuccuaaauaaauaggcuguaacaaacauguuuguguuuagauguguacuuuucugguaugauuuugaagguagauuuccaggguuguaauugcagagucggugcacaaauggcauggauuucuacaugucucuucagaaauguuaaguccacucacagacuuagcuguguuguacacuguccuuuguauuuaaauugguggcuaacugagaaauaguauaaaccucauuuauccaauuauaugauuguaaaguguuuuauuugcuaaacaacauuaagauuccucucccaagcacacugguugguaaaugagcaacacugacucucagauagccucaguugcuuaaaugauccuuagagugacucaauuugcaugugaguguguauauguauaaucagauuagugaaggcuaauauggaacucguagguagcucagacuggccccaaauucaugauccuccugcuucagccucccaaaugcuggaauuagaagcaucuacaaugaugcuggguuauaguuuuagaaauaaaacaauucuaagugaaguacuuguauaacacauuguaaauucuacuugauuacuacuuagaucauauugcaaaaguauuucuaggcucauguuaugcagagacaacaguaacauuuugguauuuuuaaugcaauauuuacaguguuaucagaaccuaaaauucaugcagcaaaaaaaucacuuguuuuagaaugaguuacauugagacuauaaucauuuaauauagcuguauuuagcuuucaggcaauauuuuuucaguaaaucagugguuaauacaaucucaaucaggaaggagccagcaagcuccuuccuuccuuccuccauuuccucaucugucugugauggaaauagguaauaaaaugucucauaaggugaucccacuagugcagagcuguuuccccacccacccaccaucucucccucucccucccccucucccucccccucccccucucccucccccucucccucccccucucccucccccucccccucucccuccccccucccccucccccucccccuccccccccucucucuguguguguguguguguguguguguguguuugaaccugucugacucacacuccccgagggauccagagaauuuagcuagagcuuaacaaaguggcuugguguagaugcuuccccggugccuggacuuuugcaaacugaaagaaguacucauuccuugucucugcucuucguucccacuggacucuguacagccuguuguuggagccaagaaaagacaggaagaaacccugggaaguuuuugaagaaaguuagagcucucuggcuguuguugccagauacgauggagccagauccucacaaaacagacacagaaugguuccucucccuuccugagcugcuaggcuaaaccuaugcugagauuuaacucugaggaagccagcaagauacucucucuuuuuuuuuuuaagauuuauuuauuuguuuuauguauaugaguauacugucgcugucuucagacacaccggaagaggacaucagaucucauuacagauugugagccacuaugugguugcugggaauuaaacucaggaccucguaaccacugagccaucucuccagccccagcaaguuacucuuauccuaccaucuucucaucucuccuggacucauaugcuuauaauuacauaucaauagaccaugacucagugguagaaugcucuagcaugcauaagauccuggguuuaauuccuaccucaacaaaaagaacagagaucagcagggcagagaggaacagaaagugaccucccucagagacugguugcuaugaauggaacuaacuauuagguuacugacuaguucauucagcaugaacuaaacacuuacuggguauuacaggcugcugucccugcuggacauccacaaggaaucuuucugugugguccccaccuuuguggccagacauucuagugauaaaaaugcucagaagacagaaaaugacaguaacacucuuggggaugggagggaaccaaaccuggggcuucauauauaucagagcugugccccuguucuucauuaguacuuaauuguuagacugaagcagacuacagugguguguuacauugugccaccaguuucacaggccuuacccuggcaacuccuugacagaggacaguagacaaugugggcaaucuagagaggccauaugcugugucucuaggaaagccacuguucgugugagcuggcccacaggggauagcccccaacuaugacugcuggaaguguccauccaguaacgugccucagcugaccacaggaucuguuuugcugucugcaggcacaguuugacauugcaguggccagcgagaucauggccgugcuggccuugacugauagccucacagacaugaaagagcggcuaggaagaauggugguggccagugacaaagacgggcagccugugacagcugaggacuuggugagugcugcugagaggcucugucucaaaauaaaaaggaauguauuuuauaagcauagcauucucaccugguuugccuugaccagccuggggugggacagacaugggcaaagauaacaauuccaggggcguggucaguuuggugaugcuaaucuaggaaacaguaaaggggacaaaucagccauggucccaguucuccugauuuacgugucuuuuucucaccuguagggggugaccggcgcucugacaguuuugaugaaagacgccaucaagccaaaucugaugcagacccuugaaguaaguaguuuuccuuuuauuuuuuuauuuauuauuuuuauugauuuuuuuauguguaucuaggguggggugccacauguauguauaugcacauauguggaagucagaggucaaucucugauauuaucccucagcuugguguuugagucaggugcuguucacuggccuagagcucacuaauaagguuagaugacuagccagcuagcacucacuuggguccaccugucucugccucuccagcacugggucccucuccuccccuccccuccccccccccucucucucucucucuccucucucucucucucucucuaacuucuggaauucaaacucagauccuucaggucagggaccuuacugacugagguaucugcccagcccuguuuuuugguuuuugguuuuuuuuuuaugauuguuuauagcauagcauuugccuuugucggacuuacuguagauuacaaggcaguaugaauacuccuggccaaugagagucuaaaugaaaauuuaucaauucauagggaugacuuaaacccuggauuugguuucacugacuagaacaggaacaucgaaaauaaauaucugccuaauacagccauggguggcagugccacauuuaugugacuuugucuguuuuaacuuuugaaaauacuucaucuaucauguuaauuauaaauuguuugcuuauaacuauaaauuguuuuuuuuuuccaaguaaaauacaguaaguacuaagaaauguuuucuaagagcauauuuucagcucaguuuuguggugacaucaguuuuguaaucuuuuauacaaacacuaaaauuuuaucuuaucuucuuugauucaaaguguuuucaucucucucucucacagacacacacacaccacucauuacaaucuaguuucuauguuccugaccauauucauuugacauagccauuguuuaacccuuuucuuagcuaccaguuuuuaggauuuggacucaaagagguccaaaucgggagggaguaucuggauuguguuuagcaaagagacaggucugaggcuagagauguggcucggcaaguaagagcauuuacugcucuugcagagggauucaguuugacucacauaugauagcuccucuucuaggggauaagauguccucuuuggccuccucuggcaagaggguauacauaugguacauaugcauaugugcaggcaaaacacucgaacacauaaaauuaauauuuacagagagacagggagagagagagaaagagaaagagaaagagaaagagaaagagaauagguguuggggugagagauguuaagacugguguuuuuacagacagaugccagggaggaaaauccauguccacuuuggucaauguuacugggcggaauuuaugauuugcgcuaggcuacaaugggaaagagggauggagguguccagaggaugaguauuuggggaaaaagcaaaaagagaaguagaaugcccauaaccauccauguacucggcugacagaaaguugaguuugaauggaugcuuuguuguuugccuuugcguccugggcugaacuauuuaccaccucuaccucagcuuucccccauguaaaauggugucagucacagcuaagccaacaggguaauagugacgguucaaccauugacuuccaccuaccauggaugcgugcugacggcaccauugggaacaugggcucagaggucccugcccuccugaaagucgugcagugguugaggaggcagagagcagacaaauaaguucacuaccuucuccuuggugccaugguugugggcacgagagggacggcagagagcauccaucucugcguucacagacuacugggcaaaggcgagcggaagccaagggagcgugggaaaauacugcucccggcaaggaggccgagcccaggggccugguccguggcucucagccuuucuacacaguuccucacacgguggugacucacaccauccaaaauaauugucagugcuacuuuggaacugcaauugaucccuauaaaaguguuguuccacagccuuaaggggucgggacccacagguugagaaccacuggccuagggcgaagagagagcuaccagccagcguggcaggacugugaaaacugagcugguacugagucagguaauuccaaggcaucccugggcuccuauucaacagaugacgguggccccaguugaacauggaacagaacccugaaagugccaggccugccccucccuaacccuucuauaccauccuccacccuccccugacccuguccccauagccugaacucuuucucucucugacucucucaugagcacacaaaugugcuguaguguguugucuuauuccuggguauggggguaugggcaccugugaucccagagagacaaagacaggaggauuagaaaauugaggucaggguagacugcacaaagaauuccaagucagccugaauucuauagugagagccugucucaaaagaaucacaguugggagguagcucaguacuacagugcuugccuuggucuagcaaaacaacuaguaaggaagcaaauagacacuacugaaccuuuaagccauccuccucucugugagucuaauuucauuuguccuaagcaaugcuuaguacauuuacaucgugucuaauuuucauuuaugguauugaccguuuuaagauuauuuagacagaaaauguauuuuuaagaacaaagcauagaauuugguuaagauguucucaugcgugaacucugugaguuccuugauucuuagauacacauuugggaagggcuucuagaaucagugacauaggagccuguauccauggacagccuaagcaucucauuugugggcagugucuuguuuuggacacccccuugcuagugucauaggagaguguuggguacccccugccucacuacagguggccaugaugccagcaguuuucagucugaagacuuugguagauucugggauacugauugauaucauguuccaccauagacuaggaggagcagaagucuuggggauaaagguauaaggccuggagauucccggcaagccuuguccagagccagacugugaaccuacugaugacuuaacacgggaaaguaauccuaagagcugaaaauauaucccuguggacaagccacacacaguguucguugaugaagucgcuaaaugcuccaugucuggugccguuguggcugcaggcuacauguauuaauccaaauuaaaguuuaauaaaauuaaagacaucuuucaguugcuuagccacauuucuacuguuguguuuauuuagauuuugggaaaaggggaacuaacuacauuuuaaguaccuugcagccgcacauggacagggacuacaguaucggaguacagaaguauuauacccuguugaugcgcugguaaucaaccaaguaauugaaguaauaaacaugggaacuuucuguaaagaccauuauggagacuauucaucaggagaaaccaagauaguuccuauguuacauuccaaagaauucugccuaugaaacaaaaaucaagauaaauacacuuauacauaaagauugguucuuuuguguuuuuguuuuguuuuguuuuacuuugcuuuguuuuuuagucaauguguuuaucucaaagugcuuuauuuuauagcuacauccgccauuacauauacguuuuuguuugaaugucugauagcaacauuuugggcaugagucuacuaggacuccaaacugggaguuucagaaccaggacuguaaucuuagucagguuauucaucuucuccuuggccuuggagaguaccccuugcuucccugggccuuggguuuccugggucaggaagaggucggcucuugcucucacauuauuugguucugugaucuccauuuacacggacuuauaaagagcaaggagacuagaaugugggagugggauugugaucacaggcugaagagaaguugaccagguggugguuccuguuccaguuagaugggaguaguaagggucuccacaccagucaaccauguuaacaguucacaggagggugguauggcagggccugccagcaggccuaauguauaaccuguuagcuuucuguuacuguaacagcuacgugagauaaaccacauauaaggaggaaagguuucuuugggcucucacccuguuggcauuuucggucugccucugguugcccuguugguuuuggcgcugagucagagcacaguacugagaaccuaucggagauucuggucagagaacacaccagaagaugcugcucuucucauagccaggacaugaaggcaguacgagaccaugguccaacaguccuuuucauggagacgccccauccccaggaccaaacuccucccacaaggccccguuuccuaagacuuuuaccaccuucccuuggugccaagucuucacagagaccucuggaagacagccggcauccaaacuccagcauagccuuuuauauugcacacacaucaaagcauccuguuggacuccuaaguuacuuaauugccaguugaagugaagugaaggcuggggagaaggcuccgugaaaaagaacacuuguuuuguaagcauggggagccugaguucagauccucgcugcccacauacaaaucuaagcauagucguacacaccuguaaccccagcauuccuguguggacaugggaggcccagaaggaggacccuggaucagcuaaccucagauguaggcagugaaaaacaagagccucuguucugaaugaaauggaaggcuagcacccaagccugcagcuggccucugaccuccacaugcugacugagaccugcauguaccugcagucacacacacacacacacacacacacacacacacacacacacacacacauucucucucucucucucucucucucucucucucucucccucucccucucccucucucucucucucucucccucucucucucucucucucucucaagugaaauaaagacuuaaaccacaaaacuuuuuuuguuguuguugcugacagaagagucguauagccucgcuaauaaagaaaacucugaaauggaagauuugcuuuagauuaaacagcaguccgacgggauuauuccagaauccugaagccugugcuuguucagccacaaccugucaccuguguccccaggagaccaggccccguaccucccugacagauggcagccaugaggguuacagucugucgaggugacgagccagcugccauccagggauagagucugugacuuuguccucuacauuucuccauggcggccgcaugccccaggcagcaagguuggaacacaggaagcuucagcgucuguaauaugcuuuucucagcgcacuugagagguugcauagaaagaagagauguguuaauagauguuaggguuacagauagcagucauccguacaugugaacaagcgugcauguuggauuguuagaacccucccaugcucacgucacucugaccuucuugggaccuguguacucucucuccagagaacuuggggcaacgcucuguugugaacucacaggguggcuuugagacgcugucuuagucucacacugucuuccugcuuugguucagcuuucucaucuuugaaccauguuagaucaugggaauuuuccaugcuccgcagcugcccugcccccacccugcauggcucccugcucuccgcugugucagcaaaagggcaggguguguuuucacaggugaagccaagccuucauccgagcagaccuccaauaaccuggcugggcuaggaauaaagccugaauguuuuaauaagaaaauuauuuucagauagaccuaaaguccguuguuaucauuaaaaggaagaaaacaaaaccacucuaaaaauaacuauauugacaggguugguuuaaagacuuugaaagccuagaauuuuuacuaguuccuaauaaugguuuugucuuauuuguaaugaugcugauugguuuguugucaacuugacacagcuagaguuauuuuggaaaagacgaccauguccccaccagacuggcuuuugagcgagccacugauugaugugggaggguccaccuuacuauggguaguaacauauucaggcuggugguaagcaggcugagaaaggcaggagagaaagccaguaggcagcaccccucaugaccucugcaucaguuucugcacccagguuccugcccugacuucccuugcucagggacagagugugaccugagaguuguugcuaaaauaagccuuuuccuuuccagguugcuuuugguccugguguuuuaucacaguaauaaaaauccuaaguagcauaguaauuaguaagaacgucucauaaauaaaguacaguauacacauauuaaaaugucaugaagaaacccauuuuucugcauguuuucuuuaaaagaaaguuuaauaguaaacuuuaguuguauguggugggugguuggcugugauuccaguguuuaauaaauagagacuggaguaucaggaguucaaagacauccuggacuauagagcaaguuugaggccacccaggcuauauaacacccagcuuaaacaaccacaauaaauuguuucuaucauuuggacaugucacccaugguggguauuuuuuuucuuuuuguuuguuauauuaauugccagauuucuaacauguaaaguuuuuagaguauuauuuaaagauuuaaucagaauauuuuauuuaaaugagaaagcaacuuuagccuagaaauugaaaacaaacaaacaaaaauagccuaagcuuguccuuuauauguaauuggccugucugguuuucauaauucauaaguuauguuuuuuuuauacucaguucuuuguagguuuguuuaagacaaaaucuuauauaaaucuauacugacaucaaacuccuaaucuuuccugcuuuaacgacccaaaugccaggauugugggauuuuucucuccuccuuuuccuucuccuccuccuccuccuccuauuauaguccacuaauagucuacuauuccuccauuccucucuuucugccucccucccccuccccucuucucacuauguaguccugacuagccuggcacucacuguguagaccagacuggccuuguauucacagagauauaccugccucugccucugccucugccucugccucugccucugccucugccucugccucugccucugccucugccucugccucugccucugccucugccucugccucugccucugccucugccucugccucugccucugccucugccucugccucugccucugucucugccucugccucugccucugccucugccuccugaaagcaggaagauuuuuguuaacuugacuauuuguucacuuuaaaaaagcaaaaucaaacaaacaaacaaacaaaaagaacauugaagauauuacuuaaacuaucacaguuugauuaaauuauuuuuaaauguauaauguggaagaaauaaaguauaaaacuuauguuaugauaaacaggcaaugagcaguaacuuaucaaaauuauaaucagaggugaguguguucuuagagaucucuugcucagcauuaacuauaggcucguucugucuaaggagacuuagugugugagucaaucagggugucuuugguuucaguuuguuuuaaagguuuuucuucugucuugucuuuuuguuuguguguguacguauguauucauguuuguguacuguacauauaugcgcauacauggaggccucaguaugacauuggguaucuuccucuguccaucaccacuuggauuuuuuggcagucucccacugaacccauggcucaccgauuggcuagagcaucuggcuugcaaccucugugcauccccccaccccccuucucaggugcuaaaguuacagacuggcgucaccauagcaggcuuuuacgugagaccugaggauacaaacucagguccuugugguuucuuugucaagcauugacugagccauccccccaagcccugcuuuuaucuuuagguugagccccuguacuccaggcugguuucuaacccuucuguagcuugaugugacuucgaacucuuuuacuuuuuuauuuuuuugguuuuucgagacaggguuucucuguguagcccuggcuguccuggaacucacuuuguagaccaggcuggccucgaacucagaaauccgccugccucugucucccgagugcuggggauuaaaggcgugcgccaccacgcccggcgacuucgaacucuuaaaccuugcaccacuacccccaaggguuggaauuacagacaugcuccacccuaccugacucacaguaccuuuagaucucucggugugcuuugacuaugcaguagagacacagagugacaccaggcacacuuacacacccagcagucuguggcaccuuguguccccaaguuaaguuuggucuccauucuucuguuuccuuuggggcucuaauuuauucucguucuucugcagggaacaccuguguuugugcacgcuggucccuuugccaacaucgcucacggcaacucaucaguauuagcugauaaaaucgcgcugaaauuggucggcgaagaaggguuuguggguaagugguguuguuuaaaaguauugauuauaaaacauugaugaaauuggaaagauaauggcugggauugaguguugacaugaaaucucguccuuuacacuuuucuuuguagagggucucagugcuggagaacucuuguucuguaacagcacaguuauguugcugacugcagucaagcacguaggccuuugaaaguucuaauacccaucaacugaaugaccuuggauauauuuuaaguauacugaaucuugguuuucuuaucugcaaaauguuaaugaaauuauuuuaauuagucguccaauggcuauguauucagaacauaccacauucaaagcucagaacuagggaauccagugguuagcagagcaggucuaacagcaggccuugugcaaucuucuaucagugguaugcacgggagguucuccucacugacugagcaauuagcagccaucagaagacuaauauuaaaaugauuuuuuuuucuuccuggaauccugguguguuuucacaacccaauaaaagggaaguuuuccagccaaucuacucacauuuuauuugcuaaauccauacugucugcuguggucagggaggcaccugccguagcauuugcuccacaguuacuagccacaaucuuaggccuuaauaguaaagcuuugacaaaaaugaaaaaccaagcaaggacuguagaaaagugcuucacacugccaugaguuuuaucagauucccccugcugccguagacaguucguuuucauguaaaugcccauaaucagguacagcacuuacuuccugcauaccuaaccaucagccuuguaucaaacucaaaaagugaggugguuuuguuuuguuuuguuuuguuuuguuuuuguuuguuuguuuguuuguuuguuuguuuuuuuaaaaaucugcugggcagaagaaccuagaucuacacuuucaugcuguggcauauucaagacugauuuaagaaucccuuguagacacaaagaugagaucaaaugaggauuaaauguaauuccacccuucaaagaucugugucaugcagcaaucauguacugaguccccagcaggaguggcgaggcucgaggucuggguggauuugccugguugagcacgaguagcaguagagcuaauggcugaggaggcuggggaaaggcagauacugaagagaugggcacuuaagugagaggcuucugauacaucgacuguggauaaaagggcuuccaggauaaagcacucuguuuuaugcugacagagcucccugccuuauaucaucaagcaggcauuuccagagcaugcaucaucguaucuuuagagauauaugcugauggugucugcaaagcaugcuagcccuccugugaccuuagacucuaggaguguucuuugaagguuuucuuauuuagaccgugugaagguggaucggaugaggagcggguacugagaggugggacugauccaggcuuuggaguuguggaaugggagccuucuuuugguagcaaugaagcaagagcuuuucuagggcucaguuuccccuuuguuauaauagucaauaauaaauugauuuguaaaacaggagaacuaugcauaugccccccauuacuauuucucugaccccuuguagucugaggggagauccccaugguaauuaucuugccuguagagagacgcagaacucucuuaacaccguguuaacucugugccccaaauuccuuguugggaaagugagggcuuuaaaaauagaaauuaugaguguguguguguguguguguguguguguguguguaagacggggagacaaggcagcugugacacacauguagaggucaagggacaagcuugugggauugguucucucaccacuuuagugaggguccuagaguuuccagcucaggucgcuaggucagcuuaucaagcaccgcuacccauucagucaucuccccagccaaaaucaggcucuucacagggcuuucuggauggacuuuaaaagaugggguguggcauuucgccugucaaggucuggccugacacccacucauccuuagccaguccucauggucucucuuccccguuaucaacacaugguuaauaaaaguuaaaguccuguuuuaaauugaguuuauuuuggagugauaacaaauuucauguuaguuauuguauagugcacaucacuuagagcggcaguucucaaacugugggucaugacccguuugcaggggucaaaauagccuuucacuggggucgcauaucagauacuuauauucaguucauaagaguagcaagacuacaguuaugaaguagcaacagaaauaaguuuauggucaagggucacuacaacaugaggaacaucagagcauuaggaaggcugagaaccagugacuuggagccuuccaucguagcagcacagcaagagaauauagucugccacugcaccucccaucuccagaacucuucaucuuuguauaagaccuugccugacuccagcacaauccaucugcuucuagcuugcagacacaguuuuuuacccucuaguaaaucgggaugugguaguggagacagaccuuuagagucucagcagagaguggggugcacugugggagccagguucuguguuggauaacaggaaccuggagacaggcgggggcaucuccuggacaggaucuucuuuguuuccuguccuacaacaucauguucaguucugcuucuacaucuaggcaaggacuccuuuugucuacccagaauaauuauucuaagauaauggaaucaacaguccauuuagccugacaacagagcgguguuuauuuaaucagcugcaugaauaugucagacgagagcagggcuucaugagaauuuuagagaaaucaccacagcgacuguaauggccccuuucuauuagccagugguucccaugggaguccacucaaccuccguguaccgccgaaaggcaggcugcucuugggcagcaaacacaacucgaggguuauuuuuacaaaaagaaaaagaacauugacauucuacauuuuuaauuauuauuacuaucucauuuaaaguguuuguaagaaucucaaaauugugcacaaaccuuagcuuuuucuuucuuguuuuuauuccuuuuuuuuuuuuuuuuaauuuucuuugacaauuuucagguaaagacucaugucuacuugaaaauguggaccuggaacuguacaugcucauagccaagggcucuuauagccaaaauagccacagccacagaaguucauggauagacucugaaggucuacugcccccuccuguaguuaaauacugauaaaauagaccagaugucauggcauaugcuuguagucuuagaaggccagcccacccuagucucaaugacucaagcauccuccaccuaaaucaaugaauaaaucaacuuaauuaugaugcgauaccaugcuaauacaucuuaauauguguaguaauagguuguguuuguaucucccccaaucgcccacuuccuauugcuguagugcagugccgcagacuaugucuuaaaagaaguccgauuggacuuuuguucuuaguguggguuggcugaggacucacaucuucugaggcccuucuggcuggcagaguugugaggcaacaaaaaaacacacaagagucagagagagaauauaugggugugcaugcuguguguguacacgcacaugcaugagugugggguauguauaugugcaugcauaggccuggagucuguggaugugugugcauugcauggauaugagguauauguaugugcauguauggguauggggguguguaugugcaugcauggaguguguguaucugugugugcacaugcaugugugugguauguauguaugaaugcaugcauggaugagggauguauguacauguauguaugacuaugggggcugcacaugcacucaucuguucuucucucuccuuuuuuaaaguuucuuuguuuuuucucuggguuuuuuggggguguggggcuguuucuugcacaugugaguggagaugacuuagcaguccagaagagggcaucagaucccaugagcaacagguggcugugagcacacaugauauugguauugggaaccaaacucagguccucuaccagggcagcacaccagagcucuuaccuaaggauccauuucuccaacccaggagagcuuuuuaagacagggccucaguuaguagcuuuauuuggccuggaacucacuguguacacuaggauagcagagacucucugagcucugcuuccugagucacagccaccgccccauuccucuucucaaaagcccgccaguauuccauuacaagacacccacccugcuggccccauugaauccccaccagcucugaacaccagagcuggugucaagcagacuucacccucucgugccucauagcgucuauuuagauccaaugggagugcagggaggaaaaaacaguguucugauacagcacucuccuaccgggaaaugucuuucugauggauugcugagucaaggucaccuuggguaccacugacuuuaggcaucuuucuuuugacuuuaucccuuguccuuuaagacgcuuguaaaucuugccucuugaguuucagaggaauccacugaguaguuacacccagcuuauucucgccaucuguuuuauugcaaugaaauguuaaauacuccaucauuuagguagaagaaagccagaccaaacuaaacauuccuauaauuucauccacccuuuaaaaaaaaaagaucugagaucugaguugcaauaguguccagcuucugagcugagguuccuggagcucacccuguugacaucuaaaacucugcucuuggucaggggccucauucuguuaugaaguucauucuugggucuugaguaacccuauacauaaucacgucagggguaagaacugcauuauuagcaaucuggcuggaggggacaugcagccccagccgccgcugaguccagggaauggaguuuuagcaaagccacacuguggggauguugguguguggugucccuggaugucuguauccugcagcuccuugccaacucccguucuccagccccucugugcugaccucucccuucuaugcaugcuucuauacagacugaccucucccuucuaugcuuccauacagacugaccucuuugugguuuaauugugcuuuuaguuucuaacagguagucuucagccuuugaaaagaaaaaaagaaagaaaggaagcaaggaagagagggggaaggagggagggagggaggaaggaaaacacugagaaagacagacagacagacagacagacagacagacagacacugaaggagucccagugguaaagugcuuuucuggcauagucaaagcuauagguucaacccccagcacaaaggaauaacaaaggcuagacagauggcuugaugguuaagagucacugcugcucacacagaggaccuggguucaaaucccagcacccacauagcagcucacaacuaucuguaacuccaguuucaaggaucugaugcccucuuucugguauuagugugcaccaaacauguggugcauauacauguacacaaacacuaauacauguaaaaauggaaaauaaguaaagaagauuggaaucuuuugguuaucugcuacuugggaaagucuucagacuaaguuacccgauccccauguuccagucgauuuccccaagucuuguuaguuuguuuguuuuggguuuagguuuuguuuuuugaaauaggguuucucuguguagcucuagcuguacuauaacuuguuuauagaucagacuagucucgaaaucagagaucugcuugccucuuugucccgcaugcugggacauacacacacacacacacacacacacacacacacacacacacacacacacacacgcaucucuagcuucaucacaucuuaaugugcuguuugugugugcuuuagguucaaggguugauuguuauaagacagauagagcuagccuggagauaagaguccauggcagagucuagcauggcuggggccuuagagucaauucccagcacucgaaaagaaggcagagacaugagaugugaucagaaccucugugacuuugcugcugugacuugaaucguuggcugccuaauuccucuuagcaacagucuugggagguagagccuaguggugaauggauuaaaaagccuuggcuugaaguuggcuccugagcucaggaacagaccugauuccucugacgucaccccuccugucuuagcugugucuugaaguuguccucuacaugugucuccaucuucugugggucgcccuucuaccgugucccaggugagucucacacaagcagagcagaugguaacagcuugcuguuugacuucuagaacugucagccaaaauaaauagauuuucucuaaaaaaaaaaauuaccccaucacaaauguuacagccacaaggaccuaaccucgccuuaguugcaucuuuuuuuuccuugcuucucuaaaggaaagcacuguccagguguggaagagguaucguuuccagguaugcaguaauacuucuaccacaaaagauacaaaagacggacagugaagcuucugaaaccuacucuguuuacaacauuagguuacaguaauuuuuugacagcaccacagauaaacccagaguuaccagccaucuccauuuauuaugucacuaaaggucaaacaauguaauggguauuuguaaccuaauaaguuauaggcugucugugggaauagcacauagcacuugaaaaucucacugugucauucauaaagaaccuccaucccucguuaagaaggcaccgguacuggccccaugcccggcucucagcuccugcauacagggcuguccuucuuugucccuauagcaacuguucucacuuagauucacaacauaauggguguuguuuaacagacaugucucuuggaucagugaucugcaucacagcaguggugccaugcccaaaggaugucucauaccaccuacuuacccucaaaaauguaaaauauccuggacuggaaagagggcuccccgguuaagagcacuugcugcucuaauagaggaccuggguucaguucccagcacccacauggcagcucacaacuccagcuguaagggaucugauacccucuucuagcuucugaggguaccaggcuugcaugugauauacagacauauacauggagacaaaaguucuauccacauaaaauucaauaauaauaauaaauaaacaauaauaauagaguuuuucuuaaugugaaguaugucaagaugagaugguaccuaccuaucaucccagcacaaaccucaggcaaacuaccaagacccuagcuagcccaaggacggggggggggggggggggggcggggacaaaaguaucucaauuuucuucugagguuuuuguacuuuuuagauucauucauucauuuauuuauuuacucauucauuuauucauuuauuugugugagaauggcaaggaugaugcuuacaauucacacaggcaguuucgggcauugaugcaucuuugcugagaacaaucugaguuuacauucugaaaauccacuaugugcccagcacuggacuagagcuuugugccugagaaccccacuggcuuguggcaagagccuuugaaggaguuuaacacuggccacaguuuccacaugagaggauugagccccagagugaaagaguuuguuccaaggugacgagcagcgauuugaacccaguccuuggcccugaucugaacucuugcuucugugucuuacuaccugugaauguguacuugggguccacaccaccaucguccagcccuguguuugcacacaaugggacuaauguuuguugaaugaaaaccuaauaguacacaucaguuauaugaaauacuuccccaaugacaggguugucugcaaugccaauaggcuuuuuaacagugaacauaaacauaucuacugaaugguuuauugaaguagcaaauaauuaaauuaaaaguaaaugaaugcuacaaaggcaugugacugcaagucuagcuacauaggaggcugaggcagaaggaugauuuaaauucaggaguucaagaccagccugagaaauagagugagcuucccaaagaccccaugucagaaagggagaaagggagaaagggagaaagggagaaagagagaaaaagggagggagggagggagggagggagggagggagggagggagggaaacaaagaaagaaaaagaaagggaaggagggagggaggaaggaaggaaggaaggaaggcaggcaggcaggcaggcaggcaggcacuggagagauaagcagcugauacaauguuuccuuaacauucauagcuccauggguagaagcccaggaaccccauagaaacuagaugugguggugcuugcuugugaucucuggccucaggagguggaugcugaagaucagaagaucagcauccgcuucagcuauaaugugguccgaggaaagccugaucuacuugagccccugucucaaauuuuuaguugggagcuagagagacagcucaggauuaagaguguuugccccucuuccaggggaccaaguuggguucccauccccugcgucuggugacucacaccuaacuccagcuccauaggauccaacacccucuacagcaggcauauguacacacauggucuacacucacaaacacauguaacacauaaauaaaauaaaaaauuagucuuuuuuuaaaaggaauuuuagaaagaaagauguuuuaaaagacguuuugaacuguaggaauguucagccugaccuuggccaguuucuucaugcccuacguaaugcaaauguguuuaacauaagcucuguggcucauucccguuuggauuuauguauaccccaaacagcgugcuuggcauagcauccugcuuaucaccauaaaauguggaguucaaauucggcccuugucaaaacaucggggcgcagagauuaguguuguggcaguugacauaaaaugacuuuuaaaagugguccugagguuaagcugggguuuuguaacucggcgauugcaugggccuucuaagggauuuucuuuaauguccguugcacaauagguuuucagauuacguuacaggccugcuaucuuagcccaucugggccaagcacaucuagccucgggaugcuggacaggggccaaauugccuuuuauaguugcaaaaauugcaauuaugugagguuguuugcuacauuuuuuuuagcaguauuugauauaauuacaauauuguacuguuccuauacaagucacauaauagaauuugagacaaggaaugcuggggaacuugcaguuccugaagaaauauaauguauuauaucuugucagaggcuucuuugcaucuuuagggaagggcauucuggagggaaagcagaccucuaaugcguucucaaacccgcaggccucucgccaccuguaacuauaaaugcucucaucauuucccuacuaauguuuuaguacaaaggcuguugugacaaaauccacauaggguuugagguccugugggcugcuugucuagcucacagcaaaacaggguuuaaaaaucuuagagacgggcuggagagauggcucagugguuaagagcacugacugcucuuccagaaguccugaguucaaaucccagcaaccacaugguggcucacaaccauauguaaugagaucugaugccccuucuggugugucugaagacaucuacaguguauuuauauguaauaaauaaauaaaucuauaaaaaaaaaacuuagagacaaaagaggugucugagugaaaugauaaagauagaccuucagcaauagaagaaugaaaaccaagucaaaaccuagaaaagagcaucacaguagauagauagcaucugccuugggcacaccuggucaugugucuauaaccugaccaggcuguucauagacacuguggcuguucacagccucuggagacuucaccagugagauaaagaaaagagcaauauaaaaugcauagauaguaguuuuaauauuuauguaugaucauacagagguaaaauucaagaagccaacuaaaaaauuuaucguaaguaauaaaaguuuuaguuugcccgguuggcuacaguauaaguacgugaaagucaauagccuuccuuuaugugaagaauaaacauauuauaauguggacugugauccuguuuauucauccccuccgugcuauaaaguacccaggaguaaauuuagaaagacauggacacagagaaagaagaauacggccauuuguaaagcugaagguuacagauccagugagacuggagugaagaccaggaguccccucacucucuccgacgacuaauccccaggacugugcugucuuacacugaugagggcaaugagccauugaaaagggacuccuuuuaaucuuuaaagggguacuuuauuaauguuuucaucaauggugucagaagcuccugaaccuguucauuugcuaucuuacccauguggggggagggggggcugcuugucuggcaacugaacccaguccucuucuagaauagcaagugucccucgcugccgagcuaccucccuagcucccauuuuuaacuuuccuuuuagacacaggacuccguguggcccacgcuggcuugcaacugaggcuagacagaagcugcugacccuccaucugcuggcacaugucuggccucaaaugucuaaaugcuaagagaauugguuuaauaugaaaaaaauaaauaaaagagcaaaauuuacuaaauuuacuaccucuccuggcuccuuugggauguucucagccugcuucuugucuuuauucaggauaagugagucuagcaugaggaaaauggcuacagcagugguuuucaaccuuccugugcugugaccccuuaauacaguugcucauguugugcugaccucaaccauacaauuauuuucauaauuacuucauaacuguaauuuugcuacaguucuaaaucauaauauaagcugggcaugguggcacaugccuuuaauccuagaacuugagaggcagagguaaguagaucucuaaguucgaggccagccugguugacagaaggaacuccaggagagcugagacuacaacagagaaauucuaucucaaaaaaacaugcacacagacacacacacacccaucaaaaaccaaaaguugauugauuaauuauuugaaauaauaauaaaauuacuaugaaucauaauguuaauaucugauaaugcaggacccuuaugaaaggguuguucaacaccccuacaggauaagaaccacaaauauuaucuguguggcauagagcacuguguguauguauaacauuuuauuaugaagcuuauuaucccagcaaaagauuacauuacaaagauuguuucuucuuuucuucucucccucccucuuuuccuuuccauuuuuuguuuuguuuuuguuuuuuuuuuccccaacuggagccuugugguguccaggcugagcuuaaacucacuguauaaccaaggaggaccuugaacuuuuaauccuccuguuucuaccucuuaggugugguauuacagcucugcccuaccacauccaguuucuauauauaguaguuaggaucaaaccugcuaccuugugcaugcuagguaccuaccuaccuauugagcuacacuccugguccccaaaucaccauuucuuuuucuuuuuuuuuuuuuuuuguuuuuuguuuuuguuuuuguuuuuugagacaggguuucucuguauagcccuggcuguccugaaacucacucuguagaccaggcuggccugcugggauuaaaggcgugcgccaccaugcccggugucaaaucaacauuucaucaugccugcuagccuugcaaaaguuuggagcaagcaagguucaugaagggcagguugaaguuguucccacaaagauuguaauuccuuagcuauacauucuagcuucgacauaaugaagucccuguaaaggccaaguucacauccugaucuuucaguuaacucaaugggaagaacuuucccuugagucuggcauuaaaacaaacaaacaaacaaacaaacaaucaaacaaucaaacaaaaaacccagcauuccaucauggaacauuucacuaucagaauaagaagucuccccgaugucugccucacaagccagaugcuccuuuucagagccuccacuuugcugucugucucuagugauggggccugugcucuccucagagucccucucgucaucaucuuugucugucucuccuuaguguaguaauaaaucccaugucccccacagucuaucucugugacccucuugagcaccccauagaccuuuccaugagaagucaggggucugucccucccaccuccuggccucaaaacagaaggcagagagaccuugcaaggcaccuggaagggagaagggagcagaucagaaagacucaagaaacuaaagcaacuuccaagggaugcucucgacucucacaggaaagccaaaagacagcaagccccucacugggacgacaucugagcuguaaacagccaagcccuguggugggugucucuuuagaagagcugccagcauacuagacagugagcuccaacgaugcagcugcccuuccuggucacuccacucaugcuggagguggggcugagggcgcuccucacugaugcagcugcuuaagaguccccaugucccucuaaguagccacaccaaacacucuuuguuccaacaacaugggcuagauucucucuuugguuuacugucacuaccggaccuacgggagauccauguuuguuugcaacucuuaaggaaaaggcacaaggcagauggucacacagaugacauggcaggagcucacuucugccuggagaagcauucuuaacagugcugcuuucugcuugagggugaucauggagacucacagaagcgcuuaacuuucccagucucccauccccucaucucucugcaucucuuucucucucugucucuuucuguauguauauaucucugugugccucucuaugugcauuucuuucccucccucucucccucccucuccccuccuuuuccccaccucucccucucuccaagacuggccuugaacucaugcuugugagcaugaccuugaauuucugauuauccugccuccaccucugggaugcuaagauuacagacaugugccaaccccacccaauuuaugaggugcuggggguagaauccaggcccucuaccaacugagcuacauccccagcccauccagcaacucuucugaaagggagagugccuuucuuccucucuccccacugguuaggacauuuaguuaugauggcaggggcucgggcaaucauucuggaccccugggucgcggcagcugcagaugaaggagaaacuggcacaccagcacagagcgccaacugugaucuucugucaaaugagagagaaguacgcuuucacuggaacugagccacuucauagcuccauguauuugugggcaaaccuaauccugauggguucaggcgugaaaacggggccagcuuuacagacauccuagcauuuucuucacuuagaacauuuccucuuguggauacuugcaggcuaugcaggguuuccuuauucugcacagcauuaacucugggacuauagucagggugaugugucuaauugaaaagaaaugugagguuugccucaaguuuuccuaaugaaagaacugagcuuccaaaggcuggaauguggucagaacucuaugugucacauguaugcauguagaggucagaggucgauguccugugucuuccucgauuguccccaauaucuacuuucugagacagggcuguuggggaggcuggaccucacccuuccaucuagauuuguuggccauugaguccccagugaucuacuuagcuucacucucccagugcugggguuacaaacguacaugcccagcagugaugugggugcuugggacccgaacucaugucaucaugcuuguuccgcauggagcauacccgcugagucgugucuccagccccagaacucugggauugaugccucaaagccaugacaguggggaaauagcuguugguucaaaaguucuggauucagacuugaaucaagaaagcaaaaaccacuauuuucaugguuauuuuaaguacauguagagauuauaccaugacauuguugccugcccuuuaaaaguaaaagccauguacacucaucuaagauaugcaugcaauuuuauaaagcaaaccaaaaaaaaggggguggggauacagaugcaggugguguugagauugcugguguuugaacucagaauguuuguacacauaaacacccaaacacaugauacgcaucuggaaacuguagaacacagcucucaucuuggugcugagccaggaguuagagggaugcaucugccacucuuaucaucgcaggcuagacuggaaaccagugagaaauaacagcuagagucucaguuuuauuugcacagaaaaagucucagccuugaucgcaccugcuuuggcuauugcccgaaucuguucugcuuccucccaggggaaaugcaaguaugaacugcuguccacaaaaccugucagcuuauggagcacuuaggcacugccacugauauuuauauuaagcucuguggacaacauacagcagccagucuuggcguuagccaugcccucuaaaauuaccgaccauuuucuuccuuuucccuuucaccaagcacaccagacuguauccuuguccuauaaugcgccagacacuuaauucugguccuuuccuuccugagucacagcucuuaggaccacaagcuuuguuccaauuguguuuucacacauuuugaacauaugcacucaggcagaaauagaauucaauauuguguguucuguaguagacauacagauggucccugccucaagguuugacacaaacuucucaauaguaugagagggaccuacauucagaggacagcauccugggaaauucggggucuccaggguuuuuuuggauuuuuuuuuuuuuuugcuggagauaagugccaugaugauaggccgucaucuccacuaucaccaaggcaagagcugaugggcuacggugugaaguucagcuagauuagaagcacacaugcacuaucagcuuaacguaugcuugacuuagucugcauguaucaggacaagcaaggacugucugcauauacacaaugcucuccugucacacauccgaagucuggccuuguaaauuaccuccccucccagaguguagcaugagccccucugacugccagagagagggagccccacaucaguccauugucacacuaucacuuaaucaguaauccacccacucagugccauauugaaauaccaacuuuacugaucuccguaucauagacuugaguguuaaggacacuucacaugugucuuugucugguccucuuauggcuguggccaauuaucucguuuuugaauugugucacugccagcagacccucugggccccuuugucugcguggaacgggucucuagucgcaggugggcaaagcgucagauggaaugacagacagaugcacacaggagagguuguguagaaucugaauguaauuugucaaaucaagcaucaaacuuuuuauacagaagaaaauagggaaauugggugacacaccggcaagguacaaagagguuacuggauucuuacacaaaacagaggaauacaaacacagaaggucuaaaaggaaccaccugggauagaauucauuguuaacaaccgggaucaaaaacagcuccaccuaagauccacuuaaucuuagaagccaggggucaagggcuucgugcccuugccauaguucccauucuagucuauuauauaguccaccuucccccuaagccauuguaaauacguguguauggguguaacucagcuaucuauaguucuaaguaucuacucugguuccuccuuaggucucaaacuuccuucuuccuagaugaugguaaauucuuguguagggcagugacuuagcuuuuauucaaagugauaguguaauaccagaggcaauuuugaaugucacugaauaggcaacauucuuacugaauuccaagcccauggucugcucaaggauuuucuaggacguuggaacacuggugaaggcuuggcuaugucagaauucaaucuuaaaaggcacuuauaauaagauaauacuaaaagagagcacguggauccauacaccagacuaacgcggaaauagaauaugaauguauggguuagagagaacgccagccuccaggaggugaguuuccguaaaacucugccucgugaguggcuuccaggccucucggccugucaagcugacucgaccaccuguuuugcuacaaggucaaguaagucacccaucaguauuuuagaaguucuccuggaagucagcugcuugacucuguucccuacuaagcuguaaagauaaacacaggauucaaauacuggagucagggaugcuccaugguuuccucuguccuggguaccagugccgagcaaaacaggccaaagcuaccggggucugccgugagaaagaaacaggcaagccaguucuuuugcuccuuacauaaagauuguagguaguaaauccucggucagccauguguguuuaagagccaucccuaggguuccgagagaugcuuuaucuccauugauagagcaccugccauacgugucugaggaccugaauuuggaucuccagcacuggagggugggauaggaggaugcgggcagcccucucuugcucauucaucagcuuggcugaaucaguagucuccagauucagugagagacccugccucaaaaauaggaugcugaggggcuagagagauggcucagugauuaagagaacugccuacucuucucaagguccugaguucaauucccagcauccacaugguggcucacaaccaucuguaaugggauuuguuacccucuucuggugugucugaagagaaugacaguguaccucacauacauaaaaugcguuuuaaaaaaauaggauacagagcaaacaaaaaaagacccuggacugaaacuacugauuuucgugcacacauaagaauguguauaccagcacacaaacauauacucaccacagguguuuaaauaaaaagaaaccaugcccuauagcuuucaaguuuaaaauauuucccuucuaucuucauggcuucugggaaucuagcaaguguaaaggaaccuagaggaaagccagucuguuuccuugguuuucacucagugaucagaguuuucucuugcugcauugauguaguuaccugagucgaacgaggugcuguggcucugggauacucuccuuccugcgggggcuuuaugauaagaugugaaugccuucacauugguucacucuucuuccuuagcugcacuaccauaaacuacucuuaauagaaaaugcccugcaccccucuucccauuuuguuaagacacaugugcuuguagccaagccaggcagaauucuucauuuuauucuaagacacagccucacuguggagcucaggcuggccuggcuggaggucuuucugccucugucuccuggugcuagaauuaugagugagugaucaaagaauuaugagcuucaaaguucuucucuguguggagaaaguucacauucucacaagcugcaagggaacaaguuugcccuauaacacugggcauccaaaaggcuaacucuuccaagccagaacacagguuuuuaugugagaaauaaaacuaccauauaacacugggcacuguggcacacaccuuuaguuucagcacucuggagacagagguagauggaucuccccaaguucaaggccaucauggucaauauaucaaguuccagcccaguaagggcuauacaguaagacagacccugucucaaaaaaaaaaaaaaaaaaaaaaaaaaaaaacaaaauaccuaacaugcauaccucaauuuuuaucuaagcccuugccucuaaacuuaaauuucuccuuggccaaaaucaacuuacagaacaaaauuauuagugaugcuacuuaaugagcuaacuauaacuaauuaacucuggggguggugcagaaagaguaaguucugaauccuuccuccaaaauacauugauacuuuuuaauuuuucaaauuguuguugccguaugcauacauuuauucaaaugucccuguauccuauuuauuuauuauuggcuuucugauacuggaucucacucuguagcucaggcuagacuagaacacaacuugagaccaggcuggccuugaacuucccaaacaucuugccucugguuccccagucuggagauggaaggcaugugccaccaccaccacucuuggcccucuagacucauuguauguuguuaauguucucuuucccuucccccagaguacacccagaauaguuucuccaugcucucugcaucaaccccaaccuuccccaguguguggugaccuggucauggggcaagcgggaaggaagggucuucaaaauacuguuaauuugugguuccagugaucucuuccucagcuucacaauaugugcccaguaaguugauuuuuguauucucuauggaaauuccaacucuauuacauuuaauaaaaucaagggaccguggauuacauaaacaaaacccacagagcagaaaggauuuugguuuuaguaaaauuuccuagaccuaaaaugagucagagccuuacaguuaaucuggucuuaaagcaaggcgauuguugguuuugaagcuguaacaauaaggcugagcuucucuugugguucaucugaugacuccuccggguuuacuuagucuccuuccagccacugagaaaauaacuaaacgauccucaaaggcuagcccaccuugagcaugcauguguugcgugcggugacuuugagcugacucuucccgaguucaucagcagggagcugcagagaauaacuauuuacauaggacagaaggggccgggaaagacucaacucuauuuccuuuaccucugcacagaaauuauuacccaccaugcuuuagagcaaagccuagcuccaugcgccucaugucuuucuauacucauguccccuugcggucucucauuugucgugagaaaguaagagugguggcaugaaucgaccaaaucuguccugugccaagcugauaacagggacuagugcuaugagaucucuaacaguucauaaaucuaacuucauguccaggaguaauggggaauucaauauguuguauguuauaugucuguugcaugcaucacacagaaaauguaucgcuaucauaaaguagcuaugaaaucugacaugaccgauuuuucuuuuuauugucugagugcauauagaacaaagggcauuuuagugacauuacaaggugaaaauucaguucccaguucugcugauaaucuucagguguuucaaguaugaaaaacucaaggaagaccugucuugcuuuaagaaggguuuccccuguuggagagagagagagagagagagagagagagagagaaaauuuuuaaacuaaaccagucuucuuuccccagucuaucuguacauugguguaaagacaaucuaagcuagaaaauuagaaucacccacuucuccaucccauggcgagaaagcuggugccugguuuagggagaccagucuuggggggucuaagggcucaguggggagguagcucugggagaccacuugguucuaaggagggaacacuaugaugugcuuguguggccugccugccccugguguuaggaaugaaguccagacagacauggucccugaagcauccucucugaaaucuuucuugauucauccaaagucuuaucuacucuuccuugcccaagucccaccucuguuggcguggcaaccaacaauuagaaggguagauggguaaucugcacacgaauugcuccuaagagaaaacagauuucugaauccaaagaaugaaauacccuugaagcacaaggcacuuggauuuuuuguugcaaacaguucagcuacagaaaugucuaugguugucggauggaucagcaaguugagccugggucucaguccagcuuaauaccauaguaacauagagaacaauuauugaaaccuuccauccuucgaaucacgggcuuuaagcagagggcuaugcuggucaucuggaaagagggaaggaauuacucagaucauauugcccugugcucauugucuuggugcaggagggcccauccccuguggcugacaccacauaggcaggugagucagauauauaagaaaacuugcugaguguuggccaaugacugagccaguaagcaaaugcaacugacuccuccaugcccucugucccaggcccagcucgagggagucccuguucugccuuccuccagugaugggucaugacuugguauuugugagcugaaauaaacccuuuugucuucccaaguugcucuuguuccgaguguauuagugcagcaagaaaauaaaacuagaaaaaaugcccagguagaaauguucaauaaauguuccauuuaccuucaccuucucaugcccaguuuguuaaauaguugccugccuuccagcaaauacacauuuuagcaggaaggcugacaacccaaccaccaucaccugcaccuucucauguugaucggugccccccucccuccuuccuccucaggcuacuaaguccggacucaccuuuguccccacuugccaaguugcacugaccccauuauugaugcaauacaucaaagcucugcugagcagaauuuuuuauguggauaauucagaccccagcaucucaguggaugagguuacggugauuaacauccuaaguuugugcagccuuguagucuagccucuggugcauccguaauauucucagagggagugucuagagaguccaggguuccuuuguucuucuugacucauagccagcugcuagagugcgguggaggguuuauuuuugguuuuguucuguuuuguuuuuguuuuguuuuguuuuuguuuuaguuuugagcauuauaagaugcuaugucuuaguuaaaugcuacgaguggugaccaaaaauaucuccagaaacugcugaguuuccccucaccuucacuagugggaggggaugcagggacgaauaucacuucacucaggaggaacucaaugacauuuuaugguuugcagugccauaggguggguaaaggcgggucaagcacgagaacagccagcucuaaggaugacacaggguagaauucagauuuaccugcauaaagugaauaaauacgauuucaauaccaagugcaagccuuuaaucucagcacuugggaggcagaggcagauggaucucugugaguuugaggccagcuggggccacauagugaauuuuaggccugccaggguuacauaguaugacccugucuagggggaagggggagaauugaaguauagaaaucauuucgagaagaaaaggccacaucaauauucccucacggauggaauaguggcuggugacagccccacccaaaaggaccauaagcgguuaaugguugcuucagaggagguagucuuauuccuaggugguauagcacugcuaagucaccauugcuugugcaagcaaucauaaugaaaugaagugggccccaagacaaauaauaaaaaugguaacaagacaggagggagggaggcuugcugggaagggguuuggugggaagggaaaagggggagguagauagauaauagggaggagcagaauguggacuuugaaaacagaaggcaggcagagccaugcugcuugcucauggggcacuuuagagcagauaagugcaauuaugggcuugcuuucaucacuaaaugaggacgucuccuacaggcgauugcacaggcacgccacagagguguagaggcucaggacuugucaagugaggaaaaaaagugaaaguuuuuccaaaauuccgagacguacacaauuauugagaagcguugugucaugggucacaaaacaugcaggaaagucagagccacuccuguccaggcaacagaggagcccggaucuacaacuggguuccucguccgaucuccagaaggugccugaggcuuaggagccagaaaaagacuaagaaugucauccuaaaauuccucacaguuccaggcuuuuuaugaaccuguaucugacaggacuucucuagaaaaagguaauauuaauaaagaugguguguacuuugaaaucugagaguugucacccuguuucuucauuguauauaaugagccagagauaacauagggaaacuuggcaaauacaaacucccuccuucaggggugguguagagagcacauggcaugccucugucgcauuuuuguggccguccuggucauuccuucucuaugaucuuuacaccaggacucuuaagugcucuuggggauugucauggccaagacagcugccugcacuucaaccuccuucugcacccagaguuccaagucccuccuagccgggacccaaugcccccggccccuuuucugagcugcuuguagguuucugacauuugaaucaagccauccugcaggaucaugccugugcuuacucagugagcccauccgucagcauuuccuguuuccauucaugcuguaagugaaagagcuguaacaaagagauugccaagacaaaucauggcugaggcuuacacaaauaauuuuuaucacaagccucuuuuaaauaggcagccuuccgaaaccugcauuccacgcuuuucaggaaagccaagucaugcuaagcaaacucgauucaugauuuaaggcuaugucuauuaaauucaauaugagauugaucuuuggcuuggcucuugaaccuucuacuagggauagcaaguaagauaagggaauaaauugcuucuuuuaggucaccguggagguuuuaacuuguuggucauucucaggaagucgugaggaagugaaaccuacaggaagagcaacuuguccuuucucacaagggugggcuucuuaucaaggcccaugggguggggcuaacccugcagucgucaaucuccaaguuagucacuguuggugccuuagcaaagcgcuucuugcuuuacuuuaguaaaggcugaucacccaucagcucaccuucucccuuggcagccugcagccuggagacaaaugaccuuagaauggucacgugcucagaaaacagagcggcuuucaaagccugggaaucuggcucuuccguuuccugcacagcguuuuggcagcuagccuucccagccgccgcccacuuccuuccccuagcugaagcucucuuuucuccacucuuguuuauuuccaguuugugucuuaaagaacggaauugaucuuaauuucucuauuuagacacucgaggcgaugaucucauucauugucagaugcgaguggcguuuacaccauugcaucuaggauuaaaauugucaaaacaguuuuguaaggaagaaagaggguagguaagacagacaugguuuucuuccuauuuuuaaugucuguccuguugaguugugaccuuugcaucggcuguugaaucgcacgcuauucguuuaugcacuuuuaugucagggacuguguuagguguuagagacagacaaguaaggcuguccucuccucuaaggaagagcuagcagacugggcucauguggaugcaaaacuugggaaugggggcggggaaaaacaacagcagagguggaagaugcccacgaggacaagaagggaaauuccccugccugagauucaggcaaccuccuaggauguaagcccuuggacugggguuuagaugcugugucuaagaagcagggaaggaaagaaaggaauuuucugggugggaaagaacagcagagaugauaguaauauaguaggguuguuuuaggaaacuugguagcuagaugcuacuacagaaugagggguguguguguguguguguguguguguguguguguguguguuccugcauaugugcaucuuuguauacauuugggaugugaaugugugcagaggucagaggacaaccacaggugucaguccucaaagugucacccaccucacccuuccccuuuuugaagacacugucauauaggucugaaacugaacaaugaaggcuacacuggcugccuauccagccccagagaucgaccugccucugccuucccagucugggauuauaaacauaagcuaccaugccuggcuuuuuagaacaugggcucugggaaucgaacucacauuccuauguuuaugcaaacauuguaccaaacugaguaccuucccugccccugaaguguggggggagacagagcagggaugguuuacaugagcaaagcuuuaaggcuucaugguaaagaugaucagaacuuuuucuccuuaagaugacagcaaacuuaugaauggaggagagugaggggaccaugcugagaguuaagacagcagcugauacuaagcagaggagugguuauaaaagaaauccuguuucucugaguagguaucugaggacuugguauuuguguuacuuacuuuuccugcugcugugauaaacuacugagaaaagcaacaucaaaacaaauaguucuucuggcucccaguuugaggcuguaguccacacgguauggugggcaaggcugguagcaggaguggguggcauugcauccacagucaagaagcggggaaagagaaaucuucuucuuagcccaaucucucuuucucucuguaguccucacaucugcagcauccuagaaucgccuuugcaucuuaagcuuuaucuucacagccuccucacaguagccucucaggaccuccuugcaggggaguagaaaucacuucuaacuuugcccacaauagauggagucaugagaauggucccaucugccgugaaaaggagggguauucuuccaauuguucugcuauaaaucuuugcaaagaaaaauucguuaaaaaaaaaaaauucagggagagcgaagcuaugaaaccuauccuuuucuauaguaaguuaaaacauuaauuucaaaccauaaaauugacuugucaaaugcguaucaguggucauaaaagauguuuuaugucuauugcccguauccuuaccccuggaaauuuauucugagaauauacuuugaaagagauuaaagcucauauguagcacaaauucagugugucuuucuacaugcuggugacggcccaauuguucaguaacagggggacuguuuuacagauuuugucacccuaauuaaauuauauacucuguuuuuguaaucacaaauucuaaaagguuguaguacagaaauaaaauuauacuuuuaagauaaaggagacuauagaauuauguguauucuauaaaaauagguguauggaaugcuaaaagaaaaagcaagaauuaaguguauauauaguuuaaaauaacaucugaaaaaacuauuuccaccaguucuuguugacauuucuauuucccaugaauccuagggcuacaucuucauuuguuugcuuuuuccuuuuuuucuucuguagcugcugagaauuugaacucaggaauucccucaugcaaggcaagcauugugcucuccgccuucaacaguaaccuuuaggauuuuuauaagaccuuaguaaauaaauucauguacuucuacuuccuaucuguaccauuauuauggccuuagucauauugucaguagaugguccauauuccaaaauaauuuuuacauuaguaguauucuucccaaaugauaauggacaaucacugcacaugagugucuuguuaaaauacugaaucuguuggggcuguagaauuaagagcacuggcuguucuucuacaggacugugucugauuccuagcacccacauggcuuagaacuaucuguaacaggggacccauggucucuuccuaccucugcagauaccagacacacaaaugguacacagauauacaagcaggcaaaacauucaugcacauuaaaucaauucaaaguuguuguuuuuaaugcuaguucugauugaguagaucucauggguccaauaguccacuucuuuaacaaggucuuaagagaugcuguugcuugcuuuugcuccauggaucucacgcuaaauaccaaggcccuggagcucucucuugaguggaagacaauacuauugacccaguaucuaucgugguuuuggaaagcaauacucaaguuccaucugucaccuccacaaauagcacaaaagccacgucugagaggaggggaggugcggguuuguauaugugugcucaugcgcacacagaggccagaggaagacaugggaugucugauuccaucacuuucuaccuucuucucuugacucaagaucucuuuucaaugaaccugcagcuaggcuguuggccaucggaccccagcaaucuugucuccccacacacacacacacaccccacugugcugagguuacaggugcacacagccauacuaagauuuuuuucaucaauguggagauuugcacucaguuccucaugcuugagcaacaaggguucgcucucacccacugaacccccacaguaccauuucugucaacuggaaagaagucuaaaaaaaugaauaugauucuggaauccagcugccaccuuucucacaugcccugaucaguauccuuaagccaugccuccaacuugaaaucugcucaccaacagaauggaucaggggcccaaaaauaagaaaggauaacguaugcuugacccuuugauaaaguuuggagcacaucuuccauuaugagggaggugccaggucaccucuauguaggcaugggauacagcaccuuguaguggccuuguguggcagggguaggggccguugugagagcuuguacuuuuauuaaacauugguugcuguguucugaugauaagagcucauucccuaccuguuucuguacagugacugaagcuggcuuuggggcugauauugggauggagaaauucuucaauaucaaaugccgagcuucuggccuggugcccaacguugucgugcugguagccaccguucgagcucugaagaugcauggaggcgggccgaguguaaguucuuguuuucuuccuagcuuaaaaaaaaagccgaggaguggagagaugacucugugguaaaaagcaccugccagucuuagagguccuggguucaguuccaggggaccuuacacccuguucuggauuccacaggcaccugcaaaaucacagugcucauaaacauacggguuucgugcacacauaacacauaaguaguuaaaacauuuaaagccauauaugagcuguagaauuggcuccaugguuaagagcacucacugacugcucuuccagaggcccuggguucuauaauaaccaaauagugucucacagcucucugcagcuucaguuccaaggggucugacaaccuccauacaaacaaacaugcaggcaaaacaccagugcaagcgagcgagugagugagugagugagugagugagugagugagugagugagugaguggaugaaaaguuauaugcauguauguauaauuugaaauguucucuuccucuucugccaugcccacauuuaaauuuaaacagcuuugauccucuaaaagguuuaaagucuguuuggucugauuggaucuuuauaaaauacaggaagaaaucuuggagacacauagagaccagcagugguagcaucacaccucugcugaggaaacuggucagaccuagaauugaguccagaguuuuuccagaccuccagacuauaaaaauaccuggcaugauguccagucccacugcacuucuccuugacgugugcgccauguugccacacugugauuucuucccaguuauuccuuucugcucuuuccuucccuucuuaauccugugguucuuuggcaaagaagauaacacaagguuagggaccauaaguagaaaugucaaucguuaagucaguucccauuaccaaaaugaauaccugauacucaacucauaaggagaugcgauuuauuuucacucacagcucuguacguuguaauccucuggucagcauuuguacaugaagcaaggcaguaaguaugucaggcugggagcccaggacaaaacaaaacucaccuccuauguagggguugggcgcaggggcaaggcucccuguauuuccccugacagcucccauuaggccucuccuucuaagacuccaccaccucccacuaugcuccaggagagcauagccucauaaaugucuggggaacauugaaggaccaaacuguugcaugaaugaacaauaguaaccagggagggcuguaaaggcugggcuuggccucauggcauuuuaugacugucucuccucuucagguucugaaucccuugcucucaggaacugucuaauuaguuacugggccccggggccuggcauauuccauauccagaaaauguuuucaguaauggaguaacaaaugaacuuugaucuuccaauccgacgucccucugaauucucaucacccaccucgaugcauuugccucuuacuugaaacaguuccguggugauauuuuugauucaggauaaugucugcuucucuucagcaacauugcacacauagccacagcugccucguguguguucacucagcugagguuugcauuuuuuaauccauuauuugagcaguggaaaauccugugaccuuugaaccugcccauuuuaacacaguucuuuuucucgccacugugaccugaugagaagcagcuuaaaggaggaggggcuggcugggcuuacaaucugagaccacgggguaggggccauuggugccaggaaggaacagugacuggagcaugagaaaacugucuuaguuaggguuguacuuaguuagggucagacaccaugaccaaggcaagccuuauaaaggacaacauuuaauuauggauggcuuacagguucagagguucaguccauuauccucaaggcagagcauggcagcauccaggcaggcauggugcaggaggagauuucuucaucuucaucugaaggcugcuagcagaauacuggcuucugagacguuuggacaaaguccacgcccacagugacacaccaacaacuccaacagggccguaccuucuaauagcaccacucccugggcugagcccauacaaaccaucacagcaaccaaucacacagucugcaguaggaagcagagacgauucuuguaucaucuugcuuugugcuuuugucaugggccccagcccauaggauacugcugccuccauccaccauaggacuucccuucucucuggaagcacccugacagacauacccagggcuacuucucauuaaugcccugggcauuuccuaaugcauucaagaugacagugaagauuuuuuuuaauuauuuuuuuuuacuuguucacuuuacauccugcucacuaccccuccuuccuaaccacccccuuccacaguccuucccccauccuccccuccccuucucuucugagcaagugggcccuccccuagauauccccaacccuggcacaucaagucucuggaaggcuaggagcuuccucucccacugaggccagacaaggcagcccagguagaagaacaugggagagcccacacuugaguuguucaggacccacaugaagaccaugcugcaccucugcuacauaugaguggagaggccuagauccagcccauguaugaauauuuaacugcuaugccacuggcauuuuaaauccguagccugucuuccagcacacuaaccguucuuggugcgguauaagaacugacauucgaauauucugaaucuacacaaucuuuucccaguuaacccuuuaauugcacuacaguaaucagguuucucaggcagcagaggucacuggguguguagaugugugguaggagguaaaagggaauaaggaaccaggucacgugauuauaaagcgugccagugcagaauccaggaucuacuuauuccccugggaacucaggagccauggcuuguguagguccaguccaauggcagucugauggaaaagucuccuuggcuuagaggaggccagucuauguuauauauccauaaaucaguagaucucaucaaaaauuauccuuacaaaaaucacauacaauaaugcuugaccaaauaaauauccagauacccuaaauucuccacaaguuaacacuuggaguaaaccacguguuuuggaguguagggcauugacaaaauuuaauaucaaauuuuuuuuuugacccaggguggaaugacugcauuuucccaaauaugugcaaaccucuuucugggaucucccuucaguugagcuggccuaguuaggucucuuugugccaacguacugcggagaucccaagccaggcuguuccuucacauuugaccuacaagugacccuuuucaaggauaucugcauuuuaccaauggacuuauuuuacuuuuugagguuugcaguauccagccuacauaagacuagcucuauuucagugaacuacaggcucaaaacccuguguguauuugagaauuagcuuauagguucugcagucucuuugggaucucuauucaaaggacguuagacaccucuucauaguucuguuugaauauauuccaauggaaguuauugcuuauuacauaaagaucuucuauaucuucguacagaucuguucccguauaugcuuucuaucuuuaaauaacagauuauuucuguuuuuauauguuauuuugucacuauccugucugaauucacuuaauuguauugauuuagccuaccacaucuuugggggauucugggcugccauucauugcucaaaaugaguuccuuuuuuucccuuccagucuguaugguuucuucccuugucccuggcaagggcuucccugguaauugcaaugccguguuggauguaggcgucuucuuaguccucaucuucaaggggguuguuuaaacagcucauugcugagugcgugcaaggcuugggauacauuuguaaugaggccuaagggauuaccuucuauuuuuaauuggccaaauuagcauagaaacugaugcaggcuuuucuuccaucuuuuaagaugacaauuugaguguucucuuugagauuguaaggcuugcuuaaauuugugccuugccagaacaagccugguuuaggcagcuauaucugcuuuacaaauaacuggauuuuacuagucaguuuucuaauguuuugagucgggucuccccucccgcauuuauaugaguaagauguuagauauacaaaaauuaaaauuuugaacuuuuuuuucuuaacuagggaagguuuguguaaaaauuacaguacuugauuuauucaaaguugaguagacuucuccuuuuaaagcagaccuauugcuauagggaagaacuuuuuuuuuuccuaauucguaggauggaucuuaauuucugucucuuuauuucagguaacugcugggguuccucucaagaaagaauauacagaggagguaagaagaacuaaugguccagugcagccagugaguagcuuccaguugacuguccgugaguguacaacuuagaaauguacuucucuggacggaggagauggcucaguggguaaccaccucgcaagcgugagaaccugaguuccaucccuagcacccgaguaaaaaacaaaacauagugacaaacacuugcuuucucaacgcuagggaggcagagacaaguaggucuccggggcucgauggccagccagccuucuucaugagcuguaggccagggagagacucugccuccaaaagaaagguaccugaagaauagccaagguucgccccacaugcgugcgugcaugcacacacacuagaauuucauuuuuaaaaagucccaugaaaauggaugggauaaaaggaugaaacccuuucauuuaacucuugaagcugaagaaaagguaaauauagacuuauuugcuguccucuacucacaagacagcuauccgagcccagagaugagggaagcuuuuaccuaugucuccuuuuguuguagcaaaaguugucucuugggagaugcacacguguuuuuaugacuuauaggaaugcaaucaguaucuguccugcagacaaacugguuagauggugacaguaccacuuagcuccuacagguggugccauggguuuaaaccagaagaggcaggaccccuucagcaucccggggucuuuugcucccuagcugcagagagugggcuugccuacauucuguuagucuuacauagcaguaguugccuggccccagucucagauacaugugcuuggacccagaauaguuuuagaaccuaccuugaccaugaaucaccucuaucuguaaucaucuuucuuggaaacacaaggugacuugggucuccuuuuaaaccugucuccggcaaagaaaagauagaaacaaaaguugucaguguggugaggcugggucuagcuugggguggggggggguuagguaagacauaaugacacagcugcuggugguuuccuuccagaacauucagcugguagcugauggcugcugcaaccuacagaagcaaauucagaucgcucagcucuucggggugccgguggugguggcacugaaugucuucaagugaguccagcuuucugugaaagacacagaauucaguuuguuugauuugguuucauuuuccccaauguguucucuaguguuacuguggaaauuaaacacacagagucaaugagcaccugucugguuuugggggaggggguauuuugguuuuuccuguucuacccagugauucugucugauagacugaaugaaugaucaaaaggagguguuauguaacuucuugauuaaaaacccauaauaagguugggugugguggugcacauaccuuuaaucccaaacgcuccagaggcagaggcagacagcucucuguaaauuugaggccagccugguacuacagagcaaauccagaagagccaagguuuacacagagaaacccugucucaaaaacaaaucaaagaaaacaacacuugagucauguuaaaggggauucuuucuacaugcuuuuucaucgugucugauuuauuuaaacacgugaccacuuuugauguucucaauauauucaguguuagggagugaaguucuauauaaaccguuagucuuucucucaaaacaucacuaagugaauacagaugcagaauccacaaacguucucaucaccaggacggacacccgugcagagauugacuuggugugugagcucgcuaaacgggccggugccuuugaugcgguccccugcuaucacuggucggcuggagggaaaggaucuguggacuuggcccgggcugugagagaagcugcgaauaaaagaagccgcuuccaguuccuguaugauguucagguaagucgcaucuaccaguggaguggcagcucucguaucuuguagaaggccagcgcuuaaagcacuguuuauaugacccaucuuauguggucuucuuggagauucaacagugaaggaagcucaugacuaaaggcguuagccaucugaugugcccuucugcuuucaaacauugggcccaagggaggggauggcucugggugggaagcuaugcucacagggauugaccuuccaacaacaaggcuuuugaacaguaucaaagcuacucaauuacaaggcaugcuucuuguaucuccuaugguucuuuuguguggugugugugugugugugugugugugugugugugugugugugugugauauguguggccacacacaagucacagcaugcaugcaaaaaucagaggucaguuugugcaagucaguucuggccucccaccacguagguuccagggauggaaccacgagcaggcgagacucagcagcaggcaccuuuguccacaaagucaucucaucaacccucacagugguuuucuugcccaauaucuuacauagcuuuuccuuguaguaaaauauguuaccauuuacaaaucgugauauugaguacauucacaucauuaugcaaccgguuucuagggcuauucucaucuuagaacacugaagcuugguauccauuuaacagucccccacccccacccccccuuccaacagauccuucagugaaccaccauccuacuuuaugucucagaauuugacuuuuuagauaccgcuuaugaaugugaucuugccaaaauagucguuucuuuuuuaucuguggcuuguuucacacaguccauggaugaugucauagcacaugugagaauccucauugcuuuuaauacuggauauugucuuuacuacguguaugcucugugugugugugugugugugugugugugugugugugugugugugugguguugggcuguauaaccagcaaugggaauacuagguuuucuggcgugguuucucucuuucucaugggggcagguagguuuugguguuuggucuucuaagacaagcucuccuauaauccuggcugaccuuguagcuaaggguggccuuaaauuucuaaucccuccugccucuaccuccuuaguucuuggauugcaagcaugugucacuauaucuagccuuauaauucauuuuuaaacuaauguuggcacucagccuugguggaagaggcacauuugggaauucaaaguugaucuccaguccauaguaaguucaaaaccaaugguucuguuguuuugguuuuuugagacaggguuucucuguauagcccuggcuguccuggaacucgcucuguagaccaggcuggccucaaacucagagaagagaucugccugccucugccucccaugugcugcgaauaaaggcucgugccaccaccgcacagucagagcuacaugggacccugucucaggaaaacaaaaaucugaguucuacaaagcuugacccaccccacccccacucucaaaggagcccuuccuuuuuguauguguguuucacuuuuauuuuaauuauuuuucuuuccuaagugucuauaccuuuuucaaaauugucauauguugacauaucagagcuguauuuauuuguaagguacauaacugauacaccauggacuucaggcagggucccguuagaccacacuucccucucugugaggcucaagagcugugaguggaaucauaggaacucauuuuugcaaagggaugacccugaaagcaagccuugcucucuccauugagaguuaacaugaacgguccuccggugcccuuccucugaguuuacacacauuuugaggugcgaccuucacagcggggcaggcucacauuuguuuuuguuaggucuuuccuguuacuuauguaaaaccauagagccuuucucugaguugaaacuggggcugcaugggaaaaaaaaaucaaagcacagccagccgugaguuuaugaccugggacagucacagccccuccccuaguuuaggcuugguuucuacucugcaagucauuuucuuuuuuuuuuuuuuuuuuuuuuuccgagacaggguuucucuguauagcccuggcuguccuggagcucacuuuauagaccaggcuggccucgaacuuagaaauccgccugccucugccucccgagugcugggauuaaaggcgugcgccuccacgcccggcgcaagucauuuucaaagcagaguguauuggggguuguuauuguuguugucguuguuuuggggguguuuuucuuucuaguugguuuugagaaaauuacuucauuuuuuucuucaaagauucaaauuugaauauauuccaguuagauguggccacugugacuuuucuugucaucgaaauuuaaggcauuugccaccagauccucaaauuuuauaggcauaaauuuaaaauacauguaugcaugcacauguguuuacgucuauguauaugaaguagggauuuuuuagaguagaggugugauuaauucaaagucauuucauuuuuuaaauauccuuaggguuuuacauacauuacugugcauaugggguugaaucuguagaauuuuaaaucuucucuguaucuuacucacuuuguagccauuaggggaguggggggagggacauacucaaugagaacaauuacgagccccuucuuauuguccaugucccugccccuucucuguccucucucccuuggucaccugugccugcaugcccuuugcccuguuucuccuuccucuuuuguagguccugggcccuuuggguugucugugacaagcugccugcacaugucccauugaguuucuuguuggugacucugcuuuucucacuucuguguuguuuucuucuucauuucuuauccagcaugagcugccuuagcagagaucggucuuccauccugcccgucaccagccuccuccaagugauucauacccaguuccccacaacaauauccagaacagaucuugcccaacucucgcucuccugaguccuccuuugaccugcaugcaccuccauagcccacccagugcaucauuccuaugugcaaaauggccacgagagaucugagccucacucgagagucacccugacuuuugaagcguccccuucacugucccauuugcccccucccagcccugucucgccgaugaaagaaacagcauggggggggggggggcagugugugauuucauuuacaugcccugugaaaaacggaacaucauugccauggaaguuucuagaaaugcauuguucccacuaacacuaugagggaaucuccaguggcaagcuauggagguuccacuacaaguugagaggccaccauccaccucauccuauucuugcaggacgauaucauaguacccucguuguagccucaaaguggaccuuaaagauaccaaauauuauaaaauauaucucaagagaacaguucccuucagguucaggggugacaucucaguggacaugaaauagcuuugcugugcaguuaggagagucuaacaccaaaaaguacccaggcuccuugaacaugaaaguaaaaugacuugugcuugcacucuuaugcgcgcacacacacacauuuccaaggagguuugugagacacgaagaugaugcaucaugaaaauacccgcucgggcaggcauggugguaaucccaauacucgggaagcugaggcaaaaagugaaaaguucaaaaaaaaaaaaaaagggagggugggggggccaaguaaguauugguagucccuacagaguacuguuugcgaguaauaacgaaaaauauuacccuugcacauuucuuauuuucagugacgaaugcagguuuucuaacuaugagacaucuauuuacuucccagagcccagucacuguugcccgucacacauggcacuugccuuggaaagauguuucucaggggaucucaagugaaccugcugcucaggguggaagcucaggguccaggcuccuagaaguacacgcucaccccuagguagcucacugugcuugucucuggugcacagugugcuuugugucagagauacagaccccugaugucccugguaacgaugacaucuguucccaggguaccagguaguacgugugucgugcagcucuuguaccugugaggucugaucagugcaaaugaacaugguugguuuccaguuauaugucugucuggguuaccagaaagggugccugccaaacuacaaguccgucauuuaaaauucagacuucauuuaaaauacaaacuggaguaauuaccaugcaccuggagauuuauaucugacuugcaaguuauuaauugauccuucucuuugaauauuuuaugggccucagaauacaugacuucaguaucacagaauaaaaaugauuaaccuaugugcuuucagcuccauggccuuggagacacaaaagaacgcuaucuuuuauucagcgcaucugggaugcauaccaaugacuuuauuuggugcagagcugaaacaauagugcggccuugcuaagauauggucaggguuagguagcagaauacuagguaguauuuuuaaucaaucacucagaagggauuuuuuuuuuccaagcugcuaccauuagcaucugaucuccaagugagcagaaacguaaccauuuauaagccauuggcuugguuuuauuauguuguuuuacauuuuucucccuuucuuucuggcguaugcccacauguguguguggccacaggagggguccacauucccauaugcacuugaaggacacaggagaacguucuaguccaucacucucuaccuuagugagccuggaguuagacuggcagccagcagacuccuucaaccuuugccucucauagcacugggucuguacacacgugcuuuugacauggaugcuacagagucaaacucagguccucacaccugcuuagcaagaucucuuggccaccaagacagcucuccagccccacaaagccuuuuuacaugguuauuucuagcagucuuguuuuuuaaccuuuaguucuguuucacuuuguuuuguuuuguuuuguuuuguuuuuuaauuuuacgaaagcauuauuacaccucucccacccugugcucccucugacccugcuuaugcucccacuuacucucucuaauuaaugaccucuuuguucuuauaguugaugcauauacauauggagggaugcauagauauauaaauccuaucagcugagucccuuuuugcuuguguguacaugguuucaaggcuggccacuuuauauuggauaauguauuaaagggcucaucucugagagaagcuauuucucaucucaguagucauuaguugccugagauuuuuaucugagggcagaagucccucaucucacccuccacauucgaauugcuauuaaaauuguuaucguuuaggcagccauuuugaggcaauacggucucacaggaaugucuccaucuucuggcuccuacgaucuuucuccucauucuucugugauguuuccggagccuuagguacaggagguguguguguguguguguguguguguguguguguguguguguguguguguaugaaugaauauauacauauucauucucuggguuuauccucuggggcuggguccccacaagccguuaaccucuguguuggggccaguuguuguuuucuguaaugggcugcauuugucugcugaggagggcugagagcuauacuccccugugguuauaggauaaguuuuaguagagguaggaguuugcuggucugguaaaguacauucuccucugagauccaagaucucacgaggccuggauaauuggucagguuucuaguaacgggcgugauuucccucccuuugagcauagcuguggugauccaggcugauagaaauauuauucugaaaagauucugaaaauacucaaagaagcuauaaaaucaaacuauugaaaagcgugucuuuuuaguggaauaaagcagccaauacacccccaaaaguuuuuacuuaaccuuuguacauacuuuugugauacacacacagucugggcauggcggagcgggcauucaacccagcacuggggaagcagaggcagagcucugugaguccaaggcuagccuggucuacaaagcaaauucuaggccagccagggcuauucagugguauuaacguguuggcagucaccaacagcugucuaauuguccuuaaagguccacggcugugugggcccaggcuccuucugccuuccacuuccugugcagucaucauucuuccuucugcuucuugagaucuuucuuguacuuccuuuaggacaccgucaaaguuguuugggcuuuguuuuguuuuuccauacugggggucaaccccagagcuuugugcaugccaggagaaugcucugccaucgagcuacacccuugggaguuuccuuuaaugccuggccggcuuuuacagaucuccaugcaaucugccccuccugacuguuucauguuuacccagagccuugacugucaggagugucucuccuucccacauguuuauugugccguggcuugcacucuguuaggaauuguuacacgaaagguccccaaaacuugugcaugacaccucagcacugcaaaaguacuuuccauugauggcuguuuucauauuuagcacaggcuuggacaaggccuacuaugugugagccacucugcuagacaugaggccuaccagaggaagggaauaaacagauucauccccugugcacacaaucaggggaaugcugauaaaagaauaaacacucauaacuuacuuuaucauuuuauuuguuuuuauaaaagcuaucauuugccucaaagcagcuuaagugaaucuuaguucagcagaagaucacuuagacuggcuugcccccaaagcguguaggccucucuucacaaccaagcaaggaaauuauagaagguuccuuugcugaagacacagaguacgcacacuacccacagggaggguagcgcucauaugggacuguuuucacacuaacucuaagcgguaagcuaacugagauguuuucauuuauuuacuuguuaaacacuguaggagaagucuuucagaaccuuggccuggggcuuccagcucaguggauuggagugccugcugaggccaugcggcugugacagagagaaccagaggggaagagacuaucccaaggcuuaccucuuccuguuuugccucccacuauggacucuguacgagucccauuuaguacaggucacaaagucagccuggcacgggagugguauucccaaagcacuuuccaguaaacacuagcgaggaagacauuagcuaucagcaaaagauauccgcacuugugcucacagaaggcuggaguggugcugagacaggaaacaucgggagcuuagcagagauggaaagauguauaggaacugccugcuuagggacuggggcuccuaugauugccguccuccaccaggguaugguccuuguugugcuugaugagagaacccuuuccugcuagaaagaucuucuaucaucucaugaaagcuuuauuuaucuuggagugguaugugcugugucuguguuugcacguguggagggcagagaacaaaugugaggaguccucacguugcuaccauuugggucccauggaucaaacuccaaucgggcuugucgacaagucucuuuaccugcuggcucuggcuccacgauacgguugaccagcaaagacaauggugguagcuucgguacagcgccuggagcaagccuucuuugcguggugaugugcugugcagacgaugagauugucaguucauguacaaaguccucugucacugucaccccagcaccuccucaccugagcuuuccuuucucuucuggagcuugugcuuagcugacaggaaauguguaguccuuugcucaacagaacacuaaggguaguugcccccauagccgcuggaguaacuuugguaaauauaugguaugauugcuaauaaugucaacuugccaggaucuagaagcaccuaggagacauaccccugggcgugcccaugagggagugucuacauuggguaagaccacccaggcuaacuguuccguggacuggcaucccagacugaauaauaaugagaaagugagcuuggugcucgcauccguggaucaaaugaugcacuccaucacuguccuuuccuaugagagaauguaugcccuccaacugcaagccaaaaggaacccucccuuccugcuucuuuucagauacuuagucacaauaauaagaaaguaccacugggcaguggugguacacagcuuugauccuaucacacaggaggcagaagcagguggaucucaaggccagccuggucuacagagcaaguuccaggacagccagggcuacacagagaaauccugccuugaaacaaacaaaacagaggggguggggggagaagaaggaggaagagagggagagggggaagagggagaaagauacauagauagauauauagauagaauagauacauagaucgauacauagauauauaaauacauaaauagauacauagauagauacauagauggauggguggauggauggauggauggauggaugaugcuugagaaaaguaugugcuacaacccuugaccucagagaccuguagcccaucuuuacucuucagcuaacauuagcuuuaagcuguguauguuagaaguguguugagcuuccugccauaguccuuuaaucucagcuacccaggaagcugaaacagagcuugcaagugcaaggcuagccuaggcuacccauaaguucaaggcuaacuagagcaauuuauugaaaacuugucugaagaaaaaaagaaaaagaagagaaaaggaaaaaaaaaaaaaacaggguaggggcuggggauauagcucagugguaaagcauuuguguccugggagcaaagcccucuguucaauucccaguacugaaaauaauggcauccucaagcuuaugucuaucugcauuugugcccuagcucuuuauauuaacauucccacgcccucccaagucugugcccacauggcagcugcgcuaacugcagcucagacacagggauagaaacuucccugaccucuugcuugugguccacauucugcccugcuggaaaguaauuagcaauuaauaguuaguugucccuuuucagagaugaacucucacaugggauuucucaugugagaguucuucaugugguuuauaaaaggcaccuugccagccagcagauuuuaggauuaaaguuacguccagccacuagagucuauugguaccucugaauccaucgguacuuuccaaagcagcaugagccuugccagcagccccuccuucagggaagaacacuacaggugcucccaaugucaaagaagggaaggcuaaugcauauuaauacugucccuaaugcugugguucucagccuuccuaacacugugagccuuugauacacuuucucguguuguggugacugucagccauaaaauuauuucauuacuauuucauagcuguaaucugcuacuguuauaauuuguaagaaauaucugauacgaaccccucccccaaagggaucaugaccuacagguuauaaacugcugcccagugggagauguggccuuuggcauagaccugagagcuuuagagagcuugauguuugaagaggacagggaaagagauuucaugagugaaucccagaaggaagaaggaagcaaagacauagggugcagaggcugaaacaccucaagcaggguugucucuuggcagaccuuacagugcuguagugcugggauuuuucuugcugagguguguauugggaaggucggacuugcaguggagacuguucagaguaaagagaagcuaccucaguggugagccaguuggugcccuccccaacccuccaacugcugcgagaacaugucgcguccugccucuucccuugcagguggcauuugaugaguaggaaucaggguucguauuuuuguggccagugugguuuguuucuuagaugagggugggaggaagagggcuuacacuugcacacaggugcacccacccaugcaugcuccccugaaggccagaaguugaccuuggguguauuuccugucaccuuccagcacuggugugucuucacacaaaccacaggguggaagucagaagauggcugcauaaaugguccucuccucccaccacauggguccuaaggaucaaacuccggucagucguugggcuuugcagcaagcuccuucaccugcuuagccauuuugccagcccucuaucuuguuuuuucagagucuuuugcuaaaguacaggucgcucuuuaccuaagcuggcagauagacugagccugucuccaccuccccagcacuggugcaucagagccauaauugugugagagcuggauccgaacuuggguccucaagcuugugcugcaagcucuuuaaccacacagccgugucccuggcccacggcuuuugguuuuugguuuuuaucauuuuaauaacuauuuucuugauuacuagugagacuguuuuuuauguaguuauuagguuuugcccauuauuaaaugccuuuuuauagacauucaaaauuuauuuuaguaccaauauucuggcuuuuaaauuauccaaaucgccaggcguggugacgcacgccuuuaaucccagcacuugguuggcagaggcaggcaaauuucuaaguucgaggccagccuggucuacagagugaguuccaggacagcuagggcuauacagagaaacccugucuugaaaaaaaaacaaaaacaaacaaacaaacaaaacuauccaacucuuuaucuucucucgcguaccuguaucccuuuacuuucuagguuuuauguuuguaaauucggaaguuccugggucugaugauacacacucauaaucccagugcaggggagccucagucacccugccucaggggaaaaaaacaauuguuuuaauuucauguauuuuaugcguaugcuucuccaaacaugugugaauguuucugcaccauaugcacgcccugugcuuucagaggccaauagcggaugucugauucucugggacuagagucacagacaguugugagcugcaauauaggugcugggaauggaacccagguccugugaaagagguucuuaaccacugacugaaacuaucuuuccagucccuagggaaaaauuauggaucuauaaaucauuucuuuugugacuuauucugguaugugugugugcauugguguagggguauaaaugugaguggaucgacaggguuucacguagucuaggcuauucuuaaacucacuaaauagucaaggcuugacuaucugugaaucucccaagugcugagaaugcgggcauacaugacccauguccaaccuuaugaccuucuguugcugccaucuuuaagaaacccuucccuccauugggaagacagaauccugugauauuuagaguuuuuguuuuuaaaucucucccauauuagauauuuugcagggagagggccuggugugguuuuauuucuuucuaaucaaaaguccacugggucacugacccuuccuugucuguuauaacuaccucaugucuguggcaaugcccuucccaguccguucaucucuuccuguguuguuaucacgaggaauugacuaauauaguuuugaaguauuguugauacuugauuugugccaugacucucucuuccuuauguauuuuauagccaguuggucacauuccagagucccaggugcucuuggguuuucauugaaauugcauaaaacuaauaaaguaaguuauaaagagcugaugugugaauaacacugagucucuucauucaugcgcacagcauuggucuccaccacuuaugguccuuucuguauucuccagugaaagcuuacaaauacaugcaccugcuguguaugguggcuugugacuuucauaccugcacucaggaagcagaggcaggcagagcuuuguggcuuugacauauagucugcauugcgaguuaccaguccagcaaggacuacauagugagguccuggccggaggcguguggcagcgacagcggugugggggauggagggaccuacauuuucauuucuguuuuauuuguuaaauguccaauauuuaaguuccaguccacagaacaacuugacaauaucacaaucugcuguacugaaaagugugauucuaagcaguuuguggcuuuaucaggguugggaagguagcaagaacuagguuuucguaugucaucauugcauaacucuccugccuguagaauauaccaaaugcccuugcuguguacggucuauagggucaucugcacaaugaguaaugcuguccuuaccgcagggucacaccuagguuuccuguccaguguuuuccagauagcaucacacacauugauuuacuaguuuccuucacuuuguuuuuaucugguugggggugauucauugguugcucucuuuggaaggagucggggguuuguuucugugggguuuuguugcaguuguuaaggguuucggcucugugagauagacucccuauguugcccagguuggcuuaaaccuuacagugcucccucagucuucccggugcugggauuuggugcuguaguguaccacuacagcuguugucuuuugcuaaucucuagucuucucagagcuucucccacacugccugauuucccagcgcuagcuaaugugaccggagagucauguccggcaucuccgauguaacacccaaacguaucagcaucaaugucugcgaaagccgaccgcucuuaggaauguuuuugcacggcauaaaucauuauuuuaacguugaaauggauaaaaaugguuaacuagguugacaggcuucccuccugccagcugaugucugcugugagcauuucaguuccuggaugacagagcgagaacggauggcuggcuuucaauacuaugcuugugggggaauuuucagucaaaaauguaaaacuuugccaagcuuugcaucgaauugcuguacucuucaagcacuugaaggccaaugauucuguugcccuuuguguuucuccagcuucccaucguggaaaagauaagagucauugcccagacugucuauggagccaaggacauugagcugucuccugaggcgcaguccaaaaucgaucgcuauacgcaacagguaaacaagauccccccacucuucuuagguaggguaucugccguuaucucaaaauacacaccuugauuuuaaguuccgucuccuagugaagcucuacucaauugccagaggaccaacagagauuaaagguuuggaaguguuggcuaaguaaaccaucauaauaaagacauuuacucucugacucagguauccuugaucuccgagaucaugaaugcggcucugguuugcagagcuggggauggaacccagagccaggcucuuguacuaggucagcacuuucccacggggcucuauccguauccaauguaugcgguauggcugucaucagaguucacaugcacucccaaucccucagucagaagcacagggaauugucccuuugguaugcagaggggagucagccuuugauucuuuacugcccuuuuggcucuacugucuuaaaaauccuugcauacgaccagugaggugaacgcaaagggaguguucaguguucagugaggucuguaugcagguaguucauuaccuuguucucaggaguugaaggcuacaccaucuucuaccucuagacagggacaagggcuggaggggcuauagcccaaaggucccugagccucaaauacuuccaccugcuuuacccuugcuacacagaagucagcaucucaguucgaugucaggaucacuacauuacaaauaacauugucgacuuucccccuccaaccccuuugucuuauuuagaauaugugugauauuuuguuaaauacuauccuaucagugccaaguugaaugcucucuggggucugauaaaaaucguuuucucaacugggcagacugguaucucagaccuuuaaucucagggcucaggaggcaguggcaggcagaucucucugugaguucgagccuggucuacagagcuaguuccaggacagccagggcuacacaaagaaacccugucuuaaaaaaaccaaaugucuacucaccuggcaugggaggcaccacagucaugaagucaguuuuugcaggcgaggcuuacccauugcacccgggauuugcugacccugcaauauccccaaaugugggaaaccugacugccuaguuugugguaguggaggaccccacucacccucuccccuggagaaaagaauuuuuuucuugaagucugaacuuguauucuuuuggcauggcucguucguuucuauuuucuguuguacuggcccuggaucuaaaagccucucucacauucucagccagggcucaacccuagccccagcuucucuguuuuuuuuugggggggggggugguuugguuuuuuuuuuuuuuuuuuuuuuuuuuugagacaggguuucucuguauagcccuggcuguccuggaauucacuuuguauacaaggcuggccucgaacucagaaaucugccugccucugccucccaagugcugggacuaaaggugugccaccaccacccggcucucucuuucuucuuuguguguaugagagaguguguguuuugcacacaugugagcauacgggugugugcaugugugcauagacaugcagaaagcaucauggucuaccugacugccuugaaauagggucucucacugaacuaaaaguuaacugucuuggcuggguuuuuuagucagcaugcucuugggauccuccugucucuacucaucccacucccaucaugcuggaguuacagacaugcacagccacauauauauauaaaauauauucauauauaguauguauaauaaguauuuauuuuauauuuuauacauuguauauuauauaauuauauaucuauauuauauauacuauaugagauauagcauauaugauuuuauauacuauauauuauauauaaauuuuacauguuauauaucuuguaacauauauuuauauuauaacauauauaaaauauguucuauauuuuaaauuauauguaauaauuuauauucuuuaauguuauaauuuauucuaauagucuuuuuucauuuugaaauaugacuuaugguagaauauguuaaugggaugauacauuuuuuaauuuauaguaaauuuucaaaggccaugcauauaauuuuauaggaauuauuucaauacuuauucauuuuacaaaaucagaaauucuagguaccaguuaugauauuuuuuccucgccaaaauccucauuaauauguaaaaguagggauuucaagaauauaguacccacucccacccccgcccccacaacugauauggcucuaaaauguucuaaauaguuguauguugaaucauaagcaauuacauucugucaucugucugucuaccacgggaauauuccuuaagcauuagugucaaguaugugguugcaauuaauuaguaaggucucugaaggaacacuaugugcuguguaauuacagcauccuucccagacacuguucuuuuuguaaguugcugcacgugacuuccuccccuuucaccuuuggaauucugggucaggcacagacuuugguccuuaaaaauaaaagaagcugaaaaagugaccucaucuuaguuccuagaauguaaucgcagaucaaauagccaugauucaugagccagcacaaagggcccuuugcuucccagcagaccccaagaagggcagaacaauggcccuaagagccucaucaggagccuuguucugguuaccuuucuccuuccuggauaucaauagccuuggaaagugcuuucuacagcauguccagugcugugucuaaaaauagccuugcuuauacacacacacacacacacacacacacacacaaugcaagugccuccucucuaggagaaccuucagaguaaacaaaaaaaaccucacaaccgcuaaauaauggccuuaagagcagaggucuuguccucccucagcuucuagcugaacaaacagccacgcccacuagccucaccugcuggagucugugcccagacacaauugcugcagagcucguguaaacaaagauccagugcacgaagccagcacucauggcaaagaaaguaauuccuuuucauuccugcaggguuuuggaaauuugcccauuugcauggcgaagacccaccucucucucucucaugaaccugacaaaaagggagugccgagggauuucacucugcccaucagugauguccgggccagcaucggggcuggguucauuuauccuuuggugggaacggugaguaccagaccucaaagcuauuccuaguuuguguugcugucacgucuuaaucaugcucugccaacucuacgaaucacacagcaggauggaauugacaauuuuugcugguuuucuaagcacucuuccaccaauaacagggugaaaauacaccucugccaucucgggccaggcccuucuauuuucagaucauguguucaggagccacagaggcauaaagugaauuuccuucugggagagagaagagagugaguggucucaagaucugucugcugacucagcagcaguguggcccagugaccgacuucugcugcaacucagaguuacgauauuguauuucuaugggcaaguuggggcuggcugcucacaguagccaggacccuaacagcuaccccaggggugagggggaaucaguggcccacccucuguuuccuucuucaacacaucuugugugucccuuugggaugacauuacacauacaucuuauucccaacauguuauugaaaaguaugaaauaauauaaaauugucaaguggggacauuucacauuuaaacauaaaaggaaacauuuuaguguaguggcuuucaggagucacacuauuauuaaguaaaguauuagaaaaagccagugguguauaccuuuaaucacaguauugaggagacagaggcagacagaccccuguguguccgagacuagucagucuaaucuacauacugaguccgugcucuauauagugagaccuugucuuaugugugugugugugugugugugugugugugugugugagugagagagagacagagagagacagagggggggugagagagagagagagagagagagagagagagagaccuugugacccugaacauagggaagaagcugauugguagacagaauugagucuaguguuagcucauuugaaagguugucgggacauaggaaauaagucucuuagaaacauagaugaagccaggaagaugguccuguggugaaucucccaccccaccccacccccaccuccauggccaggcuaagaccaaagcuguccuguaaaaucagcguggacucuuucccccagccuguuccugggccuggcucucugacuuaugaccuguaauaaaugaaugcauggaacaguccuggagcagcagcagcuacucacagguuuccuggagugagccaucagugacguuaucucaacgcagaaguuccccugguggcugcucucagggacagagggagugucccugccugcccgaaaucaggccugaggaaucaggaaggaagugaggccuaaguaaaggggguccaggaaggcaggacacugucacuuggaggcacucugugacaguacaggaagccauaugcaagcugggcaaauucccccaggaggccaggaucuccuaauaaggguggaauuuacuuucuuuguccgcacucugggcccucccacagacuugcuggaaugcaucaagcauucaucacuccucugagagacauugugguaacuuccuggugggaugacuaaggagaaggaaugggggguggggggcgggaugacacucagggaacugaccccugcaggugggaaaauucuagcuggaugaagcaauguuaugcuuagucauuccacauucaauugcuaucaggcaucggagauacugagauacaaggcuaaccuccaauccccacucccugacguccacaaucagaacuguucuccauucuucaauagaauucauucauucauucauucauucucuuauucagcaagucauuaaugguaccuccagcaugcauggggaagaacgcggucccuuaccucccguguggguuucugguacagagacucugguaaauaaauguccaacauggacagaacacugugagcuuuagaacacaggggcagguccccucuugguguguccugaaggcaggcagauagcccuucuguaccucugcugcugcuuaagucuugaaaacaaagaauuccagcauaagccaguccacccgcgagugguaacuggggucagcuugacugguguugggaaaucacauggggaaugcuggaaaggcgucaccucuuuguccuucuggguauuagcggcuggacaccuaccugaacuuccuuccuugccuagcugucgccuguguuuuuggggcugagcugucacaucgcauucuguuugguaauugcuuuaauuggugcugauuaacacuuucuaauggcuaguguggaggcuucucuggcccauuucaccuccccacgauugauuuuuuuauagaaaccccucggcucaccaucccgaagacuuucuggaugugugaggguagccaaguauuuuuucuacagucacuuucuuugucccuauguaaaaaugcauuccugggcuggcaagauggcucaguggauagagaugcuugcuaccaagucuaacaacaucccaaguuuaaucccaaggacccauaugguaggaagaaagacccugcuccuaaaaauuguccacagaaugccacacaugcaugcacacacccauacacaaaauuaauuauuguaaaagaauuuaaggaacguauuccugggugccccugcuucuuuaggaugacauuacauauacauauucuccccaacauauuauugaaaauuacgaaauaauaaaagauugucaacugguauagugcacaccucagugccucuuuuccuaagaaaucauuugccaaaugcauuuuuuuuuuuuugagcaggggcagaaggagcaaauacuuucuuauaauuuucccaaccucaaauuuuauaaacuacucuauuccuuggagcuggugauuuauaauagccaauaaacccaagagccuguguaacuuuucaaaaaauaaucucaugaugaaagagauucgugauauauauaucagguguucucuguccuaucacauugguucagccuuuaauuauuuacaaagccucuuuaaucacuuggcaugaaauauuauuuacucuguaagccauauaugugaaguaauguuggaacauaaauuccuuagagaaaggaccagaaagaccacaccaaacccuuagugugaaguagcguauaucacuuuuauaacauaaaaaauaugauaaauggggaaaugauaaaccauaagcacuuagaacaauauuuaacuugggccaaacacuuucaggagaaucagaguuccccagcgugugggaucugaccccaugucuccgucuugccuguuugggcugcuggucauguucugcaagcggcgcgcugcguucaagcaaggggaaggagcugaaguggcccuaagagacauguucucugaagguggugugucugaauguguucccuguuuuugcaaaagggagaaaacccagagauuucucccuguuaauuagucccgugcucuucuuacacucgguguugggguggagacgggggcaaaggacuucuuucuucucaaagagcuuuccuaagcaguuacacauuuccaaaacagcauggagagguauccaaccaagcuugaauucuuaacagauguccauuugaaguuggcuuuuucugugacuguuuuucuuugauaucacaucgaggcuucgaacaaaggacucugaaggaauuuacagugggaguucuuucuagguggcuuucuugguggcugguuggugggucucccuauacaucccaggcuagucuugagcucacaguuccucugccuucuaaaugcugccguuguaugaguuacuaugccuagacugaauucuuuuuuuuuuuuuuuuuuuguuaagucagguuuaugacauacagggcuggguuuuugguuuuuguuuuuguuuuugagacaggguuugucuguauagccuuggcuguccuggaacucacuuuguaggccaggcuggccucgaacccagaaaucugccugccucuaccuccugagugcuggguuuaaaggcgugcaccaccacgucuggcagggcuggaggauuuuaugauaaucuugacuggaaucuuggacuuuaacaaucuuacaauucauccagaacaaauuaagccaucuagugguauuuaugggguaguuagcaccauauaggguaucucuaagaguugcugggaaucugucucaaagacucaugaggaaggcauacacugaggcagggacauccgugacacgcaguggcuguccaucugguuccuucugucuucuaguccauucccucggcgaccugccuaaggagaauccuuaaaagauccuaaaagaugauucuguaugcaugugcacacuccuuuuuuauucucuccuuguggggaggagccaagguggaccuaccccaaaguggaagucuccgggacaaacgauuagaagaucagcuucgugcugggcugugguggcuuacgccuuuaaucccagcacuagggaggcagaggcaggcagauuucuggguucgaggccagccuggucuaaaaagugaguuccaggacagccaaggcuauacagagaaacccugucucaaaagaaaaaaaaaaaaaucagcuucaacuugcuauggcuuuugucucuccuaugggugaccugaucuggccacaccguaccacuaccaggugcaccccugacaucauugcccuagcuggcccccagaaagcaggaagcugccagagccaaugggggaaucagugacgucauacccagaugacgcuggguggagauuuacuggacccgguacagggguugcgggguaaacacagcaagccccggccucacccuccagaggcauugccgguuuguucuuucucacguuccguugaacuccuucuguuuucccuccuugcucucuaaguauguacugaauguagagcugccugcugcgcugauucaggucagcuugcugggaugcauccccacccgccacccccuccacuucaggaugcaugguuagccaagcgcuuucuaaauuccacugcccaccggcgaaggugaagucauucagaccuuguagauuucaaucggagggacaguuugugccauuuuccagagauagacuuuuauuuacacagugagaaaagcaaacacuccccaagccgugcucuaagugagacguacaaaccauaguaaagcggugaacuccaccagcccagguuguccaucgggggagcucacacacaauguacuuccugcaaaaucaccuacaccccucucccuugcucuccugccccauaguucaguggagaaacucccagccugcuucacaaaaguuucaacaaaacacguuccccucuguggugccccuagcuccuggcaucuguaacacccugaguugggaaugaugcagcuccguguggccuguggccccuggcugagcccuuggcaguucccuccucuucccuaccuugugacguuuugcuucccuaucuaacaucagaguuuccugcuuucccucagacauggcccuuacaucagcagcuuccucuugacgugguguacugacaggggguccucugccugcauggcagcgugccuccguucagggaaaucccacguucugcccagaaacagaggagaccuuccuguccauucagcaugcuauguccaagggagaggacggugacugguguccucaguuuccaaaaacuauugaccaacaagaggagaaagcgcugugugacucaccgggccagugccuuucugcuacaaaaggucaucugggucccauccccuuguuucaaucuuuuccucccuagaugaaagccaaauucuucucugcauaaacccagaguuaacuuaaaugaaagcaguccccauguuaccugugugugguggcacauuccaccacuuaaggagcaagagugggagagaaugggaguucaaggccaaccuggaaugugggggaaauggaaagagcgagaggggagagaugaugccuccugaguggcaggcuucucuuucugugauggguggaaugcagccuuacacuugcucgcccagccuucucccauugagcuacaaucccagacuagaguugaaccuuguucuuuuacuuucugcauauuuagccgcucucugcccagccugcaaucagcuuuaucaacuuauuguuuucucuagcgauugauacgaucugauuccauucucucccaccuccacguuuggccuccuuguuuucauucccggggguuuugguuuggauuucaggcauaggaauguuagcaaaaauacacccuuguucacucgagcgccugagagacacccgucaagucaucuugugcuuccggcauuugucauagucugucccucuuuaucacacuuccuuacccacgggcuuugccaagaauccuauaaucagaagcaggggacauuuaugcaaaugaaauaaaauuaaagccaaaaugcuaauguugcaaaaaaaaaaaaaaaaaguaauaggccacccucagagucugucggagggcucagugggaagaauaaaugagaaagaaaagauaaacuuguaagaaaauacccuuuuguaaaacucagacggcagugugcagagaaauuuaacugauagaaucuggacuucauaaccguuuacaagauaaacugaguaugugucugcuaaauuagccagccacgaauacuggguugaaugggaaugggaaaugcgcuagacugcucuugagagaauugguagcgcugccuucucugagaaucgcugagcauuuaauuugauguaggcugggaguuuaaggugcugagcccauugugacgucagccuccaguggagacugggcacucccuccccaagaaucaauugugggcaguaguguaguacccaugucugucuguaccucccaacauucaccuuucauuuuccaaacauaucuguuucuccacugaacacaaagcaacugcagcucccaagcuugcccaggaugagauagagagugggcaggcuugggcgagugccaugagaauauacauguucucugaaugcuccauuucucuggcaagcacacaucauuccugccucucgcugcacccaggugaagcacauugccugugcuucccuuggguagccucuuagucgaccaggucaucgaugcaaugucucuuguuaauccaagccccgcucccccuguacaucucuugguuucagcucugugugccuugcugcagugagacacuccacguagaacagcaacuugacugcuagcuacugagaauaagcucacagcagaugagggagccuuuaggagucuucugccauuaugaauucaccagcacuacaguucucaaaaccgucuauaauagucuucuaaagaguuaggaguacagccucagaggcucacaaauccugucugaccugguaguccucauccagcuaaguguugccauaaaaccagguccugacacaucaaccuuacugauguguucagacagggaguuacauaucgaauaucccacuauagaggaagaaacagaaugaaguauguugucauccuguuuccaaaauaaacucuaugaccagcuauaagaacguucaugacgaguucaaaaccagggaacaccaaguacaacuccaucccguaacuccguuuugauacucucuaccuauagaucuuguuagaugcuauaggcuaaggcucagccacuugugacugggcuacccauccuucugaaugacuggcucacugaaaaccaugguucuuacuauccucuucccggcuucacuuaaucugccuggaugacuuagaacuaggggucauggcugacugcuuuguucugguugcugugaaugagacgggugaagaagagauaagucaggugcugucuggagcguccuggcugcuagaucuucugcccccgugguauucaccacacucaaagccaucagaguuucuuccagaggguuuguaaucaaucccacccugccuuuccuggagauaaguggguggaugggcuggagguuccagucuugcuccccuccuuuccagugauggggaccaacucaugcaaauauucuacaaacuagcuccaccccagccuuccaguccucucagaaguauuuccugagcaggcccaugucagcccauguuccagaaagucucucccuacuagagcgauuguaaauaaagagaaggguggaagagaugggagcccuuugacucaaaucugucuccucugagauguuguuuagagacauuuauggcagaagaaucagaguguguggccuggagagauagcucagugguuaagagcacuggcuguucuuccugaggacccggguuugauucccagcaaccacauggcagcucacaacugccuguaaguccaagaacugacauuaucauauagacauguaugcaagcaaaacacauaacauaaagauaaauuaauuuaaaaauagaaauaaaaaagaauccuagugugcugagacauggagaaugguggucagagggaggaagaggugaggaacccaacucuaaauggugcauuagcaucucugcugaagaaguuugcccucugguaucaauaaguuagccauggagcacuuuuacaggaccaguaagggugugggggacaguguuucagccaguaaugagcuugacaaggcuugcugaagaucaguguuaccaagauaagugugcaugaagacugucguuaccuauggcaucguuaccugggcccacuacgauuguccuggcauuuuaaauguagagaagugauuuucauuuccugaguuuuaacuagaaagagaggaugucucaggcuucuuacaagagaaaaaaaaaugucaauuuucuuggagaguuggauccauagcauuugauuuuccuuaugaccagauccuuccuauaccuaugaccccaauauaguugcuuuguuaacgugaaagcaggcauuaauggaaggaccuuauaggaauauuuuaacuaaaaaaaaaaaaaaaauguuccugucacccuggaaauuccacggguuuuaggaacccucaggacuacaacugaggauagccaccaaauauguguaaacuuucacauuuccauggguggaagauacggguuggggguggagguaggugugggggaggauccaacaccauuucauagacaacuuaagcaucuauggauuuugguauccacaaguagggauccaguaauguuagaugauguguuuauaaaaagauaaagagaggggggauaguucugugaugguguguagugagguaugggggaagaggaguuccuuggugggcccaugcugagguauccuuucccccugagggaccagccacaggacagcauaguauagaauagaguuuauucagggcauggggaagggagucaagaggguaguagaggcagagacagguagagugagagaauagagaaguagaggccagccaugagcacgugggggggggggggugggaagagaguuggagcaagaacaagagaggaacaagucagagaggagggggcaagcagccccguuuauagugagucaggcacaccuggcuguugccauguaacuguggggcagagcuuagacagaaugcuaacacuagagacagcagcucugucuggccuucacagaugugccugggauuucuaacucagaaccacugauccaucauagaucagaagccucuaaaguugucucagacuguauuaacauuaauaaguagagcugucaaugaagaagaaauugcaucugguugaggcccuucuaguuugucugcucuguacagauauugugauacauuguagcuccccauucucaacucuggcugugauggaggcuagcccaagacacuggagcccuuaaccuguuuuucugucaacucuaccuucucucucuuauaugguuagagagaugccaaaggcugagagcgacauccaagcuguaauaucacagugggaggugacaacuuuucuucucugccuauauuuacaaaagcagugcacauuucuuccaugcugcucaacuuaaacacaaguuuuacaugucaucccaggcagggcaaguuucacggccaacaugaacuaccuugugacgccccaucuccaaaaaacaaggggcaaguucuaguugugaccugauuuuuaguguguccccucaguccucuccauugagguuggucagcauagcucccaaguccaugaggucauugguauuccuucccaaguuacuaagugucuuucacacaaauaaaagucacuauacugguagcuauaaguucuucacuucucagugucauuauaacugacuuuccccccaaaacaaagcuguuugacagcuggagucuguuuucauuuugagguuugucauaaggaguggaaugugcuucuguuuaagaguugggaacauuuuggcagggagagagaagagaaacuacaccccacauaaggaagggagucccuuucagcuuuuauaaaaaaaaaaaaaauuccugguuuucucuuggggcauaagcuagaagcuugugucuuugggguagaaaagauuucaggagaaaaauccauuacuggaacuauguagcuagaaaaagagaugguuuugugcaggaaaauagagguaacuuuuccagccagaacuucagaguucuuccucuccuugggcaguaaguaguuaagggcacaucucaaccacgguagggaaugucugcagagcuuucuguaaaauaugcccauaaauccucccccagagcuucugagaucacagauccgagcugaagacagugauggaguaguagcgcaguucaugugaagugcacugguccacuucagcgagcugggacagccagcuccccguccacccuuccccccaccaucgcuauacagccucagcuccccauacaguuccucucagcagagacucugccuucuacagcuccgugauuccuaaggucucccauggaagugagcuagcuagcuugcuugcuugcuugcuugcuugcuugcuugcuugcuugcuugcuugcuagcuugcuugcuagcuugcuugcuugcuugcuugcuugcuugcuugcuugcuugcuugcuugcuugcuugcuuuguauccuuuuuuauuuauuuuuaguguguguugaugggguacuauagcaccaaguagaagccaaagacaacuuuagagagccaguucucuccuuccaccuuugguucuggggguuaaauucaggucaucaagcuugugagcaaacacugaacuacugcuagcucuuuacugagcccgugcaugaucucuuucuggcuccaaaagaaucuuuuuuuuuuuuacaaauauaauauauaacuuuuuuuagauagcuuccagccagaaauuauuguaaguacaucuuaugauuccaugucuaaaauguguuaugacuuagaaaccuaauuugugcguagggauaagguuucaugguauaaacugucuacaauauaagaaugcauacaaguggccaggugcgguagugcaugccuuuaaucucagcacucagaaguagacgcaggccugaucuauauaccacauuaugggcuagccagagcuacacagugaggcucugucuuauuaauuaauuaauuagguaauuaagugggcuggaaagguggcucaauaguugagagcacuggcugaucuuccagagguccugaguucaauucccagcaaccucaugguggcucaugaccaucuauaaugggaucugaugucuguuucuggcacguagguguacaugcagguagaguauguaugcauauaaaauaaauaaaauuaaccuuuauaauuaaauaaaaugcaaugaguguauagacccacaggucaguagcagagcauuugccucacacugaagagauccaucucuucaacacauccaggaaaaagggcauagaaaaggcagggaaaauaaggagucgcuuauaccaaucaugauaaaaauaaaaacuguccucagaacuaauguuuauggagcacuugaagugucgggcaguguucagagccauuuguguauagcugacucuuuugcuguucccaguguccuuucgggagaaucgcaucucuguucuuguucugaaagcccaggggacuuaagucucuuacccagccauagauggcaaguggcaggucaggauucaucauugacuuuccuucuuagaaaauauucccauuuuucugcuggggaugugguccucuuuucugugaauuagucaaauuaaacuuugcuucugccaaccaauuagaaagggcaacuucaaacuacuugcccauuuugugggcagaugauguccaaaccuuugugccugggcguuugauauuuccauacuaauuagugaaauggaccagcaaauuggcucagcagguaaaagagcuugccacaccagccugaaaauuugaguucaacucccaggcuccuuaguaggagagagcugacuccugaaaguuguccuuugacuucuacagagucaaaugccuucagaggucuggggagaugguucagucauccaacuacuuaccaggcaagcgugaggaccugaguucaaaccucaggagcuuacauaauaaagugagcauggcaguagucaccucuaaccccagcacugagagagcagaguccuagaggucaacagauagucagccuuaccaaaccaguggguuccagauucagugauagacauuaucucaaaauaagggcaacugaggaggacacucuagcccucuagcuccacacguguaccacagauagucacacaaauaaauuucauuacuagcgaagcuuucucaagcucuuuguugaaaccccacccccuucugggacugacaucugaaaacaaaacaaaacaaaggggcaacgugcaaaugguaguggcacuuuuacacuaaagagacagauucuccucaccaagaaaaacacccauccauacacagcgagguggcgcucuguccugcuuucacucuccacaguaaauuaaaacaugccagggaaccuucacaccuaugaggacagcuggacagagaauguuaauuucacugcgugucagacacagccuguggcauauuuauaaugggcugaggugaaaccucuugucucacuucauuuccauauguaauaagagaggccuagccaaucucccacauugauugaauaaaauaaauagcuuuuugcuaccaaagaauaagacuggggaaggagggcucgagagauagcucagugguuaagagcacugacugcucuuccagagguccuaaguucaauuccucgcaaccacaugguggcucacaaccaucuguaaugaauucugaugcccucuucuugugugucugaagacagcuacucauacacauauaaauaaauaauucuuugggggagaagaaaaaaguagggaagguccauggcaggaaccagcauggguggcaccaaaaauucgaacagagcagcccauggggacaccaauggcuuguauuuugcauggccugcacucuuggucuuccaaaaguuuuggguauguaucauagaaacaugauucauuuugcuuuagaaaugcccugacagugacagccaaccaaagucauucuuuccauuacaaauuuacacaguuuucugcaggcuggaugauauugugccuacagaguuugucucauggaucucacaggauaucguaaaaauaauuauuuaugggcguacauauaauuuuaauuugcccuugugagaaaggagagacaugauucaggugugcccuuaaccccacucccuuaauucccuaaacccuugccacaccuguagugaggccauggauuccaguguugaaggacacauguccccaccuggcuaucuuaaccugcaacaguucaguaaaucccuacaggucuccuaagaugugugugaguguguguguuccuguauauuuuuccuaagccaccauuuccuggacccccaaauuauuauuuucucuagugauaagcacauugugagacucgagacaaauaggauaccuaggcuuagcauccacccuuauauagcugguaccuucaucccuggguacacugaugcccuuccauuccacuucugucuuaggcuucuguaauucugaacuggauauaauugguauuauuauaaaaucaaacuaggaacauuggugagugcuggaguuuuguuguggcuggugguuuucgugacaguugacaaccucuugaggcagaaaaugcuccccacuucccauuuuguugaguacaccucauacuaaauauucucaguagugggaugcuguugcuacccgggccaccuggugauuggcaugucccagagcacuuucuggagcaugugcacugcugcacacuguaccguucacuggaggcagcugugugcagcacuugugagcacgcccagcugucuuuuggcacagugaggacggacgcuuccucgggauauugcauaauacgcaggggaaucguugcuuucaguggauguuuggcuuuacugcguuccagacugaagccuuuccuguguugcaaaggaagguucucuagucacucaaggaaagacauaggaguucagcacagggcaaagcaggccacaguucgcagggagacaccaccuccaagguaaggcagcacagcauucauggaaaacgugcugaaacaacucaagcaauguauuuaaauaguagagccuuccgagugucuccuuggcauggaguaugcaccccagagggaacaauggagauuuugguuauugccaaaagcucaggugcuagaguucuccccaaaggaaacgacuagcccucuucuauuagguauccuguccuaaggcaugugggaccauucauuaagccaguauagccuacugaaggcacccuguugcacacaaaaugccagaggucugauucaccuguucagcauauauagaggaauguuggguacaaagccaagagaaaaccacaaaggcccuugcccuugaggaaugaacaagcuagugagagacacaagccugcagaguggauggcccugaaagccauagagaacuuaaccagguaauacaagacauagaggcagaagauacagaccuucaaggccugaaacaauauugcugauguccuuuaauauggcaagccuguauaagugguacaagaguuacaauguguuaugacacugggcaggaaggcaugacccaggucacaugaaauugagugccaagcuugggaauuagaguuuaucuugcagagccugagaaucuuaaguggagcaauauaauuaauuauguucacauuuuuagaaagaucacucagguggcaagauggauggaacagagggaggaggacuuaaucuuguuaagaugguaacuguuauggcgggagggagugccacacacccuuaaucccagcacuggggaggcagagacaagcggagcucuguguguuaguuagaaaccagccucaucuacaaagcaaguuaccagacagucaggaauguuacaaagaaacucugucucaaaaaaacaacaaacaaacaaaaagaugguaacaguuacaaagacaaagaacuacauaagguugagugagcuagagacaggaaaucagguaggaagauacaacaguaccuaaagugcgacaucaaggaagcucauuagacacucuggggucuuuacucuuaccugguccuugagcacaaauaguugagggcaaagacuuugcgacauuucucuuuucuuccuaguggcuaacaguaccuggaaacauuuaaaaaguguuggccaggcaacaggagagaaaaagagugaucuuaguuaucuuaaaaaaaaaaacaaaaaacaaaaaaacaguuuggacagagugagcuuguaugccuacuuagggacucaugggagccccgcccucacccacacccccagcauccucucugcaggcgggguuucaugaggacccugcucucccaccuguuacauuaucccaguccugcacagugaugaauuuguuuuuuuguuuuguuuuuugguuuugguuuuuuuaaucauguuaaggaaagcaguuuuacaaguucaagugcagacaccaggacacuuuguaucggguuuaagguucaguggugagauccguuaucaacauaggauucuggagacaggagcgucuccaggcauugacgauuacugccgcagacccucuugguuccuugucugcguggaacgagucucuggugcaggugggcaaggaguuggugggaauugacaggacuggacacaagggaguguggaucugaauguaauuugucaaaucgagcaucaaacuuuuuacacagaagaaaauagggaaguugggugacacacuggcaagguacaaagagguuacuggauucuuacacaaaacaaaggaauacaaacauggaaggacuggcaggaaccaauugggguaaaacucaauguuaacaacugggaucaaaaacagcuccaccuaagguccacuuaaucuuagaagccaggggcaagggcacgaagcccuugccauaguuccugcucuagucuauuuauuguauaguccaucuuccccuuaggccauuauaaauacuuguguauggguauaacucagcuaucuauaguucuaaguaucuacuccgguuccucuuuaggucacaaacuuccuucuuccuagauaacgguaaauuucuguguagggcagugacuuagcuauacaugcccaaggucagaucaaagacuaccuagaaucuaacuuagcuauaugucaaaauaucaauacuuaggaacacuuguaauaaaacaauauugucgcgucccacucgaccagcaagaaagacgcaaccaccaaccaccgguucuucuuuaagcaguuuacucaagcagcuacuuucuucaaaucccccagccucucuuguuacaaguguuuuucuccacuccagccacaaccacacccccaccaaucaccacaggucacaucaccucaccaggcaggcuugcucagccaaucagggauuaagggcgggccauccaccaaacaugggcuuguuuacuaccuggagcagaucuccauccugcugaccagggagccccaauggcuuccuacacaauauuaagggaaagcacacagaucccuuuaccaacuaaagcaaggacauuggagcauucuuuauacaggaugccacgguuccaggagacuaaguuuccgugaacuuuucaccuugggacagugcccagguuuucagggccuguugcgcuugucacuacuggaguggguguagcagauuacacugggcauugugguacacuaugauucuagcacucaggagccucuggcaggaggagucuagcaacagucucucccaaaccagucccacagaaaguccaacuccauaccuaccuccucuucaggcugguuuguuagagaugguguaagaggaagaagcuuaaucucugccaccuggcuuacacuguuccacguggcuuacaccauuucuuacuucaaagagccugcuccucagacuuuucccaggagagcuggucacaucaaggcucccaccuggaaggauuuucuacacagccuuugaagucaaccauucauguucaaucaaccugguugucaaaggacaguagauaacuaagaucgcucuucuuuagucuuguuggcuggccaacacuuuuuuaauguuuccagguacuguuagccacuaggaagaaaagacagcuaucucaaagucuuugcccucaacuauuuguauucaaggaccaaaaaaggagaugcaacaugcaucucaguaguauguugagaacagaaacagggugaguggcccuuugaugcaaagaggagaaagaucaaauaaaagcacgugaauuuuugcauaaaacucuguaaaggauacaguugaacuugaaaacugaaaccucucaguggguaaggggcuugcccugugcaagcuugaauccaagugaaaagccaggugugauggcacacccuuguaauccuagcaucaaggaggcacagacagaucccugggacuugccagcuuauuugaugacuugcaggcuaauaagagacccugugccccucuccccagaaaagguugguggcaugcugagaaaauacacccaaguuuaacuugugaccuccacacaugcacacacacacucacacauacauacacacacucacacauacauacauacacacacacacacacagagucugaaaagggaaaucacuauuuguuuauuuaguuuugaauuucauucuggguggcuuuaacugggauggaaggcuuagaaagccccaugacaguuguucuuuaaaauguccaucucagcuaacacguggaauauagcucugucuuuggucucaggaguuaauguuaggaccuaaagugaccuuguaagcuggaugcaguggugcucaccuaucugucucagccacuccagacacagaaggaguucuaggacaagcccgggcaauauugugaaacuggccuaugugggccccuacuugcacuuaauuacaugugugugugugugugugugugugugugagcacuuccauauccuacccuuagugaugguggguaacaccuugcuuuauuuuaagugucucaggggauagcgugaaaacugugccaagucaacuguaauaguagaaaaguuuucaaacaaauugcaggucuucuguaucgucucaacgucuauguuuuaaaaacuaagaauucucccuuugggucuuuuuacuccucucucgcuuccuuuaccgucacccgucacccacagccuuuguucucguagccuucaaacaggauuaauugaugccaugcagcaucaggaaaagccugaauauuuuguaagaggauucaucucgcuaaaugcccaucuuucuuuucaacuucgcugacaaacaugguuuaugcagauguagcgcaauuuguuuauuucccuguuuaaauuugaggcucuuuagcauagcauguuuccuuugcgagaggcuagccaaaaauaauauugacaaaccugugaaggcuuccaucugauacuauugcaaucuuaugcaaauguauuuagacaguuaagugaauagaauaauuaaacauccaaaugucaagaaaggaguggaggugggggggaugggcggcaaugaagcauuugaaaaauacaccuuuaaaacuaaaaggucuggcuugcaucugguuuguuuauuauuguuguuuuguuuaucuugaugucauugcuguuuucagacuuaaacagagcacacuguagcaauagaaaaugauuggcauuuuagaggaccauacuuucccaucagaagcuugaaagaccccuguccuaaugcuuccacugggaccaggccacuccuggaugaauucguucaagagggagaggcucucaaagcacaacacugaauuguuugucuuuagaaauaugcuucuuuaaagucuccagaaaaauccaagaaugagaagagccuaauacuuggcagaaaacguccaacugcagaguuguguccugaaacucugucuucucuaacaaagcuggcuuccaaagaaagucacaucguaugugauaaauuugaaauguucccucuaugacaucuuuuaaauuccugagaaauauccaacuuugagauggaaaccuuucuuuuuccaauuuagcaaagauugguuuaagauucacuauuaucccgcguccccguccccgucccgugucccccccccccccccccccccccccgucccggggagaaaaaaaaacuuuuaauauuaauauaagugauugccuauuccuuaccaaggcagcaaaugucugcucacuuucuggcuuugugcuaucauuuucaggggagcagguaguguuguuuccugggcugucuuuucugaaggaaaggucuuguagaacccaggcccagcccugcccuccagccccaggcugccccaccuuacuccugacuccuugcuggccugcuccaauaccgccucuucuccaagcugcaaggccgggugagagcuuaaacuagaccuguuugucagaacucuccugugguuucaaauaacagaaacucggcucagacuuggacaaagaggaagaacaaauuggcccacauaaaggagaaguucugcaguugaucgggucucagccacugcuguaggcagacugauggcuucuguccuccuuuccuugagguggcucugcccacuccgcccccugugccugucacagaggcccaccuaagauaagacucugggagaaggaccucuccucuaccauugcaaacagaccaguacucagcggcccuguuugucaggccagccuagcaucauugcugugacccagcagcagggauccaccugugccggagagaauggccuccaaacucaggacaucaggaagcacagcagugacugucacucaucagagacuucccacuggcaaaggcuacugugugcucuguugggggcagggcgguugggaugcaggagauaaaaagucauucaaugcauaacuuaguauauagcugcagcuccuucucaugguguguuuuguguugcauggagucuucucugugagacuucauuuucuucuucaaacacaaguugcagacaucaauagaaagccucccuaagacagggagcucucucagacuugagcugauucuuguacauacacaaacuuccuacuguugcccauauuguuucuugcucagcacauacaaacaguguggguagaucagugcacuccauuuuaguguuaaaacuaggaaagcaaauucuacuaguuuggccaguuaaaaagaccauaugccauuccgccauguuuaagucuguguagcugacaacuuuauacauguaugcaauguccuuuguucgcgcucacuccccagcacugucucucauccaucggccaucuccaccaagccccuuauugccuucagauccccucagaucccccugcugucuuccugccugcuuucuguuuguuuuagugugugggugugcgugcaugcgcguguaggaagggugugcccgagcgugcgcugguacaugaguuuuacucagcuuaauucggguugcuugugugaacguuauuagggaguuauuuauuggaacauggacaacuuaacagugauggcaucacuagaaccaaccacauuuaaacauuuauacuuuccacucccccuuuucccuccucucccucccuccccccuuguuuuuguuuguuugcuuuguuuuguuuuagcuuugacuauuuuuuaacuuucuauguagacuauacuggcuucaaacucaacagagagaucugccugccucucucucuaccgagaggugagacuaaaggcaugcaccaccacacucagcaacuuuuuaucauuuuuauagguaguagaugccacauuuuaagucugaaaacaucagaaagaaauaaugagguguggugucaagcggugugauccgggugcccaggaggcaggggcuggaggaucagguauuccaggucacccccacguacaagaaucagcugugguacccagaaaugugcuggcaaaggaaaggccuuaaauuuguaauuuuacauguauuuauuuauugagugugugugugcaugguaugggaguggaggggcaccugguugcugaggcauauagugagauugaggcuggcuugggauaccugagauuucaucucaaaggaaaaaaaaacaauaaaaaaaaauaagugguacaaugccugcuggguaauucaaggcccugaauucaaucuuuagcacuguaggauggauggauggauggauggauggacggacggacagaggacagacagauggguggguggguggauggauagauagacuaguagauggauagauggcauagaagcuugcauugcagauagugacauauaaauguguauuuucauuuauuuauugauucauggucugcaagccauccaguggcagggcauugcugugugguuaauucuuuaccccacacuggaaccggauggcaaccugccaucuaggauucaccauucacuccuuccugcuugccagagcuguggagauaccagccaauguacuccgucguaccccauguuuugcugucuuuuugugugccugaggacugcgggggcauuauaaacgugggaagacuugagagucacaugugccuaguaagcuuguucuagagcaugacaccaugaaagggacgcgcaacauuaaccagacaacucagcccugacuggggccguuggccacagaggaaacuucugcauaaccuaaaugacagcuacaguacagauccgauggcagcccccguguuugguuaagaaagcuuauugugguccuucuaugcacaguaacgggcacgcuugcaggaccacacuggaguagaaagcuccauugugguuugaggaggaggaugccuuuugucuggugacccagcuaagggaaccugagccaagaucauaucggugauggagguagaaacaccucaggaucuuccaguguuguuuuucacuuuuuuuuuuguucuuggaacugguuccuaaugcuagcagaucuuuggaauccugaggcauuuccucagggcucugaguugcagcuuugggucagcgcccucuugaacugccgguuucauuacaacaaccauaugcuucccuacucacucccugaccucccccccuuccuccucucucccacacccuaacccuuccccucucuuuuucuggacucuuuuggcuuuuuugugucuccacccacuaaucccagaagagucucuuaaguguucagagcagaucgcccaaucauuucucaaaagcuaacuuaguagaaauugcuuaagcuuuuugauauuaaguggaguaaacauuuuaauuugaccccauaucccacgacagcuuaacaugacgguauagaaaagguaggaaauuuaaacucucacaaguuggcaagaauauuaccauuuugcccgcacuuggcauugucaacaaggguccauucacuggaggggucaucggucuccauaaagacaggaccaauacuugucugcagcugcguuuccuuugaacucaucuacgugucuuugaagcaaugaucacggucuccagcuuugauucugacucuguggaccugcgccaguuuuccugauuucauuaaauuuuuggaaagaacugaaacuaugguaucauuuuauugcagcuuugacaucaaucauaauuuggggcggucuuggugaaagacaaggaauucagacugggaggcuggggaaagcgggucccagggcaaagggauagaaugcacuguuuacuucauacaaguucagccaccucgaccuuguggauuuuuagcuggcuuuauucuaaagcagcuacagucauauggcccaaaucuaguuauauuuaaaaacaaaaacaaaacaaaaaaaaacccgcauaauuuuagagaggccucucucuccuuccuucccgccucaucucucuucuucucucuccucucuuucuccuuccaucuuuucuuuccuuuucugucuucucccacuagcuuucucuccccagccccuucccucuuucccucucugcuggcucaauaggcuggaggaccugugugugcuggugguucauggcaaaucugaacccagaaucuauucaauagauucucccucgcuccacuuucuccucccccacccuccuucaaccaagucugccacgaugguguuuuccucugcucugccuuugccgcuuuaucuuuggaagcgccuuccugugagacgcccaaccccauugccccaaguacuccuccccucagcgggcccagcguugccuucuucagcauccucuauccuucguccuaugcaccaacuuguccaaaaucauuuuccuguccaagugucuucuccagggacccccucacccugcaguucgugaaggcauuugcuuaugugccauucaaaggggcaggaauuagggacagugguaaggacagggccaccccaggcagguccugcggauguccugagcauggcauggacuugcuuucccucuuccagccaauuguccaaacagcaauucccaagacagccaacagaagccaccacguggaugucacaagagagcccagcucuggacugaugcuuugcaacaggacaccauucuucccaugcucagaugacugagauaucaccagacuuacugugucuggacaaagugacaugaaaaucgcacagugacacagagaaacccuguaaaaaaaaaaaaacuuuuuaaaauucauauauauacacacacacacacacacacacauauauauauacacacauacacacauacauacauaaaaauguuuaugucuuaaacccugcaaauauauuauaauggaaaauaccucggaggacucucacaugucccaagauaccccucugcucuaccaagcuaacaccucugacaguugccuugcuaggaugugugcuguguugaagcaguguugguggacaucugcacuucgauuggccauggcaucuuuuacccauauucuucccaaguucuuccaccucuuggcuucugucuguaacacugucucuugacacagaggcugagaaacauuuccucuaaagggaccaaagcagcuucauggaucaggcuuagacccacccauacggucucaucaauguuauccccuuuccuaguguccccucugaaaaccccuuauccccucccuccuucuccugcucacucccacuuccuggcccuggcauuccccuaaaccagggcauagagccuucacaggaccaagggccucuccucccauugaugaccgacuaggccauccucaguuacauaugcagcuggagccaugagucccaccauauguauucguugguugaugguuuagucccagggagcucuggagacacugggaaguucauauuguuguuccuccuauggggcugcaaacccuuucaguuccuuggguccuuucucacgcuccuucauugggggcccugugcuccauccaguggaugacugagcauccacuucuggauuaacuggcagagcucacaggagacagccucaccaggcuccugucagcaagcacuucccagcauccacacuaagugucuggguuuggugauugucuaugugauggaucuccaggaggggcacuacgaucuccaucuuaccugcucagcuccacugugaacucguaaaacagccacauggccauauccagugugugugcgcacacacacacacacacacacacacacacacacaccacugucuauauucuaauaaagcuuuauuuguaaaaaacagacagcuagccagauuuaguugugcaagccuuaccuuauguuauugucuuaagaguuuucauugcugugaacagacaccaugaccagggcaacucuuguaaggacaacuuuuuuuuuuuuuuuuuuuuuucggauuuucaagacaggguuuuggcuguccuggaacucacucuguacaccaggcuggccucgaacucagaaauccuccugccucugccucccaagugcugggauuaaaggcguaaggacaacuuuuaauccgggcugguuuauagguucagagguucaguccauuauccucaagacaggagaauggcagcauccaggcaggcaugguguaggaggagcugagagugcuacaucuucaucugaaggcugcuagcagaauacuggcuaccaagcagcuaggaugagagucuuaaagccuacacccacagugacacaucuacuucaacaaggccacccaauucuaauagugccacucccuggguugagcauauacaaaccauuacaauaacugacucaaaaggagauuccugugauguuguguuucaguagcaacuauguaaaacugcuccagaaaggcccagcauacccagguacaagaugaaagaggcuaagaaagcuuucuuaaagcagagagccggccauguuccuuugcuggugggcuuuccuagcucccggaaaaggagguaaagcauuggcagagaauuguucagagaauuccaaaaacuuuugugucacuuucccuaaguuccaaaaugggacaggggauggaagagaugccugccacaucuagaaggcacacguggaagugacauguuucugugcgcaccagauuugcuguaggcauguguaauaauacgucacaaugacugaaguggcuggugguggacuggaggaggcaaaggaaguaaaguggcguguuaguugaaguugaauaccauuuaaccaccaucccaaguuauggcaggaggcguacugagggaaccccuacacccacacccaaaagagcgcugacguugguagucugggccuuauguauaaggaaaacucuagcuuuaucagccugauuucugugggaaaauaccuaauagacugauggcauccgucugcgucagcaugcuagagaguuaaucagauaugugucagaugccugagcuauguuagagaaugcgcccugguaggaagcugucaaucaucagggucaccgagagggcagcagaaggaggcacaguuuauagcucaaauagaacaugagugcacccuugucugccugcucauuccuacaaauguucuuaggggcuuuuuaguauuuugagacaggcucucacucuguaguccuggccagccuggaccucacuauauauauauaaagaaaccaaacuggccuugaacucacagagauccacuugccucugccucucacgugcugggauugaagguaugcacuaucacaccuggcccuaaauauuauuuuuucuuuuuuagggauacauauuauuuuaaacuacauuuuaaguaaagacucucuugugccugucuuaaguauuauaaacauuuuaucugagaagauugcuuucuuguguuuauguguuaguuggguguuacauaguggagcuuauuaauguaauuuuguucuugggauccuuaucuuaacaucuaauuucccaguguaucauguuucugauaacauugcucucuaauugguggguggaauuauaguuaacuugaaaaguucugcaagccuauaaaguuugcacgcacauuuguaaggcaauauuaucucccuugaugagaaauaacacucuucaggguacacugcaugcugugaaacguggagucacaggaauaaacugaaccucuucuugaaauaauuaaaagcuugaaagaaguuaugaaaaaauaauaccgaagccaccgagugugugcuggaauagaacccuaaucuucaagagaguaggaagucggcgaggggauccccagaacgagugguccuaguguuaucuggaaaagagcuccaggcuaguguacaaggagaagaaucccagaggacagaagaagcucagcuuguuaccuugcugaagacacagagagggugugcguccgggaaaucaaggcagcuagcguuugcauggaggguauuuauccgagaacagccuuccuugggcacucaggauagucugguccacacacuaccugguaaagccaggggagggcucaccuagaaggauuaagggaaucguguguggcugccgugaaggcaggaagaggcagaaaauauucaaaagucuugccuuggcgggaaggauaaaauuaaucccagaguaaacacgacucuagcucucccucacaaagauuaaaagcaaagcccaagagagucagccugggcuagagggacuaaaagugacuuaacugucccagaacaggauauaagaauccguauccgggccagugagguggcuccucagguaaagucgccugcaggcgagccucacaacccaaauauuagccucaggacacacuugguagauggagagggccaacucucacaguuugucuuauuguuucuauauacauacauacauacauacauacauacauacauacauacauacauucauggaacaaguuuucaauaaacagauauaaaagcaauguauacauaauaaaacguccagcuuucauuccaacaaaagccuaagaagaaguaagaguaugucuuaugaugaagaaucaaaauuaacccauuuguuuuacauauguuagaaccaguagacacugacccuaaaaacagcaguuaagagcacuggcugcucuuguaggggacccagguucaauucuuagcacccucaugguggaucacaacuuuggggagcucuagcuccaaggaauccgaugccaucuucuggccauccacaggcaccaggcaugcauguggcacguaaacuuacauugaagcaaaccacccacauguauaaaacuuuuuucuuaaguuacaugaacauggacucacucaaaggauguacuguguaagagaagggcggugggcaaucacuaauacuaauccaaaggcgacugggguuauagaacuccaguggagaacagcaugggaggcugcgugagauggcucaguggguaagguguugcccacacaagugugggaguccgaguucaaaccccaaagcucauuuaaaccuggacacaguaugugucuguaaucugaguguucucacacugagacggagaguggaaacaaggagacucuccagaaacuugugggacaccugcccugucucacacggcagugcacaccaaagacagugucucaaagaccauggauggugagggccagcuccuuaauuggggcuugcuuacagguucagaaguucaguccauuaucaucaaggugggagcauggcaguguccaggcaggcauggugcaggaggagccgagaguucugcaucuucaucugaaggcuguuuagcagaauacuggcuuccuggcagcuaggaugacagucuuaagcccacgcccaaaguaacacaccuacucuaacaaggucacaucuaaucuaauaaagccauaccuccuaauagugccacucccugggccaagcauauccaaaccauuacaggcggcaugauggaaaauaggcaaaucccccacggggguggaaaaaagacuaaaaucaauaaaggcuugacuaauacuacaguugcaauugaccuaauuggcaggucuagaacauuccauccaacugcagcagagcauaaaaccauucaaaaccauugcaaauguacauagagcauuugccaagacuccaagacuggcuauagucugggccagaagauuggucucaguagauuuuaaagaauucagaucgcaacaaguauguucacuguggaacugaaugagaaaucaagaugaaaagacaucugaggagucuccaaguauuuggaaaccagacaugugagagccuguacucaccagccaucucucucguaaggacagcuauccuggaaugaaaggaaguagaacucagugcagugagaaccuuuggaagugauugucuuauuucuuguugauagugcuuuccuuuguuucuuuuuguuuuuugaggcaggguuucucuauagacuauguucuguagaccaggccugccagaugcccuuagcucuguacugggauugaaggcuugggauaucacccuucuuuucuauuuuuauggcuaugggugucuugccuguagguaucucuuguguuuggugccuguggaggcuagaaaagggugucagauccucuggaccuugaguuauucauagguauuugccacggugucauauugagaaucaaacccugggcuucugaaagagcaacaggugcuuuuacucucuaagccaucuaucucuuccucccuuaaagagcguuuaagcaaccugggggagaaagggcuuguuucagcuuauacuucugcgucacagucagucauugaggggagucaaggcaagagcugaagcagagacuguagagaagcaucacucacgagcucccccaccucaucccaccccuuccccagcccccgcucuggcuuggucaguuaucuuucuucuauaucccaagccaacuugccuaggaauggcauccgccaaagugggucaggcccuccuacuuugauaaucaauuaagaaaaugccucacaaauauggccacagacuagucugaucuggauacuuguucaguggagguuuucuccuccuaggugacucuacauuugugucaaggugacagagaacauuagaugcuaaaaguccauccuuugugaacuuaacacacacaaaaaguucacuauuaagcgauagcuuuuccuuucuuguuuaucuccaagauugcauuacaauauauaacauaguagcuuuaaauguucacgguauuuuaaaaauucaaacacucuaaaaguuugauuuaucuuuaaaguauccaaaguuucuuuaacugagauuccauauaaaaugaaaaacagguaaauaccuuccuacuccaaguggggaaaaccaggacauaagaauguucaguuaugcaaauccaaaauccaauaguauagcuccaacuuguagcucagugucuaacaucuaauguaugggauggacucacagucuuccagacuccaaagaucccgggcagcucuuuuucccuggcucugcugucuguaacaucaacaguuuaucuuauaagguaggcuagcugcagucuacaccucuccuauucuuggugcucagugcuaggaucuccauugcaacugggacuguaucuuuacccauggcuuccuguccugccuucagggacgcuagccuugccacaucgggcuaagcuucaguuucucuccauaaccccuucaggucuaguuuuucuacauuaaaauguuuacuauuaguaauaguuacgaaaagcaauucagggcuggugagauggcucaguggguaagagcacccgacugcucuuccaaagguccgaaguucaaaucccagcaaccacaugguggcucacaaccauccauaaugagaucugacguccucuucuggagugucugaagacagcuacaguguauuuacauauaauaaaaaauaaauaaauaaauaaauccaaaaagaaaaaagaaaaaaaaaaaaagaaaagcaauucagcacgccuuuaaucccagcacuugggaggcagaggcagguggauuucugaguuagacaccagccuggucuacagagugaguuccaggacagccagggcuacacagagaaacccugucucgaaaaacaaaacaaaacaaaaaaaaaaaaacugaaucaagaaauacaaaucauaacaacaguggauuccuccauauaccuuugagacuuucuaaacauuuuuuaaauuuguuguguugauugauacaagaucuuacuguguacuuuuaccuguucuagaauuugauauucuacuuagcuggccuugaacucacaaagauccacuugucacugccuccugagugcuaggacuaaaggcgugcacaccauaccuagagagaaugucuacaauuuaaaaagacucauuauaccgaaugcuagugaguauguagaaacgggaacucccagacucugcugauaguaguaguaguaguaguaguaguaguaguaguaguaguaguacaagccaccuggaaaacaguugguagauuuuuuuuuuuuuuuuagcauguagaaaaggagugggguagggcuuggauguauuguuauugccugacuuguaugagacccccagguucaaccucuagcauugaaaacaaaauaaaaucacaaauauauaccuaccauaugacuauuccauuucauccucuuuuuuuaaauauuuuuauuagguauuuuccucauuuacauuuccaaugcuaucccaaaagucccccauaaucucccccccacccacuccccuacccacccacucccacuuuuuggcccugacauuccccuguacuggggcauauaaaguuugcaugaccaaugggccucucuuuccagugauggccgacuaggccaucuuuugauacauaggcagcuagaaacaagagcucugggguacugguuaguucauaauguuguugcaccuauaggguugcagaucccuuuagcuccuuggguacuuucucuagcuccuccauuggggacccugugauucauccaauagcugacugugagcauccacuucuauguuucauuucauccuuuuuacuuacuuacaaaaagaaugaagucuagaccaguguaaagacuguacauaugaguguucauagcagcuguuugucuuauuguguguacuaggaugcaaaccuaaggucuugagcaugcuaaggaacuagucuaccauugaucugcaucuccaucccaguaccaguuuguuuacacacuagugaaccuuaccuuuauauucaagugcaugcaguuuauuacaugccuaguuuacccaauaaaacuguugauggugcaguuggguuugcaagcgaauuacaggaagcacucgggaggcuaaagcaggaggauuaguccauguucaaggucagccuaguguacauuuugugaaugacccagcuuuuaaaaaaaaaaaaauccauauuagaaggacagucuaguaaaccuaguauucaaauaauuaaaauuccaaauaggcaguugaaacuagaagggagggauggaagucugaaugaaauaauccuccucuagucuuuaagauaccuuaucaugaaguacuaaggaacacugggcagagaauaccaaagcucuuacaggagaauaaaaucacaguggcaugcaucucucaacagcagugaggaagacagacuacaaaagagcaucgucuucacacucaggggggaaaaaaaaaaaacacuuacguauaucuucaugcccagccaaacuaucuaucaauguucuaaucauuaaugucagccuuugagcccucaaaaugaugcuaaaggagcugaugaguaaauguguuucucuucugcuguuaacagauggccacagaguaaguaguuaaggcagcaagagucgaagguagccauagccuggaacucugaacccagccuggcugccuucucugcuuacagccucaguauuggcgucagcugggggcaggaccucaucuguggccugggguccuuuuuuaugcuccuggguuauucacagaauccucacccaguuuuugcuggcugccagccacccuugaguccuagaggacacagguaggauuuguuuugcuaguuggcuccuuuguuccaguuuaguuccugaaagccaacaagaaagacuuucuguugacuguuauaaaggguggugucccauugcaugugaccuauguuauugguuagacaccagucagccuccaucaaaggcuggggccaacuggggucaucaugagcacguccgcuacaaucugggucaaggaaauggaaacucagagaacagaaaguuucuauugauuguggaacaggaagggcccacuauggggauuguuuuaauaacccuacagggugaugccaaggauggauggcgccaaagaaaaugcaucuuuuucuugaaugcauuaagagguggguuggaggacuggagggauggcucagugaagccuaaacacuaaacauuaaagccacacaugagcuuaauccaagcacugaagaggccagagaugaggaauugauuccugagcagcuaggcaagucaaauuagcacgcuugcaggugucggagaaagccugucucaaaagacaagauggagagagauugaagaagaaaccugaagcagacaucuggccucugcaugcacauaguaugcacacaaaacaguguuggggcaggaguggggggauggggaggggugaugaccuuuggccucccagagaacauguugauauauagaaggcagauguauaggaagcaccagaaagcauuaacucagagacagaagagguacaaggggacaugacugauaugcaagauggcuuugcuguacauauuugcguauccuaaucaauucugaccuaagauaguucugaaguuaaagacacaagagaccagucauggggcauguggagugcuugauccuccucuucuauguuagaaagcagaagauaaaaccugaaucggcaaagcagaguaaauagaggaagaggaagauaucuuaggguuucauuguugugaagagacaccaugacuacagcaacccuuuugaaggacaacauugaauucgggcuggcuuacacuuuuagggguuuaauccauuaucgucauggugggaaucauggcaccaugcaagcagacauguugcuagagaaggagcugagaguucuacaucuggaucggcaggcaucaggaacagagaguaagccauugggccuagcuuuaugcaagcaaaucauuguauuuuucagccaagaaucugaagaaaguuaauguaggguggggaaaaacguguugacauuuccccauaugauguacaaggacuggagaugauagaaagacugcugucaucccauccugaggaggccaaggccaaggauuggaguucaaagcuagccugggcuagauaguaagauccuauaucuauuuuaaaaacaaguauagagcaaguaacucaauccuggacccagacugguaucuuaaaaagaaggcugcaagccaggugugguggcgcacgccuuuaaucucaacacucagaaggcagaggcaggcagauuucugaguucgaggccagccuggucuacagagugaguuccaggacaaccagggcuauacagagacacccugucucagaaaaaaaaaaaaaaaggcugcaagguaauguagaccuccuucaucuuugacauaguuaagaggggccauagaugguccugauccagcauguguuggcuagccaagcuuccaguugguagacaugcucuggguacucccagcuuucuuucuuucucuucaucuccaccaggccuacacacacacacacacacacacacacacacacacccucaacuccaugagcaugcagagcaucaaggaugauucaauacuauggacccucucucuauccuguaaaaucuguuaagauuuagcagcuuuuaaaaucuccacagaggagcuuugcaucagucuagaggacagaggagaaagacaagggguggggggggggggggaagagagagaacuuaaacugcucaggagcuguggcucccugguacagugcuugccuggcauguguaaggcucuaaguucagcgcagcaggggggaaaauaguaaacuucccagcagaaacaauguccucacccuuccuuccuuucuuccuuccuuccuuccuuccuuccuuccuuccuuccuuccuuccuuccuuccuuccuuccuuccugcuccugcucuccccuccccaaacaggaugguuggugauuugguuaccaaaaagaucuaucucuguuacuuuguuaucucuguucugaggcacuccucagaaaccaguuauuaagucaguuugugucccuagagcuggcggagagucucagggcaugccaucugcagaucaaauggcuggugacugaguucggugccaaaugacaggaaagacccacgaagggggagaggugcagcccugcugggugugcagacagcaggcaacucaguuuaggaucccgcuucgucugguuuauaauuccguuucugcggggcugccuugauccccauugccuuagauauuuuguaucuuggcucuugaguuuauuguaagauuugacugugguaacuggaaacuauaaaaauuaaggaguuuggagcuauaucuucugcugagggugaccuuuagauagcugguaacgcaagaaaaauuuccaggaaugucucaaaaucaauaagcccuauuggucccuguaaaagaaaugcagucauggaccagauuuccuucugcuuuucuuauuucugucucugauaaaaguagcagucuuauugucauguguguguguaugugcaugugugugagagagagggaggagacagaugauaaggaccacacguguuaugacaugauguggagguaagaggucaaccugaaagagucauuucucccuuaccuucaccuggcccagggauaaaacguaagucaucaggccugcacaacaaagcagguacuuuucuaccugcugggcugucucucuggcugcucauuucuuauuucaacacaaguaauaaaauaacaaaguacuguguccugaaugccuaacugggcccugcucuuaccuuaguucaucuuaacuucaaaauuauguccauaauguacacugugacaguguacuuaugacuauugaaggcucagugagcuaacugcucaagggccaugugacgcagaaguccugaucugguucccauuguugcccaccccucagacaaucuauucacuuaguaccuugguucuaggugaaugggcagucuagucaagguacuagauccuccuggcuguuaccagcaacaugauacaaccguagugagcaucauggcaucuaugucugcaucuagagacggauggaggaaagccugucagccucugccuaccucagggcucugagaaguucaggaguggugcccaugguggcauagggaaaggccaaaggggucucuguagcgacccagggguccaugggaagagccacauguaaauggcuuaccguuguauaccggaaaucucuguguaucucuugggggagugaucagauccagcacaugagcaacgaaggagcaguuagcucguuagugugaguggccucgcuucagaacuuucgugcuuagguuuugcuaacgcucucgaggcaguuggcaaagcagcauugcagcccuaauaauuauaacuccuucagcuucccaaaaagguuguguguaggggugauucggggaggggcagucaaacccagggccucaaggaugcuagccagggaagcacucugccacugagccacauccccagcccggaaaaguuuaacucaguguguagguuguguaaaugaaaacuguuuacagaauucuagaugguaucaauaauccauacuugaucuaaaauaguaacagggaaggucuggguaguuacucuauaccauuuuagaaauauuuuuuuuuuccagaucugaggaccaaacccagggccucuaccacagagcuaaauccuuaagcccuuuagaaauguuuucuacuucuaaggcagucucugcucccugcugggacauguuucuaaagaugaccuuuguaaaaguucuagcccuauuguaagcuaacaccauucucuuguugggggaagggagggugguauuuuugagacagggucucuguaguccugacuguccuagaacuugcuauguagacugggcuggccucagacacacagaaauccaccugccuccggagugcugggauuaaaggugugcaccaccaugccuggcugcuaacaccauucuuuuuuuuuuuuuuuuuuuuuuucaaagauuuauuuacuuuuauaugaguacacaccagacaucagacacaccagaagauggcaucagaucccauuacagaugguugugagccaccaugugguugcugggaauugaacucaggaccucuggaagagcagucagugcucuuaaccauguuaccacugagccaucucucuagcccacuaacaccauucuuuuuuuuuuuuuuuuuugguuuuugguuuuugguuuuugguuuuugguuuuugguuuuuuuuuucaagacaggguuucucuguauagccuggcuguccuggaacucacuuuguagaccaagcuggccucgaacucagaaauccgccugccucuaccuccugagugcugggauuaaaggcgugcaccaccacgcccggcaaaaaauuaguuuuucuuucuuuuuuuuuuuuuucuuuuuggguuuuugagacaggguuucucuggcuauccuggaacucacucuguagaccaggcuggccuugaacucagaaaucugccugccucugccucccauucuuaaacagccauuaaauuugaaaaggaaucaagacuaaaacuauaaaguagaacuuccuucccuggucugucucugagcacgguugcccuccuguuucucagcagcuuauuuuuuuccccuaauagaucauauuugccaaggagugagcccauuggacuuauauacagaacgggccuauggcaauuguuccugucacucuacuucccuuauuuagaaagcaucccacccccgaguuacuaauuuaaacuuacaaucuccccaaaaaucaaauuccagaauugggcgugugaaacaggaggcuacacgugggggugcccauguaaucccagcacccaggagauaacucaugugguuucucccucauguuugugcauagagcagagugcagucucuggugaagccugaagccucuagguucaucugcuaagggguuuuccgugccuugggcaauuguuagguggcgcaggguggggcuggcgaguucuuugaguauuuuuauuauguauaugucaucucugcauguaugacuguguaccauguaccuaccuauauccauggagaccggaagcaggcauuagauccccuggaacuggaguuauagaaagccaugagucacccagguccucagacuuagcagcaagcgcccuuaccacugagccaucccaccugcccucacauauguuucuaaacauuguugauagaaagugugguuccuugugguccagaaaaauuugagagauuagucguaguuaaaaucagguucuugagcgggucgugguggcaaacgccuuuauucacagaggcagaagcaggcagauuucugaguucgaggccagccuugucuacaaagugaguuucaggacagccagggcuacacagagaaaccccgucucaaaaaaaaaaaaaaaaaaaaaaaaucagggucuugaagacaaaaagcuuuuuuuuuuuccuucaaccuuugcacaagaaucuauuaauguggcaugacacgcccagagauuuaauggcuccucguuuauuuuaagcgggacagcacacaauuagcacagagccccacugaccccgggccuguagccagaggucaauucccaggcgcucuuucuucuguagggcuguaaggaaucuagucuaggagcugcgcccugauggccguuuguuacugguggagaaguugguaugagugucacaguuuugcuuaccauaacuccacaucacucuuccucagcaggggagcucuugcucuacagagccaccuguggguucuggucuguugucccuuaucccaaauaaguagucucagaagcgauugcugcaucguugggaaggaaugugguaauuuugccauuccacacaugucucuccuacuuaaauaagcugaaaguggaagaaagacaucucucacuuccugacgcuuaauaucuuggcuaguuuuaugucccaauacugugaccgaauuacaagacacauguccacucuccuuucaauagaguaacgcaguaguaaccagagaaacuuugauuccgugcuaggagccugccuuuuaagaaagcaaccuuuaaaauacagcagagccccagccacuaagucaggugccacaguuuacauuuaguucauuguuugagauccagggugucauugcccacucgugugugacaaagggcgccuuauucccgucugugcucagaggccuuuguagccgugauacuccuacacugcaguccuaucuacauagcaccacgugcugggccuucucuuugcccugcuucagccuccacacuccagggccaauagggcagaguggucagugagaacugcaggggggcccaugggugccccaccuggccagcauauaaaggagauuggcacuaagguauuaggcucuucugagaugaaggagucacaaggaaggacuguaggcaccaugugaaacaugguuucuaagccaugcuguguaucugugucgcugggggcuugcuguggucccaggcucccauccagcagaccuauggcucugaguucccaccaggcuccugggcuacugcugcugcugcugcuccacagcccuggcuaagugaggagaguccguaagcagagacaggagugagagagggcagcacgggguaggaaccacauuccaccuuaguaguucucugcagagaauggugggacgggaagaagcagagccacucugcaggccaucuuaggaagagugucuggggaccagcaagguuucugcaugacacagaagucaaucuggccucugaagagccagaaaccagcuaucaccucugccugacggacagacagaugggaccggaagaugggugccuguuaaagcaagcgcaggagaccccgaauccugagacacacagcacagauccugcgagcaguguguuaauaugguaaccugcgugcuuucuugauacacuugggucuucugccacaggggacaaaauggcagcacugaaggucuugguuuagcaaaacaguaaagaaccggauucugcccuccgcuagccauggccaagaguacuucccuugauaacuuaauguccucucaccuugcuggacauagaccugugaucugaggacuugggagauagucacagaaugaucaggaguucaaggucguccugggccacaugaaacuauuuggggggggggggacaguuccuggcaacccacauacaacaaaaacaacaaaauuuaaaaaucuauaaagucagauguaagaaagugucuacgucagagggcccuggaaggacugaagcuggcugucauccauguaaaauacacagagcaccaugaacaugucgagcaaaguccaaaggcugugugguacuuaguaccuuagccaccuugacaguauaacuuaccaucccuagaucucaccaccucccccaugugccauggaaaucauauaaaugccucuucaagguuguuaaggaaggaaaaugggggcucagugguuaagagcacugacugcucuuccgaauguccugaauucaaaucccagcaaccacaugguggcucacaaccacccguaaugaaaucugacgcccucuucugggguaucugaagacagcuacuguguacuuacauauaauuauaaauaaaucuuuugagggagagagauagagagaaggagagagagagagagaggagaaaaugcccaguggugcaaagcaucacucaacacaggaguuccugauggaagguaaagccagcugccugcuagcuaaagggcaaguuugcacugugcccagccucuaguacaguuugcaggcuuuugcuuugacaaaaauaugugcauggucuuggugaggaggcaacucuggccccagccacaggggcugguuuugggcucuguaaugcaaauuggaauaggaagagaagcuuugaaaaucacugguggcugcugugugcccgugggaccacagggaauaugaagaagcuacauuugggggugagggguggggugacaugcuuucugucuguaugugauuucuuugcagagugugaaggcagggggcaaacugacaggaccgccuguguccauaacggaauguuauauguggcugucaugaauugcgugguugguuuauggcuaguggaccaugccgugauuaaucaccucgugaacuuugcucacgugcaauguuuuguuuucucuuucagaugagcacaaugccaggacugcccacccgacccugcuuuuaugauauagaccuugacacagaaacggagcaaguuaaaggcuuguucuaauggaaugaaacccacaggacugggcaaggugagcuaccaugauuugggucuuguugucaacuuaaaugaugucuuaugucauuuuuuucuuggguuuguuauaaaugcaaucaaacaaguaaauuguuccuaggucacuacacagucauaccuaauagcugccugugacuuggggccccucccaagcgcaggcaugcccucuguguaucuggagugaauccuauagaaguuggaucaugaaugugaacuugagcagagcgccucuaauuguagcaaaagcugguaucugccuucauuuaagacugacuuccaccgggcagugguggcgcacaccuuuagucccugcacuugggaggcagaggcagguggauuucugaguucgaggccagccuggucuacagagugaguuccaggauagccagggcuacacagagaaacccugucucaaaaaaaaaaaaaaacaaaaaaaaaaaaacaaagacugacuuccuacuuuauuaccccacaucuggguacagaguuacaguuguguuagggaaaucuuggguucauuucccagggcugccauaacaaaguaccaugaacuggguggguuagaacagagcugugucuuguuguccuggaggcuggaaguucagggucaagguaucaguugagcaagcauccuaugcccucugaggaugucaccgcauagucaccacuauauaggugugucccuaccaucucugccucuuuggucacugacuuucuccugugccccuggcuuccugaggcuuucucuuguucuuuuuaguuuguauguguauguggugcagcugcugguuguuuucagagagauuuggguuuuugagaugagaucucacuaaaucgcucaggcuggucuugaacuccugauccuccugccucacccucccaagugcuaggcuuacaaguacccaccaccacaccuagcacuuuguccucuucuaaggaccccagacacaucagauucaagcucucuaagacuuugggggugagggggagagacagguuuucucuguguagacccagaacucacuuuguagccaggcuggucucaaacucagaggcccaccugccucugccucccuagugcugagauuaaagacauguaccaccacagacuuuaaagacaucuugauuauucugccaaagacccuguuuccaaaugcagccaaucacuaucacaggugcccagggauagcacuccuacauaccuuugggggaacauaauucagcucuugacugugguugguuggggcucuucugccucuggaaggacuaauacagacgggcacgggucucccuagacaccgugcagggcaggguauuagaacccuuucuggacucuggccccucagguuaagaaggcagacuuuuuuuguuuguuuguuuuguuuuuuuguuuuuguuuuuugagacaggguuucucuguguagcccuggcuguccuggaacucacuuuguagaccaggcuggccucgaacucagaaauccaccugccucugccucccaagugcugggauuaaaggcgugcgccaccacgcccggcaagaaggcagacuuuuauucuaagcuuuuuacaucacugagagcagagggaugugggcugugggcugugcugcugugugucccaagguguugaaacacuaccugcuggcuucugcccuggcugucuauaucaagaaaauaauacgaaucuuccugccugcaacucauagacagaaguugugauggcuuggagcuccguuuacaucccauagaucaauauguccucacuguauucccaaaguccagucuccaucccccacccccacccccggcccaaacguucaauuucaucccuuagcccagaaggggcuucuuggcaucaaacccuguccugggccuuuggccggguuucuuugaccuaaaugugcuucaacaccuguguguugggacccuaggugggaugcagaguuucuucuccuucgguugcagcuaacaguuuuauggcguuuagggagcucaugcuuguccaaaugagaggacagccucugagauccucuucgggaguuauguaguuuagcuauuguuuauuuuagguagggucuccuacugaccugcagcucguuaagcuaacuagacuaagggccagggagucccaggguuccuccuaucucuaccuccacagccccaggauuacaaucacauagcacuauaucuggaaauguuugucuguagguucugggacucgaacucagauccccgugcgugcaaagcaaggacaucauugagucauacgacaagucuccucacuguuucaaguuuggggaaguuccuucuuuggcuuuagauuuuuuuccuauaagauuuuuaaaauuaauuuaaugaugaucugggcucuggugcaaaagauuagugaggaaccacuuaaauggccucauguugaacugaggugggaaaugccaugagaacggcgucggugccugcguguuucuuguugagaggugggagcucuugugacucucagucacagccauguggcuugucuucaucauccugggaaagaaaaccccaagaaggaaaucagaugaguauugaacaaagggaccaugaaccuaaccuuugguaacagugcuauucuuggucuuuuauuguggcucuggucucccagcaaggccucugguaaaaugacaguauuguuucuuuuagaccaaaaguugaaccuuccccugacuaauuucuuuccaaguaaaggaucccauauauggcacaucugccauuugucaccagaacaggugugcgcagaucugucaucucuagugaacgguauuuucuccagacuuuuggucaauuuuuauuuguucuccaaguaagucauauacuuucauuaauaugguuaagacugagguaaugucagggauucuguaccaauacauacaccuaaauaaauuucuugugacuugucacccgugucuucccuggcaagcauccuuccagauuuuuugcugaagauaaagcaauccaggaacucaagguauuaguccuugcacucuuggagguggaggcaagaugaucaagguuucaaggucaucaucuuggcuauguagugaguucuaggucacccugggccacacaaacccugucuaaaauaaguaaggagcuggagagguagcucaacagaggaccuacguuugguucuuagcaccuauauuagaagggcucaaaaacacuuguaaucuaacuucaaaggucugcugcccucuuguggauaggaugggaugggaugggaugaacacacaaauaaaaugaaucugaaauuacauaauuaaaaucgaucaggggucuguggggaucuucuggcaugccagauacuguacucaguccuagcacagcgaguguugucccaguaaaucagaggcuucaagaagauugguccucccgacauggucucagagggaugguggcugaggacagccugcauccccacugcauagcacugcucucuuagccaccagcauguauuguuuugccacaccagucaacuagcauggagagauccagccagugagcccuuguguuucaggacugcaacaucagacccagagaggucaacauacugcacagcuaauggcuacagaagcuaagauccaacccagauuagccagcuuacagugugacacagcccuuacacccauucccuacaggaacuuaggcccauuccaaaagaugguaucagcuaguuaauacguuuuuguuuuuguuuuuuuaaauaaccgaagguaaguauuuggauauucaacucucggucuaaaaaggacuucaguguggugggacagccucuuaccucagccucuacuugaauagcauuguuucucaucucuccaacacuaaaugugaaaugacgaaacuucauucuaggcuugcugggcaguaguucaaaacccaucauuugacccugcuggaacaauugaaaagggaucugguggccucagauaaaagcuuuuacaaauaaccacuccucuccuuggcuccuguaaacauauuuucuguuuuccaugacucuccaaaguggcaguccagaaccaccucuaugaauauccagagagggcuguggcuggugaaagugcauaaauaaaaaacguuucgucuuggacagcacuccagcgucagcaaugaacacgcuuugccuugucauaauuuaguggcacagcgacacaagguugaucauuguaaagccucagcugcagugcagaacagucaccauccuucgaggagcaugguagacacuugcaccugugccccucuugggaacaaagggaugcuaaugacuacuuuugcuuccuccccuuucuugcccuuccugccucccucaauuucccuccaugagauaucaugagacugaaugugaacgugagauccaaggaguccccaggacuugagcucagccuccucccuuugucccaagacuucccuguagcucuuuugcuauuguuagcaugagcugugacucauucuuuuggaugucacuaaauagaaaucuuucaaauaagguuuggccucaugaaauccaucccgugcuugcaaucucuugccacgagguguuuguguuucauggggaggggugcugugcucccuuucuucuggguucuuguucuccaccuugaucauauuucugagccuccaaacgauccauacaagaaaguccagcaacuuacugaagaaccagggcugcccucccuccaaugcgcugugugauguuuaguaugcauugggauucauuguggucccacuggagaugccagugucucaccagaagucucuuuuccagaguucuacccaucgaaggaaaccccaucucagcucgcuucuucccuaauaugccuuuagggaggagaauucccaagcuaaugacugaucaaaaguuccuccugagucagguggccacgugcauuccuuccuguggacagaccugaucgaccccaacuccuauagcaacggggagcccauggcaacaccucagcccuaugauuuggguuuugaaauuuaucuuuuugcucuaccacuaaaguaagcacacauuuauucuuuucccuuccaggcaggaguccaaggaaauagcagcccuugcuacuuaauccuuucuggcaucugauagcuauugugacuaagucuuccauaucuagguuagguaccaacucuuaccuucuuaauccuccuuuagaggaaccucgaggcacaauacacuuacugaaaugggauagcucauaaauauuuuggacuggggauguagcucaauaguagaccacucacucacccagcauaagcuaagccccagcuuucaucuccaucaucacgugugcagaguacuuuauguauuuccuacuucuucaguauguucccagugggaaaacuuccaagguuguuucuccuuaaauuagucucuuuuuuguuguuuuuuuguuuuguuuuucaagacaagguuucucuguguaguccuggcugucuuggagcucacucuguagaccaggccggccucgaacucagaaauccaccugccucugccucccaagugcugguaucaaaggcgugcgccaccacugcccggcauauuauucuuauaaugaauuuuuuguuuguuugguuuuuguuuuguuuuguuuuuucauuucaaagcaggguuucucuguauaacaauccuggcuguccuaaaucuugauuuguagaccaggcuggccucaaacucacagaguuugaucaugcacugucacguccagcuaauaauaauucauuuuuacauuuucaccuuagcuguugccccacucucauuuuaucuuuaauuagacuuugcaugguuuuaccaacccauaagcuuuccauacacgcgggaccauugcagaggccguggugcaugucuguaauccacaucuugaggaggcugaggcaggaagguugcaaguucaggcccaggcuaacauugaucccauguuucacaaaagaagcacggaaacacagacucuucuagacacagaaccauagggcacaagggcacuggguuagccaaccaaucuuccauuucacaccucagcaaccucaaaguucucacagcgcugagggugugccccgcccacagaaccagcccccucagcccagcaauaccuuccccuccucgggacucacuggucacuacaauaaggcugcugugucccugggugaagagccaggaccugcaccagacagcccucuuaaugggacguuuucuuuucauuccugguuguuauacugacuguguuucugucuucuguuuacuugccugacuuggacccugaugucgagagguauuugaaguucuguccuccucuccaucacugucuucugucuuuaaacugcccgggcaucucccugucuccagucugcaguuaucugugggaggcaaaucuacccagugucagcagagugaacucuuuugguccacaaauaaaccccuccguguguaaacucagaugaaaggcugcauacuggcauuuacaguuuucccuggagugggagccuguuuucuucuggaacuugguuguuuugcuugguuauuguuuuucagauauagucuggucacuuucucucucugaaagauugcagagagcugggaauguggugcaugucuguaaucccacagcuucagagguggaggcagggggacugggacaacagccuagacuauguagcaacuucaaggagaaccugaguuaaaugaaacccuaucaaaaaaauaaaaauaagauaaaugaacacauuuuuuaaaguuagaacuuguucucuaugcucucuguaugaaacaggagcagaaaucuaaggcaaucagauugucccucuaacaccuguaacagucccuggaucuugcauaauguacagcacaaaaucugcaagucauagaaauuguggagugucuuggaaaguggagaggccgccuugagggacagcacugacuugugguuguggagcacuacaucugagucucgcugugugucuguuuggggguccacuuauaugugugcuuauacacacauguggacggggaguagaagacuaacguugggucucauucuucaggugauauaccaggguuuuguuuuuugguuuuuuguuuuuuguuuuuuuuuuaagauuuauuuauuuauuuauuuuauguaaguauacuguugcugucuucagauauucuagaagagggcaucagaucccauuacagaugguugugagccaccaugugguugcugggauuugaacucaggaccuucugaagagcaguagguguuccuuaccacugagccaucucuccagcccugauauaccaguuuuugauauuggacugaagcacacuaaauagacaaggcugacuggccaggaagcucugccuaauucucugcccuaauucucauuucuuacacagaaaacagcucacacaagaaucccagccuuuaaaaccacaacacaaguaagaguuuaacaccagaggaaaagacgacuuggcucugagaccccacccccucuuuuucagagucuucaaacaaaaaacgucuccuugccuuuuugcugcaguuggagaagaaaaugaauuuugaaaucuugugaugcaaugcuggagcaauccugagacaggccaaagaccgcuuccucauacaagauuaacucuguuuccagccaagugguguucaacagaaggaccugcgccacaucuggaaggagugaaguuacucuugguuccgauaguguuuacaccauuucugcugcuuauacuuuagaaaguuuauuuuauggggacuagggcuuugcaagagugugaacuaaaagcuaaugcuuccgucuuuggaguuuucucuuucaucuuuuuuauucuuccuuuccucaccuguguugaggaugggaugucaggccucugcuugcaccguccagcgcugugcugccaaacuguauuuguuuuugucuuugaacugaaaauaaacauguguucuagaaaaccguguucagcuaguaaagccacucacugaugucacuguccuugugaagccuuggguugucaccuggcacauuuguggcagagauugcaagugcauucggagcuuuauaaaugacaagaagacaaucauauugagagaaaugucuaggcagcccagacuguggaagccuggcuggucuccuggagcaaagugcacuaccuauccacaaugacuuccgggucucugugaagucucuuucccuaacccuaaccucuuccaccaugaaugaauaucaauggccauucaacuuucuggucccacggggguagaagagugccucuuaaaggucagguguuuggcaaauguuuuuccuuuggcccaaaugaacacaaacuagagaacguucuaugacccguucccuacuuuuugacccuuccuugucccuccauucccugccuugcaaaaauauaaaauuauguagaacuuaaaacaaaaccaaggauucagaaacaaacaauaagugauuguccucgaagcagcauaaguaaaacugucaccauaaauauccuaaauaucccggggcacauccuucgugauccuuccugucugcccuuacgauacccauuccagugacccugcucagcucauaaugugucuuuauguacaguuuugcuuguuccaaaacacuguuugaaagccaaaaggcccacucagugccuuuccugaguguaauuuugcuuagcgauucuaaggcguccuuccuugucucugcccuuucuuagggaguccaccucuccagauucacacuuacccugucuucacaauacuuacacccaugugauggguaaguucucuacagaagguacccagaaaacagcagcuccuggugagcucauguuuaaggagucccagucacagagcuggcaagaugguucaguggguaagagcacugacugcucuuuggaagguccugaguucaaauccugacaaccacaugauggcucacaaccaccuguaauaagaucugaugcccucuucuggcaugucugaaaucagcuacaguguacuuauguauaauaaauaauaaauaaauaaaucuucuuugggacagagugggcagagguagguccaaaaaaaaaaacccaaaacaucaauuuccaacaaccacaugaaggcucacaaccaucuguauagcuacaguguacucacauagauagauagauagauagauagauagauagauagauagauagauagauagauagaugauagauagaucuuaaaaaaaaaaaaaggagucuuagucacaggcucucccccaccucccaauaugguuggucaccugcagucaugccuuuccugcuauaugaacugugaucccuucaacuguaagccacaauacauccuuucuuuuuccuuagguuccuuuguuuggugauuuagucaccagggcaaaagagguaacuaauccaaucuccuauauagaaaaacaguuuggagucaaauugaagagcuaagcaaaauguccauaacuugccaguuuccuaaaugcaauuccgcaauggaagaaagaaaagaugucacaaaucaggagaccucagcugcaccuucaaggugaaaacuaaaccaaauccguagcucggucacccaccuguggucucagcuuugucaucuggaacccccugcucuccuuucucugugcuacuugagccuuaguuaggcaguuccacagguccagugcuuagccuccaaaccuagcauggccgccccgacuccaagguuaugugucuucuguuuuagcuacaguggucugcaggaggcagcaauaauuaaucaggcucuguauauucaagcuguuugcccccuauguaguaagugaauauagauaaucuuucugcacuguuaauaguagaaccuucccccaaaacauuugggcuaauauuuacauuuucacaagcuuuauaaucauuacauuagaaaagcugguucuaaaaccaucuuuauuagaguuaccagagaaauccuuuuuuuuuuuuuuuuuuuuuuuuuuuaaauaaaaugaagcuuuuucuggggaugugacucagcugauagugugccugccaacccauucaggaagcccagagcuccauccucagcaucacacaaaaccagcucucaagagguagaggugggagaaucaggaguucauggucaacuucagcuaauuuaaggcuagccuggacuacgugagacugucucaaagauagauaagauagauggauagauagacagaagauagauagauagauagauagauagauagauagauagauagauagauagauggauggauggauggauggauggagggagggagggagggagggagggagggagggagagagagagagagagagagagagauagauagauagauagauagauagauagauaaugaagcuugcuucuccuuuuugaaguccauaugccccuggggauuuuuauuuuuaacacauuuacuagauaauuauuccccaagcuaaggauuaagaauuaaccugaccuccacuuucacaucaucacugagccagcacaauacuaaacacacaggaggucuaaguaaauacuccaugaaagguugaaugaucacugauggcagcaaugucuggcccagcgccaccccugcuaaauguuccuguuacagcccugucccuuccucucuccccuucacagcaaguaacucagccgaucgcccgagcuuucuucccuaggaucccaagucccccaagccuaauuccuuuaccuguguuugacauagggacucacucuguagaccagguuagccugcaacucgagauucuccugucccugccucccacuguugcccauacccagcucccaacuuacuuauacgacuccuuagaaagauucauuuaacagcaauggagagaugaggucauaugaguuccauagcucccauccccacaccuccgaaccuugucuaacaagucaccaagagcugaguagacagacacucagacaagacaucaacacagcuuggaggauaaaagagagaaggcugaggaaaggcuccccagaaauggcucuagaaagcaugaagggaggcagcaggagcucccucaaagagcagacgcuauaucuacaagcaaggcuuugcgccuaccugucaagggcuucccucuagguuuugcguuuaauuuuuauaaaaaucagauucugguaaggcuucccacaacagucuagccaggccucuugaguacucaucucgugauuaagaugagacuaaaggcaaauuuguuccaaaaaugggccugugccccaucucugguuugggacaauccaacucggaggagagcagcaagagcacucugcccuugcccgagguuacaguguuuauguaacaaaucagcucaacuuaaauauuucucaucgcuugucagggcugcagaccucugcccggcacaucaacaugaaugucauguguuuauguagcccugugugggcaucuaugcuuaugcaaaaggaccucaaggguucaaagccaguuaauauuuucaagcaugcaucaugccgcuugcauguuugcuauaaagauggcaaagagacaauuucucaaaaccaccagacugagucgauuugugcgcacacuugagagcagagucauuuaaugaauguguguuuggcaaagucuuacaauuaaggaauuuuucuuccucgguaauugccuggguccugauaauucuccucuaagucagucuccugaugagcccccgccuugaaagagacaauguguaccagacaaagagcagagacagacacggugagagaacauacaggcucuccugggcucagaacaagccaacuagagaaaugcuuuccaauuucagcauggaguuuggagccaaaggaguuuacagggaccagggggaaguggugcacucagcacagcauccccuccugcauccucccuuuccuuucggaugcauuuagggccuccuuugaagauccgaguucccagaauaucccaaguaccuccaaccucaaacagagugcagagauuaguccaaagccaagaagaaauuauuuuuaaauuauucauacuaccuuguuugucauuagaacagauaauugaaguaacuguaaauauguauacacagaaguugacagaagagaauuauccacagcaaacuacagauggacagagaagcccacuuaaguacuaaauaauuagagaggcugggagccaaggauggugggaggucacuaaggaguguggaacugggacaaagcuggaagcggcaggacgugggacacaggagagggacgcuggugguggagcaggggcuggaaguacaagccaaagagcccggcuuaugcagggagaaagccgugcacaguggguucugguuucugacaagucugaacucugagaggcggaagugacagauagagccuuugacaaaaagcaagugcaggcuguaggagacaucucagcugcccagccuggacuggccgcacugcagagcuagaugcaaagguuccccgaggcauggcugaccuugcuccgcucugccaugcagucagcguuagcgacuuuguuucauaucacuaguacccaaagaauggagugugguugugugugugugugugugugugugugugugcucgcuucaugcaugcaugaguguguacgugcgagugugugugugugugugugugugugugugugugugugugcaugugguuuguuguuuauuuuucaagacaggguuucuuuguguagcccuugcugucuuggaacuuacuauguagaccaggcaggucuugaacucagagauccagagaccugucugccucugccucuggagugcugggauuaaaggcauacacgacaacugccuagcuuacuuaaaaaguuuuuuaaaaauaauuuuuaaagcuaauuuguuccacguuguuaaaauucuuuuaaguucauaaauauaagucauguagauaaauguuagcuauggccauuccuauaauguaauaucuccacuuuccccagcuggaaaggagggcuggggagggcagggguaguagacuggguauagggagaguuggauaagggaggggaggggaggggaggggaggagaaggcugaagaaggugggauuggguauugaacccagagcuucauguguucuuuuuuuuuuaagacuuauuuauuauauauaaauacacuguagcugucuucagacacuccagaaaaggguaucagaucucguuauggauaguugugagccaccaugugguugcugggauuugaacucaggaccuuuggaagagcagucagugcucuuaucuacugagccaucucaccagccugccucauguguucuaagcaagcuguacuacuguacuacuaagcuaccugcccaauaauagcagcaucagaaagccacugucuaaggggcucgauuugccuaacauguugauccagucauugugcauugaaaugaaggguuuuacuguaugccacaaauauguaugauguuugauucaaaguaaaacuauacagguuuuuuaaguccucaaaaacgacucuuuccuauagugaacaaauggugauuuggaaaaggaaagaugcaacuggcuacgguuuggcauucuccucuuuaaaagaaaauuaaaacuuggguuaggcauggcagcacagcgcagcccaugagagauuaagaaaagaaaacggagccgggcgugguggcgcacaccuuuaaucccagcacucgggaggcagaggcaggcggauuucugaguucgaggccagccuggucuacaaagugaguuccaggacagccagggcuacacugagaaacccugucuugaaaaaacaaaaaacaaaaaaagaaaggaagggagggagggagggagggagggagagagagagagagagagagagagagagagagagagagagagagagagagagagagagagagagagagaaaguagucauuuaguacacaaguuuuaaggguaaaagaacacuguggcccuccaaguucucagccucacccaggaccuuugcccacuacaaaguguucccacucaacagacgaaugugaucaacaaagagaaaccccacuguaccccagcagaaugggcagacaaccugaaaaugaaguccaggauuagccagugguauugauccauccgggaggacaaaugaaauccaaaaggcugugcuuuuaaagauuuuuguaguggcagcagagcuucaggcagcugucccucacuggcacagguaucugauuccacagauacccagagacugcauaccaggagcagucugcacagagagcucagggccuacaaacacuaacaggaagcaggaagcaagcgauguccauggacagcuauuuccuuagugccuccuaauaacauuacugauaaauaacauuacugaacgauaaccugccaaccauucagacauuuuacacauacuauuuacagaaguaaauacaagguucauauuuuuucccauuuuauaguucaggaaauugagucuugcacaauaaggggaccuuaccucacaaggggcccaagaccuuacaagugacacuucugggucucagcauggucucucugacccuagagccaugcucaaccccacugagcacuuacugcagccuggauccagguugggauaaacguguucagagagaugaaauuucguuaaggugcuuggaccaagacccacccagcagcuuccaggaggaguuggaaacugagagggaaaagccaccucuccacagaugauuugaaguuggccuuaacuacagaagccagguaugcugacauagacauguaaucccagcacugaggcaggagaauugcuguguauucgaaaccugggugcugccaggguuacauaauaaacaaaggaguggggggaaauuuaaaaaucaccauagcgugaacagcaguacaaccccuuacaaggccuccggucagugcaugcccaaggaaccaagcuacaacugccagauugucucugccaugcccaggcuccaugccaggcacuaaaacagaaaaacuuuuaaggacuaaucacucuugcucucuucucuucuccucuuuccugcucuugcugcuuacccucuucaaucucucuccccauuccccucccccuucucucuccaugugcucaugacuggccucuccuccccccccccucucucucugccuuucucugucucuacuccuucaauccccacccccaugcccaugccuuaaauaaacucuauucuauacugaaaaauaacaaacuuuuaagguuaauaaucacugguuauaaucaauuugauucagccuaauuaaacugaaauuuuaauaggguuucacagucaauuaguguguguguguguguguguguguguguguguguguguguuuguguguguuauuguguuauaaaacuaaaaauacagggucagugaccuggcucaucaagguacuugggaagguuuuaauaucaacuugcugcaaguuagaaacucuugaguaggaaaccucacccgaaaaauugucccaauugccuugauugacccaccccaguucugugcagcaccuucuggcagcaucugugauaaacucccuuuuaaucucuccaguugccugcuuggcccugccuccuaccgccauguuugauuugccccguggcagcugcugccgcuuucccagguaacagaaucagaauucccaagcuuuccuugugggaauagggaccaccggcucuccaggaacuuucugggguuucccaugacagccugggacaccugucuugugaacugcauaacuguggguucuauuucugcagagaaccugcccaaacacugacgacccgaguucauucauagucagagaaaacaaucagguuuugcaagcugcccuuugaccuuacuucugcgcugugccauaaacaugcccccccccaccauaaguucauuaauuuuucaauauuaaagaaauaguaaaggacagugacugcaagcaucuuaucucagcauuuaagaaguagaagcaggaagaucaggaguucaaggcagccucagcuaccuauggaaaccaugccucaaaauaacaggggaagaaaagauugaaaauacauggccaagaauauaauugacagccgaguugaugguacaaguauguaaucccaccauucaagaggaagaugugggaagauuugagaucagucuaagcaaacaaaaccaaaaaucuaaccaaauagcaggguggugcacaccuguaacugcaacacuucugaaguuaaaggcaagauggucagaaccuuauagagaucucugacgacauagugaguuuaaggcuaaacucaaaacaccagaauaagccaggugcugggcacgcaccuuuaaucccagaacucaggaagcagagaagcggguggaucucuuucaauuuaaagcuccagccuggucuacagagcaaguuucaggacagccaaggcuacacaggaaaacccuguuuagaaaaaaaacaaaaauaacaaacaaaccaacaacaacaagggaaaaauacaaacaucaaaauaaaaagaaacaaaccaggggcuuuguguacccacugagcuccguccccaaguccuguuccaauguuaaauuccuuucucacuuagcagacgugaccaagcuagcgguaguucggcuaggaaugaucuccuuggggagaacagugccagaucaacuggcaaggcuagacuuggacucaaacccaguuccuugcuuccugucuuuacacucgagcagauguuuauccugagaaggacguggcuuccacaccgcccagugauaugaaugcuuuguaggauuggcagggacuacagagauaaguguccauaggaagcuauugcuuauuuucuaauuagggacgggugggguuggguaugugcacuggaguuacagaugguugagccuccuaacgugggugcugggaaccagacuaagguccucugcaagaguaguacauccgcuuaaccagugagccaucucuccagccucaaacuauuauugcaaucagaacaaaauugcauuauuucaaaugagagacuggguuuuagaaaucacuuuuaaaagagagagagagggcgagccaggcagugugaugcgcauaugccuuuaauuccagcacuuuggaagcagaggcaaguagaucucucugaguuugaggccaaccaggucuacacagugaguuccaggauagccagagcuacacagagaaacccugugucuaaaaggaaaaaaaaucucuauaaaaauaaaaaaugacuaagaacagcuaacaguuccaaugacagaugggaggaagaaggccuccauaagaagaacaccgcacuagaucucacuccguagcccuggcuagcccagaacucauuauguagaccaggcugaccuugcaaucccagacaaccacuugccucugcuuccaaaguacagacuugggaguuuguaacuuccucuuccagcaucaaaaacuuuagaauuuuaauuauccaagcuuuuugcuuuuugauucuucagagacaaauuugucucucugugcuuagcagcauuauugccaggguuugauuaaccauguuucugguguguguguguguguguguguguguguguguguguguguguuuguugagacaggguuucucuguguagcucuggcuguccuggaacucacucuguagaccaggcuggccucgaacucagaaauccgccugccucugccucccaaaugcugagauuaaaggcgugcgccaccaccgcccgggauagcuaugguucuauuuaugggguucuaacucaagcuaaugaagccgccuugaguaagucaccuuugugaguaagccuccuuuauaaaacgaggaaugccugccaugcugccaguagcagugagauucuugauucaacugcaacugccauuuacugggugucugccucaugccaggguuucucuuacauguaguaucagcaggcugucccucacaaagggccuaugacugggauauagacagccuccucugagauacagggagccagacccagagaacuuugucgacuuucccaugagcagcuaucagguggaugaggcgggcuccgggcugggggacuccaacccauaaucuuagcuguuccuugguuggucaauaggaagaauaccagaaucaaacuagccuacagcuuuuucugagccagaucugcagcauagacuuccuuauuuugcucuaagcacauugaaaacagcccucccaagacuaagcacuucguuauuuaauauaaugaaggugaauaugaagacacggggcuugauguaaugcuuacccuguuccuacagaugcggucaaggcuggaccccuucuagcauccaggccuggaaacagacaucagcugacucccaggcaugcagugaagaucagaucaguggaccuccaaauauucucuuuuuuuuuuucuuucucccuaaaccucauccaaagucaggucucguagcgaaaagcacaugggacauguccauguguuacccagucacacccacagaagaacugaggcaagaccacgaaagaaccacugaucucuggugcacugugcagaacaaaaccauggagcgucuacuucuauugauuaaaauuaucaaauuagauaacaaaaaauaaaccacccauauugagauauuuuauacccaugaagaauguguuagagcuaucauuggucaaaacaaugaaaugagcuuuggaaaauacgucaauuugaaaagcauucaucuggauguaacaaagacagaucugaaaauuguauuaacaugcuuaaccaaaccaggaguacuggggaggggcacaccuagcaucccauugagauggaggcagaaggaucaggaguucaaggucacaccagcuacacugugaguuccaaguuacagagaaaaacccugucucaaca

SEQ ID NO: 5406 - RNA, 3065 nt, Mus musculus
uggaaaaaauuccuuuauuccuguacacuucaccuuugcuuuuggaaguauacaaagccacauuugaagugucaguagaguccuggguggggagguuuucguuuucauguguggagugaggccugugcuuggggagauagggcaguggaguucacugucaaugucaguugaguacaggcuaggaaaaaaauguguauguagagagaggagcacugugucaguucauuucccacuguaaguccaagugacucauuaggggauugucggcuaugcagagaaccuaucgacuuacugaagacuuuucuacaaggucccguggaugacaucuguuccuuuggucacauuuggagucuugagugaaaacugaguuuuaaccaccgaggacaaaacauccuaugcagaaagaaagaauugacuuaagaacucuugagaaagaacuuugugaauuuucaugauuuucuuugaagcccuucccuaaugacugacuucauuguccaacguuucagagcagggaauggggacuuccugcugcuugcugggcuucaggacccaaugaucuucaaaauacuuuguauugucggguuucggcaccagacagggacagaaacacaguaagguuucuuggucagugacacuucaguuguuucuauucugauuuuaagcucugguuagugcaguugcuugaagcuggucugaggacuucgcaaggagccagcugucuggagggaggugggguucacugggguggggguggggcacaguugaguucugagcuccgucacuuccuacuugcggacauuuugauuuugugaggaugcuuaccucuugacuauggcuucuuggauuucagauagacauacccuacaaggcagucgggucgaugaugaguagaaggaccuuugucgccagggaauuuguuuccuuuaucucugauaggcucuagggucaaaggagaauucaaccuaaagcacaccuggccuguuuuuucucuggagaccugaucuuuuaguuuugacuccuuucuagcuaggggaguucuaggccuaccucagacaccgaauuguguaagucccucuauaugaucuuucauuugaacuuuuccaggccugaugguguccucccgaugagcugcuggcauggaacucuggaaaaaaaaauccccucacauuauugauggaaaaccccacaucaaaaaacaaagauaccugagaauguggguagaacggaagcgccagcgggugaugcgggggcccuaucuacuggcuacuucuuccuuaucccaucuuccaguggagaaucccacuagaacauucucuccgcuguagaaaaagcucagaggaagcucacuugaagcucucuuuuucucugagagcuucagggaaccuucaccagcuuguuuucaacaaccuuaaacguugguuacuucucucugaaugccuuugugguuucuuuccguucucugaacuuaaaugaauuguuauguacaacaggaauauguuagugucucccuguaauuuuacacacacacacacacacacacacacacacacacacacacacacuccuuucuguuuaaaauucuccaucccaccucuuagcccuaaacguuauaauaagcucauucauucguaauucuucuugguugcaugauguuuuucaaguaagcuagucaaagcagcugccuuccugggggugggggcaaggagggagagguugcuuagaaagggcccugggaggaaagcuggcugagcugaaaacacaacaaggcauuuuaagcccagcaaacgccaaaaugcuccaggucuugaugacuuuagccccucgcccucugggcugcucaagcuuucaauauccagcuuagggugaaacaugcacuugguaagaaaaaaggaaaaccagucugggaauaauuccugaggcacggugacugccugauuacacaaacauugucucaucaauuuucuucccaauccuacagaggaaguggcaucugugguggucauggcgugaauaggaauguguguuuagagccgcgggguggggccgaaggagaggggaggagacacucccagcuguccuaggagagcugaggcgagaggaccccacagcacggucuuuucccacgaccuuuacccggugggacagagcuuauccagacagagggagucgacauauuucgugcgccccaagauugcucgagaagcgcaguucgcgucugcagggcaaaaaacgaggacgcccaauuagaggaccgacugucuccugccucccagacgauccacgccagucuccuccuuggacuacacagccccucgaggcccugucgcugggcacagauucuccaccucggacgacuuccuagccgggggcggucucuggggcaggagcaccaggguccuuggaggcgucuuuaaggcuuugguccccgcccucaucgcccgcccucuucccgccucccuccgcaaggauccagcgucuaggcgcgcggagcaggugcgggccaccguaugcggcuguuggggcugcugugguagcggcgcggggcgcucgcccaccccuucuccgggccacucucaggcucuggcgcgcggggacaugucgguggugacuggcggcggugaggcggccgguggcggcggcggcggcggugcgcgugucuucuuccagaguccccgcgguggaaccggcggcagcccaggauccagcagcagcuccggcuccucaagggaggacucggcgccggugacuacgguggccgccgccgggcaagugcaacagcaacaacgacgccaccagcagggaaaagugacagugaaauacgaccguaaggagcuucguaagcgguuggugcuggaagaauggaucguggagcagcugggucagcuguacggcugcgagguaccuggacacuggcugggggcggaaagagcgguguccggaucucuucugccccucugugcccacccgggaauuuuccguggcucuggcucccaggggugcacugccccugggaaccgagccccgggagugugucguugcgugaucucucucccggggugcccucu

SEQ ID NO: 5407 - RNA, 35686 nt, Mus musculus
auuuuuuuuaaaggcauaagaauaaaauaguuuauuaaaggacugguacauacaaggcaucuuuucucaaguacuucaaaacaauagcaauacuagauuguagauaacuucuuuguauauaaaagaugugcagaaagaaacaugccuuaucaguuucuauuuacuggguauggcuauaggugaccucuaugaaaaugagccgcacagcaucacagaguguagguaaguucacucaacauucaucucucagacugcuacuguaacauuuacaccauugauuagcucuaaauagucaguaagaggcuggaguuagagucucaagagacaaaagcaaacauuuguuuuucuagaacuacccuuugauuaauacauuucaauagguuauauucccucaccaaaaucaaaccccuuguuaaaggaaccaccuacuuuauauugagucuaaacuaaugagacuacagugguuuuuaguguuuuguaacguuugccacucaggguaaagaacuaggaacaucaugauuauaaacaggcaccacacugcaguccccucagaguagccucuagaguauacaaccuggcacuaaguggugaugggaaggucugccuuuacugucuacaaacuuaaagguguuaagcuggaugccaguuuccugcaaaggggaacuugugcaaaagugcuuucugcucuggaaauacauccugacauuagcugauuguacauuauaacauuuuaauaacauaaagaacagugagggcugggguguagaucagugguagagcacuuaucuagcccaaccaggcuccugggucccaccuccagcccugcaagacacacgaagggaagcaucaggacccauuccauugaaaagccugugauaccuggacauggcaacauguuuacaaacacccagacaucaccuuuuggauugauaauucgcacguuuuuucaucagaaaggcucauguugaaaaccagugcacauguaaagcagccacaccgcuccauuccaugaagcagcauugaguagauuguccuuacgaaucccacggcugggguucuauuugcuuuugccugccaggucccucuccucugcugccagcuuguucucauuucauaaccaccuacaguugccccuagccaaaagggauucuucuaaggucagccagguguggcagcuaccaccuuggccuggucagaagcauaggguggggcuggguggagaaccuauauuccuccccugugggacaucacugaucuaaucagcaugcuuauaacauccagacagaccugccauugguaacaucucacugaggguaaauucacuuaagauccuuuuucagagguauuuagcagaggaaaagaaaguguagcucaugagaacucaguggagagaagagagccagaagauaagaaagcugauaggggccagcaguuggcaccucacaaauaaaaggcaggacuuccaucugucaccuugucacaugcugacuuucugucucagcaaacaagcuucagucuuaugaauuccucucuaccuuugaagacauuguacaucccagggaaauuauuucaugauaagucaaggcuuguguuugcacugucuucuagcacaguuuaaaacaaaacaucuuaaugauagaacccaaagaacagauugugagugauagccauccuugccccgagcugcuuaaauagcguuguuacagauacaucccauugaugagguaguccgauuccucagauguaaugggccgggcuuucuugaguuucugcuucaccagucggagucggcaugucaccaugagaagcaacaaaacagugauggccagaccuaaugccagagguagcaccgcaccugugcaagguuuggaaaaaaaaaaaagugacaguaagugauuggcaacagugauugcuacuggcuacuaugugauacuuggcaugcauuaauuuacccugucugaauagcuccaguugaugcuaguuuuacuguugcuuuuugacaaaggcacagggagguuaauuccccugcauaggucaagucuuaaaccaaauucuuuacaaauuguucuuacaauuuuuuuuuucuuuacaaaauuggcaucaggaguagagccacugcagugacaucauccuuaucuccaacuauaguagagacugugaccaugagaaauguuuucauuaucgucauacaugacaguuauggccagacaugaucaucuucucauuagcuguagucuaacuccugauuucugguucugguagagcuuaagauauucacuuccaggguaucauagauggcucaauaguuaagagcacuuaucucucuuccagaggacccagcuucaacucccagcaugcacuuggcagcucacaaccaucuguaacucuaguuccagggaucugaugcccucuuuuggccuccacaggcaccaggcgcuugugugguaccccauauacauacaauuaacuuuuaacuuuuuuuuuuuuaaucuagggauccuacuaucccccaguagaccauuuauugaaaacuaaccuuaaauaugcugggauauuuggucagcccuaaaaccagaggcauauaggcaacacuaaacagacuaagcagauuguauuuaugcaaggugugcgugcguguguguguguguguguguguguguguguguaaaacaauaauaaaaagaguccaugaacuuuccaggguuaggggaagcauuugagaaaggggagguagggacuaauguaauuauauucuaauuaaaacugaaaguguaaagaucugcugguguaacuuugguuucccauggggcugguccuaggugucagaccagaauagccugcagucuugcagagucuugaaggggcaugguagaucugucuccagucaggcucagcagcagcuucuauucuuaguccccuccacacuugaguagggccagguugugaugacauggugacacuauuuuuaguugcaccuucuugcaacugggcaaacuagaggagccaacauauccgcgugcaguucgauucugaaacauuucauuuugcuuauuuauucugugcucauugauagcuuuccaugugccagacacuggccuaagugcuaccaaucaaagauaaacauuuuuuuuaauuguugcucacaaaaauacccagccccaaggauauacuaagugcuagcuuuauagcugaaguaacucaaccacaugagcugguacuaauguugugcccacauuacacacaaugaaaacugaggcaucuaauuccgugucaccuguggucuagucccuacagugcugauuucccuaucagggaugugagaacauaucugaguaacuuaaaucugaguagacagacauuuaguagaaagacuacaguguaauacuguuacaacaacagagucgugucugccuguagggaaggaagacuuugcccgagugacuugggucuuaaguuuguuacauguguuuguucuugaauacauguguauacuuuggagcauuuucugauuaaccugccuauaggacuguaguucucaaauuuccuaauguugaagcccuuuaguacaggucuggguaucugcaugugggcggaccugccuguggucucacauauuuccgauggccuuaggugacucuuucauucaaccccaaaaggguugugacccacagguugagaaaccacuguuguagaagaguccagcaauguccccugaggcuccucuguuaucugguuuagguaucuaggggcugucagcacagaggccguggcuguugcagugaacaugagaucaauagauagaaaggaagauccagaagacccaacaggagcaggcuccauggacaggagucagaggacagagacaggaaggcagcagaagacacuucacggagauugguuggggagcgagggaugcucgacagagcauaaaggcucccagggugggcccuggggaguccgcuggauuagcaaauggaaauuuauuuacaggagacugggcuauugaauguuuugugcacagaaaaacacccgaaugcuugcagccacagagguuaugaacccguggagagagggagacuaagagaugaccacaaaauacagcugaggagauggcuacaucaaagagaggcggucaugggugggaaugcccuuuucccauaggaaaggaagagaggguggggcagacagaacagucugaggguagcugaggaguucccuccagacagccuucacuuuaggcacuuaaaacugaucccagauacagcuggccucaucuugaccuggagcugauuucacacgaaagggcuuuuuaaacugcagguuaauagcagaacaccaaggacaguccugugucuagagcauagggaaggauauggaaguguccagggguaacaaguuuuaagguaagaaaaccugcagccaaugcacaacuuagaagcugguucuagaaccaucucccaucccacagcccugcagucuggaagcaugcagaacccacuuccccuccuugcaucccacugcccuggggguuuagagccaccgcuggcuccuagugcuauccuaucccagugcccuggggguuacagccaccgcuggcgccuagugcuauccuaucccagugcccugggggcuuacagccaccgcuggcuccuagugccauccuaucccagugcccuggggguuacagccauugcuggcuccuagugccauccuaucccagugcccuggggguuacagccaccgcuggugccuagugccauccucaugagaggcauuuucaaaggauuaaguggccuacaagugucaggaccaagacaaagaaagaaacuuuguucuccugauaggagcucagacaccccuaaccucuucagcuuggaaucuaacagccccaguucugccuguccauggacggucuguuagccucagagucuggguugaucaaagaugaaaaccaguguuuaggcuaaagguggggggggggcaaauuuuggguggacuccuaaaucucaguucuaauccuguggcucaggcccaccacgcaugacaaaacagauaugaaauucaugaaaauuucuauuuuccaaaucagguaugagguugcuaaugccuauuuaagucucuuucccucuccuucuuccuccccacuuccucucucuccaucccuccccucaucuauaucuuaucagaauacugaaacauauucuuuuccuuuuaaauggaguugugugucugugcaguuguaugugugaaugcccacacccauuugugugguguggugugguguaugguaugguguggugugugguaugguguguguguguguggugugguguaugugugugugguguaugugugugugugugugugugugugugguguaugugugugugugcgcgagguauggugugugugguguggugugguguggugugugugcgguguguguguauaugguaugggguguaugggugugugaugugguguguguggugguggugguguguguguguguauguguguggagccucccccagccugaagcgggcugaugaaaacauugcugccacagagaaugagaccaccugggguggagccuucugaccuagauggcucuauuguucugucaccugucgcugcucuucuccaggauacauccuauccugcacaucaccuacaggcuggcuccagacaccaagaauggacuggcccggggggggggggggggggggggggaugggccuucccccuuuauaagcacagucucuuaguaaacucaugggccuugaucagaaccuugucuuggcuucauuaucuuuucucgcagucuaauccucuuucagccccagccugccucccagguguaccugguucauguaggccggcauguaacagauuggaguucaaaucagggacauugauuggaacgguggggaaacacugagggaauugcugucuuguauggagcuccacgagaaggaaagcaucagaagauuguaucgggcacagugagcaacugguauuuaugcuaucgcugguuuuaaacuucauuuuuuaaaguguugcuggaggugcgauaggauaccggcuaaguuugaagcagugcugaccuggugcugcuuccacuuaggguuugacagcgaaacaugugugggacuagaaacuucaaaucaggcaguugucugcagcuuuguuuuuguuuuuguuuuuguuuuuuugagacaggguuucucuguauagcccuggcuguccuggaacucacuuuguagaccaggcuggccuugaacucagaaauccgccugccucugcauccugagaacugggauuaaaggcgugcgccaccaccgcccggcuguccacagcuuuuaagagcuguuucaggcgagaggaauaggguuuaaaauaaaaaaauaaaauaaaauaaaauagaggaaaauggauuuugaaacucuuucagagacagagagaaaauagggggacacccugcuuuauucucucuggccccuacagcagaaguucucugcucucuuuguguugucuaaugucuggugcaucaauccguucagugucaauucauguguguugucucguugucugaaugacugaauguucuguguuucauguuggaaaauaaaaauggcuaagacuuuaucugcugguucaacaaagcccgagaguggcccacacuuuagccaagaaucaggcacagcaggagagccacugcugaaaaaacugcuuuuaaagaaaaggagucuauagcuucguaguuuuaaggcaaaaaagcugauaguuguuuuuuuccuagaaaauucucugcaaucaugauuauuguguuuagcaaaugacaaagugcuuuuuuaucuuauagcuauaaaaaguaaaauucuuugauuggucuaaauuuauaagauuccuguagccacuuaauuugguuuuuacuggucuuaaagguauaauauguuugcgugucuucaucauagaauauuagcuuauaaguuauuggguaugauuuaaaagguguaacauugguagcaggacagcuuuaaauugguaacucagguuuggagucuuucaaacacguggcauaaggcaggccaaaaaaucuaggccucuaaggauacuucuaguugagauaauauuuaaugugauucuuauccuaaaagguagacuuaaagauaagauuuaaaacaaugucucuuuaaugaaacauuaaaauuugcacuaucaugcauucauagguauaaauuagcagccaaauuucguaacgugauagugauguuucuaauauugauucuaagaugauaaauuguuuuaaaauuggguuuugcuuucccaaaguuguaguuauagucuaauauugcaaaagaaacuuaaaaauucugaaaucuguccucaaggcaagaggaacaaagcucagagcagccucugcugggcuugugugacuuucuuuuguuuugcaaacagugccuagagaaguucuugccugccuucaggggaauuuucuuuuaacuaaaagaacacuguugcagaucuauccagauguuguucuaaauaaaguucuaauucaaaguuuauaaaaggucaaucaggcuguagaacuuauaaagacauuacaaucuggcuugccuacaucauguaaagguuuuaaagguuuguuuuuuccuuuguaucuuuacuuuguaucuuuacugcuaccugcugggaggccgcugagcuauucuggagacuacacccuauccugcacguugucaccugcagcugcuuccaggcuccaaggaugaauuggcgggaaugccccccccccccuuuauaagggcauuugccauuaaucauuugagccuugaucaggaaccuugucuuuuuuuuuuuuuuaagauuuauuuauuuauuauaucuaaguacacuguagcugucuucagucacuccagaagagggcgcuaggucucguuacggaugguugugagccaccaugugguugcugggauuugaacucuggaccuucggaagagcagucgggugcucuuacccacugagccaucucaccagccccaggaaccuugucuuggcuccauuuuucucucagcugccucguuuccccucucuuuucagcccccgcuugccucccagguauacccguuucuucugagcagcaggccugcuucagacaguuuggcaucugaacaugggaccugaggaacggcagaaaaaugcuggaggaacacugcuugguauggagcuccaggggaagaaaaagaaaaggaucguacugggcauggugaagcaacagguaaaguguugcuggaggugcggaaagauacgggcuaagguugaaucagugcuaacccaacgcuggauucacgaaggucagcagcgaauuaucggaacuaggaacugaucaggcgguuguccacaguuuuuuuuuaaaacugcuuuaggcgagaggaaaaaggguuuaaauuaaauaaucaggcagauguccgaagacgggagcugcaucaggcaucagaaacaggguuuguaauacuaaaauaauauaaaggauaauggauuuugaaacucucccagaggaagaaagaaauuucaggggaugcccugccuuuuucucucuagccccuacaacagaaguucucugcccucuuuguguugucuaaugucuggucuaaugucuggugcaccucgugucaauccauguguguuuugucucauuguuugaaugacugaauguucuguuucauguuggaaaauaaagauggcuaaaacuuuaucugcugguucagcaaaugaguggccacaugcuuuagccaggaucaggcaccgcaggggagccacugcuggaaaagcuguucucaaagaaagggagccugcagccucuuaguuuuggggcaaaaaaacugauagaugguuucuuccuggaggguucucugcaaucaugauuauugcguuuagcuaaugacaaggugcuuuucuuaucucuuaauuauagcuaaaaaaauugaaauucuuugauuagacucguguagccgcuucauuugguuuuuuuacuggucuuagagguguaauaugcucugagugucuucaucacaagaguauuugcuuauaaguuauuggauaugaucaaaaagguguaacacugguuacuagaaaguuagcuuuaaguugcuaacucaaguuuggagucuuucaaacacauggcauaaggcaggccaaaaaacuaggccuccuaaggauacuucuaguugagauaauauuuaaugugauucuuauccuagaaaguagaauuaaagauaagauuuaaagcaaugccucuuuaaugaagcauugaaacuugcacugucaugcagucauacguauaaauuggcagccaaauuucacaacaugguagugaaguuuuaauguugauucuaaggugauaaauuguuuugaaauuggguuuugcuuucccaagguuguaguuauagucuaauauugcaaaagaaacuuaaaaauucugaaaucuguccucacagcaagaagaacuaagcucagagcagccucugugcaguuugugugauuuugucuugccuaaggaagcucucgaaacuugccucuccuugccuucagggaaaauuccuuuuagcuaaaagauagccuuugcagaucuacccagauguuguucuaaauaaaguucuaauucaaaguuuauaaaaggucaaucaggcuguagaacuuauaaagacauuacaaucuggcuugccuacuucauguaaaguuauuauagauuuaaagguuuguuuuuuccuuugcaucuggaaaauuguaaagagcuugcuuuuagugagcuuguaaucacuggaaaauuuugccucuagguauggcuuauauagccuaaccucauguaauaaaaauucuuagugucucugcuucaauacaagaagcuaagaguuugaaucuuucaguguauauuguuuccuaaguggaaaguauuuuauuaacuaaugccucucaagggaaguuuacuuuaaauccuugcucucacacacggagcuuuuaaguucuggggagaacuguugcuccauaagauucagaggcaauaucuuuuuaauauuuaggguuuuaguuauacuauaaaauugugguacagaaaaucuagaaugaaaaauugauuugcuucaaaauuuuauuuucaaaagcuuccaggagauguuaauuggcuaagaccucaccacaggagaacuuacacuuuugcuaggugcuauuaagugagaugcaaauuaacugccaaagaacaaaaggcuuugcagaaaauaaagaaagcuuuuauaauugcuaucaauuauaaucaaugguaauuaaauauuagccaugcccacagcaauucuuugguaagagaaaacauuauuguaaaguccuuuucuucuccucccagccgaccguugguccauguggagccagccagcugcuggcugcugaggggcggggccuugggguagcggcguucccugagcggugguggcacagaacucagggaagggccgugcucaccauugcccccaugagccucugccuggcccugcugggguagcuguauuuuucccacuaggacuuggggugcucuguugcucucgcuugggcuuccuggccuagaacagauuggucugcuucagccucuucagccugggagaagggccagaggcaggcgaggcugaggugguguucaccucaaagcacaguuuuaacaucuuauuaagguugcuguugugcuaauaaagaauuguaagauaaaucuguauauuuuagaaaaucuauaacaaaaauugugccuuaagaaccuaagugucuguuccuuguucagaacagcaauuaaauuggucauuacagaauauuaauauuuaaucuauugcauaccaucauuuuaaauaaaauugacaaucaauaucccaaagauaaguuaaaaauuguuuuuaugcaugcuucuguaucuucuaugaauucaugaaugcaugcaucccaauuacuguguuuaaaaacagcccuacuaugggagaaaaguauaugugaauuggaucacacauuuauucuuuugaguuuacuccugcuucagcacagauaauuaaauugugugcuguagaugguguuuuaaaauguugcauaaucaagcuuuaauuuguauauuuaucaauauauauaucucagagcuuauaauugcuuaaaauuguucaucccucagaugcuauuaauucucaagcuuguaaaugcuuaugcaacucauaagaaaaaauacuguuccuuuaaaaggacuguuuuuggacaguuaagaauuuguccuggguugccuggaaaagauccccagaauuugcuuuuguguuauagagauuuacauaaagcuuuagcugauaaagauuacacauagcuccugaaaggauacaaacccaggauccuuauaauuauuugaguuuuagacuuacuaaucaagcuguuuuuccccagaagauaguuauucgcagagacaacuuaaggacuuugaaugauuuucaaaaauuguuaggugauauuaauuggcuucgccccuauuuaaagcuuaauacaggggaggugaaaccuuuauuugauauucuuaaagggaguucugauccuaccuccccuagaucuuuaaccucagaaggauugcuggccuuacaacaaguggaaaaagcuauugaaaagcaauuugucacuuauauagauuacucuuugccuuuacaucuguuaauuuuuaauacgauucaugugccuaaaggauuguuauggcaaaagucuccuguaauguggauacauucgaggauuucuccuaaacuuaauaucuugccauauuaugaagcaauagcucagaugauuauccuuggaaggaagcaggcacuaacuuauuuuggcaaagagccagauauuauuguucacccuuacaguauaggucaagacacuuagcugaaacagcacaguacagauugguugcuugcucaaauaggguuuaaaguaacuauagacagccacuacccucaagauagguugauuaaaauuuuaaagguauaugaggugauauuuccuaauaugaccucuuuacaacccuuacacaaugcuguucugguguuuacugauggcuccucuaaagggcaagcuggauuucuuauaaauaaucaacagguaaucauaaagacuccuggccucucagcucaauuagcagaauuaacagucaaguauuugagauauuuugucaacaauuuaauaauucucaaagacaggguauuguggaacuuucaaaaaaucuuuuucuuaaaaaacaaagaaagagggaaauuauauccccaugcacauuauuuaauauaucccugugcacauuauuuaauauaucccugugcacauuauuuaauauaucccugugcacauuauuuaauauacccccaugcacauuauuuaaaucauacuuuuauuuuaagaauuuugaaugucaaggaccuuaauaaaugccucauaggaucuuaaaaccagacauaaucaugucuaugugagaugaaagggaucuaagggaaaagcauaggcucucuucacagaaugcugcagaagcauggcggcuaauucgugugacaagcugacaggugaguucgcugaguguccugacuguagugacaagaaagcugaauuggguauauguuuuugacccacccuugccugccuuuaucccagauuggacaagcuaagcugccuugcuucaagcuuuuuaacccuuaugggacauagaacauuagagacuguguaaucugacuuagaaagauuagucacaagaaagaguuauagugauucuucuccuucccucauugugaccaguuauucuacucaaucuugggcuggucuaguaauaauuccaguauuagagauuccuagagaagacagcuaaaaucuuaauuaccuagcaaaguuaauuuggagcacauccuccacuuucagagaaugccaggcuuuucugcuaauucucaaagccaggucccccucagggggaggucagagucugagcuugauuguugcuaauuugcaacugaauaaaguaccugggcuuccacaaagaagcuuuuauccuguugcuuuucaacuaucuggacuuuguuuuucaagcaggucugucucuccuuacagccugauuucaucaagcauucagccuccagcaagcauggguggcagaaauucaucaauaugaagaagcauauucaguauauauuguggcuuuggucugauuugggaauaaugugugcuaugaggacuggacagucaaugaugggcaaccagauuucggagccauaucaagcuaagacagagguauaugccaagaggcugcgguuuguuaauaauacaccacagagccauguuugugcaaaauaaacacaaacaagcugcauauauucuccuugauggauaagaauggcucgggaaaaucugagauuuccuaaaacgggcagccaccugccaccauaacucccaggcagaauuauagagcauaaauaaauuuuaugucucaguccagcuauuuuuauuauauaaucagagaggaaauuguagccuccccuagccugaagcgggcugaugcaacugagaaugagaccaccuggggugccacugagaaugagaccaccugggguggagauggucuccuauuguucugucaccuagauggcguagcuuacaggcuggcuccagacaccaagaauggacuggcgaggggggggggggcuucccucuuuauaagcacagucucuuaguaaacucaugggccuugaucagaacguugucuuggcuucauuaucuuuuuuccgccaucuaagucucuuucagccccagccugccucccagguguacccgguucauguaggccgcgggccaacauacaacauguguguggugugguggugguggggugugugugguguguguguguguguguguguguguguguguguguguguauguauguauguucgugugauuguucucuaucuuacuuuuugagacagggucucucagugaaccugcagcucaccuagcuacacuggcugccuagugagcugugggauccuccucuaucuaccucaaagugcugguaucacagacauaugccaccacaucucucucucucugucugucuguaugucucucucugucaucugucucucucugucaucucugucucucucuuucuguuuuguuuguccucauagcccugggaaaacacugugcagcccaggcuagcauugacuuuguggcaaucaucauguuucagcauccugaguguugcaguuacauagccaccucacccagcuucuuugcuuuuuuucuuagauuuauguagugcacauguguuugcagguacauguacaugugugcaggucagaggucgacacugaguaucuuuuauuaucucauuccaucuuaucuuuugagacaaggucucucauuaaacccagagcucaucuauuggcuagaguggccgcucagugugccccagggacccacccaucuccagcucccuagggccagggcuacauacccauaugaccaugccuaggucuucccugcuugcacagaacauauguagguccauguucuuacacggcaggggcuuugcugacugagccauauucccagccccuuguuuuuuugaaacaggauuuuacuguauuguccaugcuggucacacacuuacgagccuccauccuaccugucucccaaggcuacgaugcuaagggcuacagggauuucgcucccugccucauuuauuccuuacugcuuaacccuuaguugacauagcuucuucuggacuuucaguuuggguaaucugaaauuauuuuccucccaacuucuucugaaauacagugauagaguuguuaguaaccagcuaaagugaauucuuauugauagauaugcuuaaauguguauuaaaaugccuuaguaaauucuaacucuguauccaaaaaaaaaaaaaaacaaaucuaaggugcugaaauaucuagugugcuugugugaaugggaaugauaugucaaagcaucuaaacgaccagagugagcagcagugaacgagaacugagccuccagagacacguagccauggugucauuguggaccggugacagggaaagaccagccagcaggcgcagggggugcagacagguaccugacagcuguacuugugcucagacaucaguuguuuauaauuuguauuuugguguuguccagcuaugaaaaggagaugagcgauguuguacaaauacuccaaaggauacuccaguuuguuuugauagauuuggcaugcaggauuaaagccuauggaacugacaguugcuucccuuccaauuaaaaacagcccagugauggagcuguccucacaggugucuccucacaggugucaguauucucccuccucuggugcuuuccacaucccugucauguucugucauuaagagcacagcaucucuuccucacuccccucccucauacauaaugcaaucuucacagccaucacuagauccaaaccaugcaguacaugccaaacacuguguuguguucacuuucuacagcgacccugugaggcaggaauagucacuagugccaccuucccccuaaagucccugggguacagagagaagaaucugaaugucguuggucgaguugaguggcagagccagaauuucaacuguggggucugaucaguccuggaacucgcucuguagaccaggcuggacuugaacucagaaaucaccugccucugcaucuugagugcugauauuaaacauguuugccaucgugccuggcugagccugcauaucacaaguaugacuuccagagugaucccuggaaguguauggguggagagauggcucagugguuaagagcacugacugcucuucuagagguccugaguucaauucccagcaacuacaugauggcucacaaccaucuguaaugagaucugacgccuccuucgggagugucugaagguagcgacaguguacucacauauauaaaucuuuaaaaaaaaaaaaaaagugagagcugaacauaguaguccagugucauggguaccacgauacucugugaccuugaagauaagaagacagucuggggacuacugcuucaacaugaacucucagguguaagagaauaucuuauguauuguauggacaaaucaccugucaauuaaaaaaucuauggccuauaagaaaggauagaauagaaagugggagacauccaaaagguagaaagaauucugggacagagccaggagugggaggaguugcuggagaagaugugaggagacagacacauggcaccugaacagagguaaccagccacguggcagaauguauaaguuaauauagauggguauuuuuacacuaguaguuagucagggggcaagccuagcuguauggccuaggucucugaaaauauauuuugagacugagucauuauuccgggagcuuggggccgagaggaaaaacagucuuacaacccauggcuccaccugacauccagccaggauucaggcaggaagugcuuguuccucacugcuccguaguguguuuccaagguaugcacugaccugcuuccggugucgggugcuccccuagacacugaccugcuuccggugccgggugcuccccuggacacugaccugcuuccggugccgggugcuccccuaaacucugaccugcuuccggggccggguacuccccuagacacugaccugcuuccgggccgggugcuccccuagacucugaccugcuuccggggucaggugcuccccuagacucugaccuacuuccggggccgggugcuccccuagacacugaccugcuuccggggccgggugcuccccuccugcuuggccacucuuggacuugagaucauaauuuccuucuucuugguucuuuccugaggaauugcugucuauggaagguaaacagauauauguuaaagggacauuaaaaacugcaggaaguaggaaaaagguuucuccaugacacacauuaaauauagaauuacagcuuuauuuauuuauuuuuaauucagauauauguuugucuguguaugacauguguguggguacccacagaggccaguugugaauccccugauguaggugccaggaaccaaacuuagguucucuaguugaccacuaauuaaucuuuccagucccuuguuuacuuuuuagaagauggacuuugagaaagggaugguacuuaaaggguguuuacuuaaaaauaauucaacacaggccaguugggcaaggaagcucaucccuuuaaucccagcauucuggaggcaacgggagauggaucucuggggagcaggggugggagcagggguggggagcagggguggggggcacucuaugugaggugaagauacuuggucagcaccauuucaggugcugggucaaaccgucaagaaucugacuuugugguuugucuuucuuacacauuuaagcaugguaaaacuuuggaaaaagguuuacacaugacacauucuaaauauuaaauucagggguuugcacagcaagcuaggcuugugcgcuaccacuaagcgauuuucuuguucccuuuguucauuuucagacugaggucccaguaagcuuugaagagguucucuccaaauggccuggaagugauuuaaacaaaacaugauuaucauuuuucucuccugaugaaggaagcuuaauaacacacuuggggagggggacacagugcagucccagagcuguguuagcaugcacaaggcucugccugguuuaagucccuggaacccccccccccccgucauccuuagucacugcaaggacuguuuuccuguaggguaguauucuaagaucgccaucucuuccugugcccaaaagguagauacauaaagaaguccacugguugauauaaaugacguuuucuaaagauguaaacaaggaaagagggucucaaaaucccauggaacuagcccuugaguauccuuuguauuagguuuagaugaggggugagcaguucaagaggacacugagauggauuguugaggacuaaggaguuucuuagaagaguuauuaaugccagggacagacagauaggcaggcaggcaggcaggcaauaguggagguucugaggaggcuucuggcuacaaacuagagacagguggcacaguggaggaucuuaugaaucuuuaaggccaggugggggugggggacaugaugauggauggagggauggauggauggauggauggacauaacaacacuacauucugcugaugccuuaacagcucugcccccugaugggaacucacuucucaggggaugaauccuaucuauugugucccaguaggguguguguauccauaagaaggcaaucuaacauuaugcuauuagaguuugugauaaaugaaccuccucacacuagccaugcuguuggauuccugacaccaucuugggaggacacacgcuuuuacagcugccuuauagaucauacuuucauagauacaaacuacuuuccuagguuuucgaucauacagauuccaagcaguucccccacaacacaaacccugagaagucuagacaagaacguaagagagggaaaccuuuaaaaacaagucuuuaggcucuuuuuuuguggcaacuuuaggaggccagucauuucaagaugaaacugaguaucuccuucuccaccacuggcugucagaaacucauagaaaugggugauggaugcaagcuucaugcucucucugagaggcacauagucacagaagcagcuacugccacugggugaggagcaccgggguuaucucuucugaagcagcggugagaaugacaagcaagguuuucccauggagugagguguccugacccaugacagagugugccugcuguugaguaaggggcagucucauuauagaccaaggauaacuggauagaggaaaugcaagucuguucaaggaugcauuggggaugccaucuguguguucucaaacuuacauuuucacuuauuguuaaaaggagggggaggauauuccuggacugacagauaucacugugccucgugguugguguauaaaagagcuaggagaaccugaagguuuuuaaucucucuaaggaagaugguguacaccaauaugcugucugaaagcccucaaacaaagaaaguaagaagcccaggaccacagcacccaagauuuaacauuauuucacauguccuugacuuggcacugauugcucuaaagaaacaauucucuaagucaagcaaggaggacacugcaggaugugcuaaacguacagugaagggaaccaagacuccaagggaaaacgccacagauugccaagaggugaaggcugucgccaccgagcccucuaccucugaguccagucaagguaagccuugaagaguaacaaguguccuuuuguauuuguggccuccugacugcuguaccugacuccccugucccuucaugggcuagcucggucugaucaucuccacucuguacucucccagaugucccugccucuggcuuugccuucccauauauuuauaauaaacuuucucuucuaucauaaaaauaauaauaaauaaauacauuaaaaagaguaacaaguaagguaagauuugaaucucaaaguaaauaauaacauccuuaaagcugguagaguauuuuacaauguaugaggcucagaguuggacucuuaguguuauauaaauaaauaaauaaauaaauaaauaaauaaacaaauaaauaaauauucuaaaaacaaagcccuuuuauaugacagguaacccagagauaagccauggccugaggcacuggauauauaguagaggaaaaacaccacaccugugugcagaaaauguuuguuuguuuucauguuucagcccaguccucgaaggacuuggcugaucugcuacagaacccacaaacucuugaguugccaauaacaagagccuaugucaauggguacacaacacuccuuuaugccacucuguaggccuggaaaccugacuuccuuccuccagcuagacuggauacaagaagacagcauuguuagugagugacuuggaccacacagagaacagucccugcagcugcaaccacauugaugacacucugcccauugugccaagagaugcugaacaaacacaggccacacuggagcucuguacucccaaaugccagggccucggggcauuccagcacacacucccugugcaaccaaacauuuauacaugcccuauguaaucuuuagacaccuguuucugaggccgagggugcauuucagugggucacuauguuuugcaugcauaaaucccugacuuuaauccucaucgcacacacaaaaauggugccuauaacugaacacauacagagauuguuuuucuugucauuagucccuaaaauauacaguauaagaacuauuuauuuagcacuuacauuauauaaggaguuauauguaacuuggggauguguguaggacugaugcaaauauccugccauuaacuuuuuuuuuaacaguuguuuauauuguauguguguagggagggggcaugcacauaugccagggccauguguggaggucagaggauaaccugcuggacucagcucucuccuuccaccaagugaggcccugaguguggaaucagguugucaggauuugcagcaagugccuguaugcacugagcuguuucucagcacuauauugcuacucucacagauggaacgugagcauccuugaacuuuggugcuccccgguccuagauucucaccaucccucagggacuuuuuaccaggcauuccuuuccauuagucaacaguucauuucucuucaguggugggggucaaaccaaggccucuggaugcgagacaggggcucuuccacuuauauacagcuccauacuuaauuauaaauucauuacuacaaaugcagcguuguuuuuguuuuguuuugcuuuguuuggccaaauucuucauuucaauuuucaucuuuggagcauauuucccugauggucuucaaguauaaaauauaacuuugaaccauguuaauaucaacgaaugagagacuagucauggagaacucgaguccuuaccuggcuggacaggauugaucugacucucuggcgccuucuggguggaguggauccucgucucugggugggauacaguagcggguugguuguggguaguggcucucugggauuuuuccaacuuggggucuccuucaccuucauuuaaucccauggcuccuggcugggcagaaguagccacugugugugucaccaacuugcggucaagagccacuguggaagaacucaguuacuugcugggccuuucucucucucucucucucucucucucucucucucucuccauuguauauggcagccagaagacaacccugcuguuccuuaggugccaccaacucugugucugagacagauucucuuacuggccuagaacuuggaacucaucaggcaggcuagccugggugaccaguaggcuuccucaaucuucuugccucugccuccccagaucuaggaucaccaucacaugaugacacucuugcaguuuuguuuuguuuuguuuuguuuuguuuuguuuuguuuuuuuaacacggaugcugaagaacuaucaucucagcuuuggauuucucuucugaauguuaacuaaaaccaccguaucuacaguugauuuaaaaucauggacauuuaagacuacuaacucacucagcuaagacaggcugagcccacuaaaacuacugcuuaguuuguagauggguaauguguucuuuucucuuccgguggcuuccuaacauggaugagggcauacucaacacuauacucuuggguuuuugucuuguuuuuccagucucucuacuuuggcuauaguggggucugaaccuuggagcucaugcacucgaggcaagcaccugacugcggagcuacguccucagcuccuccgccuuguguuccuuacaccagaccugacugggugacuuauuacagcccuucucucucagguuaccuuuagguacauggccuuauacaaagugauuuauaggucuaacuuggccauacuccaaugugucauaaacaauccuuagaaauuauaaaagcaaugccaagugugccuauaggcccaugccuauaaucucagaacucagaaggcuaaggcuagaggauugugagugugaggucagucacaugguaagacuguauuucucacauacacacacacaaacacaguuaucaaggcaauuauuaauguacuuuagguuuuauuuuuuaaguguauuacacuacaugguggagaucagaggccaacaugggcccuggggcuuaaacucagaucauuaggccauuaggcuucagcaaugccuguauucacugagucaucuugccagccccgcuucaguuuuuaaaaagugcauguuaugugugugauauuuuacagacacugaccugccuacgcuacuaccccuuccaggucccugccugauaagaccaugcacugacucacaguuuugacagaagucuucaucagacccgucgggacacugccucacgccaucacaagccaacgcuaugucaauacagcagccacugucacagaagaaaugguagcgcgagcaagcacuggagcauccuguuugugaacaagucucaggucacagggaugcagggugacugggaaaggggacacgaagcaggguuaaguggcagggauagugacgugacagaauuggcacaauaggucagagggucccucugucaccucucacuggacucucagggcugccccagagcuuucugccagaagguccuuugcugcccugguuccuuugacacccacuuauuuggcauccauucacuuguucaucuaccauggagccccauucucaggugggucacuugacacuaucccaaccauggaugaccugcuucaggagcagcaccauguuauauagucuguguucucaagucuuguuuacuuuuuuuugguggggggaggggaggauaggguuucuuuauguagccuuggcuaucccagaacuagcucuguaaaaccaggcugaccucaaacucacagagccugccucugccucccgagugcugggauuaaaagucugcagggcaccacuaccucuggcaaauuccuuuucucuaagacuuuuuuuuaacuagauuaccuuucugcuguugacuccuaugcguagacaaccagguugcuaguguuguagaggaauauauuuuugugaaaugaugguaguuuucccucuugggaauuucaggagcuucuagucuugcaguauaauucaaaagagcuacagacauuuucuugaaaggcaguuuucucuacuuuugauuaagacaacuuugcuaaauaagaaucagauggggggcuggugagauggcucaguggguaagagcacccgacuguucuuccaaagguccagaguucaaaucccagcaaccacaugguggcucacaaccaucuguaaugagaucugacucccucuucuggugugucugaagacagcuacaguguacuuacauauaauaaauaaauaaaucuaaaaaaaaaaaaaaaaaaaaaaaagaaucagauggguuuggagagauggcucagggauuaagagcauuggcugcucucccagaggcccagaaccuacauggcagcuuacaacuguauguaccuccaguuccaggggcuccaacgccugccaugggcaugcaugcaggcaaagcaccaaugcacauaaaacugaauauguguguguguguguguguguguguuuguguguauauauauauauauaugucuauaguguguguauguacacacauacauauauauuuggucuuucaagacaggauuucucuguucuggaacuuaaucuguagacuaggcuggccucuaacucacagcgauccaccugccucuaccuccugagcacuaggguuaaagauguguaccaccauaccuggcaaaaauacauaaauguaauaauacaaaccaaaucagguaacucgggugauagucaugaaaggcacccagcuagaagccggccuuaaggaguccuacaguuucuuauuuauuuauuuacuucuauuuuauguacacuggugauuugacugcauguauaucugugugaguguauaggaucccuugggccaggaguuacagacaguugugagcugccauguggguacugggaaauugaaccccugcccucuggaauagcagccagugcucuuaaccauugcgccaucucuccagcccccuggaauccuacaauguuaugguaacaggaaugacuaaauggcucuuucaggaacaugacuggcagauuauaagacauuccacuaacagcaaaagcuaagcauaguugaugugcacagacggaaucuaacacugauuuuauugaaaagcugucaacuagaagacuggaaagugacccugucugggugcaaggugauuggaagagugcuugauccuaaaggagaauuaaagaaaggaaggaaauaacgcaggagcugcugagacagcggucaguuuggccuccuugaaaacuuaggccugcagggucagcgacagccaccagggggagcaagcaaaaacaaaggcgcugaucaccaagcaaucuuacucaugugacaggaaauccccagacugcaggguucuccuuacuucuauguaguuuuagaggcagaucagcaucuauauuuaaucuguuucuggaauagcagucuccaaacguuuuaagcaucguaauaaacacacaccucaaauuuacucauaaauaauuugcaugugcugguguucugagacacuggacccaaggggacugcaggauggcucaguggguaaaggugcuugucaccaagacugaaaacaugaggucaauuccaggaacccacaggcuggaaagagagcaacauucucaguaagcuguccucugaccuucacacaugcgugugcaugugcaggcacgcacacugagugaacacacacguacacacagaauaaaagacaucacacaccuuauuaaacacacugaaaauuuucagaagguugaaaaugaguaaaauuaaaaguucaagugucuuguuuucuugcccuaaaaaugugcucagcaucaggugggguucgucccuauuugaaaccacugugcuagcucauguuaaacgcucucucuccagccugcuaucugcagagaagguuccucacaugcauucaaaagguguuagaacaaucaauauacucaaaaccugaaccagguuauaguguguguguguguuaaaggagacagaaacuccugucuuauguccccaccuguuugccacuguuuauacaugguauuucauaugugacuucauaguacgcucucuaacugaaccaguaagugaucagguaggaauagcaccacgcugacuccuuuuuuguuguuguuuuggauuugucuuuuuauguugagacaggguuucucuguguagcccgggcuguccuggaacucacgcuguagaccaggcuguccuggaacucacgcuguagaccaggcuggccucaaacucagagauucgccugccucugccuccugagugcuggaauuaagagaguauaccagcaccacuuggcuucugugaaacuuuuuuuuucuguuuuuuauuuuuugauagacaggcuuucucuguguagcccgggcuguccuggaauucacucuguagaccaggcuguccuggaacucacucuguagaccaggcuggccucagacugagcagggcuuuacuacuuuuccuauuucaguccaacuggagucauuaaccacauguuuuucuuucuuauauuuuaagugguuuauuauauaaacuauugauuuagucaucuccuuucuagccuaucauaugccuuuccucccuacaccccauauuuuauuuuuaauugauggacaauaguauauagauauauggcacccaaggguauauguugaugugcguauaauauacauacauauauauacauauacuauauuuguauauauguauuuaguacuaacuagaucaagucaguaaacaaucuauaucaccauaucuacuaauuuuuugugguaagaauauuuaaacuucgucuuuuagcucauucuauuuauuuggaauauuuacaaguauuuccuacauacugacccuagcuuuuaaccaccguucuacccucugauuccauuggcuggacuguuuaaacuguagacuucgguuaaacacuucaaacacgcauaucagaaagacccucuaacuuuacauuaagcccucuccuaggaaagacaggcacuguccuuaacaaggucaaagagcaaaggcagaaggucagcguacaggaccccuaccucaugggccauguccugagaacguucuuuacacucuaaccagcgggauccaaacgguccuaaacacagagccguguuugcuauuucauuuucagcaaaaacuucaagcaccgaaaguaagauggaggagcccgugaaacgggaccccaggguguaaaucccacugacaccauccuuccgugaccagcugggcuuggcuggccaugggggacucaauggaaggaaggacuggcuuucuccucaccucccguggaguagggccugggaagcacagugacagagacguuaucggagcuucucugacccacggagucagucacagucagcuggaagauguaagcuccuuccuucaggcgggacagccucaggguuccuggcugaggcaccugccauacaaacagcuuuagggaagagaguagagcacagaggcccaggagcacccacaaacauggacacugcccccuuccccacaaagagccuucagcuccucuuuucucccuagauaaugauuaacuuuggaacagaaacaauaacaaaugauagaugacacuccaagguagaaaugacuucugauguacaaauuaaaccaaaaguuugaaauguaaagaagacagacagacagaaaggagguccugcacaggggcagucagucauauauacagucgcggggaaggggaggccgugauggcggcacuccugcagaaagaggaagccggugguagaaaccuuguuagcaggagacucagcgugacccuauccugugacacagcuacugacacaguucaugcaacuggcuucauuaacaggcacugggaccaauguucagaacacaagagcguguuaacaugggucagaaggaaccacagcauacaugaggaauucaauuaggggcuucagauuuuuaugaagaauauaaaucuaagaaaaucuagaugaugcuagaagguagauggucugaaaaucaguacaaguuuuuuuuuuuuuuguuuuuuuaacagaauaaaaggaugaguucagcauuuuguaaagggaagucuagugacauacagccaaguacagacuguuugccuaaguagagcugauuagcaguacgcuaggaccgagguucucaaccugugggucaugaccccuuugggggugacauaucagcuacccuguuguaguguuuugaauauauuuggcccggggaguggcacuauuuggagguguggccuuggaauaggugugucacuaugggcguggguuuuaagacccuuauccuagcuaccuggaagacaguauucugcuagcagccuuuagaugaugcagaacucucagcaacuccugcaccaugccugcuuggauguugucauguucccaccuuaaugauaauggacugaaucuaagaaccuguaagccaggccaaauuaaaugcuguccuuauaagaguugccuuggucauggugucuguucacagcaguaaaacccuaacuaagacacuuguguaucagauauuuauauuaugauucauaacaguagcaagacuauaguuaugaaguagcaacaaaauaauuuuaugguuggaggggucaccacaacaugaggaacuguguuagaggguugcaguauaaggaagggugagaggcaccgauuuaggacaugauguauaaaugcuucugggaaaguugaacgaugacucugggguggugagcuccaggaaggacucugagugacaggcugggaccauucugaacauguccaauccuaaaguuauuucaucgcuaagcaaaagcagcacacugagaucaaugcagugggaccagcugauuguugcuuuguugugguuccggucaggcacaaacuggcuuuucacuaccucauccucuaaggcagugugguucucaagucucccuggugcugcaacccuuuaacacaguuccuuauguuguggugacccccaaccauaaaauuauuuuguugauacuucaaaacugaaauuuugcuacuguuaugaauaguaauguaaauaucugugcuuucuaauggucugagcgaccccaugagagguguugagaaccacuuuucuaauggaugaagcgugugagacuuagucugaaaguguuccucucuaaaauggcuccaacccucucauggcugguauauguaggcauccccucacuaaugguuuguuuucacccaccgcaaaucuagcuguggccaagggagucugcuggagggcaagagagcaggaggaaucaggauagccuuaugcugugcccaccucccuucuuagcacaguguccaugaguaggauuaucugcuguguacaaugccuccagaucacauaaaaaaagaauucauucuauuauuauugccucccucuuuacauuccuuccuuucauacuuucugggaaaaauuuuaauccaggauagccaggaauuggugacauagucuagguuggccuugaacuugugauccuccugccuaaacccacugaguacuagaauuacaggcaugugccaucauacuuggccacuacccagucuuauacuaagaaaaaagaaaucuuuuuaaaaaaggaaccagaauuacugaaacacagccuaagcuuucuccucugagcuaaaggagcaagacucuggcaagcauccaagcaaccaaucaguuuauacugagcgccaaagggacuuuacagaacaaucauuuuuaggauaauugauuuuaugauuuguucauuuuaagcacacucugcuuguuuaugugcauuuagggacugacaaugaaggacauuacagaaaaccacuucccagaaacaucaguuuuuguuagcaagaacagcaagagucaccuucauguccacugacgaugggucacccugcugcagcguccacucauaaaggacaauggcguggucguccgagcuuucucgaccaucuagaacuaccccgucugugggcagauguaaaaccacauccuucccagccuugcuaacgggaggcuuguccucaucugugaaagagaagagacaggagaggcaugccucucugauuccccagcugaugaacagcaauagcuugucuguagauuaguccaucaaaaaaaaaaaaaaaaaaaaaaaaccucaaagagaauaaauaaucaacugaaaucuaccuuccugcaaacuuccauuguguccccuuuauacaugcaaacaguaaaccagcacccuguucugacauggacuuuuagcaaugacacacguggaagaggaacuauggagcgccagcuguuugcaaaguaaccauauauacauacauccauuccagauggcugagagcccccaugugguugcuggaaacaaccagguccucuggaagagcacccaguguuccuaaccucagagccaucucuccagcccuauuuuuuuuuuuaauuuaaugauuuacuuuuaaguuaugugcauugguguuuuuccagcaugcgugucugugugauauugucagauccccuggaauuggaguuacagacaguugugauuggccaugugggggcugggauuugaacccaggcccucuggaagagcagccaguacuuuuaaccacugagccaucucuccagcucccaauaauauuuuuuuaaaaaauauuauucaaagguuuuacauggaagaaucaggaaagcacugaaauaucuugcuugucaggaaacaaguuaaucuugccucuccugaagaaaagucccagccgccccuggcuuucguuuaagugcaucauagcugggacuucuaagccccgggaaauccucagucuaccuugcccucugaugacuucugagaaaacaauuucucccgaguucuagucaggcuaauuacacuguuaaacguauuuugaaacaaaccagagcuuaucuacacagaaaccguccuggaagcaaagaaagcacaacgcucuccaagagugugauaaauguaauuucgaauuuucauauagacaauauguaauugagcaugcuaaguacugugggaacauugauuuguuuuggaaaccaaacacaguggguaagaccuauggaggugaaauaagccucgugcuucccaacacccugcugugaauggagcuuuccugagagaccuucugaaucugugccacacacacuggcaaggggaccaaaaaaaaaaaaaagcuacgugagcagggagcgggcaagcgagcggggucagagcagggccagagcagggaagacagggaaggcauccugccuuucugugcuuguuuguuuuuccuuucaggcuggagaaucaaucauuucuuaaauugcaucacugaagaaaaaaacauauccauaauuccagaacaauucucauuaucuuaaguauguggagucccaucuaucuuucccauaggauacugaugaucaaauacaauaauaauaauaauuauauaauauauaauguguugauuauuaauuaauuuaauuaauaaaauuaauuuuuaaauuaaauaaaugaaacaauuguauaauaauuauauaauauuuauaguauauaauaauauauaugcuauauauuauauaauuuauauaucuuuuuucuuucuuucucucucccucucucucucucccuuccuuccuuccuuccuuccuuccuuccuuccuuccuuccuuccuuccuuccuuccuuuuuuucuuucuuagaguuucucuguguagcagagcccucaguuguccuggacucucuucauagaccuggauggccuagaacucacggagauccaccugccucugccucugcuucuguagugcuggggugaagugagugcaucuuugcugccccuuccugguaaguuauuuguaccaugcagugugcuaagugccccacuggcauccccucacuuaacaucuacugucaggcugaaugaaacauuuauaucucgccaacuuuaucacuguaaauaauuccacaguuaucacguuauugcucauacuguugcuccagcacagauuauuauucuuaaagaacaaaaacaacaaaacaaaaaacccaaaaacuagaacagugguucucaucuugugggucaugacccccuuggcaaaccucuaucuccaaaauuauuuacauuaggucucauaacaguagcaaauacaguuaugaaguagcaacaaagauaauuuuauggugggcugggucaccacaaggaaagcugagaaccacugcccuagaagaauggguauuuuaaaucucugauacauuguuuccuaguugguuucuaagagguuguaucaguuuacacugucaauguccaugaguauacagauucucacaugugugccaaguuauguuuuuuuuacuuguuguuuguuuuuuuguuuuacaauuuagugaguguaggcugacauuuacuuuugauuuuuuuccuucacucuuucugaugguaacagggacccaucacaugugcuagcuaaggccauuuccuguguuuaucaacugcaugucuucaccaggaaacuguuuccuugaauccuuuguucauuugucaaagcagcccucagcucuguuaacauuuuaagaucauacuuccuagacucuuguuugcaguuccuuacuuauugacacacauuuuugugugugugugugaauuuguacaaaaucuuucuuugauguucuauuuaacugauuugaagacuucuuccucccagacagauaauacugaauuuagcuucuaguuuuucuaacuauggaguagacuauggcuuaauuuuaaacuacuuguguauguauauagggcuggugagacggcucaguaaauuugauaaccugaauuccaccuccaaggcccacaugauggaagaagaaaaccagcuuccugcaaauuugccucuguccugccuacauacacuguggcaggcauguccagaaacauacuaaguaaauaaaugaugcgaaugccaguguuaaucccagcaccagagaggcagaggcagaccucugugagucugaggccagccagguguacgaaaagaguccaggauggccaggucucugcuacacagagcaacugucucaaaaaacaaaaaccaaaccacccaaacaaacaaaguaaauauccaucugggauuugugugaggucagaguugucucaauacauuucuccaacacugacaauaaauaaucuuaguauuauuuaugaauaauauaagugguuacugagagagagagagagaaaggaggaggaggaagaagaggaagaggaggaggaggugaaggagaaggaggaggagaaggaggaggaggaggaggaggaggaggcgaaggagaaggagaaggagaaggagaaggagaaggagaaggagaaggagaaggagaaggagaaggagaaggagaaggagaaggagaaggagaagaaaugagccaggucuguggagaugagucagccugcugcggagggaucacccugaacaggaaggucaguccucucuaccuaacugaagccuggcagcagacggaggucugcuugggagaagucagaauuucacccaaggcuuugguuugacugcaaaggguugccuuucuaagcucuauccagagacacugaauuucaggcuacuuuagucaaaacagugcaaagguucuagucuccgaaggcugagggauuauauucucagcuccuauaguauccuaaggauuucagccucuaccccauaguccucuuuacucaaggcaccccacugcucuuuccagucaaucacaccagccaaccuagguucuguaacgauaccauagacaccuauagugcccggaaaaaucacaagaaacauccacacucggucauuaugcaacagugagcuagaacagaagcaaguccaagaugguuaccagggacuugcaugggaggagccuagacucaacagaggacugaggaccucaggcacuccuccauucagaaguuguagcagguaggcucuguccuacaauuuucucacuuucucuaacagccgccucauuaugcuugagagugacagacccucagggcuaugaaggacucagcucagcaaacuacuugcugaguggcccucaggcaaguugcuuuccaggucagccuuccagacaacaggauuugaccuuagagcuguuucaagaacuagcaaauagcuuaaaauagcuucuaacaucaaacucacggagagugaccaauauacuggcagauggguaaccacucuaaaucuguucuauccuauccagcaauccccuaugucuucuuaauagacuuguuacaacucccugcaaggagcuuggcuaaaucacugacucauuuagccucaagcuccacgugcucacagguucacaaggaaggagguaagaaaucauaacaauccagaaaggaaaacugaaguagucuacaaacacaaggaacgcauacaggguaagcauccggacagcggaccccgggagucugucugucuguacaaugcccuuugcccuccauucagggccaaucagugcagccugggagccaaggcugcaccacagggugcugaggaccugaagaaaucuggguguaucagcgcuucccagagagugggcauguuagucagugcuccccagagaggaggccaugccaguggccaaggcaaacucccccuagagaaaagaaggacaaaggagggcagggaggagaaaaaacacuuagauggcuuuugguuuuggccuuacucuuaauucuguuuacuuuucuuucccggguuuaaggaaagcucuggaagcaaugcaaaguucugucagaugagcacagagaaccuagggggauaaaauucguuucucugcuacuuugccccuucauugugucuuguuuuuuucccuagagcaacugauauaaaaaccagagggcaagcuguuuaggccuuuuaaagagagacuaacuuuacacacuauccacuguguacugagcccagcagaccccacuacagagcuccaauccccuccacacacagcuggccuccuuaaauugaguggaacacaaaaccaacaaggucacgaauguggggaaauuuuugggcaagggauggaagaaaagaauggagauggagugacaaguuuuccuucauauuuuuauaucugaaggagcuauguguuggcagagagccaaaccaggaagcaggaguggguauuuaggagcaauucugcaucuaaucaaaucuuguccuugcuauuuccugcgguaaaacacgcuuuauaaaaccuaugagacaaaauaaaacuaaaauaaucuuuacugggacaaagaagguuccgggcuaucgucuuaaaucgauccgucagugcucuccgaucugcccccuuaucuuccaaaggcagcccaacggacccugucugcuucugccccucuauugcacuuucuuagcaccagcccaaagucagagaaaaaugugaaccacuuucccgguuacccacagcuuuaauccucuggaagcagagaaguuugcucgcucgauagcaggcgggacccuccuggcgucgcuuaccuggccggggagggaucccagcggcguccucggcgcgacugaggguguaagugcgguacccgcggaguggcgcgaacuugcagacgcugcggccgcgcgccgugcaguugaacagguagcagcggggugcgggcauaggugcgggcacgcugggcccccggggcagcugcaccacugccaccgagcagcucggcucggagcagcaggccgucacgcacugccgccaaccccgcacgcucccgggugcgcgcaggaagcuggcucccgccgcgauggaauccugggugcggaugaugguaucgggcaccgcccgguagaccgccguaccgcccgcacccgggcaauccucccgcgggccgcccaguagcuccggcucuagcuccucgcgaggccgugcccgcuguagcugccggcgaaaguccugaagcagccuauccacuccggacgacggagcggcgggcuccccgggccggcugccgggcagccagaggcagagcagcagcagcccgcggagcgcgcggugccggaagccggggcccgguccuccuccccuuguggccauggcacgagcgcggccucagagcucggcggccccggggccuggcugcuucacggaggcggcgagugugccggcuucgagaggcaucgcgggccggacucggccggacucggcgccgcccuggcccugcuaccaggcugcgagcuuucggugcuucuaucuucgcuccggccgcggaagcgcaccgggacgacgagcggccucuacguggaucagcaccggcgugcggacagcggcugcgacggggcggagccug

SEQ ID NO: 5408 - RNA, 12609 nt, Mus musculus
ugauggacuaaucuacagacaagcuauugcuguucaucagcuggggaaucagagaggcaugccucuccugucucuucucuuucacagaugaggacaagccucccguuagcaaggcugggaaggaugugguuuuacaucugcccacagacgggguaguucuagauggucgagaaagcucggacgaccacgccauuguccuuuaugaguggacgcugcagcagggugacccaucgucaguggacaugaaggugacucuugcuguucuugcuaacaaaaacugauguuucugggaagugguuuucuguaauguccuucauugucagucccuaaaugcacauaaacaagcagagugugcuuaaaaugaacaaaucauaaaaucaauuauccuaaaaaugauuguucuguaaagucccuuuggcgcucaguauaaacugauugguugcuuggaugcuugccagagucuugcuccuuuagcucagaggagaaagcuuaggcuguguuucaguaauucugguuccuuuuuuaaaaagauuucuuuuuucuuaguauaagacuggguaguggccaaguaugauggcacaugccuguaauucuaguacucaguggguuuaggcaggaggaucacaaguucaaggccaaccuagacuaugucaccaauuccuggcuauccuggauuaaaauuuuucccagaaaguaugaaaggaaggaauguaaagagggaggcaauaauaauagaaugaauucuuuuuuuaugugaucuggaggcauuguacacagcagauaauccuacucauggacacugugcuaagaagggaggugggcacagcauaaggcuauccugauuccuccugcucucuugcccuccagcagacucccuuggccacagcuagauuugcggugggugaaaacaaaccauuagugaggggaugccuacauauaccagccaugagaggguuggagccauuuuagagaggaacacuuucagacuaagucucacacgcuucauccauuagaaaagugguucucaacaccucucauggggucgcucagaccauuagaaagcacagauauuuacauuacuauucauaacaguagcaaaauuucaguuuugaaguaucaacaaaauaauuuuaugguugggggucaccacaacauaaggaacuguguuaaaggguugcagcaccagggagacuugagaaccacacugccuuagaggaugagguagugaaaagccaguuugugccugaccggaaccacaacaaagcaacaaucagcuggucccacugcauugaucucagugugcugcuuuugcuuagcgaugaaauaacuuuaggauuggacauguucagaauggucccagccugucacucagaguccuuccuggagcucaccaccccagagucaucguucaacuuucccagaagcauuuauacaucauguccuaaaucggugccucucacccuuccuuauacugcaacccucuaacacaguuccucauguuguggugaccccuccaaccauaaaauuauuuuguugcuacuucauaacuauagucuugcuacuguuaugaaucauaauauaaauaucugauacacaagugucuuaguuaggguuuuacugcugugaacagacaccaugaccaaggcaacucuuauaaggacagcauuuaauuuggccuggcuuacagguucuuagauucaguccauuaucauuaaggugggaacaugacaacauccaagcaggcauggugcaggaguugcugagaguucugcaucaucuaaaggcugcuagcagaauacugucuuccagguagcuaggauaagggucuuaaaacccacgcccauagugacacaccuauuccaaggccacaccuccaaauagugccacuccccgggccaaauauauucaaaacacuacaacaggguagcugauaugucacccccaaaggggucaugacccacagguugagaaccucgguccuagcguacugcuaaucagcucuacuuaggcaaacagucuguacuuggcuguaugucacuagacuucccuuuacaaaaugcugaacucauccuuuuauucuguuaaaaaaacaaaaaaaaaaaaaacuuguacugauuuucagaccaucuaccuucuagcaucaucuagauuuucuuagauuuauauucuucauaaaaaucugaagccccuaauugaauuccucauguaugcugugguuccuucugacccauguuaacacgcucuuguguucugaacauuggucccagugccuguuaaugaagccaguugcaugaacugugucaguagcugugucacaggauagggucacgcugagucuccugcuaacaagguuucuaccaccggcuuccucuuucugcaggagugccgccaucacggccuccccuuccccgcgacuguauauaugacugacugccccugugcaggaccuccuuucugucugucugucuucuuuacauuucaaacuuuugguuuaauuuguacaucagaagucauuucuaccuuggagugucaucuaucauuuguuauuguuucuguuccaaaguuaaucauuaucuagggagaaaagaggagcugaaggcucuuuguggggaagggggcaguguccauguuugugggugcuccugggccucugugcucuacucucuucccuaaagcuguuuguauggcaggugccucagccaggaacccugaggcugucccgccugaaggaaggagcuuacaucuuccagcugacugugacugacuccgugggucagagaagcuccgauaacgucucugucacugugcuucccaggcccuacuccacgggaggugaggagaaagccaguccuuccuuccauugagucccccauggccagccaagcccagcuggucacggaaggauggugucagugggauuuacacccuggggucccguuucacgggcuccuccaucuuacuuucggugcuugaaguuuuugcugaaaaugaaauagcaaacacggcucuguguuuaggaccguuuggaucccgcugguuagaguguaaagaacguucucaggacauggcccaugagguagggguccuguacgcugaccuucugccuuugcucuuugaccuuguuaaggacagugccugucuuuccuaggagagggcuuaauguaaaguuagagggucuuucugauaugcguguuugaaguguuuaaccgaagucuacaguuuaaacaguccagccaauggaaucagaggguagaacggugguuaaaagcuagggucaguauguaggaaauacuuguaaauauuccaaauaaauagaaugagcuaaaagacgaaguuuaaauauucuuaccacaaaaaauuaguagauauggugauauagauuguuuacugacuugaucuaguuaguacuaaauacauauauacaaauauaguauauguauauauauguauguauauuauacgcacaucaacauauacccuugggugccauauaucuauauacuauuguccaucaauuaaaaauaaaauaugggguguagggaggaaaggcauaugauaggcuagaaaggagaugacuaaaucaauaguuuauauaauaaaccacuuaaaauauaagaaagaaaaacaugugguuaaugacuccaguuggacugaaauaggaaaaguaguaaagcccugcucagucugaggccagccuggucuacagagugaguuccaggacagccuggucuacagagugaauuccaggacagcccgggcuacacagagaaagccugucuaucaaaaaauaaaaaacagaaaaaaaaaguuucacagaagccaaguggugcugguauacucucuuaauuccagcacucaggaggcagaggcaggcgaaucucugaguuugaggccagccuggucuacagcgugaguuccaggacagccuggucuacagcgugaguuccaggacagcccgggcuacacagagaaacccugucucaacauaaaaagacaaauccaaaacaacaacaaaaaaggagucagcguggugcuauuccuaccugaucacuuacugguucaguuagagagcguacuaugaagucacauaugaaauaccauguauaaacaguggcaaacagguggggacauaagacaggaguuucugucuccuuuaacacacacacacacuauaaccugguucagguuuugaguauauugauuguucuaacaccuuuugaaugcaugugaggaaccuucucugcagauagcaggcuggagagagagcguuuaacaugagcuagcacagugguuucaaauagggacgaaccccaccugaugcugagcacauuuuuagggcaagaaaacaagacacuugaacuuuuaauuuuacucauuuucaaccuucugaaaauuuucaguguguuuaauaaggugugugaugucuuuuauucuguguguacguguguguucacucagugugcgugccugcacaugcacacgcaugugugaaggucagaggacagcuuacugagaauguugcucucuuuccagccuguggguuccuggaauugaccucauguuuucagucuuggugacaagcaccuuuacccacugagccauccugcaguccccuuggguccagugucucagaacaccagcacaugcaaauuauuuaugaguaaauuugagguguguguuuauuacgaugcuuaaaacguuuggagacugcuauuccagaaacagauuaaauauagaugcugaucugccucuaaaacuacauagaaguaaggagaacccugcagucuggggauuuccugucacaugaguaagauugcuuggugaucagcgccuuuguuuuugcuugcucccccugguggcugucgcugacccugcaggccuaaguuuucaaggaggccaaacugaccgcugucucagcagcuccugcguuauuuccuuccuuucuuuaauucuccuuuaggaucaagcacucuuccaaucaccuugcacccagacagggucacuuuccagucuucuaguugacagcuuuucaauaaaaucaguguuagauuccgucugugcacaucaacuaugcuuagcuuuugcuguuaguggaaugucuuauaaucugccagucauguuccugaaagagccauuuagucauuccuguuaccauaacauuguaggauuccagggggcuggagagauggcgcaaugguuaagagcacuggcugcuauuccagagggcagggguucaauuucccaguacccacauggcagcucacaacugucuguaacuccuggcccaagggauccuauacacucacacagauauacaugcagucaaaucaccaguguacauaaaauagaaguaaauaaauaaauaagaaacuguaggacuccuuaaggccggcuucuagcugggugccuuucaugacuaucacccgaguuaccugauuugguuuguauuauuacauuuauguauuuuugccagguauggugguacacaucuuuaacccuagugcucaggagguagaggcagguggaucgcugugaguuagaggccagccuagucuacagauuaaguuccagaacagagaaauccugucuugaaagaccaaauauauauguauguguguacauacacacacuauagacauauauauauauauauacacacaaacacacacacacacacacacacacauauucaguuuuaugugcauuggugcuuugccugcaugcaugcccauggcaggcguuggagccccuggaacuggagguacauacaguuguaagcugccauguagguucugggccucugggagagcagccaaugcucuuaaucccugagccaucucuccaaacccaucugauucuuuuuuuuuuuuuuuuuuuuuuuuagauuuauuuauuuauuauauguaaguacacuguagcugucuucagacacaccagaagagggagucagaucucauuacagaugguugugagccaccaugugguugcugggauuugaacucuggaccuuuggaagaacagucgggugcucuuacccacugagccaucucaccagccccccaucugauucuuauuuagcaaaguugucuuaaucaaaaguagagaaaacugccuuucaagaaaaugucuguagcucuuuugaauuauacugcaagacuagaagcuccugaaauucccaagagggaaaacuaccaucauuucacaaaaauauauuccucuacaacacuagcaaccugguugucuacgcauaggagucaacagcagaaagguaaucuaguuaaaaaaaagucuuagagaaaaggaauuugccagagguaguggugcccugcagacuuuuaaucccagcacucgggaggcagaggcaggcucugugaguuugaggucagccugguuuuacagagcuaguucugggauagccaaggcuacauaaagaaacccuauccuccccuccccccaccaaaaaaaaguaaacaagacuugagaacacagacuauauaacauggugcugcuccugaagcaggucauccaugguugggauagugucaagugacccaccugagaauggggcuccaugguagaugaacaagugaauggaugccaaauaagugggugucaaaggaaccagggcagcaaaggaccuucuggcagaaagcucuggggcagcccugagaguccagugagaggugacagagggacccucugaccuauugugccaauucugucacgucacuaucccugccacuuaacccugcuucguguccccuuucccagucacccugcaucccugugaccugagacuuguucacaaacaggaugcuccagugcuugcucgcgcuaccauuucuucugugacaguggcugcuguauugacauagcguuggcuugugauggcgugaggcagugucccgacgggucugaugaagacuucugucaaaacugugagucagugcauggucuuaucaggcagggaccuggaagggguaguagcguaggcaggucagugucuguaaaauaucacacacauaacaugcacuuuuuaaaaacugaagcggggcuggcaagaugacucagugaauacaggcauugcugaagccuaauggccuaaugaucugaguuuaagccccagggcccauguuggccucugaucuccaccauguaguguaauacacuuaaaaaauaaaaccuaaaguacauuaauaauugccuugauaacuguguuuguguguguguaugugagaaauacagucuuaccaugugacugaccucacacucacaauccucuagccuuagccuucugaguucugagauuauaggcaugggccuauaggcacacuuggcauugcuuuuauaauuucuaaggauuguuuaugacacauuggaguauggccaaguuagaccuauaaaucacuuuguauaaggccauguaccuaaagguaaccugagagagaagggcuguaauaagucacccagucaggucugguguaaggaacacaaggcggaggagcugaggacguagcuccgcagucaggugcuugccucgagugcaugagcuccaagguucagaccccacuauagccaaaguagagagacuggaaaaacaagacaaaaacccaagaguauaguguugaguaugcccucauccauguuaggaagccaccggaagagaaaagaacacauuacccaucuacaaacuaagcaguaguuuuagugggcucagccugucuuagcugagugaguuaguagucuuaaauguccaugauuuuaaaucaacuguagauacggugguuuuaguuaacauucagaagagaaauccaaagcugagaugauaguucuucagcauccguguuaaaaaaacaaaacaaaacaaaacaaaacaaaacaaaacaaaacugcaagagugucaucaugugauggugauccuagaucuggggaggcagaggcaagaagauugaggaagccuacuggucacccaggcuagccugccugaugaguuccaaguucuaggccaguaagagaaucugucucagacacagaguugguggcaccuaaggaacagcaggguugucuucuggcugccauauacaauggagagagagagagagagagagagagagagagagagagaaaggcccagcaaguaacugaguucuuccacaguggcucuugaccgcaaguuggugacacacacaguggcuacuucugcccagccaggagccaugggauuaaaugaaggugaaggagaccccaaguuggaaaaaucccagagagccacuacccacaaccaacccgcuacuguaucccacccagagacgaggauccacuccacccagaaggcgccagagagucagaucaauccuguccagccagguaaggacucgaguucuccaugacuagucucucauucguugauauuaacaugguucaaaguuauauuuuauacuugaagaccaucagggaaauaugcuccaaagaugaaaauugaaaugaagaauuuggccaaacaaagcaaaacaaaacaaaaacaacgcugcauuuguaguaaugaauuuauaauuaaguauggagcuguauauaaguggaagagccccugucucgcauccagaggccuugguuugacccccaccacugaagagaaaugaacuguugacuaauggaaaggaaugccugguaaaaagucccugagggauggugagaaucuaggaccggggagcaccaaaguucaaggaugcucacguuccaucugugagaguagcaauauagugcugagaaacagcucagugcauacaggcacuugcugcaaauccugacaaccugauuccacacucagggccucacuugguggaaggagagagcugaguccagcagguuauccucugaccuccacacauggcccuggcauaugugcaugcccccucccuacacacauacaauauaaacaacuguuaaaaaaaaaguuaauggcaggauauuugcaucaguccuacacacauccccaaguuacauauaacuccuuauauaauguaagugcuaaauaaauaguucuuauacuguauauuuuagggacuaaugacaagaaaaacaaucucuguauguguucaguuauaggcaccauuuuugugugugcgaugaggauuaaagucagggauuuaugcaugcaaaacauagugacccacugaaaugcacccucggccucagaaacaggugucuaaagauuacauagggcauguauaaauguuugguugcacagggagugugugcuggaaugccccgaggcccuggcauuugggaguacagagcuccaguguggccuguguuuguucagcaucucuuggcacaaugggcagagugucaucaaugugguugcagcugcagggacuguucucugugugguccaagucacucacuaacaaugcugucuucuuguauccagucuagcuggaggaaggaagucagguuuccaggccuacagaguggcauaaaggaguguuguguacccauugacauaggcucuuguuauuggcaacucaagaguuuguggguucuguagcagaucagccaaguccuucgaggacugggcugaaacaugaaaacaaacaaacauuuucugcacacaggugugguguuuuuccucuacuauauauccagugccucaggccauggcuuaucucuggguuaccugucauauaaaagggcuuuguuuuuagaauauuuauuuauuuguuuauuuauuuauuuauuuauuuauuuauuuauauaacacuaagaguccaacucugagccucauacauuguaaaauacucuaccagcuuuaaggauguuauuauuuacuuugagauucaaaucuuaccuuacuuguuacucuuuuuaauguauuuauuuauuauuauuuuuaugauagaagagaaaguuuauuauaaauauaugggaaggcaaagccagaggcagggacaucugggagaguacagaguggagaugaucagaccgagcuagcccaugaagggacaggggagucagguacagcagucaggaggccacaaauacaaaaggacacuuguuacucuucaaggcuuaccuugacuggacucagagguagagggcucgguggcgacagccuucaccucuuggcaaucuguggcguuuucccuuggagucuugguucccuucacuguacguuuagcacauccugcaguguccuccuugcuugacuuagagaauuguuucuuuagagcaaucagugccaagucaaggacaugugaaauaauguuaaaucuugggugcugugguccugggcuucuuacuuucuuuguuugagggcuuucagacagcauauugguguacaccaucuuccuuagagagauuaaaaaccuucagguucuccuagcucuuuuauacaccaaccacgaggcacagugauaucugucaguccaggaauauccucccccuccuuuuaacaauaagugaaaauguaaguuugagaacacacagauggcauccccaaugcauccuugaacagacuugcauuuccucuauccaguuauccuuggucuauaaugagacugccccuuacucaacagcaggcacacucugucaugggucaggacaccucacuccaugggaaaaccuugcuugucauucucaccgcugcuucagaagagauaaccccggugcuccucacccaguggcaguagcugcuucugugacuaugugccucucagagagagcaugaagcuugcauccaucacccauuucuaugaguuucugacagccagugguggagaaggagauacucaguuucaucuugaaaugacuggccuccuaaaguugccacaaaaaaagagccuaaagacuuguuuuuaaagguuucccucucuuacguucuugucuagacuucucaggguuuguguugugggggaacugcuuggaaucuguaugaucgaaaaccuaggaaaguaguuuguaucuaugaaaguaugaucuauaaggcagcuguaaaagcguguguccucccaagauggugucaggaauccaacagcauggcuagugugaggagguucauuuaucacaaacucuaauagcauaauguuagauugccuucuuauggauacacacacccuacugggacacaauagauaggauucauccccugagaagugaguucccaucagggggcagagcuguuaaggcaucagcagaauguaguguuguuauguccauccauccauccauccaucccuccauccaucaucaugucccccacccccaccuggccuuaaagauucauaagauccuccacugugccaccugucucuaguuuguagccagaagccuccucagaaccuccacuauugccugccugccugccugccuaucugucugucccuggcauuaauaacucuucuaagaaacuccuuaguccucaacaauccaucucaguguccucuugaacugcucaccccucaucuaaaccuaauacaaaggauacucaagggcuaguuccaugggauuuugagacccucuuuccuuguuuacaucuuuagaaaacgucauuuauaucaaccaguggacuucuuuauguaucuaccuuuugggcacaggaagagauggcgaucuuagaauacuacccuacaggaaaacaguccuugcagugacuaaggaugacggggggggggggguuccagggacuuaaaccaggcagagccuugugcaugcuaacacagcucugggacugcacugugucccccuccccaaguguguuauuaagcuuccuucaucaggagagaaaaaugauaaucauguuuuguuuaaaucacuuccaggccauuuggagagaaccucuucaaagcuuacugggaccucagucugaaaaugaacaaagggaacaagaaaaucgcuuagugguagcgcacaagccuagcuugcugugcaaaccccugaauuuaauauuuagaaugugucauguguaaaccuuuuuccaaaguuuuaccaugcuuaaauguguaagaaagacaaaccacaaagucagauucuugacgguuugacccagcaccugaaauggugcugaccaaguaucuucaccucacauagagugccccccaccccugcuccccaccccugcucccaccccugcuccccagagauccaucucccguugccuccagaaugcugggauuaaagggaugagcuuccuugcccaacuggccuguguugaauuauuuuuaaguaaacacccuuuaaguaccaucccuuucucaaaguccaucuucuaaaaaguaaacaagggacuggaaagauuaauuaguggucaacuagagaaccuaaguuugguuccuggcaccuacaucaggggauucacaacuggccucuguggguacccacacacaugucauacacagacaaacauauaucugaauuaaaaauaaauaaauaaagcuguaauucuauauuuaaugugugucauggagaaaccuuuuuccuacuuccugcaguuuuuaaugucccuuuaacauauaucuguuuaccuuccauagacagcaauuccucaggaaagaaccaagaagaaggaaauuaugaucucaaguccaagaguggccaagcaggaggggagcaccc

SEQ ID NO: 5409 - RNA, 11386 nt, Mus musculus
aggggcgggccugaggagcgcgcagugugcuuucugcugaaccuucuugcugguuucagcauggaggaaauuuaugcuaaguucgugucucagaaaauuagcaaaacccgcuggcggccagugccuuccgggagccugcagaccacagagaccuuugccacgggcucuugggacaaugagguaccggguuugggcgggccccggcugcucugcuccacgccccccgcgcuggcgcgcgaaagcgggcuugcuggucugguuuagcugcccgcuacuugagagcccugguggugugucugagccugggaucugguuuuaaacccucaccaagucuguagucauaccguccaaacuuggccauaucucugaucuuuucaacucuuaaccauaucguuugucugagaugcuauugaagcaaggucgcccgaaaggcaaucugaaucugacuuuccuagaguugauguuuucgucaccucaagcuaaaacugucugcuuugcaggaaaauugcguuucacuguggucuauuggagauuuuggaaacuuggauucugacggaggguuugaaggagaccaucaguuacugugcgauauuagacaucauggggaugucauggauuuacagguaaaucugauugucugccaaagcuaauuuaggaaauuugagacuauuuagagguaacaaggcaccuuauaguuugucuacccuuaccccugauuuacagcacuaaucucuaugaauuuaaauuugccaugccaucauauuaggcacuuagucucagaaguggggcugggaaauggaauucagguaaaucaguuugaaaaugaauugcccaaaccgggcauggugguacaagccucuaauuccaguucuugggaugcagaggcaggagggaucucaaagcuagucagggcuacauauacauagcaagaccuuaucuuaaauaacaauauuuguccaucuaugugccaaacgauguuugguaaguuuuauacagguauguuaauuuagacuacaugucugugagucagguuuaucauuucauguugggaugaagauaaucucagcacuuaugagagcuaggcaagaacucucugcuuugagugucuguauccccacccucaaguaagacucacugcuucgcugaucagauggauggacagggucuuuugaacauacaugguaaauaucgugugggauuauucuuaugucauucuuuaacaacuugguagaaauuagcguuuauauuagucccagcuacuuaggaaacugagacaacaggaggucaagaugaguuugggcaucagagacaaacccacacacacauaagcacaccccaauccaaaaaaaaaaaaucgugcugggcgggguggcgcaggccuuuaaucccagcacuugggaggcagaggcaggauuucugaguucaaggccagccuggucuacagagugaguuccaggacagccagggcuauacagugaaacccuuucucaaaaaaccaaaaaaaaaaaaaguaugggggcuggugagauggcucaguggguaagagcaccugacuguucuuccgaagguccagaguucaaaucccagcaaccacaugguggcucacaaccauccguaacaagaucugacucccucuucuggugugucugaagacagcuacaguguauuuacauauaauaaauaaauaaaucuuuaaaaaaaaaaaaaaaaaaaguauguauucagauguccuguauuuuacuugguaaaaagcugucuauacuuaggaaugaaauauuucuaaacuuuuauuauuguggcccaaaauaaaagaucuggaguaaaauuuuaagcuuacucuuuaucuuucaugaaaaauuuuguuauguacgaaaauuuuuacuuuucgauguuaacacauuuuauuugcuuuguguguguguggagggggggcuauuugcuucuuuaaauuuguacaggguuugcuauuagucaaguugaaccaguggacuuuuccccccuguuaauauguucaaguaaucuauaauaauaagcagaaaucuucuguuuaguuuuuugaccaggaaagaauuguagcugcuucgucaacaggcuguguaacaguuuuucuucaccauccaaauaaccagguaaagaacucugugggaaagaacacucgucuuuuuaacuguuccuggggaggcuuacagaagauuguguuaguaagcgcacagugcuuuauaguguuggaacaugaggagaggcagucacugggcgcacuccuggagcuccgacauuuccagagcugagagaaauguagcucacgacuagccugggcaacauguacaaccuuaccuuacggagaaaaagucaugagaggggaauaugcugucgaauuuuuuagagguugcugagaaucucagauguaguaagcaugcauuccuugcacugagcuucacccccagcccuauauuacugcaaucaugcuuacauuugcuucuguggaaauuagaccuccuuuaaaugaacuguuaauuagcucuacuggugguaauuuuccugcugcuuugugagcuccuccgauagucuuuuggagggaugaagggagaaagcaugcaagcaaucauguguucacacuuagcuucuaacucagauaccacaaagagcugaaagaagccacgccuucauuaagagagagggucuacuaccugaagaccuuucuguuggggcuggggagguggcucagcaauugaguguguacugcuccuagagagagagagagaccaugguucuauuccaagcccucaaaucagguggcucacaacagccuauagcucccacuuuaugaggaucuaaaucccacugaccuuggcaggcaccuguacauaaacuuaggcauacauaugugcacauaaauguuuuauuauuuuugucuuaaagacaggauaucacuauguagaucuggcuagucuggaacucccuauguagaccagccuggccuuaaacucagacauccaccugcauuugcuccccaaugucaccgugaccagcuuuaauuaguuuucuuaauggaaucauguaaaaaagauauagagguuaguuccuuacauaugaauuuaaucauaaaacuuuaaagaaugugucaacauucagcuauuuaguaacaaaaaucauuaguuugagauaaaugugcugagucuauucagaauauaaaaaaaauuaagggaaguaguuucuaaacaucaguaugcucaaauacaaaggaaaggggagacuuguucuuucuucuacaaggacaugaaauacaacugaaaaauacuauuauuagguaggcaugguggcucaccuauaaucccaaacacuuggaaguccuguuucaaaaaucaaaaauuccuggagagaagggcucuuuuguuagaacuuugcucugauuaacagugcucauuucugaugccuagacccuguccgucaaucagcaguggccugcagcucauuaccauacaggucccagcagucccuccuauagcagugcaccauguacaggaauugugugugacaacccagaaauuguuacaguuggagaggauggccgaauaaaucucuucagaguugaucacaaggaggcugucagaacuauaggugaggaguccuauuucuucuauucauuacauaguaauugaacuaaguaaacaugaucuuaaaagcuugaagggugugaaaaugacacuuggcaggauccuuguaaaagauaguguacggauagucugguauaaaugauugcuaauagaacagaaagauguaguagguggcaguguuugguuuuagcuaaaaggaauuaucacauaacuagggaacaaguggcaauuaguacauucuugauucuguaccauaaauaacacuaauauaugacacacagaaaacauggaauagcugggcgugguggugcacgccuuuaaucccagcacuugggaggcagaggaaggcggauuucugaguucgagaccagccuggucuacaaaugaguuccaggacaaccagggcuacacagagaaacccugucucgaaaaaaaaaagaaaaaagaaagacagacagacagacagacagacagacagacagggaauagcauggagaugguaaaccuagacagcaaaugacaaaguuuacugugagcuggccuuagauauuuguuacuggagagaugacaggugaagccggaaagggaaauugggauggauugcaaagguauugugaaugcauagcaacagaagcuagggaucuguaugugguaaacagauugcucuugaacgucuuugcacgaggaaugacugacaccagucgugauuuggccaguguucuagugagauggcucuuacuaugcuucacuaagacuugccugagaagauuccaggcccccccacccuagaccuguugggucagaaucuccaggucugcaccaaggcaucaguuuguguucuuuguucuaagugcuuaauuucugaguuacaacauucgcuuaauuguuaagagcuguuggccugcuagcaauguacagaaguggcacagguuuaaguuuggaaguaucuaucaugugccucgagucuaaacacuuaggaaauucaagaaaagaaucauuauaaaaggaagguauugggcauacuuguguaaucucagcagucuggaggaugaggcaggaggauacuaaauucaaggugagccugaacaacauagugaaguccuggcucaaagcuuccuagagacccuuuuagcaaccaugaaggggaaggauguaggugaggaagcugcugacgaagguaaagauggguggauuugacaugagucugucuugggggcuccugggggucccacuugggggugaauaauaaagacacaggcaucuguauagucuaagucugcuagccuuuuuugcuuugggacagucuccugagcuaaccauccaaacuggaccugacuccccugccaccgugguccucccucugucucccugcucugcccccucccuguuccagccuuaagcucuuuuuuuuuuuuuuuuaagauuuauuuauuauuauaucuaaguacacuguagcugucuucagacacaccagaagagggcgucagauuucauuauggaugguugugagccaccaugugguugcugggauuugaacucaggaccuuuggaagagcagucugugcucuuaagcacugagcccucaagcucuuuuuauuguuacacaaaaggcaucauuagcaaguuaauuuccgcauaccaaaauuucuuauuugaucuagggguugucuugaaagacccauccccuaagcaguucuuagcuaaaggagacuuccuaguuucuuccugguuugccuggccuaucucaggacuaaacuuugcaaaccccauaaaaguuuagaugacaaccacugacaaaaggcuacuucaaagcuuaggucccuucacugcagauucaugccagauacaaaagcucggcuagaauuuugcugugugagucugaacaacaguauagaaucagaguaagcuuugugccugucaguggguaaaguuuucugccaaguacuagcagagcuaagauuggauagacaggagcuugaacaucuaucucagacacagugccuguuggggugagacauaacuauaguuccaucacuagggaagcugaaggcaggaggaaaagaaaaguaaaaaggaagaauucaguauaaaaaacaaacggccaaucagcucugcacuuagaaaacagauggccugggagugaagcuuucuaccagagacuggaagagaguauuuagacauguauuuuacuauuucuuuauuaaaaacuaugcugagucauuagucauuuauuuauaauauuucaaccaguagggggacgugguuuacuuuuguuuuguuuugugagacaggguuucucuguguaccccuagguguccuggaacucacucuguagaccaggauagucucaugcucacagagaccugccuaccucugccuccugagcacagcgauugaaggcaagugcugccacaccuggcuggaaaugucauuaaaaggaaccuguuaacgcauuuuuaaaacuugcagauaaugcagacagcaguacacuccaugccguaaccuuccuucgaacuccugagauuguuacaguaaauucaauuggacaguuaaaaauaugggauuucagacaacaaggaagugaacccugucagauacuaucacuguaaguuuugucaucucaguauuaugauaaaaaacuuguuuaauuaguuauuguagucaacuguauuuuuauuuguaugaguguuuugccugcuuguauaucuaugcaccacaagaauguagugcccccagaggucagaagagggcauugaagccuuaggacuagauuuacaggcaaauagaauugccauguggguacuaggauugaaccuggguccuaacugcugagccaugucucuccagucccccagcuuugcguuuuaaugaauuucagaaacacugauccaugauuaaacugaugaagccaagguaacacaauggaguugauucuaccaucuuacauuagcauguacuuguauugauucagagccuuuaugucuuugaaguauauauuguuuaaaagagaacuuguuucuuuuuaucaaaugauuauaugauagaggguuauaaauacacuguagaugugauugcagauaaaauaaaauucagggucauuauucuuuuuuucuuuuuuuuuuuuuuuuuuuuuuuuuuuugguuuaucgagacaggguuucucuguguagcccuggcuguccuggaacucacuuuguagaccaggcuggccucaaacucagaaauccgccugccucugccucccaagugcugggauuaaaggugugugccaccaccgcccggcagggucauuuuuccagagcuuuuuagauguguaaucuuugcuccuuucuuaagaaacuagaauguacuaucagacuagaaaaaauuuauaugaacuaauuaauauaggcauaaagaauggcugcuguaauugauauuuaguuuuacuuuuaaauuguaguuagacuauguauuggcguggcuuagcuaugugcaugugauugcagguacccacaggccagguuuguaggauacuccuggaacugggcugacauacgacugggagccacugaugugggggcaugaacuuggguccucuggaacaguaucugcccagaacuacugagccagcucucuugcuggacacauacuuuuuaauagaaaucuuucuuacacaucuuaccauuauguuauuuugccuccuagccuuuaauucuaaacuuuuauuacucauauauauauauauauauauauuuaccauuuaguugaaauuuuuuguuuucacuaagauuuagugucuccagccacauaacuauuuaccauuuaguuaguggaaugaaauguuucuuauuaggcaaagauaaauuguuuuuuaccauaucuuuugauauuguucugucuuccuuaaggacuggugaccgagugccacuccacuguguugacagacauccagaccagcagcauguuguagcuaccgguggccaggauggaauguugaguauuugggaugucagacaagguaccaugccugugucauuacugaaggcucaugaggcugaaaguaaguauuguggggacacaaagcuugcauugaaugaguuucucaugagcaugaagugauucauagggaccauuucacaucagcgcuuuuaguaucuggcccguauaagccagauaaucucuuccucuguuuacgcccuuuaauguucguucaucauaucuacaacugcagucaguauuacuacaugcuccucuuacugagcugauggccuuagguuuuuuguuuuguguuuucuuuuuucucaaaacuagaaccuauggaccaaaccgucauacuucauguugucagguuacugacuguucuguauaaaauuaucacuuaauauuuccuaauuuaugaauucauuaauuuugugcaguuuugagauaggaucucacuuuguaguccagguaagccuggauuuuacuguauaccaaacuagacuugacuauaccacaguccuccugccuuagcuuccuaugugcugagauuacaggcaugagccaccacucuuugauaaaauauauucccauucccuauuacuggggaaugagccaggaccuuaaggguguacucugucccugagcuauaucacaagguccaacugaucuuuuuguuugauauuccuuuuuagaaagacucuuuccuaggggaucugacacccucuucuggcuuuuacucaaauagaaauacaagaaagcaaacaucaaaacaguacugcaacaugaccugguuuaugagauguucauccagaaaggugugaucccagcagcuaggucacagaggcaggaggacuaagaguucaaggccaaccugugucacagcugcugggaucacacuaaaagauaaaagcugagaaucuuauuccugugcagaugagcugggguaccuauaaacuuuaagucuauugaaaaucaaaggcuucaaaagagagcccuaucuggaaaaacaaaaaacaacaaaacaagaaaauguaaagagaugcagacuauaaguaaccuuuuggugacuauaacaugaagauagguaagggccacuacuuguggguaggccauaaaauaaccucuguggauuacuaaaauugauuuccuucugucuuuuagugugggagguucacuuccacccguccaacccagaucaccuguucacuuguucugaagauggaucucucuggcauugggaugccuccacagaugcaccugaaaagucuucucucuuucaccaagguaaagguucuugugugcugcuuuaggauauuuuaaauguugagucagaaucuugcuauguagaccagguuuggccucaaacucaaagagauuuaccugccucugccuaggaauguuuugccugcauguauguggguguaccacaucuguacagugaccacagacaccaucucuagcuugaacauucucaggaguuaagaacacugaccauaauaagacaggaaauaauuggaauaagacaggaaauaauugggcagaauacacaaaauuauuguguagaagaguaagcagaccagauggauaaagaaaaagggcaagauaggccuagagagaguguagucucagcaguugagagcugcaggcaggaucaucaauguaaggccauucuaagcuauauauagaguuuaaggccagccagggcuacaugagaccguuuccaaaaaacaaaacaagagagggggaggaggggcuggagaguugguucaacaguuaagaagagcacuggcugcuccucuaaaggacccuguuucaauucacacuaucaacaugauaggucacaaccaucuguaauuccaguuuuaggggauccaaugccuuccuccagucuccaggcaccaggcacacacaugaaauagacauacaugcaggcaaaacacccauacauacaaaauaaaacaaccaagggcgaaugcaaaaggaaagacucauuuaauuuuuaauuauguuuuuugcauguuuauauucgucaauguguauauaaguguaguuggcagcugaggccacaucagauccccugaagcuggaguuacaggugguuguaagccaucugucugucuuggguacugggaacugaacccagguccuuuguaagaauagcauguguucuuaacagcuaagccaucucuugggcccuggaaguucauucgcaugaacuaggaacuuauauuuuguuuguuuguugagacagguucucuuuauggaguccuggcuguccuggaacucacuagguagcccaggcugacauuguacucaaagguccucuaccucccaagugaggaacuuguaucucuguguacauuuuggguucuucuuuccuuacauuugguuguuuaugguaccucucuuuccauuaaacuuuccauuaaaacaauaagcaaagaugcagaacaccuacauuccugcuuuuccccaagacuacagaugugguaccuacccauacucucccuucaaauguugagugcuuacuggcacugaauaagggugacuuucaguagguaaaagcacugcuaccaaacuugacaacggaguuugauuggcaggacucaaguggaggaggagaaaacugauuccuacaggacaccuucugaccuccacaugugugcuguggcuguguguauugugcaugcacacacaauaaauagguguaauaaaaaauguaagggcuggugagauggcucaguggguaagagcacccgacugcucuuccgaagguccggaguucaaaucucagcaacugcaugguggcucacaaccauccguaaugagauuugacuccaucuucuagagugucuaaagacagcuacaguguacuuacauuaaauaaauaaauaaauaaucuuuuaaaaauauauaagauggucugauaaaaacugaaugugguagugcaugccuuuaacccagcacuugggaggcagaggcauuucaaagaacaaaacaaaaaaagaugacaugauaauagaauucuuuucauuaucugugcuuauucacgccccucccacuucagccugcuuuaacaguaaauuaaguugauuuugaaauaucaauagcagcuuuauauuuagugguacagagucagccuugugguuugaaugagaauaugaaugagcccauacgcuaauauuugaaugauugguccccaguugguagaacuguuuggaaggguuaggagguguggccuugugggaagggguggggcucacagguuuccaaagccaaugccauucuccagugucucugucuccagucuggaucaggacauaaacucugagcugcugcuccagggccugacugcugucaugcucccucauggacucuaagcacaacaagcccugagccccaguaaacauuucccauuauaaacugccuuggacauggugucucauaagacagucuuaacauuucuuuccuucucuuuucuucucacaggaggaagaaguaguacuuuccugucacauagcuuaaguaaccaggccgguguucaccagucucuaguaaguuccuggcucagcacagacccugccaaagaccgaauugaaaucacaagcuugcuucccagcaggacucugucuguaaacaguuuggauguuuuaggucccugucuuguuuguggaacugaugcagaagccauuuauguuaccagacaacuauuuucaugaaagugaaaaaaccuaguuaucaaaauuuuaucaccagaaaguggcauuuguaaggaaacaauaaacuguuuguuaaugucagugcccaau

SEQ ID NO: 5410 - RNA, 26174 nt, Mus musculus
ucauccuuccugccuagcaagccuaggccguaacucagcagugcagugcuuucugggccuguggcucuguagugcagugcauuccuggcauucauggguucaauucccugcuauugguagaaaaggcaaaauuagagcaaguacuuucuugggccaugcuuuuacaauggguuaccaccaaaacucugacccagucucgcucuggccuagugaugucuagcgaugucuuccaucaugucauuaaguccugggacuacagaugugcugcucuacucuggcuuucaaaacuccuacaaugacauaagaaauaccacauggaauaaauacaucguguaccagauaacacuguugaaaugggcaauucugagugacagagaagaaacaggaugaaacaugcuuguaccuguacugugcucagacccggaggacugaggccauagccuuuauuccuugauguuaacuucuuugaaagagcugagccucagcuucagccaugugaaugauaggaccuauauaccacaccacguacaggugcuccucagauaaauaaacuuuaacccaaacagccacacuuuuaucuggaacuguaauucuuuggugagguuucuauggcccauuugcuccugcaggguguguauacaccugcuguagcccuuuucaguuccuaaagacacagagaccuaguguuuuaauuaagccgaagcugggcagguccugagucccauuacuugccuucuggccuugcccugauucacucugguccacuugucucccuccucaugugugcucucucguccugaccucauguugaauccuccuggucucuccacaccuuuucccaguucucuacucucuucccacuuuggucucucugggacacccccugcccccggaaucauuagucccacccuauucucuucugcccaccuaacuggcugaucaguuuuuuuguuaaccaaucaggggugaugggcagcaauuuuuacauaagagaccagagauaguugaucaugccaucguguuugaaccuuggaccacaaccagaugucugaaugcacagugccccaaaccauccuccaacuucuauccuguucagugggggcuggagcgauagcucaguguuugaauucuuccugcucuuacacaccacuugagugugguucucaguacccaaggcagacagcuccagcugcaggagagccagugccuucuuaggccucaacaagcauuuuuacucaugugcacaaacucucuccuccaagcaaaaauuaaaaauaaagcaauucuuuuuuaaaaaaguuuauuuuacagugagaccaugucacuauuauaaauccuggugcauucaagguaagggguuuugguacagauacaaaucaugauacacuucagugauuuuuauacugugucauguaugugauauaaaggcacauuguacugaguaaaaaaaaaaauaaauguuaaguucuccagcuuuuaaauuagaauuucauaaagugcuucuuauaaaaucuuacaauaguaaucaaauagauacaguuucugcagcaaaggcaccugggaggucuuggcacuuggcuuugucuugcuucccuuucagucugguuauuucucagucaucuuuccauuuaaacuuuccuuagugauucaucuucugaacagccagccugugcacggagccucacacugaaagggccaacuguaaaggucuugggaauuuggcaauuucuuuguuuaaguugaaugauuuaaauaaaaugguauucaaauggcaagucugggggcaauagaguccaugauuggagauggugcuuuaaauaucuguuuuaucuguaaguuuuugugcuguuuucucagagccgucuggguauaagaugauagguaccgagaucccauucauuuuauccaccugaagaauuccucugaaaugcaagauaagucauuacugccagcaucacacaucucccgacuaggcugcuauauaacaaugcuccuucaggcuacuguucuccuuccugcucaugaguaaacacacugaaugacuagaagggagcagaccacugccugguccuacaugaaggaaacauaagucuucaaggcaagagcugguguugcccuggacugguguaggucgguggaagcaaagcucaggcagcuuuccagacucuguccacagacacagcccugaccacacaauggguuucaucuugaacccaagauccuauguuacccuuuccagauuucucccauuaaaacagcaccugaggucaguuucaaaccaagccagcugacuguauauguggucggcuaugugcugcgcuguuacucuguauggcguaacagcagcaguuuucaaguugcauccugcucugagaguccacuuuauuauucaaugcagcaacuugcuucaucuugggugccaaacgcugacacaguggcucucccucuugcucugacaacacaguccccaucagcuguugaacacaggccaugguacaaaggcugaggacugaauuaaguaaguuuacuaccuucuaaccuagcaaaugggcuuaaaacauaguagagaaagcaagccagugguuaccaagcacccagauccacggaugaugcaggccccuccccugcgucauguauaagccagcugugguggcucacaccuagaaucucaacacgcaacucaggaggcacaggcuagagggucauucaugaauccagagccagcccaucuaaaaacacccaaacugaacaagagagcaagcagguaccuaagacuggauggcagcaccacaaacuaagcagucuucaggccgucaggauuaacagguaacgaugcuccuaacccuguuccugcccgaccagaccuaauggaaccgccauucucaggccccuugagucuagggccagcacugauauugccagcgcagccagugucugaacacuuaauggacuguacugaaaucuaacagugggcagugacuauacaggcucucugccucuugcccuuagaauucuguggccacuuuaacucuuucuuagccauucagcaaugaacuucaugaccuaugaugugaaagcugagagucagaguaauuaagaguggaauggaaucaacaagccuguuugccaauggcuacaaguaucaaaugaaaucaagaacacucagggucuagccaggcuugcuggcuuacaccuauaauaccagcacuucagaggaggaggaggagaaucagaaguccaagccauccucagcuacauggacaaguucagaggcagucuggccacaugagacccugucccugucuuccccguggugcugaggggaaggccgcacuggucuucuggcaucaacuaaacugauacucuggaguugagacuaguuggugugggucucacuggcuccaaucacacaggacuuccuagguuuucuguucauucucugcucuuaggagauccagcaaaucucuguucaugguugcaucucugaaaguacagugaucucaaguaguacauaaauauauuuuaauuccacuaaaauuagaaaaugggcuagaaaaaguuauuuuuuuucucucacugucugacccuagcacuauauuuuguacuauacaauacuuucuaccauagcauauaguaaagccaccuccuuuuuaauaguuaagaucaaugauggcucgaaacucugauacuuacuuguucucacacacugggaagagcagcuuuaacacugcuaugacuccugcugcucccagaacuccaaccaccaugacguccagaaacaugaagagcacagggaccacacugcuccagaaccuacagagcgcuuuucucagcuucuccauccacuggcacauuaccuacgaaguggcuuuugauuagaaaggccuguuccacgaacuaaaacuuaaauuucuguuuucuuuuuagauggggggcgggggggggggcucucuguggagcugcgugcugccuugccacugggaaauggcuagcaugcucaaggggcuugggggugagcggaacacagucuguugugcuacccccuacaacaguccgaaaugaggguccuuggucuguguuuucuugggugagaaacacagggucuaggacaacugcugugguucccagucuccuguguacccaggcacugcuggguacagcugagaguugggaaugggggccccgugggugugcgcuucccuucuggacauuuacuuggagggaaggggaaagcugagccucugauggggacggaaaccaguuugguucccagugagugcugagagucagaaggggccaagagagagaccuucuccaggagacuuaggcauggcucuuuaugagaaaggcccauggugaucccugaagaagggggugguucuugcuugucuaaauuguuuuguuugauggcgaaugugaaaacacacaccuuacucaggguaaaccagggauugaauaccuuuugugcgaaggaaugcccaggaagggaagcucauuggcugaagacuggggaccuaucaagacaccucauuagcauggagaaguccagguuuuuaugcuacaugacugacugcuauggaccucuuaguggggugucaugguuacauguugcagaucagguaguuugguagggaguuggcuuuacuccugccguucucaauucugagaguucccuggggucugagccugcucaaccuuaccaguucuucuaucugguggcacacuccacuugccccccaucagacugggcucauauagagucaccugccucaucucccaagugcuggggcuaaaggcauacaucacuaugccuggccucuugugaaauguuucuguggguuauuuuacuaagaugccuagccaaauuucuuaauguuuuggcuuuggguugacagaaacaaccugugucuugauuauaacagugguuauaugugugucaaaaguaacucaagaaaagaaagaaggagagaaggagagaggaagagaaagaaggagggagggagggagggacagagagagagagagagagagagagagagaaggaagaagaaaaagcaugguuuggacuaagguaaauagcucagaaaugagugcuuugcccucauucuacagugauggguggggcauauguaacaugauaacaaaacuguauuuuaaaaugcaccuaaauaaacuuuuacaauuuuaaaauguaucuucccgaaacacaggcaggcaggugugcgugcgcgcgcgcgcacauacacacacauauaucaagggaauguuaaugcugacuaguaaacaggccuguccacuguuacagguaaaggacaaggaagggaagaaacaagccccacagcuuuuagaauggggugauccacugguaaauacaugcaugggcacuggugggcuggacuaggaagauaguccguuugagguugaccuauugcgggaugucauggugcacacugccccacuagccuagaauccagcaaccccaaucaagaguuuugaccuucaguggggacuacugcauagaccuuacccauucaggggcagacauacuaggacacucccugaacuauagcuguaaaugucacgugugauauaaauguucuugguagguauugauguagcgucacauggaacagccaucauuccuaaugacaccuugaugaaauauuuuacaguacaugguagaguaagcacagguuaaccuaagagagaaguuaaagagguuaagaauugagccaaggauacauaacuaguaaauggcagaucacauuuuaauccuaaacagcaugacuccaaauguaucauuuuagcagcacucaaucacugugugggaacuugagggcacacugcaccugugcauacacaaggugaaggcuaaaugauuaaacaagcgggaaaugagagaaugaacuuuggaacuggagauucccaacuaaugaaguccauggcugugcuaaucauaaccugacacuaucauuagguaaagcuuccagagggagacaggaacaccaugaauaccacaauaggauuaagauaauagccgggcggugguggcgcacaccuuaaucccagcacuugggaggcagaggcaagcggauuucugaguuugaggccagccuggucuacaaagugaguuccaggacagccagggcuacacagagaaacccugucucaaaaaaacaaaacaacaaaaaaaagauacuagccagugagauagcucagugagaaacuugugcucaagccucaugaccugaguguggcuccugggauaaacagguaaaggagggagcaaaguccugacaguugucccugugacaugcacagcacacacaugccuaugugcauacacacagaauaaauaaauguuucaaaaacaaaccccaagugagccaagcauggugacucccaucgacaguaccaacacucaggagauaaagacaggagguuuugcuaggaguucagccuaggcuacagucuuuaauaacaaccucaaaaccaaacacauccaucauuaaacgugauuagcuguuuggucuuuauguuuucuacuucauucuaaaggacacauuuaucuucgcuauaaccauaacugccucugacagcacugcgaaaagauaccaccaaguguuugacuuaccuuguaugaagauggaggcucugcucuaagaggagucucaggcaacuugccagguaaagcauuuccauccacagugguuuccacauuccccaugagguaguggcugguggucugcagugagcuaacaguuccuacugaagagggagaagaaaguuaaccaaacugcgguggcagcuggccucugcuacaagcccuuccagagcacagcaguaauaucugugauuagggcacuaacaugcauuucgcugugacagaauaagaauuuuauuuacugaguuaguaccaggaagaaagaacucagaccacuauaaggggcuacaaaaguuacuguuuugucacacagaaaagcuacauuuucaguucugccaggcaugguggcucacuccuauaacccuagacucgggaaacaggagcacaaagucaagaaguucagcucucagcagccaugcuggaacuccagcucuagggucugauucuguucuggcuucuugggguauccacguauccauauacacauacacacacacacacguauccauauacacauacacacacacacacguauccauauacacauacacacacacacauuuuuaaguauauaaagcaaacuaauuuuauuaacauuuuaaauaauuuuuuuuaaauaccuuuuuuggaaaagucaggaagcgugaauaaaaugucacugucuugagaaauagaauaaagcaugcuuucuuccaaaggaaggaaauagcuugaauaucugaguacucucugguucuuaacuaaaaugucaauuucaguaacauucuuuuguugagccuauaaaagaaaacauaaguacuauuuacuuuaaauaaugcccuagaguuuaaaagugcacuuuccuccuuuacuucauaacuaagaaauucauccuucuccuccuucccaguccugcugugcccuacugugugcccuacugugugcccuacuguguccuauuguguccugcuguguccugcuguguccuacugugugccuugcugugugcccuacuguguccuacugugcccuacuguguccugcugugcccugcuguguccugcuguguccugcuguguccuacuauguccugcuguguccugcugugcccugcugugcccugcugugcccugcugugcccuacuguguccugcugugcccugcuguguccugcugugcccugcugugcccuacugugucccgcugugccccgcugugcccugcugugcccugcugugcccugcuguguccugcuguguccugcugugcccugcugugucauacugugcccuacugugcccuacugugcccuacugugugguauuuacagcuucagcugcagcuucacuucauucacacagcgcugaagagauggcaacagaacuaccaacaccaccaagugccuucucuuucugucugcagaugcuuggcacauuucagaagacaaaaaggaguacgaaugucagauuugcuacgugaugagacaguucuaggguauugugaugguuugaaagagaaugguccccacaggcuguuugaauuauugguccccaguuagugggacuauuuggaaaggauuaggaggcauggccuugucacugggggugagcucagaggcauagucucucucugcuuguagaucaagauguagcucuuagcuccuucucugggcuccauaucugccugcuuacugccaugugucccaccaugaugauaaaggacuagcccucugaaacaauaagccaaucaaagaaauguuuucuucgauaaguuguacuggucuuggugucccuucacagcaacaggaaaguaagacagguaccuuccugcuaaucguuccagaaacaaaagcaccaacauuuacacacacaacagaaauugaaugucuaguuagcaagcacagugucuuacuugucucccgucaaucuccacaaccucuccuuggaugacaaucagcugggagcuggcacuguacgucacaggccucucgagaacuaagauccucacagugacaauuccaaaauaguguuucuccuccaauuuuuccagauuuucacucuucacuauuaaacaaacaaaaaacaaaaguagugagauuuuguacaaaaauugccauuauagcaguuaugguauuugaugauuucuaugacauggacuuggaacacgaccgcagcaaacguguuuuacuggcuuccucuguccuugaccuuaccagucucagauuuauaaaagcagagaugagcuggcaaguccuuccaguggcaucuagccacuggauaaagaaacgcuugcuggucugcagucggaaugugccacguugcaguggcugcuccucugcuaggguuucaguguuugccagugaggagcaacacagugcacguggacagcaagcuccgcuccagggagccagucucacacucacaaagccagcagucagaggagggcacacaugcaagccuuuacuuuuuacuucuuuccuucacucucugcaccuaguaaguggcuuuuuauagcuggacagaucaggaauggggaaagggagagaggucuaguccucuguaauggugaugggaaaagaucugaacauauuucauuguauacauguauggaauucucaaagauaaagaaaacauuuuaaacgagaaagcagccaggaauagagguacacaccucuaaucccagcacuugggcagcugaggcagcauguggccagccagggcugcauaauaagacuuucuccaaacagcaaauuaagagacuagagagaugguccauccauuaugagagcuuacuagccuaucagaggaccugaguucagaacccagcauacacagcagacaucuuacaaauagcuguaauaggaucaaaugcucccuucuaaccucugugggcaccugcacagacaaaccuuuaaaacacuuguaaagagguacacacugaucaauuugcuacaacaugaacauuuaguuguugucucccaaauaugaggacuacuugucaaaaagaauacaaauacacguuccuaaaugcacaccucggggcuuaagcucauugugagccguuaaagggcuguuccuuugaucuagaacacuggauaccaauucauuagcuacuuaguauugucagucaccucacucagcuuuuccucaggcucuagccauagcaugcucacaguaauuuggggcauguggccaugaugugauugugauuagugcccucugggcuccagcgcugucagcccugaguucucaggcuccucagcauccccucuuuuauugucuguguggcuguguugcgcuuacugugcugcugaggauggagcccggcaguucacuugucaggcaaauaucuaccacggagcucugucuucagcaccucucugagcuggggcaggaggcgggcaucuucccucacuaaguuauccagacccagugauucuccuaccuaggccaagccaggagcugggacuauggaaacacaaaucugcaugucacuggcuuaauaaaucaaguguuuuuguccuauuuacuuacuagugucccucccagccuggucagcaugucuaagcccacagccuggggcacaagagaaauacaacaaagaggugcucucauaccccugccacagaauaaauucacaacagcaaaauccaccgauguugacuuccuccucacugcagucaucagcuuugaaagaauuuucucagugaugcuugcuuccaggcaugaacgaauaacccugcuuaacuccccaccucagugccagacaggcccagucaugacuucucaggaggcacagagcaggagucacaucucccauguccuuuauguuacucaaauaaaauuauacagcccaacauaacacuauucgauucuuuaaauaaccaaaacccuugagguuuaaagagaaaagcaggggcuuuuuaaaagagcaccugcugcucucgcagaggaccugggaucaguccucagaacccacacaguggcucacaacugccaaccacucccguuccagaggauccaacauccucucuggccuucuuggguaccaaguacacauauggcacagcuaugcaugcagaccaaacaccauacacauaaaaagaaaugagucuaaaaagaagagcauuuuguugacagaugaguaagaacaauaaaggaggagccgcacauacaauuaguaucuaucuucuacaaccaggaugaaugagaacuaggguucuccagcuggcuagcccacaccuaugcuaaucuaccacuucuaugcuaguuacacuucuaaccuaccaguaacuaaaggccagucccaagaaggaauaaguacacagcaucucaauaaucaacgaguuuuaaugccuuagcuacuacuauagaaacaauguaucacuuuaaggucccacuucacaucagaacuaauuuaauauuauuaaagacacaguaauguuggaaacaauucaauaguacucaccuaucaaagucugacagcuuauucggguuacaccacuauuuacagguaagucauuuacauauaccuguccacgcucauagguuauguuaagaacaaccuugaaauaaagcagcauauacauuaauuucaaugguuuauaaaugaccacaaacucuucauaucaaaaauacaucaucuaacuauguguguagcagguguuauaguuuggcucugccccucaaagacccauguguuggaagcuuggucucucuccaaguggugauguuugggggaagggagcccucuaagauacaaagcuuagugguagaugucuaaucccuaggacaaugucuucaaaggcacugugggaucccagucucucuuaucugguaucuggcaaaauaaauuuguccuccuguuagcuccuaucacucugguaccauuugccauaagaccaaagacaaccaacaccagcacuauguccuugagccuccauaacuaagcuaaaagcaaaacaucaaaagcccuuuugguuuuauuuagggcuuuuguuuuguuugauuugguuuuuuuaauaaguuauauauuuuuauuuuauuuguauagaugcuuugccugcaugcgugucugugcaccguguguguagugccuaagaggaaaacagggugcugcuucccuggaagugaagauacauguugaaggcuaggcugaucuaaggcuuucccugaggcccugauguauagcaaaaacauucuucuaaacugucucuaacccuugagccugcuuggcagagucaguauggccuggagccaggaccuugggacagcuacagauucugaucuuugagaacccaacacuucccacccuaaggggcuacguugugugucccaaccccauccucugacacccuugagauauccaguacccuccccccuuguguagaacugcuugaaucacuuccugcugacuuauucccacaguauagcagacuuuuacugacucaguaccauuuuucccauaaaacuacacacuagacacuguauaucuaucguaagcuugcuugacauaagacauagcuuaugcaagcccccugaucccuacuuuucuaucuucuuuaucuucucauccccucagcagccugucacuggagaaugaccugcuggucuaggucagcuauagaugguuauaaacugccauuuggggacguugggaauccaaccuggaucuucuacaagagcagucacugcucuuaaccacugagccauccuucccguccuugguuuuggguuucuuaagacagucucgcuacuuaagaagcacaggcugacuuuaauuugagguaagcccuuucugccucagccuccaaagugcugggauuacaggaaugaagugcuacgccuagccucauauagccuggcauagauuucauguauuuauauguaguagccugccuugggcauugcaauguaauaacagaaaauggacuaauacaaucaguaaaacuuucuggcuaaauauuauaguaaaaauauaaucaaaagaagacaaaccuguucuucagacucuuccccacucuugcucaggguaguuacauugauuuggaugccauucuacaaaacaaagguauagguuggacagauacucacuuuacauauugaaaauaaacugacugugcgggcaaguucaaauauuucuuggauucagaagagaugaugaagaaucuccaaaauucuaaaagagaggaaauaaguccauaucucuauaacuuuacaaucacccaguauuuauuugguuuccgggugcuuguccgcacaguugcuauuuuacccagaagaaauugcggcucaacuacaauuucauauacaagugugcuugagaguugcaagguuguugcuacugcuuugugauuucuguauucaaaagaagaguucuagcauaauucuaaaacauuauaagcagaauaaagagcuggagauggcucaagaguuauaaaagcacuuguugcaaaacaggaccaugggaaacacugaauccacaagguuauccugugaccuccauugguguaaguucccgauccaacaccacauauacacaacaaguaaaguuuuaaacauaaaaagugacauuuaucaugacagucacuucugucuuuaguguguuccuaccacauaaguuucuugucauuuggggaaaacucgaauuuuauaaucucuaaacuuucuccuacuauacugaagaaggccaauguggcaacaagaguaaaucaugggcuggcauuuugcaauggcaggguucucacaguaagccaggaaucugaaagacuugugaccuuagagcgguugaaucucguuccccugggauguugaagaaacucaucuccgacccaucacgcaggaaaggacugcuccucccacccaccccacccccacgaccacacacacacacacacacacacacacacacacacacacacaaacacacauccaauaaaaagcccauccgggaagcgauagaccuucagccucccucagucgcuagcccgaguggccccgagaccaagaaaggcacucccuccuggucgcggccgagcagacacagguggccuggaaaauugcuaauugggcaacacaaacaucuucagggcccaggaccgggcgcuaacccaggaaggagccauuacaaacgaccgaagucacuagcgaucacgcauuuucgacagcaaaaccuggcaggauccgaaccgauucgagaggcgcuaggaaacucaaguucgauggccgcagucuugaccacacuuucaaggacgccugcacgccuuccuugcguucccuuucgggggacccaccccacccggcauccgggaaagcccccccuuucucucccggcggccagacccgguccagccccgcacucucggcuguccaccugcgggagggggcagcgucaccccgcccgggcucccggagguccaggcagaggagcggcuuguugcggacgcccagcccuaccugcggggcuguggacggcggccugggcgcguugguggucagccaucccgcggcuggcagcgcuaugaacagcaacaaccggacggacagcggcgccgacaggccgcccuccaucuuggacaacaccggcccggcgcggcgggaggugagggcguggcgguccggggcggggcggggccuaggggaggggaggggcuggggggcgggaccgaccccucccaaauggggcgggucgaccgagcugcuggggcugcgcaggccuuugacgucuaugggcggagccaacuuugugagcguccuccgggaguuugagaugagaaagggguuuucuccaaacaagugcaauucuuuacgaagccuuuacuuuuggagugugauuuuguuuucucuuucgaaacaggaucucgaaacaguagccuaggcuagcuuugaacuacuuacugauccugcuggaauuacagaagugugccacccucucaccucaaccuugaugguacuuuuucauuaguaucaauaugucgauauacuuacaaaaaaaugaaacaacuagugucuuauaaaaugucaggaaugauaaauaaaaauuuagcacuuggagagguacccgcuuuuucacuggcucucacuaugcagcuccagaacccucuaucuacaccaagcugacauucaacuugugacaauucuccugccucugccuccugaguguugagauuacaggcaaacaccaccauuccuacugacucauaaauugccaccucuggcuacaggugagacuuuuguuuguuuguuuuguuuuuguuuuucgagacaggguuucucuguauagcccuggcuguccuggaacucacuuuguagagcaggcuggccucgaacucagaaauccaccugccucugccucccacgugcugggauuaaaggcgugcgccaccacugcccggccaggugagacuuuaaaaaguuuaugaaguacugggccuccguacagccccaaguaucugauucgauuagauugcacuagagcugggaaagugauaauuugucaugggucagggcugaggaccuggcccuuaccuuaaaugucccacuguacuuuuggcgucgagagaaaaugccaccaaaugaagcccgguucacaugucuccacauucugcuccauuacuuuccuaaccuaugaaaugaagguguagaccuuucuuuaaccuguuaauuuuuaaaauuuuauguaaaugaguuguaaaccaccaugugggugcugagaaucaaaccccaguccuuuguaagagcaauaaggggccuuaaccgcugagccgccuuuccaaacccuuuuucuaacccuuuagcuuguauuuauuguggagcaaggugucauguggacgugagaggacaacauccgggggccaguucuccgcuucugccauguggcuuacggggauccaacucaggucgugaggccagcuggaaaacaauucuguccuaaucgcacugaacuucagggaggggcuggagcauauuggcuggggaagaguaggagaccggaccccagccaggagguuacugagaagcccucagccguggugauuucccaccauugcccugggguccccacacuucuguuacuaaccccucacaugaguaagcccaauaaacccaaggacuuccugggcgaaugcuggugggauuauauuuugguuugucauagaccuuagaaguagggguagaugcucacagcucccccggggaaggaguuuucuuaauacaggauugcauaccgauugacacguaguuguauguauggccuguuagguagaauaagaaauuuauuuagggggcuggucagauggcucagugguuaagagcaccaacugcucuuccaaagguccugaguucaaaucccaacaaccacaugguggcucacaaccaucuguacaguuacagugugcucauauacauaaaauaaaucuuuuuuuuuaaagaaauguauuuaguuuuucuuugaaauaaaaccuuugccauagaaaggauuuuuuuuuucagcuuuugaagccauuuucuccuacuaccucugccauaugccuuacuucuaggguacaguaaacugcuagguagcucucagauauuaguaggucauuaaggauggauccccccuccuucauaaucagcagaugguaaauccaggaaaugaaauugcugaacugugacuacuaaaugcaugagcucugcuggagacacuguagcagucuagaauauuacuguuuagcuggggguuuucugguaaagcacagccacaucacuguccccauccuuagcaaugaauccaccucucccuugguacagugcuucagagcccuggguucauucccagcauugacugugggcccaucaagaugguucggcugauaaaggcucuugcugccaagccugaaaaccugacuuuagcccuuggaagcccacaugauggaaggagagaaccaacucuuugcaaguuauccucugauguccacauacccacugugguacaaguguguacacaccucacacacacacauguaaauaaauaaaagcaaaacccaaaaccugggugugauaaggaauauaauucccaucagcucaaggucauuguugguuacaugaaaccuugucucaaaaaagaaaagaaaaaaaaaaaacuugaguuaaccaaaaugggccuaucaauuaccuguacaggaaaaccaucccucaggaaagcuaucucuggucuuuauccacccucacccuuugagaguguuuccuuugcagugguucuuuguccacuugucaaccuugagagugccccacuuuaccuugcaauaucuguacacgacauuugugugucuuggaauucuuuuugacagagguaacaugggcaaagaggagacuaggaugagauucgccauaacaaaccuaagaaggacucguuaaauguucacaguguuucucuguguagcccuggcuguucuagaauucacucuacagaccagguuggcuuugaacucacagacauccacaugccucugucucccaagugcuggaaucaaagguguguaccaccacagcccagaaaauguucacuuuuuagcuaaguucucaaccacuaugagguacuguacaucaguacuaacuuauugguggauucuauaaugaaggccuacuuacuucucuggucaucuaaaacuacuggcuauuacacucugugauaaacuucuggaauuaaaaaugagucuagagaacuagagagauggcucagcaguuaagagugcuuguugcucuucuaacaacugauuggaauucaguuccgagggcccaauguagguggcucacaaccaccuguaguuuuaguuccaaagguuguaaggccuucugacuaacacaugcaaacacacacacacacacacacacacacacacacacacacacacacacaaauaaauaaauaaauaaauaaauaaaaaaaauaauccaaguucagaaaaagacaggcauggaguguggaauauauagaauauaugcaaaaggucccaaaguacaugugugugacaaggugguagggagaaaaggccgcuuguuuagcaagagagcucuuccuaguaucagacaguccauucuuuauuucacugucucugcucguggcaugagcuccgggaaggagcagccaaacuuuaaagcauggagccagcucaaauagauucuccuuggcacuuauucuuuggacaaaggaaaaaaaaaagcuaaguaguuaacgcugaugaagaccaacuuuaucaucuguauggcacugcuuucuuugggucccauuuuauuacaugcacacaugaaucccauaauuugaaaaaauaaaauuacacaacuaugaugagcuaacaaucccccaacugugacuauaccucguuaaaagguucuguucacuuucuauucagaagaaaaugguuucauccaccugacuuugacguucauaugcaaaaucaagaauuaacuuggcaguugcuuaugaauaauaaacccaucaguauuagugcaguacauacuuugaucuuauuuugagucagcucaugucaacuggauuuauuugagcacaaagcucauccaaggguuccauuuaccuacuacccagccaguuugacuaugugcacauugaugcauucugauauuugaggcagaaaauaguuugaaacaucuaauagcuuagaaagugaaguauguaagacacagaauagaccucuaauugaucauuaauaaucuuugaacccaaauauggauacaucugccuccugggcauuuucuuaauuccugauugauagggaaggucgagccaauuguaggaggggccgucucugggcugguggcccuggguuuuuuuuuaaauaagaaaccaggcugagcaugcacacaugagagaaagcacagcaggaagcagcaccucuccaaggccucugcaucagcuccugccuccaagguucccacccuggcuuaacuaccuucaguaaugaacuauagauggaaggcauaagccaaauaaacccuuuccucuccagcuugcuuugucauggugcuuugucauggcaaccaaaucuuaccucauuuuccuacauuuuuguuguucuugugucuaugguguguguguguguguguguguguguguguguguguguguguguguguguguguguguaaaacagcccuggcuguucugaaacucccucuguagaccaggcuggcccuaaacucauagagauccacuugccucugcuuacugacugcuaaaauuaaaggcugcaccaccaugcucagcuuuccaagaaauuuaaaaacugcuuuuacuggaacuguguuguccauguguuuaaaaauaaaaauuugguuuuuuuuuuuguuaguuuguucuguuuguuuguugagauggggucucacuauguagcuuuagcuggccuggaacuccauguagaccaggcuggucuagcucugccucucaaguacuaagauuaaagguguguacaaccaugccuggcuagaaauaaauuuuauuagauccagugaugacaugccacauuuguauaaauaguuaacaauagaaauacuaguguaaggucagcaagacggcucagcuggcaaaggugccugcccuacaagccugaugacccgaguuugcuaccuggaauccauguaaagguggaagaaaccaacugaccuacacacaugugccauggcacacacugaccuacauucucaaaauaauaagguuuaaaaagaaugucuuugucagucaacaagcauuacgucauuuuguuuaaauucuuucuguauuuaaacaccacaacauucuaauacaugguuacaauuccugauuauaugugacuguuuuuaauaacuggaguuucaggccaaaaagcauggagucuugcaacaccuuccugacucuccccaaugcuagguucggccaccagucuucaauguacagauuaaagagacaauuuugaaaagcagagagaggguauuuauucaguguggccacacugggaagaagaacaaacaagagacuaaugaccuccauguuaaucuucaugguacuggcaugagcuuuggacuuaaaaagaggaagaaucgggacacaggggaaaggaugcauaaacacuacuggccacacuguggucucgccacucucucagguuugguucugcaaaaggcccaaagaaauccuuauugcugucaucccaucccaugaggguauauuauucugguuccuacaaaugaucauuucugcuccauuguguggccucauccagaggaugaccuauccugcaggguccugcugcuuuagaauccaagcugauucaagagagaugagucuaggccaugacaaguuaacagugaccaaugucugguauuuucaguuauuacaaaggcauuucuugaaugcuuagaccuauccucuauugcugcuuuuuaaucaugaccuggauauagcucagcaguuaguaggaacugcugcucaaucuuaagguggacuuuggaucacaacacucacaccaggcaguucacauagauaccuguaacuccagcucuaaggcauccaacauugucuucuggauauggauaugugugugugugucugucccaucacagacacacacacacauauaguuuuuagagaugguagucacauagugagccucccucaaaacuacaacaaaaauaaaauagcaaucacaguacaauuaggaacacaugaacacaaagcuacacaauguuagcaccauuaacaauucuaguuugcaggagaccagcuuuaucaagcauuuuucuaaguuuugcauuuuagaagacuuauauacaaaaagaaacauaaauauacuacauacaaaagaacccacaauuuucaccccagcuacacuggugcuuuuuaaaagugcuuuuauuaguaucuacuaacuaugcacaaguuucauuaucaaccuuucauauguauacacaauguauuucaaucauauucaccugcccauuacccucucgcucccuucccaccaauagccuaccucuucccaacucuugccuuuucaucugugucucagauggauuuuauuaggguuguuaaauggacaugggugaguuucuuuccaagggcauggacccauuaccauugaaggaaaugucucuuucucccaucaaucauuaacuacauauaaauccucaaggagagguggagcccugugaacccuuccuuuuuaugacagaguguuuaugggcccagacuugugcaaauaaucacagcugcugugagcucagcaaugccucagccacgucaugccugaaagacagcauuccacacugcccccucaccccuuccuccagcucuuacaucccuucugcauccuacuucuccgguguuccugagccuuggagauggcucucuuaagcuuauuuuuguuguaucccauagguuuuggcauguucuauucucauuuucauucaacacuaggaauuuaaaauuuuuuauccuuaguuuuuuuuuuagcauucauguucaauaguguuaauaucuacuuuguguacuuuguuuaguuucuguugcuuucuagcuuuuauuccauuauggucaaauagauuacaaaagguuaucucaaauuuucuguacuuguugagacuugacuuuuguccuaauauaugauuuaucuauuuuaaagauaguucuacaggcuccugagaaguguauucuguaguguggauggauguuccaaucuguuaagccuauuugauuuaugaugucaucuaacuccaguguuuuuagcuuuuucauacauauaaccugucuauuggugauaacguaggacuaagucugacucuaucuagcaguguuugcuuuaugaaguuugguucacguguucagugcauuuguuuagaauuguaaugucuaaaacauguucccauaaucaguacgaagugacuuccuuugucucuucugauuugaagauuauuuugucagauauagaauagcaaagucuacuuucucccaguuccauuugcuuugaauaccuuuccuccauccuucugcucuaagacaaauucugucuuugaugaaggugugguuuuuggaagcagcaaaugggagaugugcugagauuaaagguguggaccacuaucaccuggcuuuuguuuuuaaacacaaaucugcaagccuuucucuuucugaugggcaaacugagaccacagauauucagaaaagggguguauuaaucccugcuacuuuguugucuuuuugaacugcuguuuccuuaauccucauugguuuaucuacuguuguaacaucuuuuacuuuucucuccuguauccucuucauguguauaucauuacccacagguucaagaguuccucucccaguauccucuguagggccagcuggcuuugugcucauaaauuccauuagccuguuuuuguuuuguuuguucgaucauggaauguuucugucucuugaucaauuauaagauaguuuucugggguauaguagucuggguuggcagccacagucucccagaacuugaaauacauucuguaccuuugggaguuuuuaauguuucuguugauaacuaagcuauuauucuacaaagcuuccuuuuauacaugucucaguaguuuucucuccugcagcucugauacgcuuccuuuguuuuguauauuugguguuuuaaccauaauaugaugagaacuucuuuccugauccuauuucuugaguguggguaugucucuuuccuuacauuugggacacuuuuugcuauaauuauuuccagacuuucucuuuauuaaaucccauuucacauauugagucucuuuccucacuuagcuguauauuuauucucuugcaguucauuucgauuaugcaugcccaugcugucuuugaacacauauaccaucacucugugaauucuuugaauuucuucuaaacuagucccacugagugucaacacccugggacugguauuuuugagagaagccauacugccuuuuucauuuuacuuguguuuuuuucagacuugugggucucugguaaaugucauggcuggcagagagacagucuguaugcagcaagaaggaaagccagcucaacaugacuuacuuaguugguguugguucauacuucuauagucucauaccaagcaguuuguuuuagauauauuuaaauauguuacaauuugagaaaaaaauguuuucugauaacaguugucucaauucugagcuuacgguguaauuucauugaaauucuuuugcaaaguacaugugaccucuaccaugaagauggguucuauagcuugaguaccuaggaucuggcuuggucucaguccuacagauguuuagagggcacuaagcuauaagguacaugugacaucucuucuaaggaggguucuguugccugagaaagauaaaggucuagcgaaggagaauaugggauaaauauaauagugugguguggcccuauaaacagcacagaucaccaugcuauuaacaacauccacuuccagccuucuagguggaaaacagguauacacauucuaaguguugcaguucagaaaggaaagucauucucuguagaaguacuucaggucugcccagaaagguauucuggcaauuaggagccaaggaauaccauaaagucacacugcauaacaaaccucacacacgacauuuauuggcagggaaaaccccgggggugggggguggagguuguugcugcuuggguggcugcugcagcagcuaauugugcagaagguagggcuuauauagaauuucuuaggggcggagcuuuccaggguaaggauuagugggauuucaagucuugaccuuggaugggcuuagggauuggugggcuguuuuuccauguagggugggguuugguuacucucccaccuuggggcugggaaugaaugcuaaagcuggcaguaaacaugguugacucucaucuggauucccuugcauuccuuuccuaaguccuagaauccuguuuacagcuugagcaucccucagcaaugggaaucuuccuuaggaugaucacauuaccagugguauccuaguuagcaggcaguguuucacagauggauugccaggucuugucacaccucugccaauuccuucaggacacugguugcaaauguugguccugccucuguguaguuguucccacugucuuguauucugcaaagagucuguauguaaguuccuauguauacuuuaguuccuaccagguuuucaguucacugaaggcuaugcagaucugauucaaauguuugcuuuugaggcagggccuaugcauccuugguuugcuuuuacucgcuacacagugacuaugaucuucaacgauuaucccgcuucuacaacuugagugcucggauuacagacauguaguuuauacaguacaagaaacauuauccuggguuguauccaugcuaggcaggcauuguauaaucugauguacaucuccagucacuuccugacaaaguccuuaguguacuaucucugagaaacuuuaauuuuuucuuuuuuuuauguguauggguguuucaccuacaugugugccugugcacuacaagcaugcaguacccuuagaggcuagaggaggaugugugaucccuugggaguggaguuacagaugguuguaagcagccauggccaugcuaggugcugaacuggguccuuuggaagagcagccagugcuacuauccacaaaugcuucucuccacaauccccccaaaucuguaaaaacugugugagcaugcauggauauggugugcauguggcggucagaggguagcauuuggcgcugguucugugguaacauguggguuccugguccacacuuaggcuguaggccuugagguggaagugguuuuagucacugagccauuuucucagccugaguucaaaugcagucuucuucucacaacaugaucacuccuguccgaccuccuuggcuuggcugguauauuugcccucauugaaggguaucucuccugaaaagcucugcuguuccaagagucuacuaugauuuuagaaaacguuaaggacauuaacaucucaguacugucaaucaaaguaaagaacauggacacaggcuuucauuuuucuuuuaaauaccuauggaguugaaauuuuuauuuuguuguuuauuuauuuauuuauuuauuuaucaaaaccagaucuaaacucugguaccagaguuugaaacaagggacugacacaugcaaggcaaaugcuguacugcuauugaauuucuuugaggacaaaucuuguuuucuuccaauucaaaccagaaaggcuuagucauccauccaaacuauaccaaugcaagagauaaauaauagugagaggcagagaagagagauguauucacaauggcuucauugcuuaccaaugaagccauucauugauugaacaaaucaguccagugacuuaucaacuccugcacagcuauaucaucuccauguguucuagcccauauccaaugauuuucuaaacuagaagacgguaacaggugcaggguuuuugauuacacccuucuaaaugggaccagacuauaaauaaauucauguuucuuuaccaucuucuguuuccuaaauuccuuggaauauacggaauaacacaugcguggugaacacuucuagccaugaaauugcuucaaauacuauuuuucuuaaaaaaaaaaauguuuacuuuuaaaaaguccuuucuccucaucuuccuggauaugccuaugaucugucauaucucugauuuucacaaguacacauuaaaaugacauaaaagggaauaaucugcuugauuagaaaagaguauaccgggcuggagagauggcuaacugguuaagagcacugacugcucuucugaagguccugaguucaaaccccagcaaccacaugguggcucacaaccguccguaaugagaucugacucccucuucuggagugucugaagacagcuacaguaugcuuacauauaauaaauaaauaaaucuuaaaaaauauuuuaaaaaaguaaagaguguacuaaaacauggaaauauguuaucagcauaaaaaaaccgguaguuuuuauuacauaucuccaauguaagacugaagccuuuguauucuaauuuguugcacaaaaccucugugcuguuaagccauguccaguccugaucuacacacacuaguaugaucaaaaucuacaacaacaagaaaaaccccaaaccaaagcuuguuagucaccuuuucuuacagcuuucaccgagcaacugaugccucgggcuuggcgauuuugauggagagacuauggaaaccccagggcaaccucuuccaaaggcaaggggaggaugugccgccggcuuggagguuucucagcucucggaugccuccgcuauuccuacggaauggcccucuugagauacaggucuuuauaugggucaccaagggcggaagagaguccucaaacagccuccacagccagaagacagcgggcaccagauaacagcugccgggccgaacgagccggccauuaggccgcgggaaaucgcgccuccgaggugggcgacggcgccc

SEQ ID NO: 5411 - RNA, 1212 nt, Mus musculus
agcugcauagugagagccagugaaaaagcggguaccucuccaagugcuaaauuuuuauuuaucauuccugacauuuuauaagacacuaguuguuucauuuuuuuguaaguauaucgacauauugauacuaaugaaaaaguaccaucaagguugaggugagaggguggcacacuucuguaauuccagcaggaucaguaaguaguucaaagcuagccuaggcuacuguuucgagauccuguuucgaaagagaaaacaaaaucacacuccaaaaguaaaggcuucguaaagaauugcacuuguuuggagaaaaccccuuucucaucucaaacucccggaggacgcucacaaaguuggcuccgcccauagacgucaaaggccugcgcagccccagcagcucggucgacccgccccauuugggaggggucggucccgccccccagccccuccccuccccuaggccccgccccgccccggaccgccacgcccucaccucccgccgcgccgggccgguguuguccaagauggagggcggccugucggcgccgcuguccguccgguuguugcuguucauagcgcugccagccgcgggauggcugaccaccaacgcgcccaggccgccguccacagccccgcagguagggcugggcguccgcaacaagccgcuccucugccuggaccuccgggagcccgggcggggugacgcugcccccucccgcagguggacagccgagagugcggggcuggaccgggucuggccgccgggagagaaagggggggcuuucccggaugccggguggggugggucccccgaaagggaacgcaaggaaggcgugcaggcguccuugaaaguguggucaagacugcggccaucgaacuugaguuuccuagcgccucucgaaucgguucggauccugccagguuuugcugucgaaaaugcgugaucgcuagugacuucggucguuuguaauggcuccuuccuggguuagcgcccgguccugggcccugaagauguuuguguugcccaauuagcaauuuuccaggccaccugugucugcucggccgcgaccaggagggagugccuuucuuggucucggggccacucgggcuagcgacugagggaggcugaaggucuaucgcuucccggaugggcuuuuuauuggauguguguuugugugugugugugugugugugugugugugugugugugugugg

SEQ ID NO: 5412 - RNA, 50586 nt, Mus musculus
auccacauuagaauauaaguuuuuuuaauuuuuauaaauaacuuaucuguuacaaagauaguuuacccagcuaaaucacaaaaccaucaacucaagauauccaaauuacguuuuauuaauaaaacaaguaaaaacugauuuaucaaucuucacauagaacugcagaggaagcugaaaaacaaggccuacuuuuaaaacacaaugcaucaaauguacgaguuuuggggucuguugccuagugaccuaugguugccguaucucuuuccauacucacagugcaaagcccggaaggccaggcucugaccuucuuaacgcucauucauaauaauccuguuuauuuaaaacauagccacuugugaacauuuacagugggacaaucuacauuauuuccuauuuuuuucuuauauuucagcacuucccuuagccccauuccaagcacugauaauuucauaauucuuuuaaaaugcauaugguuauuuuuucuugauuucauuuaguuauauacauuccugaucauaugaauauuuauuuuccuuacaaaaauauaucaucaaaauaaagagaugucugagguugcuucaguguucaagucugcuuguuuucuuucuuuuuuccagcuuuucuucaguuguccuaaagaugacuaugcuuuauaaauacacaugacugugccaacaguccgacagccacacuucuucccgggaagaagaggcugcgggaacggcugcugaggcugcuucuuaaaacugcauuuucccaacaagagccucccauggaguucuaugggauaccacacagauggggcaagauggcaguggguuuaaauacuuucugcuuuaagcugcuggagaagacaaaacgacauguuuggucacccacugcucaagucaguguacagcgugaccucgaccguccgauggcugcaguguuucuugcagugacucacaugcagcaccugcaugucuucucagagcauuggcaccaagggacaaaggacaggaggaggaaggggagagggaguuauguugugcacaguuucauuucauuaaugcuuucuaccuuauggcauugcuuuucucagguaaggcuuaaaaggagcaugaucgugcuuacuaaaagggaaaaggacacuaguuaacacaagucuauuacacuauacauauagaaauauaagaagauaauggagaaaucaaagcagacgugagacaucuguacaguaggagaggcuuggggagcgcacuguggauguacagacagacacagcuuuccuuuuaucucacaccuaaaugcuggcuucacagagauguccucagaagacagaggacagggccaaaaguaccccagauuuguggcguuucccacaucuacuggcacuauguggcagcagaguucucagucaaaccuuguuccuucucuuuguguauguaguguuucaccaaaagcucuaacaacacaaaaagcaaucauccugucucucccuuccucccgucaggaucaguggugacaagaggggaggaguccugggaacaccuaggcacugacacgugacacuggacauggucaggcagcaggcagcccggucucucaggccuuucaggugaugaaucucacugcccaugacauuagauugagguaucauuagcucugugggcugacacucaacacagcacaccacugucucgucacaccuucaacuggacuaacuccuguggcggugaaacacuuucccgaugacaggcgaccuucuugaacuuuagaugugguuucagaggaaggcggggccuuuggcucagaaaugccgaggcaucucacacuguucacagcggauuaaggccgggugauucagaaacguacaggcagugcaauuccacugagcaccuuccucauccucugcgucuugggucuuuggugcuuugaugguggaccuuugaucuguaaggaagaaaagaaaaaacaauuuuaaguuaaaaaaaaaaaaucagaaaaucuaccaaauggugaccagauaaaacaacugcugaacugaccaugcuuccccuagcgggaagagcaccgugacucgacacaaacacuuccacggccuaagggagaacacagccucauaguuccaaguacaagggaaggaagggugaacacuccuucccauccccacugacugucaugucagacugaaggauccugcugacugucaccaacccuccugccuucaucuccugugugcuaugacacuugaaacaacuacuuucuaacauuuauaguuuacacuuauggcaguaacaugcugaaaaaguaagacagagucaaaaaaucaucccauuuucuuguuguauuuuuaaaccucagacauggcauaagagagcccugaaucugguuuagaauagcagggagccuucugcaguguucaguccuuugguauacagcucguugcaguguucaguccuuugguauacagcucgcugcaguguucaguccuuugguauacagcucgcugcaguguucaguccuuugguauacagcucccugcaguggucaguccuacagcuccuuagaugccauaugcaagucaccacccucagcaaugccaaauguuuccaucuacccagugucagcuucuauuuaaauuuauaaucuaguuaauuuguuuuacauuuaugcauuuuguauauguaaaugcaugaguaugcauguaucagcaaugcauguaucauagcaaguauguagaggccaguggccaccuuggggaaguuguuucuuucuuucuuccaugugcagccagccuggggagugaauuuaggucaucagcaccaagagcccuuagcacucaaccuucguguggcuccauuugagucacuguuuggauacagaggggccagccccauuuuucugcauguggcgacuccacuuuacuaacuggucccgugagaggaggugagcacugacgcaccuugcuugucccucuucugucccacugcugugugucagagagcaugcuuaggccaguccugcacucuucugaucacuguaacucugucauccgcucugaaguaggagugugcuaucuccagcuccauccucacucaagguggcucugccuauuuagaguccugucugaaguuuauaauauuuuucucauuuuuauacugacauuggaauuugguagaaugugcagauugggcugaagagauggcuucgcaguuaagcacacuggcagcuuuucuauaggacugagguucaauucccagcccccacaugacagcucacauguuacaggugaccuaacacccucacacagauacagguagacaaaacaacacacacuaaaacaaaacaaacuguagaucuuagauauuguagguaauaacaguauaauuuuuguaauccaugaacaugaauguuucugauaauuuccuucuucaguguuuauaauucugguauaaaauucuucugccucuuugguggaguuuacuccuauuuuaacguuuugauuguuacugugaaugaaacauuuuucugguaucuaugaauuucuuuugcauaacuguaaaaaaauaacugauuuuugugggaugauuuuguauacugcaacguuaaugaauucacuaaguaguuuuuaacaguaaaugcuugaaacuaugacuaauacugaaucugauaaauacuacauuuuucuuaaaacacaaauaccuauaaagcuuaauuuauaaauuagguauauugaaagaacaguaacucauaguaaaauagauuauuaacacuauauuaaugaaagcuaucuaaaauuuuacuucucuuagggcuaaaagcaaauuaugcaucauaauuaguagugacaauagugaccuaaauagacaugccuauauauuuaacuucagccagucagauuuuugcacauaauuucauucguauacauauccuaaugcuuggcucaaauacacaggcuuauuucaugucuuagcuugguacacacauauucugucacuuucaaugguggaaaauguuucuagaugauaauacauuuuugaaauuuaccuggaauucaggauauauacaaaacaauguucucaaaaaacugaauuucucuaaagugccugccuuaucacaguuuacaaauuuaaagacacaaucguugcacuuaguuuuaaacccaaacuuucuauuuugggaguccacaguggguacuaaggucucaaacauacucuuaaaaaguuacauacgucacaccuuugcaugcucuccaccccagaguguaaauaaacaaacacacaccucccugaggagucagcccaugccagaaugcccaagcuggaaacacuucccaaguggaagguugagaacauaaaaaauaaacauuuucuaggauuucgcuuuccaaacagucucacauuuaauggaugcacuaaccuuuggguuuugguggcacagggccuacaaauccaauauugucauaaaaguuaugaauagcgcugggguuaaaaugugguccugaaauauacaaaaggaacuauaucaucaauauuuauagcucagaaauacuuaauuuuacuuuuuaaagcaacaaauucuaaaaauaagcaaaagaaaugcuugagaugauacccgcuuaauuucaaauuacauauaagacuucaaaaacauaucuuagaacauagauauaagauaguacucauaaacacaggccagugaucgcagggaagaagugacgucaacacuugucagaaagaauuagcagcagaucccuguuuuacguaacaagguaaaaugacggcauuuuaacaucaauuuaagaaagguccaucauuguucauuuuaauggaugcuggauuaaacacagaaaugggacucaagacuuuucguuaaguuucuuuuuucucuuuacauuuuguauauuucuauccucccuccccgccccacacuucagaauuagguuucagugauaaaguuucauuuauguuuucuauggaacugagugaaaucuaaguacuuuuuacuacaauaagaaauuaaugcugguaacuaacugcuugaaaaguaucaaguccuaucacuguccauagacuauaacauacuuuuauaucacuuuucuauuuuaucaaccaagacagugccagcgauaugaggacacacaauucuugaaagaagaaagggaaugggagaaagccauauggacacauccuuacgaauacaacccuuugacaugcagcuagaaagacaaccacugucuucccuuaccacaggcuacagcagaaggcuacaggagagcuaaaggcuggauguauuugguuucuugaccagguacauauuuacugagggcaaagaagccaacuguucuuuagcacuuucuggcuccaaagcuaaauacuccgagacagugacugguaagccacaagaaaacacuuggcagaucaauucaaugaauuucagcugagaaugcauugaacuuuaccucgggcuugaaaaagaucaauuucuuugguuaagcagucaaugucaaucuggaguugucuauuacaacuucucaacugcugcauuucuucgagcugaaaaauaauuccauauaaaaagguuuguauugaauucucacgucaucagugaacaaagaauggaguuggcagggggagguaaggacagaaaaacaaguaugaacuaagagcaucugcagaaaacuagagcaagccuuuacacuguggcaggcagccugcucuccugaucaagcacaggccacggcggaugcauaacacuuacugacgguaucugggaaauggaauuugaucucuucaggcgccuucgaguuagauuauuuuccaucucauugaccucagauuugaguuuauccagcuuuuucuuuugcaucucgagcucucuuugaagccguuccauccuggccuucuggugcaccagcagagcugcaacaggagcacaugcgugaggccccgcccacuccagcagcgaacucugcagcagacaagcauuucugggacagccugccaagaaccccagagcuacauuacaacaaaauacugggaugcacuuacauuuucaaaaaucuugaccuggaaacuuuucauuacuuaagcaaauacugcccaccuaaaaauuuuucacgguuugaaugaaaccuacacuacuauggcugaagacaguagucuguuacuuuuuaaaagauccuagcuuacuaaacuaaccgaauuugcucuuuuaguaguucacaucugacucguggaaaggacaaacucuuuccuccagugugacaccacggucuauguucgagauauucuaacaugaucauuuuacagacauuuuauacgggaauauggaaugggguaaauaauuuugauuauaacaaauaagaaugacuucaaaccacaugaauaucaacaaacuguccaaacuucaaauuaaaaagugucauuuagaguagcaauaagucuuaugacauaaaugcugagcuaucuggaaacguucaucaagcugucaaaauugaugucucuccccggaagccgcccaugagaaauggaaaccuugucuuuuaggacacuggacuggaaagacaccuugggauggugcuacccagauaacaagcugaugugagaaaguaccucaagacugcagcacuguuuuuagugcuuccuauguucagaaauguuuggauacacacaaacacuugccauuguaucacacugccccaaauauccaguauagucgcaugcuaugcaggcuugccacuuacagucaguagguauaccagcaucuagauaugcaguagcauuaccacacuggucugggcacuccaugguaauuguaugauaaauggacuggcuacguggcacaguuuucagacugaaucacuuccugaauguuguuuaccuguucaauuaaaaaaggaauuccaggggcaggcagaguguguggagaaaagucaagaucugaagaguacuaguuaaaaauguccccaaauugaagaaaaagaaaauauaauucuacaagauaauggaacauuuguucuguucaccuaacuaacuaaaucaucaaagaguacagaugaauacacacauuuucaaaguuugggagaacgugcaacaacaggcagcugcugacacacagacaaauauaugcugauaccaugacaaaugacagaaagcugcagaaaaaaaccacacggcaacuacggugaagggagagagaaugcuggagacugugaaagccaaguaaaacucaaguacuagaaaauacaagagaaauaggaaguacgucuuccaagaaguccgcuaaggucuuggaaagaaugcccaagcccagugaaccaaccauucuucucuguguuuccucuacaggccgcgcuucaaucuccauggaagcccauucuuaaaugccaagaugcuuaguguuuagggauuacagaugaaaggaaucgagauguaauaucuaaaugaaauacccaguuucuaaauuaaaaugaccaaaagaaaaauaaagaauguguguuuaaaccuauucaccaagaaaggacauggaagacauagaaaacaaaaaaauugacaagaacaacuuauacuuuuacuagugaccacaacagauguaaacacuaaauaaauaauuucuugcugugauccuccaugugggugcugguaccucagguccucuauaauugcacugcugagcaaucuuuccaguccacaaaguagauuuuauaaauuaagaucuauguuguuuauagcagaaacauuccacucacucagucacucacucagucauucuucuaauaagcugagaggugaucacacuguagucacccagggacacaaugcacaggcaaucccucaccccguggagcucacagaaacagggcgacuagggcaagagaagauagcaacaucaggacuccagagaaccuuaaacagaugaaaaagggugugugcgugugauacuaacacauucagugcuuuuaagucuuuuugucaaaguuaaugaaauaaaaguaauuuaagcaugccacccccuaccgcugcuacaaaacuccagcagaagcuguugguuaccagggcagucccaacacugcuucuggaauacaggaauacuggaauacagcugccagauucugauggacacaaacgucuuuuaauuuuauuaaaaacuguaaagacauuucaaguuuuauaguguaaauuuuaggcacuauaaauaauuccuaguucuuacagaaacacaaaacucagaacuauuagaagagaaugcacuuauuaaagacuauccauuguaaaaugucccagguauuaaugauuauaaugauuuuagauuuuuuuaaaaagauaauuuuugucacuaaaauguagcaagcccuuauuucucaaguuuaaaauuuauaugauuuaauauaccuaaacuagguauaugacuaagccauauucaaguuagaaugaagaaaguacgucagcuuuuaaaaucaaucuaaauccucugcagagcagagauuguaucuguuuuauacauugccgugucaccgcuagauaucuacuuggugaccgaauuacagaagacucaaagauggcagcuuuuaaaagcaucuuguuuucauuuguuuuuaccauuucuaaggcuaguugaaaucuaguugcugcuagaucuugcagcagggccuguauucaaacaacagacacaacaaggaaacugagaugaugcagaacagagcccaccagcuaaucuaguaauaacagagccuaugaggcagggagagcuugaauucaaagcuuauuugggcauuauagagaaaagaccugucucagaaaaagaaaaaaaaaaaauauauauauaugcucauuugcauaagcauaucucugguuuauuugugauaauaucuaguaucacauaaacauuacauaaacagcuguuauacuguacuguuuaaugaauaagucuguaugucugccguccagaugcaauccugauuaaguccaauugauaaacuaagguuagaugugacuuaacccauauauuuacagauauacauguguauaguauguacuaaaaugugcuuuuauguguguauauguaguuguauguauauauguguauauaugacugacuauaaggagaaagaauguuaauagagauuguauuuaacaauuaaguagacagacguggagacauauuuacuguuuuuuuucaagacaggguuucucuccgugcagccuuggcuauucuggaacucacuguauagacgaggcuguucuguaacucauaaauauucacccgccucugccuccugagcaaugggauuagaggugugcaccaccaacgcccaucaaggcaucaguuuugagacacagcuugcuaggcagggcucuccaaugguggggcaugcugcuccagagguagcucuaauacaucugccaucacuggggcuccugucugauggugcaggguggggaauuagacugguaacccuggauacagacugcugcacguuuaaggagucuuuuaauucuaagagugacaccaagcuaauaaugguuccuuuaaagaauggaagagccgacaggugggagacucacucgaaaaagacaaaucauaagcaguuugauaucaacuuguaauuauugcgaugauuauuuaauaaugugauuacaauuaacauaaaacaaaguucuaugugaggcacuucauaagauuaaaccaauuuaaaaacaguaauuuaaauuuuauuuccuuuuggaaaaaaaaaaucgcugacuuuguaugagaagcagaguuacuaacucuccauagcugugacuuguaaggaagugcugugagaaacgacaaggacugagaaacauagaacucaauaaacuuuucaaugcacaaguuuuuaaacuugaauuucuuauauuuugguugugagccuagucuuuaacggcugagccauuucucuagcccacagaccauaugaaacaugaagcucaagaaggaggaagaccgaacgaaguguggauacuuugguccuucuuagaagagggaacaaaauacccaugggaggagguacagagagaaaacuguggagaaggaaaggccauccagagacugccccaccuggggauccaucccacaugcaguuaucaaacccagacacuguuguggaggccaucaagugcuugcugacagaagccugauacaacugccuccugagagacucuaccagugccucacaaauacagagguggaugcuuacagccuaccauuggacugagcacagggugcccaaugagggagcuagacaaaggacccaaggagcugaagggguuugaaaccccauaggaggaacaacauuaguacccccagagcucccugggacuaaaccaccaaccaaagaguacacauggagggacucacggcuccagcugcauauguagcagaggauggcccuugguccugugaagucucuaagccucaguguaggggaaugccaaggccaggaagcaggagugggugaguuggugagcaggggguggggggaggggauaggggauuuuugguggggaaaccaggaaaggggauaacauuugaaauguaaauaaagaaaauaccuaauuaaaaaaaaagaauuuuuauuuuagugaaggcaaucaauagcucaguaaaaucaaugcuucuguugguauuaacaggaugagagaaucacaaauauggcuggagacaagacacugaaaucaaauuauuaaaauauaauuuaugugugucccucaauuauuuuuagagggguugcuuggagaagggagacugagugcuaguccgcugagcuucugucacacauaguauguaccuuucuuuucccugugacaacagucuuacugaggagugucagcccaaugacagcaugccacugugggggaggaggagauagccccuccuuuucagcagcuacuguuuguaguggucuccaucaggagggaagaggaauguagcuuauagcucagcggguucucagcaaaguccaaacaguaggagcaguaguaaguacacaggcaccaagggaugccuuucuucuauguuuauggcaaccuggaaaggccagaggagcuggacagaucaagcgagguacuggcugaaaggaaaaagaggggcucagugggcaaagcacuugucacacucauaacuuaaccuaagauugauccccacaagccauguaaaggucaaaggagaaaacugacucuaagugacccucugagcuccacucaaaugcugagguacaugcauuccuacccacauaugcaaauacauaagaaugcacgugugaacauaaacacacucagaaccacacauacucauacucuaaauaaacguaaaaaaaagaaaaagccaaaaaguagaugagaaggcauggcaggcaugagagcuuuuacugugaagagagcuaucaccugcagugaccguuuugaacaguauuccucuggcugcugggugcacaaggaccacaaggaggcaagggugagggccaggugcuaauacacuaaucugagagguaguggcauuuaugaggacagggacuaugugggugggugggaagacaggacucuggauagacuuggaaggcuaccugacagaugugaccaugaacuaaaggagucaaguauguucccacgguuauucuaaccguuagaacugccaguaacugaccaagggaaaaggaaccuggugggaaagucacaggcugcuuuaagaaccaguaaaucugagaaauccgucaaacauuccgaugcagagccucugugcacacaaggugccuuagacucagggaagaagucuggcuuaagaguuaccaaguuaaggucuauauaauguuauuuaaaaucaaaggccagagcugggcaugguggcagaggucuauaauuccagcacuugggaaacugaggcagaagauuuugucuuggguagagauggacuacauaggacuaucuuucuaaauaaauaaguaacaaaaaucaagagaucaaaugagauacucaaagagcagauaggaaagagguuaagaauuuuauuaaucaugagcuaggagacucuggacucacuagaaccaaagaaguggaggagcaaagacgugagcagagucaggggagacucagugcuucauggacaagaggguggcugaucuccagagaagagagaggaaggcucagagugucuacugaggauguaacaaugccaucaccaaagaccuugacaguaguuuucugggugacugcacuggggggaaacuugauuguaguagauucuagagagaaugggaagaaaaacaauauggagauaguguauuuaaggaaccuuuuguuuucucauuuaaguuaaauacaaauaacuaauacuuaaacuguccaguuaaaugcgaaugucuacguuauugaauuuaccaucauaaaaccuuugcucuacauuuaagaaccagcaaaugcucaaacccaggagccaggcugccaggagaggcgaccaagauguggaagaacuuagcgaguuacaggaacucaggcacugcugaauguaaagagaaccaguuucagggagucauuguauugggguacuaucaauuuuaaccuaauuucuaguacaaacacaaccauucacagaccucuacaacacacacgagcaucagcucacuauaccaagaugcuaacugcgcaaauuuaagcugggcccuggacacgugaugcuuuaaaauuacaggauuauggaaugggaaaaccaccacagcguagcauggaugaagaaucacugcguauucaucuguuuaaacaaagcacgaccaaagagucagggcacucuaagggagcacccucccugacgcaggggaggacaacaggagagggaggucugcaggggaaaccgggaaaggggauuacaucggaaauguaaauaaauaaaauacccaauaaaauaaaaaggaaggaaacuuauuaauaaagccaguguaucagagaaagauuaggggcuggagagauggcucagugauuuugagcgcuuguugcucuuauaguggacggagguucaguucccagcaccuacaugguacucacaaccauccuuaacuccagugccaggggauagaauacccucuccugacuucugugggcaccaggcaaguauacgguacaaagauacauaaguaggcaaaacauuauucauacuaugaaacaaaauaaagaaaaacauuuaaaaacaagccaaguugauuuucugaagcacuacgaacuauaaaacuccugauuauaaccauauuaaacuuuacaugaauaguuucaaauucuaaaauaauauuauuuggacauuuaaagaugaacguugggccagggauauagccaaguggaagaauacuuaguguagcaaggccaguacugaaaaacaagccaucagaaggcaugcugaugcccucuucuguugugaagucauauggacaauaaauccagcauggagacuauccaccccccuuuaacauuagcauuaccuuguguguaggcagcaucaucagaucccauacucaguuuccgggcuucgcuuauucuauccacaugugcuagagccgggucugugagaugcugaauguucucuguuucuacauaauggucaggaugauuuagaagauuuguaaguucaaagguuggggagaccacccccggggaaacagcagggggcuuauugggggaaacuguaauuuugaaaguauauuuuguguuggguugagugaccaccacucgaggagacguugcagaguuaccaccuaacacucggcuuuuggguggauggugauggauaaaggcaggacccaugcucacuugcccagacauguuccuggaggcugcagauggcccagaguuuguagauaugaagagugucgguugauuccgcaugccuugcucaucuccugcgguggcauuggcugaaauauagaccuuggguugacuacgggagaucaucucaucaguauuuggaggacuggcagcuauguaaacagugggcugauuucuauuuaaggucuggcuguugaccaaugaggaagugcuggcaguucgagguccagaagaacguaauuuugaagaacuguuucuuuguggggguucaaguuugauuucuaucugguucuuucgagguccuguugaaauauucugaauguuauauuggcuaugggcagaagacugagagcucccagaugagugaaugguuggcgguuguggaguaguuggcgaacugauaggcauguagacaugagaggucugauggcccugcugauucggcugcuggguugagguauguggcaaaggauuggaugcaggauaaguaguccaagguccaggcugugaagguugauaggcuugcugaggguucaugggauuaaacugagacacccagccagaauguuguugugucugccgagcuguaccacuaggaguuguaauauaaggccuaauauagauagaauuucccuguggacuguucaguacaggcggagguacaccauguaugugcaaagauguaggaguacuacggccagucuguauguuuggggcuaaaguuaccauaauaggauugaaccugggagucuguugagaaagguuugaugucccuuugcugccuaggugaaauccaagaugcgguguugaguuugaagcaccagauguacugggcauuccaaaaacauuaaagccuugaggaacuugagcuggugcugucuguggcucuugcugaaacaguucguuauuggacugcccaccgugaagcuguccaucacuaacgcuguguguuaaaguccugcuuccauucacucgacuuccuucucuuccauggugguaaacauucugugacugcaaguccaaguugagagaagucaugugauugcguagaccagaaauuccagacucaucugaaaaauucaggucuccuucaccauaaagauaccuuguacucuccugagagagaacagcgcagcaggcauccagguuauuauuguucuacagagcaaaauaaggacagguuaaucuuagucaugagaagugaauacacagacuaucauuaccacagaaauacacaacuaacaagugaacagauacuauaaucacaagagacaucuuuugauuugagaacuauuuuagguuuauuaacucucacuauuaguguaauggaaacauuuacuaguaacaaauaaauguaaaccaaauaaaucauggucuaagaagcuacuuaguaaauggauggauccaaauacaguaaaaugcagccuaauuaaaauacaauuuuuacaaugaacaaaguaaucaacuuuaagaauauaauaagguauaauuaaauuucuuuuuaaagugaaaugauaagaugcaaaguucuucaaagcacuuaaaaaagaagugagcauuuauagagccaauuguuacacgguucuaccugugcuucuuccucuuguaaaaccauccacaaaugaaauauaagcacaaaguagccaacaaaagaacugaguucaugucucugccuucaacagagccuaacaaaaacccauuccagagcaauaugcagaaagaagcaaaacccaaaacaaaguguuuuuaaacgaaguaccacaccauuggucauaaauucuccagaaaaauacuuauuggaaaucaaucauauaugcagcaaucuuugagcuuguggaagauuugaguuuucaucccacuaaagagccuguaacucaaucagguugacaguuuuggaaaauggcaguggucaguucucucaguccugaccucuccagccaaggacaguuagcuagguuuagaauacuccagcuaaauucuaaguauuuauacaauaccacagacagguagguauagcucucaccucucaucaaagcaguuucuuuuugcagcagagaccauuacauaaauuuacaacuggucaaaaugcagagaacuauggggugggugccuggcaucaauggguacaucuacagcacaaccucuaaccacagaacagaggauggugcaacuuuaggagcuaguggaccaggacgccugcuguccuguggucuucuggaaccacagggaggcuacgugcaugaaauccuaacauuauagcugccuaaauaagaccggcacaaugacaauaccacuuaacaugucagcauggacagggaagcuguacaaggcaccaucccuagaugaggagcuauaggcagucaauggcugcugagagagggagacucagucuucuccagggcugagcccuucaauuccaagugcucagcccuaaacacaugcacacgagagugagacagcucagugaccuguuccgaagagacaacacggaaagcuccagaaaacuacaguagacguuucucucaucucaggccccuucucaugaacauguguucacauccuuguaccuauacacauuaauauacacauuaauguauacacacacacacacacacacacagcccuggauuaaugaguuagauauugcuugaugguucacagagcacacacaaguuggacaagagaaaacagucaaacaacccuccccaaaacaaagccaauacuaacauagaaacucuagguucuuggugaagggaaugguagaguuagguuaacuauguuccaacacagugaauggagcaucucuagcuguaguaaagguucacauuggaaacuucguaaaaugcaugguugggcuuaaguaauggaggauuuaaagaaaugaacggcacuacaguuuguuauuauaagcagccgagagagcuacugaacccagaugaacagagaaguaacaacaaaagaguauuuugggaaaaaaaaauccuguuaguagauaagauguaaggagaugcauauucuuuugacaaagcagccaguuagaaggcaggcaauaauaaguaucugauaaugcaggugaguaacaagagaccaacuaauacaucuuggacaugggagaaaaaaaucggagcacuggauggaaaauuaggagccaaaaagaaaucaaggauguuaaaaugucuaccagcaaucagauaaaaucaugccagaacuuucauuaggaaaugaugguccacacacaccauuugaacaaggagagcaaacaagaagaaagaaaugacugauacacuucccccuucccccagugauccugccucuggaaugcuugguuugucuucucaauacaucaagauuacacucaaguauacauuagaguucuuuauuuuuugaaaauacccuaagcaguucuauaaaagacuuuaaguuucauucccaguuuucugauuuuuaaaauauaacugguugcagggcagugguggcucaugccuuuaaucccagcacucaggaggcagagacaaguggaucucuuaaguuugaagucagccuggacuacagagagaaacucugucucaagacaccaaaaaagaaaaaaaaaaaaucacugaacuauaaguguucuagguaguucucucaauaucaaaucugugaaauuuguuaaagaaauuacauuauuuuucuauuaguuuuucaaugacucccuaaacacccuuagaauagcuuuauuuuccuacacauuucuaccuucuaucuaacuaaaaaagugagacuuaccccucuucccaguuucuggcucuuuucccaccuucuucaaacuuugacuccuacuuuauuacuuuuaugcugguuggucucugucuacuugacacaaaccuagacaaaucugggaguagagaucucagccgaggaacugaauccaccagauugaccugcaggcaagucuaugggauauuuucuugauuaaggaaugcuguuggagggcaccagcccugggcagguaguuaacaguugcuuaagcaagcaaacugaacaagccaguuagcaacacuccuucauggcacugcuucagcuccugccuagaguuucucccuugggcucccucagugauagacuaaucugagaguauaagaugcaauugaacccuuucuuccccuaguugcuccccagcaauagaaacccaacuaagacacuucccuuuucucuuucuuuuuuccauuacauucuacauugauaagugugaacuaacuacugacucauuuaccaaauauuuuaauggggaacuuccauuacuguuacucuuuuuagaacugugagucacguauccuagcaguuaauauaccuggauuauauauaauucaucuugaagaacauggaaaaaaauuuuaaauggcaaauauauaauaaccuguauuuacacugccaagaaacaauaauaucuucauuuagaaaggauucacuuaggaagaugauuggugggacucaaacuagguuaaggcugaaaacauacagaacaacucaaaauacagaucaaagaugauaaggguaugagugacauauauguagucacuauaaaauaggauaaaaauuucauacacuaucaaacuuuauaaauaaccuuucaaauuuugaaggaucuucaaaacgccuuuugggaggaagauuuccagguuaaaugaauggccagcuacaacuaucacuaaauacuaagaauuauggauuucuagaauuuuguauacuaagaaaauguagaaauuggagagauuaauuggaaaauuuauaaaguaaacuuagaaauauaaaaaacauuuuucuucauaauugggaaguuaugcacuguucauacaaaucccucaugucagagauaauagacugacaugccaacacuguuuugacaaauguaccaaucaacagaagaacaagcuuucugacucaauuauuuuucccccauuuccauacaaagaucugggauuucacaaaucugacgagaggaugaggaaaagggaacaagauuauagaaagcagaacucuugucuauagggcagacaaggccuguauuacaggcaggcacugagaacccuauuuugccagaggccauguuacuaugagacaccaaagaucauuuuucauuacagcacaguaaugcuaacagaguuuuucuccaauaucuaaaaaccaccagguuaauauuauaaauaguauuguaucaauaaaucaaaaaaucauugaauacuaaccuguaacaugcaccuggauacaacaacuucaggcacuucugggaauuuuugucgcaggucauguaaaaccugaaaaucaauuugguggcuuccuugggccauucguaugucgccugcucaggucuaucucaauaggcaauucuaggccugaguggaauuaguacucaucucuucuggccaagcauuuucugugaaagaaagaaaaauuauugagaacugauuuuagaaugaauguugcuauagauuuauaaucacagcucuuaacuauaaacuauaaaaguguuacuuagguuuaaugauuuucauauagcuauacauacuuuuguuucuaauagacaauuuugaaaugaucuaauuccuccauauuuguauguucuacaauggcagaagaugcaucuaauuaggaaucugcugggaugcugucuagucuuuccucguucuuuuagggagacucaggauccccuaaccuuuuuuaaugaguacacgggagagccuuagguacaagaccuuccuuguuuuacuuaaaaccuucaagaaugugguucuaaaagaccacauguguuuuaucuaaaacuuaaugcugcuaucuauauguugcuuuacauucagcucugaaaugcacaaucaacuccucuacacaaaauaacuaagucuuuucuacuucagcucuccauuaucacucacaugggcagucauucucuucuucaugcucaucuaccaccaaguccuguguuucguuucaaaaguauuuuguaucugaugauucuuucucaccccuacugcuuuuuucuggccaccuuauuccaucuuagcuauuacuguaagucuccuaccucugcucugugucaguuucccugccucccacauccucagucuuuccccauaaacgaucuuugugaacaguacagcagaguagccacucucccacccguguggcuuaaaacugcauaccaugcggccucuuguuaacuaccacauuccuguucccucuguugcuaaugggcguccguccgguaugguauaucuuuguugaggcuuuugaacugaauccccucagauccuugaaggcucugucuacuuccuuacacucacuaucaagugccucccacugaaaaacagguucccuaaccauuuuucuuuuguuaaaaaaacaagccgggcggugguggcgcacgccuuuaaucccagcacucgagagguagaggcaggcggauuucugaguccaaggcaagccuggacuacaaagugaguuccaggacagccagggcuacacagagaaacccuguuucaaaaaaacaaaaaaacccaaaaaaccaaaaaaccaaaacaaaaaaccaaaccaaaccaaaaacauauccacauacuacuuuuuccucugugacauuuauaagugaccucuagaggaucaagaccucuaagauuaaccacuguauucccaagacuagaccaaaucuagguucauaaaagaugcaacaucauuaaaggaaaguuuuacuguaaaguuucuuuuccauuacaguuucuaaagcacauuucaaaugacuuaaacccagaaaaauaauuuacaggcaauauuaggaaugggaaaauaaauaccuaaaugagaaacaccuucauuaacuaaagaugaagaaugaaaacgaauucuaaucucuucuaucauuaaagcauacacagcauguuaccguuggcuugcuuuucuacacacugaggacacaaaggagaaacauucaaaugcccaacuauacuuuaugccuacuuucugagaggucagagcagaucauggaggaagagggacuugaauuggaaggcuaaucuuguguacucucucuacacuagguuugcucucugaacuacacauaugagagagacacuuggaacagccagguucagguuagaacagccaaucugagaucccaggguuuauaguuuggguucagcauaguuaacuguccccuaaaacaaacuaaguaucacuauccgcuggggaaacauagaagaauccagacuuucuacaugccauccuuguccuuaauuauauucuaaaugauuaaaaucaaacaggaaaaacuaauccacacuuaagaaaaagacaaccaauggagaacaggcccaaaaugacuuagcuacuggauuuagcaauauggacuugaaaguagcucaugacugcaagggugaauauacuuggacuucucaggaaauaaguggaauauauuuuuuuguauucacauauaugaaauuuguauguaagaccuauuuaagaacuaaaaauaugugaaacagaacuccacuggacaugcuuaucuacaguagaagagaagaaaaucacgcagucuggaagauggacagagcuguaaguggaacggggcuuccagacccuuuggaugcaguaggcaguaccaaaagcuuuuaauguccuuguaauuagagacuggaaaccaggacacauguaaguauagaaacaaacagacaaaccuuauggaagugugguuaaauuuuucucaaguuaguaaauguugcaaauuuacagauuuaaggaaaacauacaaaaggcccaauauugucugcuacaaaccagggaaagaaaucuuaaacacaaccugaaaaaugacaccuauggccaguuaaacagcauauuuauagaccgaguucacggucuagcccaagguaguuuugaacuugggguaauccuccugucuuaguuuuuucuaaaauacacagugaagagcagugcugcaaaguagaggaaccaugaccucugguuagcaggaaauaugcauacagaauucuuaagacacagcgggguacuaugcucaaguuaaggaggaacaagaacaaauucaauaauuccaaucuuaagaaaucugagucaggcaggcauguugguguacaccuucaaucccagcacuccggugacaggcggaguuugaggccagccugagcuacaugcagagugagcuccaggacagccaggguuauguagacaaacacugucucggaaaccaaaccaaaccaaaccuagccacaccaagccacgccaaaccaaagaaaauuuggugucacuuguuugucauuuacugcuuaaguguauuucagcaauauuccuguugugcaggaaaguaagcuuuugguagaauauauucaaggaguguuguuugagggucucuuuacuacguucauguguaguagcagagaagacgagcaagacagaauuucccagacuucacuggagcaccaccacauacugguaucuaucuuguguggagaugccggagggaaaugcugcauacagacacagaaauuaaaauacagcccuucauuggcugggagcuuauggaaaggcuagaaugguagaccaggaacccaggaguccagcugucugcuuccccaccacugggguuuuaaguacacaccaccaagccuacauuuuauaucuauguguucuaguacugaacucagaccaagcuacccaccugagcuccccaaaagccuaaaauccuuaaauaaaaggaacugauaggguuccuucuacgaaauuccuaagaaauacacauaaacaugacaagaauuuucuuucuauuaaagcaauaaaaaagaagguaaccaugguagaugagaagaacaaacuuuccuacaaaguagaguucccuaagaguaaaggaaacaauauucagcuuuagccaugggaauuucuaaaggguuuuucuuuuguuguuguuguuguuguuguuguuaaaaaggguaaagaaacaaagaggaaaaaaacauguuaauaguuaaaaauggaaguaaccagcacuaucuuaucacaaacuaaaugaaguaacuaacguauauagaacacacaauaguugcuaaguaaaacucugaggauucuugaaauguccucuuuggcaaaucauugaauuucaauacuuuaguuauccuccuauauaaaacaaugacaaaguauucaacugucauaagaauccaaugaauauuucauguuaagaugacaaugacagcaaaaaaaaaaccaaguaucaauaaaacaguaauacuaucauuuuauuuuuauaaaacagacaaacaacucagaagcuuacaagacuacacaguguaaguuaauuauauuauuaagccugucuagcuuaggggaaaaaguauaaauagguagcaauaaugauuauuuaucuugaauaguguggguucucacaagauaggaaggaaccacauuuuaguaaucagggcuucaugcuacccuggcugcagaauuuugaaguugauuuaaucuuugaguuguuccuuuucagucuucauagaacaaaugauuaauguacguuagaaaaacugagacagcuaaaugcagaucuuaucaauauguaagccuguggccaagcacucgagaaguuguauaagcuguguauucaaagggaucuucacugagggagcuggaaacucaaaguacaguuaggugaaugugagagauggagcacgaucauaaaguaggucggcucuggaaaugagggggaagugugggcagaggaaaaaggggacacugcggaaagcacucuagggaggacacagaagggcgugcagucgcugacagaagaaaccucaccgguacaguggguuuuauuagcggcccagagauauacuuaaguagaauuuuaauauuauuacuguacacauaccauuuugagacaagaucaugcuauuuaucccaggcugucuuugaacucacagucuaugugccucaaacucucaaguucagggguuacuguuucacccuuauacaaugugaauuguaaaaaaaauuaauuauuuuaacaaagaaaaaaauguaccugcugaauaucaaacaauaauagaaagaaguacaacuuucacuucuaaacacauaaggauccucccucaguuuauggacaagaagggaaggaguccacuuaaguauauucuagaauugacucuggggugacuuucuguagagcgugaagugcugagcugggagaguggugggaagcuacuguacaguagagaaaacuguaguggugagacuaucuuguucacugcuguauacuaaguacuuaaaaaguauaugguagggauacagagauggcuggaguuaagaauucacacugcuaauucagagugcccagacucaguuccaaguacccaugcugagauggcucuaaccaccugugacgucagcugaagaggaucgggccccucuaggcccugcacuagccacacuguacacuagccacacuguguuacacuuuucuucaguuucagaacuuuuuguucauuaauucauaaagcucauucucacaggcaaauguuagguuuuguuugagguaaagugcaauauuuguuacaguauuuuggagauagggucucuguguagcucuggcuguccuagaacucacucuguagacuagguuggccuuaaucucagagaucugccugcuucugucuuccagucaucaucaccuggucauuucuugacuuuuuaacaugaauaaaacuauacuauauuuguaaaagguucuuagcuuuaaaaauguuuacaacucaaauuucuaaaagcuguaucucuuuuuuauuuucccuaucagcucugcacuguuuuagggaggaauacuuuuaguaauuuuuaggaacauaaacaucaaauuuuaacagaacuagauacauaucaacaccccucugaccgucagauguuagaacaguagccucuccaggguucaauggaaaggcaggcaguuuuucucucucccuaccaguaugucuuaauacuaacuaacucacguugcuuuuguggauuggcugacauuaucaaugaguuauuuugaaauaaugucuuucccauaaaaaacugaugugcagucagaauaguuggaugauguuaucuaccaucuuuuaaaguuauaguacguuauagaauccucugaccuaaaugaagauuuccaauugaaaccuaaaaagagaaucaaauuaucuaagcauauacguuacacuguugcuguaguauauaucauauuauaggccagguaaguaauacuugauaugugauuuauuuuuaaagaauuuauaaaugucauauuugaucagccuaaaaaagucaguauuuuucuuuuccuccucuuauucagacaggguguuacuaugucacccuagcuggccuggaauucuuuguauagaccaucaacucauuccaucugccucugccucuagagaccuuggacuaaaguggagugccaccauacacaagccaucaacacaauuuuucuaauaaauuacuggaauucgauuucuugaaguaugauguuacaauuuuaacaagaugaucuaaacauaucugucaguauuauuuuucuaugauagaaauaaaagaauuauagccauucaauaaaaaaaaucugaaauuuaaguacuauuaccauuuaaaauaaaaauaagaauugccagaccugguagugaaugcuguuaauuuuagcccuugggaggcagagacaaaugaagugaguuugagggcagccugguuuauguagugcucuaggacaaccagggcuaucuagagagaccugucuuaaugaaaacaaaaccaacaaaauaugaacauaagauuauaaccaaucuucagcacugacucugucauagaauuuauaauauggaaucacacugcaaaaucaaauuaacugccaagacaauaauauagcaaaccagcuauucaaaugcuaaaugauuuuacgguagccauuauggucuaaccuaauacacguaguaacgugaagugagcaagugaguaagcauuauauaaaccagacagcuuugcaggcugagaacaauuaacuuucuaaagaaaagccauauacauuaacagucauagugugauuuacgccuucccuuuuuaaaaagaagccuuccuauaaucccauuacuugggaggcagaggaaggcagauagaucugaguuugaggcuagccuaaucuacaaaguaaguuuuccaggaacagucugaggguuacauugacaaacucuaucuugaaaaaccaaaaccaaccaagcaaacaaaaacccaucccaauuccuucacguaguacagugccuuaaggacacgaaugcugacacugauucugccucccccuguacaaguucuugaaggaaugugcaggucagccacgguuggcaauugacguuuugugguuuuguggugggugcugccauuuucuauggauuaaggaaagugcaauaaaucugagacaaacauauuauauaauugacuaccuugugcauauuuccacuucauaucuuauuauuuuuccaacacgcuagcauuuuacuauggaaacaaauuuacuuuccacugccuucuuucacuuaauuuuucagauaauguauccugaacauaaauauuucuaaaagaaaacagggauguuaauaaauguuaauaaauccuuauuuauagguaacaagagaaaugaaaaccagaauguuagaaaaacucauguucuagucuuagagcauaacuauaagcauuuauaaguaaugaguuaaccugacauaugaaaauaauaauuaaguugaauauuaauuuauucacaugugguggucuuguacuauuuggugacaagggccugucuuuaacuacagagccaucucaaugcccuuccccuucacgccaaacaacaaucaccuucaaggagaaauaaacuauugcauugcuauauuaaggaaaauuaugagucuuuuucuuaguguaguaagacauccaaauuacuacauauaagaaacugauggaaaauaucaagaugcagaguccauguauauuaaacauuuuguuauggcuucuuuuaagcaaucaaguaauguauauugcauauauaugcaaguuaauugaaauacaauugaauucagguaaauauaccauguaaauacagaauuuuguuuuaucuauaaacaacaaacccuaucauuucaaauaacuggaaaauguguuaacuucaugugaacauagaagaaacagaacaguuaaggacacucacguaguccccaauaguacuugacucacacaugaacucuggagaaggacaguuguuuuaugcuuacuuuucaauggaguccaggguacuauuuugcacauuugcaggacuugacucuguagcacuuccacaucauuucucuuaacugcuucugcaguaguuugcuacuacuagcaaacaaaguaaacuagaaagacucaucaggcaaaagguaauguacaaguuaaugcucgccauguguuaggagauguaagggaggugaccaugccacucggguuaaagcagggaacuagaaguugugcacuguguguuguuauggaucacacagccuaagcuugagugccccaaguuuugcauaccuggaaauagaaaaauucaaacuguagcuguccuuggauggcucauuugcaguuuacaaauguuuaacuaaguaacugcagugagcucaucucuacuggauacuucuuuuccagagcagguccaggaacugggucuggagccuugaaaguagaagagaaacuacaguaaacccagagguaggcagaauuagaacuguggagcagacaacgugaggucugaaagcagcaguccuacagccucaaaaagaacauucagguaggaaaaagcuucuuugacacagcugccagggaaagcgauuugcuucaguagacagucuucacuugccccaagccucacaauuccccauccugggaaguaggaaggagccuuuaggaaaucuccaaugguuacaacacuagccugugccugaaaucagugcaaacuguaacagaaaagcuacaagaccuauugugacugauaaacuuggaauuauaaauucuucauuuucagguuauuuacucuucccucucaauauugugucuccuguuaucuuuuaacugcucuccuauuucccaaggccugacacuucugugaaaauauuuuagauauauucaagcaaugaaaugaauuucaaguuccaacuuucuuuuguuaagacaggguuucucuauguagcccuggcuguccuggaacucuguaaauuaggcuggccucgaacucagauauccgccugucucuggaagaaggcugggauuaaaggcacuggcucaaguuccaaugcuuaaaggggauggcagauaacaggucauaagaugcauuucuuaaccaauuaaaaacugcuuuucuguuaccaagacagucauuuguaaaaaaauauuuccuaggcccauauuaaaacaaaaacaagcugguaacucuagagguuagacaaacaguaggcuauuaaaagugguagucaauguacuaguuaaguuuuagggaccaggaaugauguccuugcacuugauucucaguaggcuggccccuuuagaguuccucuaagaagagaaucccacacuaggucaacugaguaucuguucuaucaaacaugaggacuguaauggacaaagaugaaauagugaguggacacagguaaagguugaacaaauaaacccuuugcaguucucguacaaaccaaucuagaaaaaacacaguaaaaaauacuuucccacuccuggugggaaauacaagcuuuccauguuuugugaugguauguuauagagaaaagcacccuagaagacagggaccuugguucaacucucacuucaauauggccuugaauaaaaauuuucccagcccaaaauuccuguucuaccaaauggcagacaacuggcuaccauuccacugggcugccuuaaguuucauuguguacaggaagcacccaaagccugcugcauauuaaguuuccaauacauuguuuugcaucacuaaaaaaugaaacacauucuuuucuauuugcuuuauuucugcucugaacauugagguaaacuuaagcuuucauuuucauaaauucuaaagcaagagccauguuuaauaagcuuuagauguaauaaaagugcgucccauucuuagagaugaaagugauuuaucaacacuggcuucagaauaacuacaagaaagaauauaugagacagcucaauucucacagcugaagauaaacaaugauguaacaauuuacauuaaggauauaaagauaguugguagaaaacaagauuuuuccccucuuccaguaaaguagaaaauaggugugccaauagauuuguuagaaccuagcucuaggaugcagaacuuaaaacaacaacaacaacaaacccaggaaaguaauuaauccaugauauagcuugauuuuuauacaguuaaagaaaauagccuucuaccacauauggguaauaauuucccucuuacugguagaauaguggguuccacacaaaauuauuauuuaccaaauauggcucuaagaucagauuacaacuccucugccauuuaccaaguauaaagcaagugucacaagccacaaggaauuuaagaaaaacauuucuuuacaguuacuuaaaauguauucauaccacaacuuucuuucaaaauaguuuuaaaaacuugacauggaaguauaucacucagauaggauuuuaucuguauauuccucacaaagggaaaaaaaaaaaagucaugagagauucccugucacuaacucuuuuggagaccuuucacuacuuuaaagacuaccaaggagggaaagcacuguagauaaaucaauauaauuuuauaauuagcuaucauauugaaaucucauuacucacaguaacauuucagcuugucuucuuggcuguuuuccauguauaaaguauuagagaauaguagaccugucuccucccuuucgaucacgccuggcuuuacuuacguauuuacuuuuggucuaacuguauuauggagcaucuccaggacaacguuaucuaacagugauguuggggcuagggaggauggcagguaggucucauuaugcagccaggucuccuuuugccucagccuccuaugcaguuauaggcaacaucccaauaggcuuugauuuaugacuucuuaauaggaacuuggcauuuuccuaaauacuaaaaugggaauucuagcaucuuaccauuuucuuguaccaaaauggugguuucuggucugagaugugaacacuuaggaauaucgcuauauucuucuuuuuaaaaauaacuugaaauuccccucuuccacuuuuugauauccuuuagauuuuccacaccuguguucaccuaacacuaauucaucuacaauauuauuauauggagaccacuugauuaauuaagcauuguuuuucaccaacuuuccugagacuggucuguagucuuuuauucuauuuuacuaucaugguauguuuggcucuguagaaagaaccucaaaguuuaccuuuuccucucuuauguugugaaauaguuaccugaugcuugaaguucaaaaaaaaaaaaaaaauucaauguuuaaaaucuccaaggucugguuacucuguguagggaguguuuaaguuuagaccuuucguuuugugaguccagacccuuucauacuuccuuuucucccucccucucucccuuuucaggauuucccuuuaacuaagaacauauagaagucuuagucaucuuaaacacacugccacgugcauacaccaaaguugccaguuaagucugaaagggauucagcaaguacuaauucauaaagcaacuuauucaaacugcccucuacauuuuagccuagcuaguaggaagccaaugagcacagaagaaauuacagcagcagcguaagaacugaaacaacacaaauaagaaacaauauucaggcuccuuuccugcuugccacucccacuaaaauccauuccaguuugccuucuccaguuugggucucuacaucagaggucaagaaagcuacagauuuccucucuagcuuuugguuuugaaugcauaaaauaacgacgauuauguuauuuugaaaauguaauuugucagguucaaugugacacauccaaauauggauugaaauugagaacagugacuacaccagagaugaggaggagaucggucaauaagaaaaaacaagguuguaaaagcagaagauagacaauuauagggaaacgugguagugaaacagcacaguuaguuaccuuaaagaggaacugcugacacugcugugcucugcuguguaaaacccuaacccuuucccuucugugugcaccucuccuucaaauccuaaccuuagguaucuuuagggucaugcaauuuagauuaaaaucuauuaaauguaccuuuaaaaaaaaaggcagagucucauauacucuaaguuggccucaaacucgcugggugguuggcccucuugcuuccacuuccccaguggcauaacuacaggugugcugaaucaccaugcauggcuuauguuuugcugagcuuggggccuuaggcaugcucgguaagcauucuaccaccugugccauuauuuaccuacugcuaaaucuacuuacuuuaaauauuuaaguuucaaaaaaaauauucuuguguauagucaucauccauggcccuguucuuagaagggcauuuuuacacaagugcauucucaacuccgggcacauuccagucuucuaucuucuuccuuucccucuccauuaguccucuuugcucccacuauagcuuuauaucaggguuauauacaaauacaugguuuuacauauuuuuaucacaucuagcaacugaaagugagaauguauaugguuuuugucuuucugagacuggcuucauucacuuucaucuacuuugcucuucugaguggaaagcauucuaucuguguccauacaccacauuuucuuuauccauuccucugcuguaccucugugacuugacuuggaggccugguuugggugcgugacaugauagaucuauuuuucggucuuugagagguguucauauugauucucacaguugcuggacuaccucacccucccaucagcaguauacaugugacuuuccuuuugcucaaagccuugccagcauuuauuauuauuacuuguuuucuuaaaacugaucuacuuuuacuucccaucagucccuguaucuguagaaauccauuccggcuuucugaacauauucaaaccccuuuucuucccucagugagcaaugaucuugcuuagaaugcaaucucuccacuuuugacacaugcuaaaacuacuucuucaaaaucaaccuuaguuugaccuucuucuugaauucuucuccccugcuuccguccucacggcgacacucagaacuacuaaugcuccuguggacuaauaaacaccacaagucaucgccauccuuguacugcucuauauuuuuggugacauggacuaugugcuuaaauauagaacauugccuauaugcaauauugacacauaagguguacaaaauaacuaaaauguucuuaauaaaucaaacauuagacuuuguuuugcaauuucaaauaccagaaaauacauugggaaaaccaaaauuccacuaguugaugugguuugaauaugcuugaguuaggauguggcccuauuuagagguguggccuuguuggaggaaguaugucacaguggguaugggcuuuaagacccugauccuagcagccuggaagccagucuucuagcagucuucagaugaagauguagaacuuucagcuccuccuacaccaugccugccuggaugcugccaugcuccugccuugauaauggacugaaccucugaaccuguaagucagccccaauuaaauguuguccuuauaaaaguugccuuggucacagugucucuucacagcaguaaaccccuaagacagcagcuaaaauggauuaucuaaaaccccaaugagaaccuagaugcucauuaagaauccaugaagccgggcgugguggcgcaugccuuugaucccagcacucgagaggcagaggcaggcggauuucugaguucgaggcuagccuggucuacaaagugaguuccagggcagccagggcuauucagagaaacccugucuggggggguggggguggggggaaauccaugaacuuauuuacugagcuguaagaaauuucaugaauuuauuaauuaaauuaguaaauuagggaaggaauaccuuaaaaguagaaacaaaauacuucauuucaaaguaucuacaacacacaccuagacucuauggacuaaguuucuuacauagcuuaguggcaggccuuggauuagaaccuggauuuugacucauucugaagcuauaaaacaaacacuuuugucuucuacaaaaagguuuaguaugcaaaguggguauaugugcauaagguucccuauuucugaacgucaugaaacauaugaaauauaaagaaauagacuuggaacuaaaacauacacuuauuaauauaaguuaauauauuaauaauauuauuauauuaauauauuaauuauaauuauaauuaauuauaauaauauuauacaacuuauuaauaauauuauuauauaacuuauuaauauaaguuaauauaguauuaacauauuauuaauauauaacauacaugguguaguuuuaaaucuauauauaaaauucauaaauacaaauuugaagguuguuuuaauuacuuuacgcaaguaauuuuaccuggugauaggagaugaaugauguccuauuuacugauuacuauuuggauuguaaacacagcaugugguugcaguuuucuguaacuagcucuaacaacuuuauuucacauauuaaaaaaaccaaucuauccauggccuggagguggggugagaugacagucacggcacuggcauaucucuaaguauucuucacacaggucagagaagaccucaagcggagaacaggaaugaggguaggaaauaagggacuguucuccacacauaauaagcucugcugguggcuaugacuagaaagaacauacuuuuuccuaaagggaagcucuuagauuacagcaauggaauugagacagugagggagggagagaaaggugggucugaaacaaguaaaccagcacccugacaacacacacacacuaccagcuuuaacagaacaaccgaccaaaacucaacucacugacuccuacccaauaaugcauugcaagcagcguggcccugaagccaagaaccuuuccuaucuuaacacacucaaguaucacugaucacuaccaccaagcuuucuugcauucaucccccuauuacuaccguaauguucuggcucugcuaucuguuaccuuuauaaccaauuaacaacaaccguuuaacugauacuuuguccuacucaacagcuuuucuucuuuuuuaaauauuuauuuauguguaugaguauacugccaccaucuucagacacaccaaaagagggcauuggaucccauuacagaugguugugagccaccaugugguugcugggaauugaacucaggaccucuggaagaguagcuggugcucuuaacugcugggccaucucuccagccccucaauagcuuuucuaagcuguguuuuacaauagcaacaggccuauuaacugcccaaaguauaaccuggguccuaucauaguguuccuaugagaagcaggggauuuuuauaauugacugguauugacuuuggguacacguccuuggcgcugauguagggaacgcaaaggaggaaaagaaagaagggaacuuagaaaacagagccaagaaaguuagugugagguuuguauaugcuuggccuagagugugacaccauuaggagguguggccuuguuggaguaggcaugucacuguccuugugggcuuuaagacccucauccuaauugccuuggggagucaauuuucuccuagggcauucagaugaagauguugaacucucagcuccuucugcaccacgccugccuggaugcugccauguuccugccuugacagugaauugaaccucugaaccuguaagccagccucaauuaaauguuguccuuauaagaguugccuugaucauggugucuguucacaacaauggaaacgcuaugacaauuaguuacaugaaaucacaaaugaacuggcaucaaguucacuguaccuguucaucccaguauuucaacacuuguaauacccaaggccagcuuaggcuauaaaauaagaugcuauuuagaaaaaaagaaaaaaaaaguaccaagagggccaaaugaaaggagaaaauuuaaagcuuuaauaacaguacggacguugucagguaacugggccaaaugauuuauaauguguuugcucguugaacacugcaaauaaucaugugaagcagguacuuggucagaugagcacacacugcuucacuuacaucacugaaauaaauacaaguuauuauauagcuacuuccucaucccggugcuuaaaccaggucacuaaguauucuuauauuggugucaacaauaucagagagcaucauauacaugccauuaguuugucauagacugacuguacuuaucuguacacgaguguauaagggauauguacauaacacaugcuacuuuagugcuaguagagagcucauuuggagggacccgaguuugaucccucguacagauaauuuuuuaaaaagccaggugugugaccugcauaaucccaggcuuuaggaggcagagaagguguaucccuugggcuuuauguccaaccagcuuaguugaacugguaaacuucaggccagugagagaucuugucucaaaaaccauagugaguaggcuccuuacaggagguguuccuuuggccuacauaugcauuugcacgcaugcacaaauaguauuuaaaaauuaccuacuuuccugcuauuuaaauguacaauagaacaguaaagguucacaguguuuuugucuuauaaaacucaaaaugaaaaagaauauguaaauguuuuauaaguacaauaacugacaaagaaaaauguagcuuauaccuauuucugucaucaccugcaaacagcaaggcuagauaggaaggacauuuucuaagauauuucuaugcuacuauguauucuaugagcccaggguaaucuacucaacaccauccuggaccacaaagaagacguaucugcagacccagcagcacuagggaagaaugacagcacagagcacaaggcaagcuuuauuagcuuuggcuggugagggguuauggugcauucuccagcagugagauacagaucuaaaugucucaaggcccuccuacucagaaagauacccaaguguaaccuggauucuuaaaugcauuuguuuucuuucuuucuuuuuuuuuuuuaaagauuuauuuauuuauuuauuuauuuauuauauguaaguacauuguagcugucuucagacacucagaagagggggucagauuuuguuacggaugguugugagccaccauguggaugcugggauuugaacucuggaccuucggaagagcagucgggugcucuaacccacugagccaucucaccagcccgcauuuguuuucaaagucaaggaagugcacugacuuuaaaccuugguaggcugugugcaucauucauucaccaauauuuacuaccagccucugugcuaaagcauuguauugcaguguuaaaggacuacugggacaggcagcugauacugccaugcccgguguauccuugcaguauacccagugagcuuuccuuuuaccaaaagaaaauguuuaaaacaacuuaguacaaaauauugaaaaacuaagacaauuauaacaaauugguaaauccuacaaauaaagcaauguuagccaucuauaaaucaccaauaagaaaguaccguuagagccaaugaucaguuacagcagaaaaaagagauguuuuaaaaauauuuuccagaaguuaaugaaguguaaagcaaaucugagugggacccaaggcucaagcuuuccuuucaccagcugagugugagcugugucucuccuccucagcuacuguuucucuggauggcuuuaugacaagaaaugcugucagaggauaccaucugaggacuuaaccaugucaagcucuucacaacacucacaagacuacuucaguuuauaaaggcuuggacaaagcucugaaucaucaguaaagaacuaugauaacuaauauuagaaccacucauuuauuuaccaaauaaguauaguucaaaacaaauguaaucuuuaaaauauccauccucaaaauaaccucccaacuauacaaugccugggguucuuaguaucagauagccaaccguuuguugacaaguagaacuaauccacacuuucacaaaauucuuuacguugcuacccuacuaaauguaccaaaccgaaaggaauuacaauucauaacaaaucuauauuuccucaacugacaaacuuaucucuagccucaaucucacgccuaaauuccacuuuaaacauugaaugaacugcccacuugaugcuaugaauucucaguuuagaaggcaucugagagcugauguucagaagcaagcucccgacugccuagcccagucucaaccugcccuuucccuccuuucccaacucagucaacagcagcuccacacuuccaacugcuuuggaaaccccuugggagucccuccugaauccccuuucaugccucacauacgauucaucagcagcucccgcccacacagggccuggaacacauccacacucugaccuuuucucacccuuuacuguuauuacccugguuccagccacucugccucucaucuggaucacuguagccauuuucaaugauuuuucaaccauuuucuuugcuuacaccuuuguucuauuuucauaaucuauuccacacacugcagaguaauguuuuaaaaaggaaguuaguuaccuguuuaaagaagacuauacaaucaguuaaugauguauacaaaguauuugacaucguccaagacccaacugcgauaaaaaauuuuaaucaacuagaacuagaaaggcaacugauaaacagcaccuacagaaaccauucagccaauagaucucucgagaucaaaaacugaauacauccugagaucugauaauagguagcaagagcuguaagacaagaaaagaaaaggcacacaaacugaaaaggaauuaaaauggacugggcucacaaguauacugaaaacucacagaaccuaucuaaacaguuucaaaagucucagaauacaauguguguccucagaaaucaacuauauugguguauguuaacaaugaacaauuaaaaggcaaaguuuaaaauauaauagccauuuacaacugcuuguaaggccuagguauaaaucuacaaaaauguguauaauauguaugcuguaaacuacaaaaaguagaggaaggaaauaaaaaacuaaguaaguagagaaagagacuauguucauggacugaauuaauaagaauguaaauuuucuucaaaacugaccuacaaguguaguauaauucccaccaaaaucccagugguacguuuuuaauaugaaaaagaaacagaauagccaaaacaauuaaaaacaauaaaguuagaaaaacuugacaauuuaucauguaguuacagcaaucaaaauaguguaauacuagugggaagggcagauccaaagaaaaaagaaaagaauagaaaauccagaaaugaacccuugccauuauagccaugugacuuuugucaaaguuguaaaagcaauucaauuuauucuuaaggcaaauauucaacccaaacaucagaccuuaauauaaaaauuaaaucaaaauagaugacacaucucuguaucauauucaaaacuuuuagaaaacuuuuauaauaggaaaaacaucuuugagaacagaugaguucugagaguuaacaaaaagguaaaauccauagaagauaaagugaguagagauaauagcuagacuucaccacaaaaacaaaaaaccuuccauguaaaagacgcugugaagaggcuagagacgucacacgcuaggagaaacucugcagaucgcuaaacaagaaacuugaucuagacggcauaaagaaucucuaagcucaguaaagaauguaaaacauguauagaaucuaggaccacaccacugaggauacaccaauagcaaagaagcacaugaaaacauauuuacauguauuagggaaauacaaauuaagcuacaaugagauauuaccuauuaggcuggcugagaugaaaaaauugacaauacuaagugcuggugaaaacacaaagaaaccagauucuuguacaguucuaagugcaauguaauuggcacaauaacccuggaaagccagcuagccagccagccagccaucuuuaacaagcaaccaucuuuacuuuuagaaacuaaagaaaacgaagcaugauuuggaaagagcguauaccaaacaguggucaaagaagaaucaccuauucuaugccuuuucuaauucccugauccaacaacuguuauauguaccaauaguucauuccuuguuagugcugaaacuauacaguuguuggauguacuaugguuuaaucauaugcuaaucugaaggauuuuggauucucuaaucuggggcuauaaaaauucggcugggaguugugugguauuucauacgaaaacucaauguuaaaagucuuaaugguugcuuccccccucacauucuuuguauccaguuuacuugccccuauaucuaucugagugcccucaucccauucacauauauaugccacaucucugaggccaaguaggaacauugauuuucuaugccauguugugacuaacauccaccauuuggcacacuucacugcccugaugaccauaucucauuguuagugagaauaauagugaccugcucacucaaguaacuauacaaaaucugacuacuuucaagaagcaaaaaaccuuuccaaucauuagucuuuucuguugaaauaggcaaggcgucuuuuguaaaaacgguacuucuguccagcaacacagaggaaaccucggaauccucugcuuccaugagagccaaacugacucaccacuucuaccugggugcacucacaugcacacccaacacaccacucacagcuuuauucucauuaugucaaacuggagaccccaaagugcugcacacuaaugaauguuuuaaaaaauuauaguacaucccaacaauauuaugcuuuuugguacuaacaaggaaugaauaccgauucauacaaccaucugcauggaucaaggguacuagagucaaaauaaaaagcuaauuucaaagguaacauaaugcaugguuccauuuaugcaacucuuagugauaaaacuaguauuguuggggaacaaauugguguuugucagggguuaagguugaaggaaacgguuagacuaugaaggaacaagacaagaguuuaaugaugauugaaaaguuuuacucugacaucagucuaacuaugaugacuaucuaaaucuauacacauuauaaaaaagauacacacacacacacaccaauuaauaaaccacggucuaagauguaaagaaaagcaaauuaaguuuuaucugaagacucuuguuggcuuccuaccucaucuuggguaaaaucuaaagucuaacuguaguuaaaagcccuacagggaauguacauacuuagguaucauuuccuauuuucccacugccucacucagguuccuaagguguuccagcuccuggaagauagcaaacaggcuucccaugcacaggauaccugcauucgcuacauguuguauuuggaaacccuuaccuguaucauuucauauucaaauaccugcucaaauacuacuuauacaaaaaucuguuuucuuccauguaaauaaaaaucaccccuuuuuucccccuacaaaggagucuuaaaacccuuacacaaaacucaaacaacuuccaaacuucauuguucccuuggucuguucuuagugaauguugucaggaucaccaggaucaauccaggaauaugugaucuuuaccucuacuucacacucaguuuucccuccucaaguccacuagcaaccccacucuucacuuucacagccugaauucugaucacuauccacucuaacacagcacuucccuaaagcauuuucuccacuguagccagucuucagaauguuaagcacuguguuccaucaguaacaagacaaagccuucuuuauagaguacacaaauaucuucauacucuguccucuuccuaguuuaccaucuuacaaaccauuagagcuuaauguaucaaggggcugggcagugguggauuucuggacagcacuugggaggcagaggcagguggauuucugaguccgaggacagccugggcuacagacugaguuccaggaaaagccaaggcuauacagaaaaacccugucucaaaaaaccaaaaauuauuaauuaauguaucauggaacuauaaacaauuuauagaccuuccuaccuccauauuaaggcauaccuuuuccuaugugaaaugaaaccucuacccucaaucuauguaucucuuccuugucuuucuaacucggagacuaggugcaaucucucucaugugagacucuuuaauugccuacugaaucaggcacucccucccauagauuccuaaagggcucugucuaacccggucauaguauuugucacauuucuucugcacacaucucuagaacaagaaugacguuuuaguaaucuggccauccccuucaccuaguaaguaccugaugcaaacaaagcaggaauccuaaacuacucagucauuaaaucaggaguugcaagacaacuauggguaacauacuuuuuaaaaaaaaguauaggacugagacaccauggaagagcuccaagauuucuuugcacaggugugaaacugaagcaaauaagcccggaagugucuucugguucuuuuaaucguaugacacuauaaacacauugaaauacugauuaguaccuaguuuuaguuauaagauuacuagcucaauuuucccauggcccagauaucuuucucuaaaaguacuucucguucuacuuccaaacugcaacaaugguauaagacggucauccuccaaaucuaugucacuguucaggaguggaaaaucucaugaaaagaaugaagaugucucacucaggccaaacaaucacuucagcuuaaaaaucuuucagugugcaaguauacucuuuuauguaagaaagcagaaucaccguauguggaagugggaauuuucuuuugaaauccccauuuccucuuauauuuauuuuuccauuuucugggaaaucaucaagaagauagcagacuagcacuuaauucgaguauaacugcuacaugccagucacagagugaauaccagcacuucccucacccuugguguacacacagaauauguuugugcuaagugguuuuauacugaacauguacucuguucugaauucuuuucccccugagacagagucuuauguauuccaagcuagacucaaacucaccagaaggcuaaggaugaccuugaacuccgguauccucucgccuccuccaccccaggacugggauuacagauauucuuuaaacaucuuuuuuuuuuaaucaaaacuguuugugacuguauugccuacuucucuauaacuauaucuauuuaugauaaacaccaauagaaaccuauaauccauaaauguuaguauaaaguaagaacaaagacacaagacaauaagaauaaaguagugcuggaaagaugauucccuuuaaagacuagaauuauaaccaaaaaaagaauauggaagcaaauguauauuuauccaagaggcuuuauguacaguugaguucuaaaaggcacaggauucauuuuccauuuuuggugcuacuucucauugacgccaacuaggauccagguagauacugugcuagguaauauaacaaacacagaaaauauagucacaguuacuauguaaaauaggcaauacaauauucauuuuggaagagacaucuuguguauacacccucacacacauaauacaaaauagagucuuuuaaaaaguuugaauaacaacaacuaaacuccagugguaacaguuaaucaacaguauuuacuauaucugaguaauaugaaauuagacucagaugauuuuaaagccagaucuuuuaaaauuaaaccucuaacacacugaaauuaauguacuuaauugcuacaacauagacugacaaucugacaaguuaacagauuaacucaaaagcagcauugucuccagugucugagaggaauuaagucaggugacuuaauuuucuacaccuguaaccucagcucauuagcauucuucaaugguuucucugccuaaaaaccucccugauuaguucugcaagaucaaacuguucagaugaaauuguuauuucuauuccaaaguauuuucucucacugguaaaucauaaaaaaucauccugcugaccagcaguaucuuuggaucacacaacuucacagacaggaagucaacaugguaugcucaauccugcuaacacuauaaaguuaacauuaacacauaaaaggucaaaugaaaagucguuaaugcaaauauauguguguaaaaugcuaacacucaauuaaacuaggaaguaagaauuuacuaaucaaaauuacucuauaauggacccauguccaugaauauuucucuuaauaaucagcauacaguucuaucuccuauuucuuuacauucuugccuuucuuuuuucucuccuccauugaccuucccaacucuacauuaguuauuagcuucugggacuuuaacuagaaggccuuaauuuagucacuucuuguuguuccuugaaagaaacaagaaggccauguucucuaauaaggcaaauaacagagcucauauuuuuacauuacuucugcucuccucugcuggaccugucugugaaucagacucuuuuccugaagccccgggagcucauuccacaguugauuagcagacgagcaacacagaaucacagacacucacugccacuucauuuauuccccaaguaagaccacagugugccaaaucuuaacagacaacaagugcauggaaugugagggcugucuuggcuguuuuuauacuauuggguauguuggugagugcacgcaccuaccaugguaugugugaggucugagacaacauggaggauuagguucuccuacugugguggaccauggacugaaacuuggcuugucaggcuuggcuauaggcaauuuuaccugccgagucaacucucaggcccagugaucgaaagauagaucgaucuaccuaccuaccuaccuaccuaccuuccuuccuuccuuccuuccuuccuuccuuccuuccuuccucccucccucccucccucccucccucccuuccuuccuuccucccuuccucccucccucccucucucccucuucccuuucuuucuuucuuucuuucuuucuuucuuccccucuuucuuucuuucuucuuucuuuuuuuguaauucaagaaauacuuuguguaaauggcucaaggauuuuuggccuguucaguuuuuaaacguuaggaacucuagaaucagcauucacuagguaaaggacagccugcgucaggagaaggcugaccaguguuaauguacagaggauggucacugcuaaagagagugcuggaucuuuccccuccugugcaaacaccauuauucuuaugucaggaaucgaagcaaauaacuggacuauuuaguucauaaagugagugcagaucaaccgucucaaagggauuaaauaagugaccuuuaaguuaguuaagcuauauaauuauacaugaauuauuuuucuguuuugccuuuaaaagcugcuauaucccacggggugugguagcacaugucugugaucccagguacuuugaaggcuggggcagaaguacaagcuaagaagucagucuggacaacuuggcuagaccuugucccaaaacaaagaaaagacuggugugcuaccuuaaugguagcccauugcuuagcaugcacugaguuugguucuccagacagaaggaguuacuauuaccccauuucauguucaugucaacagccuagcugcaaauauaauuaaucaauuucuuuagauuucuaggauucuuucucaaaaguuuugcuagacuuaaacaugaguuauaacauuuuccuaacaauuuaggcuaagcguaagauuagaagcucagccaggcuuauauaucuacaucacaucuuuagagaggcaggacugcagugagcucgaggcuagcuuaggguacauggcaaaccucuuccucaaaacaaagcaaaacucauacacucgaaaucugaagucuacuguaacccauaaccuuucagacacaagaguuuacuaacaaagaguagugguggagggcaugacagagcaugccuuuaauccuagcacucugguagcagaggcaggaagaucucuuguguguucgaagccgcaagauauaaguuuuugagaaccuaucucaaaaccacaaaaauaacagugguggaacaaaggacagccauuacaaaccacucagcaucuggccugcugaacuagcuccagaccaugcccuccccaacaugugaggaaggcagagaggaacggaagccaugcucugggaucuauccugaguccugaggagcucaauguagucaccucccagugguacaaagauuugcaauuugaaugguuauucuguuguuuuuuuucaaaaucucguucacaagcugcacauuuggccuuuguaaauguuuuccuuaauauuuugcaaaguguaugaaauacccuuguuuauacaguaugggagaaagucuaugugccauacaugcacugugcuacauaucucaagggucugcauaaacuggcauuuuauucaguuuuugcuguccauuucucaaaguguucagguucaguuuaucaagcuaaaugacaggcccacaaugcuccuucaccugaaagcuguaaugguccuccuguguuagacuagauaugacacaaaccaacucuccagaaagcgcccagugacacuauacuacaggcgaggcugcucuaaguagccaaaugaaauguggauuuaacaaugcccauacagugcugguagaacuugcugcaauuaccaacucagccauguuuauuuugcagagcuccagaaaggcagaaaacaaaaauggcacaaaguauacauacucuacugcucacaacuuguguuuaaauuuacuacuuuaucagcagaaaccuuagccaauuuauuuuacagauuagaaaacagguucagagaagcuaagaagucuuaacuggcucuaaaucaaguggcaaaguagaagguggccaaaacuaggauucaaacaagggugguaaauuccagaauuuucuacugagucacaaaguagcuuucuaaaguacuaacaauaggaaaucccuacuaauugaaauucuguaacaauuuguaauucugaagcacaaauacaauuuuguuuccaaguuauaaaggauauucuuagucuaagaaaaaaaugucacuggauaguucuauuuucugaaaucaagacugguacucgcugcagagcugaggucaaacaaugcccacugcucagccuccaugcuuucuuuccuuguguuuuccccagacacauuuuacucacucauuacaucucuaccuauaaacuauaugagaacaauuuugucuguguucaguguacuacaucuucaggauuuaggugucccagacacuacaagcagugcuuaauaaaaacuugagaagugaaugaaaacuugguaccccguagggauuugaugcucaguagcacggcucucauuccuaaccaggacacuauguguauaguaaaacuucugcaauggaacugcugauuaauaugagggagggcaaggacauaccuguaagcacugcauugaggucagcgcucaaaucaagaccccaucucaaacaaacaaacaaaaugaacagggucaauaaaauagucacauucagcaaaacuuuauuuaucaaacaccacugggagauagagauagggaucuacauaaaguuuugaauuaauguacuuuuaaacuggcaaaaccuaaaaaauaucuuacagaaaucuucaaacaucaacuugucagcuaacaauccucagagucaagaaaaucuaagugaaauauguaauucccucccauuuccuucaaaaaacaagacuaguguggguaaagcaccacuuguaauaaacaggcugcucugagaugaggauacucagaaaaugacagagucuuccccuuaauacuggccucuguuaccaagcucacagcugaguuuagugauuaaccaaagagaaugcacaguaccuagcaacuccgggaguacuuagggcuugccuuucugaguaaguguguauucuugacuuuuuaagggucagaauaauuuggacauaaaauuuuaaaauacuggcaaauacuuaggggaccauaagccagaggucaauaaugugaacauauauuuaauuuucauuuuauuucaguaucuccaaaucucuuacuaucugaauacaguguuaagugaagacacacacagcuugugagcacccaucaauagaaaaaaacucuccucaaugcaguccagcaguuacuuugcuauacuuggcagccaucuacuccccacacuuccauauuccugcaaacugcucauccaauccuuuacuagcaucuuccucggcacaccugucucuauuaucgcauaauccugauuuaaagaguucuuauuaaaagaaagacaacauaagucaaucaaaacaaaaagcauuacuucuguucucugaggcaugugauauaaugaaauguaaacguuacucuaugauuuauaaucuacauuauaaauauuuccaggaacuuuuaaaaauauaggaaggcaaaacuucuuuucuaaaguauccugauauucauaaaaauaagcauuuaguguguguguguguguguguguguguguguguguaacuucaggguuagaaaacccauccuacuggagcuuuacuaccgcaugccucauaaacaagcaaucucugcuauacuuuaugcuuaguucucaaaaugaagguggcucacugaaccaguucuuugggaauuuuccuuacauaaaagaggaauaaaacuuuuauuucugucaaggcacaaagccaaucauguuaagaccuuugccagagcauaaaacacucaguagggacauaauugggagucugggcagugcgcaccuaacuaugcagaauuugccucacuuaaauaggugugguaacuacacaucuuaccacagccuuggcuaaagguaagcaccucuuuccacagcugacuuaaagucugcucccugagaagcauugucauuugcaccguugaucauuucaucuacuuaugaauuauacaaacacagguucuauuaugagaggucacagagaacauuuugaauagugguauuucccaguguccuuuggaaaccauucuaacucagaaaaagcuaucugaugaaacaaaaagaaaguugaagcaauggcauauauucaguggcuaacauaauaauugccauauucaacuuucaguuugauucuuuaagccugaaaacauaaagcacucucuauuacacacugguguaggggcaagcagagguucugaaucacuggaauuuuuguucuauuuccugcuaauacacagauaguaccaccauucaacauauucauuccacacacguguuaaaagcugcagaagccuucguggacuaucuggauacuaacccaacucaugaaucugacauuuuuuccuaaggauuggaauuaaaguagcuagcuaaagcauauaguaaaagaaaaggcaacuguucauuuauuagaaauauguaugguuucaaaaagguuucaaguuguacaguuuuaaaaguaaucauggauucaccuuuacuaagacauuaaggaugcuucugaaaaggcaucaaaacucuugcuguaccaagugugguaaacagugauaacuaaaagccaaaaccaaaaccaaaaccaaaacaaacaaaaaaaccaaaaaaaaaaaaaaaaaaccaaaacaaaaaacaaacaacccucuuuuguacccagugaaauuccuagcaaaauuugaagcugcuucaugagcaacaucuccuuugaguaagcuaggacacaaagccauuccuuuuauaaaauggcaaucaaccuaacccuacgauuuggcacuuuacuaacuuacccagcacugacaaaauggaugcaaagcuagagugucuggcugcugccucgaauacugcauuuguguccaagaacuuuccaaugacuagaagcccauuuaccaacagccugcaaugcuuuugggaacccgaacuucacggagacucgaauaaaagcuccaggaggcugcaagucuccaccacucuccugaaaaccccucuuaucagaaacauuugaagaauuccuccauaacaauuaagcugacuugaauggaaacuuagcaucucaaauauacuauauauggaaugaaacuuggccaaacacguaaauacaaacucacacgcucccugacacuuucggccuacaauuaugagccaaggauucuacagcaucagcaacagacagauccaccugucaccugucagcaacacccagggacccuuguuaagucuuccucuuccaaccacuaucucggggcaagaaaaucagaguaguccuguggacucuaagggggccccaaccucuucacagcggggcgugcugcccauuuggaagaaggcugcagacaagcaaaaucggaaagcaaagcgagagaggugcuuccucuuuacccugcacuuaacuuccccggcucucccuuaacucgcgggccccgaagucaucguuauccagaccuggguucccccaaaggcgucugguucccucccucccacuuccagaucacaggccugggggcggaccgggggccaaggcacccccacccccggcucucuccggcgcugggcuccggggcaggcccggucccccucccccgacgccccggagcccaggccaggccccaggcuccccgcccccacccuccccgcaggacuuggggggccucccugcgccucgccaccgcgggcaggacccgggcggagcggcggacgaaggcgaggaaggcgcggacgccccgcuagggcuucgcgcgccaggcagagccgguccccgagccgcugcaggcgcggggagccgggcuggggguggggggggugggggguggggagggaucccgccgaggccccgcagcgccguccgcuuacccuucgccgccgccgcggcuucccccuccuccucguccgccgccgccgccucucccacuugggcagccgucucccccgucgucaccgcggccgccgccagcgccgauuccacccggcaggggggacaccucagcccucccucccuccccgcucggcccccuccgcccggccgccgccaacucccuccggccgccgccgccgcucgcggcugagggggaggggagggggucggccuggggcgccccgccgccggcgccugccgcggaucaaagcgauggccggggcggcgucgccgcggcccgcugcucggcuccggcucgcacggccgcccugccucccuccgcccccaccccccugccgcucgccugcccuccccccacccccccagcucucgcucgcucgcccgcucgcgccgcggcuccgccagccca

SEQ ID NO: 5413 - RNA, 50586 nt, Mus musculus
ugggcuggcggagccgcggcgcgagcgggcgagcgagcgagagcuggggggguggggggagggcaggcgagcggcaggggggugggggcggagggaggcagggcggccgugcgagccggagccgagcagcgggccgcggcgacgccgccccggccaucgcuuugauccgcggcaggcgccggcggcggggcgccccaggccgacccccuccccucccccucagccgcgagcggcggcggcggccggagggaguuggcggcggccgggcggagggggccgagcggggagggagggagggcugagguguccccccugccggguggaaucggcgcuggcggcggccgcggugacgacgggggagacggcugcccaagugggagaggcggcggcggcggacgaggaggagggggaagccgcggcggcggcgaaggguaagcggacggcgcugcggggccucggcgggaucccuccccaccccccaccccccccacccccagcccggcuccccgcgccugcagcggcucggggaccggcucugccuggcgcgcgaagcccuagcggggcguccgcgccuuccucgccuucguccgccgcuccgcccggguccugcccgcgguggcgaggcgcagggaggccccccaaguccugcggggagggugggggcggggagccuggggccuggccugggcuccggggcgucgggggagggggaccgggccugccccggagcccagcgccggagagagccgggggugggggugccuuggcccccgguccgcccccaggccugugaucuggaagugggagggagggaaccagacgccuuugggggaacccaggucuggauaacgaugacuucggggcccgcgaguuaagggagagccggggaaguuaagugcaggguaaagaggaagcaccucucucgcuuugcuuuccgauuuugcuugucugcagccuucuuccaaaugggcagcacgccccgcugugaagagguuggggcccccuuagaguccacaggacuacucugauuuucuugccccgagauagugguuggaagaggaagacuuaacaagggucccuggguguugcugacaggugacagguggaucugucuguugcugaugcuguagaauccuuggcucauaauuguaggccgaaagugucagggagcgugugaguuuguauuuacguguuuggccaaguuucauuccauauauaguauauuugagaugcuaaguuuccauucaagucagcuuaauuguuauggaggaauucuucaaauguuucugauaagagggguuuucaggagagugguggagacuugcagccuccuggagcuuuuauucgagucuccgugaaguucggguucccaaaagcauugcaggcuguugguaaaugggcuucuagucauuggaaaguucuuggacacaaaugcaguauucgaggcagcagccagacacucuagcuuugcauccauuuugucagugcuggguaaguuaguaaagugccaaaucguaggguuagguugauugccauuuuauaaaaggaauggcuuuguguccuagcuuacucaaaggagauguugcucaugaagcagcuucaaauuuugcuaggaauuucacuggguacaaaagaggguuguuuguuuuuuguuuugguuuuuuuuuuuuuuuuuugguuuuuuuguuuguuuugguuuugguuuugguuuuggcuuuuaguuaucacuguuuaccacacuugguacagcaagaguuuugaugccuuuucagaagcauccuuaaugucuuaguaaaggugaauccaugauuacuuuuaaaacuguacaacuugaaaccuuuuugaaaccauacauauuucuaauaaaugaacaguugccuuuucuuuuacuauaugcuuuagcuagcuacuuuaauuccaauccuuaggaaaaaaugucagauucaugaguuggguuaguauccagauaguccacgaaggcuucugcagcuuuuaacacguguguggaaugaauauguugaauggugguacuaucuguguauuagcaggaaauagaacaaaaauuccagugauucagaaccucugcuugccccuacaccaguguguaauagagagugcuuuauguuuucaggcuuaaagaaucaaacugaaaguugaauauggcaauuauuauguuagccacugaauauaugccauugcuucaacuuucuuuuuguuucaucagauagcuuuuucugaguuagaaugguuuccaaaggacacugggaaauaccacuauucaaaauguucucugugaccucucauaauagaaccuguguuuguauaauucauaaguagaugaaaugaucaacggugcaaaugacaaugcuucucagggagcagacuuuaagucagcuguggaaagaggugcuuaccuuuagccaaggcugugguaagauguguaguuaccacaccuauuuaagugaggcaaauucugcauaguuaggugcgcacugcccagacucccaauuaugucccuacugaguguuuuaugcucuggcaaaggucuuaacaugauuggcuuugugccuugacagaaauaaaaguuuuauuccucuuuuauguaaggaaaauucccaaagaacugguucagugagccaccuucauuuugagaacuaagcauaaaguauagcagagauugcuuguuuaugaggcaugcgguaguaaagcuccaguaggauggguuuucuaacccugaaguuacacacacacacacacacacacacacacacacacuaaaugcuuauuuuuaugaauaucaggauacuuuagaaaagaaguuuugccuuccuauauuuuuaaaaguuccuggaaauauuuauaauguagauuauaaaucauagaguaacguuuacauuucauuauaucacaugccucagagaacagaaguaaugcuuuuuguuuugauugacuuauguugucuuucuuuuaauaagaacucuuuaaaucaggauuaugcgauaauagagacaggugugccgaggaagaugcuaguaaaggauuggaugagcaguuugcaggaauauggaaguguggggaguagauggcugccaaguauagcaaaguaacugcuggacugcauugaggagaguuuuuuucuauugaugggugcucacaagcugugugugucuucacuuaacacuguauucagauaguaagagauuuggagauacugaaauaaaaugaaaauuaaauauauguucacauuauugaccucuggcuuaugguccccuaaguauuugccaguauuuuaaaauuuuauguccaaauuauucugacccuuaaaaagucaagaauacacacuuacucagaaaggcaagcccuaaguacucccggaguugcuagguacugugcauucucuuugguuaaucacuaaacucagcugugagcuugguaacagaggccaguauuaaggggaagacucugucauuuucugaguauccucaucucagagcagccuguuuauuacaaguggugcuuuacccacacuagucuuguuuuuugaaggaaaugggagggaauuacauauuucacuuagauuuucuugacucugaggauuguuagcugacaaguugauguuugaagauuucuguaagauauuuuuuagguuuugccaguuuaaaaguacauuaauucaaaacuuuauguagaucccuaucucuaucucccagugguguuugauaaauaaaguuuugcugaaugugacuauuuuauugacccuguucauuuuguuuguuuguuugagauggggucuugauuugagcgcugaccucaaugcagugcuuacagguauguccuugcccucccucauauuaaucagcaguuccauugcagaaguuuuacuauacacauaguguccugguuaggaaugagagccgugcuacugagcaucaaaucccuacgggguaccaaguuuucauucacuucucaaguuuuuauuaagcacugcuuguagugucugggacaccuaaauccugaagauguaguacacugaacacagacaaaauuguucucauauaguuuauagguagagauguaaugagugaguaaaaugugucuggggaaaacacaaggaaagaaagcauggaggcugagcagugggcauuguuugaccucagcucugcagcgaguaccagucuugauuucagaaaauagaacuauccagugacauuuuuuucuuagacuaagaauauccuuuauaacuuggaaacaaaauuguauuugugcuucagaauuacaaauuguuacagaauuucaauuaguagggauuuccuauuguuaguacuuuagaaagcuacuuugugacucaguagaaaauucuggaauuuaccacccuuguuugaauccuaguuuuggccaccuucuacuuugccacuugauuuagagccaguuaagacuucuuagcuucucugaaccuguuuucuaaucuguaaaauaaauuggcuaagguuucugcugauaaaguaguaaauuuaaacacaaguugugagcaguagaguauguauacuuugugccauuuuuguuuucugccuuucuggagcucugcaaaauaaacauggcugaguugguaauugcagcaaguucuaccagcacuguaugggcauuguuaaauccacauuucauuuggcuacuuagagcagccucgccuguaguauagugucacugggcgcuuucuggagaguugguuugugucauaucuagucuaacacaggaggaccauuacagcuuucaggugaaggagcauugugggccugucauuuagcuugauaaacugaaccugaacacuuugagaaauggacagcaaaaacugaauaaaaugccaguuuaugcagacccuugagauauguagcacagugcauguauggcacauagacuuucucccauacuguauaaacaaggguauuucauacacuuugcaaaauauuaaggaaaacauuuacaaaggccaaaugugcagcuugugaacgagauuuugaaaaaaaacaacagaauaaccauucaaauugcaaaucuuuguaccacugggaggugacuacauugagcuccucaggacucaggauagaucccagagcauggcuuccguuccucucugccuuccucacauguuggggagggcauggucuggagcuaguucagcaggccagaugcugagugguuuguaauggcuguccuuuguuccaccacuguuauuuuugugguuuugagauagguucucaaaaacuuauaucuugcggcuucgaacacacaagagaucuuccugccucugcuaccagagugcuaggauuaaaggcaugcucugucaugcccuccaccacuacucuuuguuaguaaacucuugugucugaaagguuauggguuacaguagacuucagauuucgaguguaugaguuuugcuuuguuuugaggaagagguuugccauguacccuaagcuagccucgagcucacugcaguccugccucucuaaagaugugauguagauauauaagccuggcugagcuucuaaucuuacgcuuagccuaaauuguuaggaaaauguuauaacucauguuuaagucuagcaaaacuuuugagaaagaauccuagaaaucuaaagaaauugauuaauuauauuugcagcuaggcuguugacaugaacaugaaaugggguaauaguaacuccuucugucuggagaaccaaacucagugcaugcuaagcaaugggcuaccauuaagguagcacaccagucuuuucuuuguuuugggacaaggucuagccaaguuguccagacugacuucuuagcuuguacuucugccccagccuucaaaguaccugggaucacagacaugugcuaccacaccccgugggauauagcagcuuuuaaaggcaaaacagaaaaauaauucauguauaauuauauagcuuaacuaacuuaaaggucacuuauuuaaucccuuugagacgguugaucugcacucacuuuaugaacuaaauaguccaguuauuugcuucgauuccugacauaagaauaaugguguuugcacaggaggggaaagauccagcacucucuuuagcagugaccauccucuguacauuaacacuggucagccuucuccugacgcaggcuguccuuuaccuagugaaugcugauucuagaguuccuaacguuuaaaaacugaacaggccaaaaauccuugagccauuuacacaaaguauuucuugaauuacaaaaaaagaaagaagaaagaaagaaagaggggaagaaagaaagaaagaaagaaagaaagaaagggaagagggagagagggagggagggaggaagggaggaaggaaggaagggagggagggagggagggagggagggaggaaggaaggaaggaaggaaggaaggaaggaaggaaggaagguagguagguagguagguagguagaucgaucuaucuuucgaucacugggccugagaguugacucggcagguaaaauugccuauagccaagccugacaagccaaguuucaguccaugguccaccacaguaggagaaccuaauccuccauguugucucagaccucacacauaccaugguaggugcgugcacucaccaacauacccaauaguauaaaaacagccaagacagcccucacauuccaugcacuuguugucuguuaagauuuggcacacuguggucuuacuuggggaauaaaugaaguggcagugagugucugugauucuguguugcucgucugcuaaucaacuguggaaugagcucccggggcuucaggaaaagagucugauucacagacagguccagcagaggagagcagaaguaauguaaaaauaugagcucuguuauuugccuuauuagagaacauggccuucuuguuucuuucaaggaacaacaagaagugacuaaauuaaggccuucuaguuaaagucccagaagcuaauaacuaauguagaguugggaaggucaauggaggagagaaaaaagaaaggcaagaauguaaagaaauaggagauagaacuguaugcugauuauuaagagaaauauucauggacauggguccauuauagaguaauuuugauuaguaaauucuuacuuccuaguuuaauugaguguuagcauuuuacacacauauauuugcauuaacgacuuuucauuugaccuuuuauguguuaauguuaacuuuauaguguuagcaggauugagcauaccauguugacuuccugucugugaaguugugugauccaaagauacugcuggucagcaggaugauuuuuuaugauuuaccagugagagaaaauacuuuggaauagaaauaacaauuucaucugaacaguuugaucuugcagaacuaaucagggagguuuuuaggcagagaaaccauugaagaaugcuaaugagcugagguuacagguguagaaaauuaagucaccugacuuaauuccucucagacacuggagacaaugcugcuuuugaguuaaucuguuaacuugucagauugucagucuauguuguagcaauuaaguacauuaauuucaguguguuagagguuuaauuuuaaaagaucuggcuuuaaaaucaucugagucuaauuucauauuacucagauauaguaaauacuguugauuaacuguuaccacuggaguuuaguuguuguuauucaaacuuuuuaaaagacucuauuuuguauuaugugugugaggguguauacacaagaugucucuuccaaaaugaauauuguauugccuauuuuacauaguaacugugacuauauuuucuguguuuguuauauuaccuagcacaguaucuaccuggauccuaguuggcgucaaugagaaguagcaccaaaaauggaaaaugaauccugugccuuuuagaacucaacuguacauaaagccucuuggauaaauauacauuugcuuccauauucuuuuuuugguuauaauucuagucuuuaaagggaaucaucuuuccagcacuacuuuauucuuauugucuugugucuuuguucuuacuuuauacuaacauuuauggauuauagguuucuauugguguuuaucauaaauagauauaguuauagagaaguaggcaauacagucacaaacaguuuugauuaaaaaaaaaagauguuuaaagaauaucuguaaucccaguccugggguggaggaggcgagaggauaccggaguucaaggucauccuuagccuucuggugaguuugagucuagcuuggaauacauaagacucugucucagggggaaaagaauucagaacagaguacauguucaguauaaaaccacuuagcacaaacauauucuguguguacaccaagggugagggaagugcugguauucacucugugacuggcauguagcaguuauacucgaauuaagugcuagucugcuaucuucuugaugauuucccagaaaauggaaaaauaaauauaagaggaaauggggauuucaaaagaaaauucccacuuccacauacggugauucugcuuucuuacauaaaagaguauacuugcacacugaaagauuuuuaagcugaagugauuguuuggccugagugagacaucuucauucuuuucaugagauuuuccacuccugaacagugacauagauuuggaggaugaccgucuuauaccauuguugcaguuuggaaguagaacgagaaguacuuuuagagaaagauaucugggccaugggaaaauugagcuaguaaucuuauaacuaaaacuagguacuaaucaguauuucaauguguuuauagugucauacgauuaaaagaaccagaagacacuuccgggcuuauuugcuucaguuucacaccugugcaaagaaaucuuggagcucuuccauggugucucaguccuauacuuuuuuuuaaaaaguauguuacccauaguugucuugcaacuccugauuuaaugacugaguaguuuaggauuccugcuuuguuugcaucagguacuuacuaggugaaggggauggccagauuacuaaaacgucauucuuguucuagagaugugugcagaagaaaugugacaaauacuaugaccggguuagacagagcccuuuaggaaucuaugggagggagugccugauucaguaggcaauuaaagagucucacaugagagagauugcaccuagucuccgaguuagaaagacaaggaagagauacauagauugaggguagagguuucauuucacauaggaaaagguaugccuuaauauggagguaggaaggucuauaaauuguuuauaguuccaugauacauuaauuaauaauuuuugguuuuuugagacaggguuuuucuguauagccuuggcuuuuccuggaacucagucuguagcccaggcuguccucggacucagaaauccaccugccucugccucccaagugcuguccagaaauccaccacugcccagccccuugauacauuaagcucuaaugguuuguaagaugguaaacuaggaagaggacagaguaugaagauauuuguguacucuauaaagaaggcuuugucuuguuacugauggaacacagugcuuaacauucugaagacuggcuacaguggagaaaaugcuuuagggaagugcuguguuagaguggauagugaucagaauucaggcugugaaagugaagagugggguugcuaguggacuugaggagggaaaacugagugugaaguagagguaaagaucacauauuccuggauugauccuggugauccugacaacauucacuaagaacagaccaagggaacaaugaaguuuggaaguuguuugaguuuuguguaaggguuuuaagacuccuuuguagggggaaaaaaggggugauuuuuauuuacauggaagaaaacagauuuuuguauaaguaguauuugagcagguauuugaauaugaaaugauacagguaaggguuuccaaauacaacauguagcgaaugcagguauccugugcaugggaagccuguuugcuaucuuccaggagcuggaacaccuuaggaaccugagugaggcagugggaaaauaggaaaugauaccuaaguauguacauucccuguagggcuuuuaacuacaguuagacuuuagauuuuacccaagaugagguaggaagccaacaagagucuucagauaaaacuuaauuugcuuuucuuuacaucuuagaccgugguuuauuaauugguguguguguguguguaucuuuuuuauaauguguauagauuuagauagucaucauaguuagacugaugucagaguaaaacuuuucaaucaucauuaaacucuugucuuguuccuucauagucuaaccguuuccuucaaccuuaaccccugacaaacaccaauuuguuccccaacaauacuaguuuuaucacuaagaguugcauaaauggaaccaugcauuauguuaccuuugaaauuagcuuuuuauuuugacucuaguacccuugauccaugcagaugguuguaugaaucgguauucauuccuuguuaguaccaaaaagcauaauauuguugggauguacuauaauuuuuuaaaacauucauuagugugcagcacuuuggggucuccaguuugacauaaugagaauaaagcugugagugguguguugggugugcaugugagugcacccagguagaaguggugagucaguuuggcucucauggaagcagaggauuccgagguuuccucuguguugcuggacagaaguaccguuuuuacaaaagacgccuugccuauuucaacagaaaagacuaaugauuggaaagguuuuuugcuucuugaaaguagucagauuuuguauaguuacuugagugagcaggucacuauuauucucacuaacaaugagauauggucaucagggcagugaagugugccaaaugguggauguuagucacaacauggcauagaaaaucaauguuccuacuuggccucagagauguggcauauauaugugaaugggaugagggcacucagauagauauaggggcaaguaaacuggauacaaagaaugugaggggggaagcaaccauuaagacuuuuaacauugaguuuucguaugaaauaccacacaacucccagccgaauuuuuauagccccagauuagagaauccaaaauccuucagauuagcauaugauuaaaccauaguacauccaacaacuguauaguuucagcacuaacaaggaaugaacuauugguacauauaacaguuguuggaucagggaauuagaaaaggcauagaauaggugauucuucuuugaccacuguuugguauacgcucuuuccaaaucaugcuucguuuucuuuaguuucuaaaaguaaagaugguugcuuguuaaagauggcuggcuggcuggcuagcuggcuuuccaggguuauugugccaauuacauugcacuuagaacuguacaagaaucugguuucuuuguguuuucaccagcacuuaguauugucaauuuuuucaucucagccagccuaauagguaauaucucauuguagcuuaauuuguauuucccuaauacauguaaauauguuuucaugugcuucuuugcuauugguguauccucaguggugugguccuagauucuauacauguuuuacauucuuuacugagcuuagagauucuuuaugccgucuagaucaaguuucuuguuuagcgaucugcagaguuucuccuagcgugugacgucucuagccucuucacagcgucuuuuacauggaagguuuuuuguuuuuguggugaagucuagcuauuaucucuacucacuuuaucuucuauggauuuuaccuuuuuguuaacucucagaacucaucuguucucaaagauguuuuuccuauuauaaaaguuuucuaaaaguuuugaauaugauacagagaugugucaucuauuuugauuuaauuuuuauauuaaggucugauguuuggguugaauauuugccuuaagaauaaauugaauugcuuuuacaacuuugacaaaagucacauggcuauaauggcaaggguucauuucuggauuuucuauucuuuucuuuuuucuuuggaucugcccuucccacuaguauuacacuauuuugauugcuguaacuacaugauaaauugucaaguuuuucuaacuuuauuguuuuuaauuguuuuggcuauucuguuucuuuuucauauuaaaaacguaccacugggauuuuggugggaauuauacuacacuuguaggucaguuuugaagaaaauuuacauucuuauuaauucaguccaugaacauagucucuuucucuacuuacuuaguuuuuuauuuccuuccucuacuuuuuguaguuuacagcauacauauuauacacauuuuuguagauuuauaccuaggccuuacaagcaguuguaaauggcuauuauauuuuaaacuuugccuuuuaauuguucauuguuaacauacaccaauauaguugauuucugaggacacacauuguauucugagacuuuugaaacuguuuagauagguucugugaguuuucaguauacuugugagcccaguccauuuuaauuccuuuucaguuugugugccuuuucuuuucuugucuuacagcucuugcuaccuauuaucagaucucaggauguauucaguuuuugaucucgagagaucuauuggcugaaugguuucuguaggugcuguuuaucaguugccuuucuaguucuaguugauuaaaauuuuuuaucgcaguugggucuuggacgaugucaaauacuuuguauacaucauuaacugauuguauagucuucuuuaaacagguaacuaacuuccuuuuuaaaacauuacucugcaguguguggaauagauuaugaaaauagaacaaagguguaagcaaagaaaaugguugaaaaaucauugaaaauggcuacagugauccagaugagaggcagaguggcuggaaccaggguaauaacaguaaagggugagaaaaggucagaguguggauguguuccaggcccugugugggcgggagcugcugaugaaucguaugugaggcaugaaaggggauucaggagggacucccaagggguuuccaaagcaguuggaaguguggagcugcuguugacugaguugggaaaggagggaaagggcagguugagacugggcuaggcagucgggagcuugcuucugaacaucagcucucagaugccuucuaaacugagaauucauagcaucaagugggcaguucauucaauguuuaaaguggaauuuaggcgugagauugaggcuagagauaaguuugucaguugaggaaauauagauuuguuaugaauuguaauuccuuucgguuugguacauuuaguaggguagcaacguaaagaauuuugugaaaguguggauuaguucuacuugucaacaaacgguuggcuaucugauacuaagaaccccaggcauuguauaguugggagguuauuuugaggauggauauuuuaaagauuacauuuguuuugaacuauacuuauuugguaaauaaaugagugguucuaauauuaguuaucauaguucuuuacugaugauucagagcuuuguccaagccuuuauaaacugaaguagucuugugaguguugugaagagcuugacaugguuaaguccucagaugguauccucugacagcauuucuugucauaaagccauccagagaaacaguagcugaggaggagagacacagcucacacucagcuggugaaaggaaagcuugagccuugggucccacucagauuugcuuuacacuucauuaacuucuggaaaauauuuuuaaaacaucucuuuuuucugcuguaacugaucauuggcucuaacgguacuuucuuauuggugauuuauagauggcuaacauugcuuuauuuguaggauuuaccaauuuguuauaauugucuuaguuuuucaauauuuuguacuaaguuguuuuaaacauuuucuuuugguaaaaggaaagcucacuggguauacugcaaggauacaccgggcauggcaguaucagcugccugucccaguaguccuuuaacacugcaauacaaugcuuuagcacagaggcugguaguaaauauuggugaaugaaugaugcacacagccuaccaagguuuaaagucagugcacuuccuugacuuugaaaacaaaugcgggcuggugagauggcucaguggguuagagcacccgacugcucuuccgaagguccagaguucaaaucccagcauccacaugguggcucacaaccauccguaacaaaaucugacccccucuucugagugucugaagacagcuacaauguacuuacauauaauaaauaaauaaauaaauaaauaaaucuuuaaaaaaaaaaaagaaagaaagaaaacaaaugcauuuaagaauccagguuacacuuggguaucuuucugaguaggagggccuugagacauuuagaucuguaucucacugcuggagaaugcaccauaaccccucaccagccaaagcuaauaaagcuugccuugugcucugugcugucauucuucccuagugcugcugggucugcagauacgucuucuuugugguccaggaugguguugaguagauuacccugggcucauagaauacauaguagcauagaaauaucuuagaaaauguccuuccuaucuagccuugcuguuugcaggugaugacagaaauagguauaagcuacauuuuucuuugucaguuauuguacuuauaaaacauuuacauauucuuuuucauuuugaguuuuauaagacaaaaacacugugaaccuuuacuguucuauuguacauuuaaauagcaggaaaguagguaauuuuuaaauacuauuugugcaugcgugcaaaugcauauguaggccaaaggaacaccuccuguaaggagccuacucacuaugguuuuugagacaagaucucucacuggccugaaguuuaccaguucaacuaagcugguuggacauaaagcccaagggauacaccuucucugccuccuaaagccugggauuaugcaggucacacaccuggcuuuuuaaaaaauuaucuguacgagggaucaaacucgggucccuccaaaugagcucucuacuagcacuaaaguagcauguguuauguacauaucccuuauacacucguguacagauaaguacagucagucuaugacaaacuaauggcauguauaugaugcucucugauauuguugacaccaauauaagaauacuuagugaccugguuuaagcaccgggaugaggaaguagcuauauaauaacuuguauuuauuucagugauguaagugaagcagugugugcucaucugaccaaguaccugcuucacaugauuauuugcaguguucaacgagcaaacacauuauaaaucauuuggcccaguuaccugacaacguccguacuguuauuaaagcuuuaaauuuucuccuuucauuuggcccucuugguacuuuuuuuuucuuuuuuucuaaauagcaucuuauuuuauagccuaagcuggccuuggguauuacaaguguugaaauacugggaugaacagguacagugaacuugaugccaguucauuugugauuucauguaacuaauugucauagcguuuccauuguugugaacagacaccaugaucaaggcaacucuuauaaggacaacauuuaauugaggcuggcuuacagguucagagguucaauucacugucaaggcaggaacauggcagcauccaggcaggcguggugcagaaggagcugagaguucaacaucuucaucugaaugcccuaggagaaaauugacuccccaaggcaauuaggaugagggucuuaaagcccacaaggacagugacaugccuacuccaacaaggccacaccuccuaauggugucacacucuaggccaagcauauacaaaccucacacuaacuuucuuggcucuguuuucuaaguucccuucuuucuuuuccuccuuugcguucccuacaucagcgccaaggacguguacccaaagucaauaccagucaauuauaaaaauccccugcuucucauaggaacacuaugauaggacccagguuauacuuugggcaguuaauaggccuguugcuauuguaaaacacagcuuagaaaagcuauugaggggcuggagagauggcccagcaguuaagagcaccagcuacucuuccagagguccugaguucaauucccagcaaccacaugguggcucacaaccaucuguaaugggauccaaugcccucuuuuggugugucugaagaugguggcaguauacucauacacauaaauaaauauuuaaaaaagaagaaaagcuguugaguaggacaaaguaucaguuaaacgguuguuguuaauugguuauaaagguaacagauagcagagccagaacauuacgguaguaauagggggaugaaugcaagaaagcuuggugguagugaucagugauacuugaguguguuaagauaggaaagguucuuggcuucagggccacgcugcuugcaaugcauuauuggguaggagucagugaguugaguuuuggucgguuguucuguuaaagcugguaguguguguguguugucagggugcugguuuacuuguuucagacccaccuuucucucccucccucacugucucaauuccauugcuguaaucuaagagcuucccuuuaggaaaaaguauguucuuucuagucauagccaccagcagagcuuauuauguguggagaacagucccuuauuuccuacccucauuccuguucuccgcuugaggucuucucugaccugugugaagaauacuuagagauaugccagugccgugacugucaucucaccccaccuccaggccauggauagauugguuuuuuuaauaugugaaauaaaguuguuagagcuaguuacagaaaacugcaaccacaugcuguguuuacaauccaaauaguaaucaguaaauaggacaucauucaucuccuaucaccagguaaaauuacuugcguaaaguaauuaaaacaaccuucaaauuuguauuuaugaauuuuauauauagauuuaaaacuacaccauguauguuauauauuaauaauauguuaauacuauauuaacuuauauuaauaaguuauauaauaauauuauuaauaaguuguauaauauuauuauaauuaauuauaauuauaauuaauauauuaauauaauaauauuauuaauauauuaacuuauauuaauaaguguauguuuuaguuccaagucuauuucuuuauauuucauauguuucaugacguucagaaauagggaaccuuaugcacauauacccacuuugcauacuaaaccuuuuuguagaagacaaaaguguuuguuuuauagcuucagaaugagucaaaauccagguucuaauccaaggccugccacuaagcuauguaagaaacuuaguccauagagucuagguguguguuguagauacuuugaaaugaaguauuuuguuucuacuuuuaagguauuccuucccuaauuuacuaauuuaauuaauaaauucaugaaauuucuuacagcucaguaaauaaguucauggauuuccccccacccccacccccccagacaggguuucucugaauagcccuggcugcccuggaacucacuuuguagaccaggcuagccucgaacucagaaauccgccugccucugccucucgagugcugggaucaaaggcaugcgccaccacgcccggcuucauggauucuuaaugagcaucuagguucucauugggguuuuagauaauccauuuuagcugcugucuuagggguuuacugcugugaagagacacugugaccaaggcaacuuuuauaaggacaacauuuaauuggggcugacuuacagguucagagguucaguccauuaucaaggcaggagcauggcagcauccaggcaggcaugguguaggaggagcugaaaguucuacaucuucaucugaagacugcuagaagacuggcuuccaggcugcuaggaucagggucuuaaagcccauacccacugugacauacuuccuccaacaaggccacaccucuaaauagggccacauccuaacucaagcauauucaaaccacaucaacuaguggaauuuugguuuucccaauguauuuucugguauuugaaauugcaaaacaaagucuaauguuugauuuauuaagaacauuuuaguuauuuuguacaccuuaugugucaauauugcauauaggcaauguucuauauuuaagcacauaguccaugucaccaaaaauauagagcaguacaaggauggcgaugacuugugguguuuauuaguccacaggagcauuaguaguucugagugucgccgugaggacggaagcaggggagaagaauucaagaagaaggucaaacuaagguugauuuugaagaaguaguuuuagcaugugucaaaaguggagagauugcauucuaagcaagaucauugcucacugagggaagaaaagggguuugaauauguucagaaagccggaauggauuucuacagauacagggacugaugggaaguaaaaguagaucaguuuuaagaaaacaaguaauaauaauaaaugcuggcaaggcuuugagcaaaaggaaagucacauguauacugcugaugggagggugagguaguccagcaacugugagaaucaauaugaacaccucucaaagaccgaaaaauagaucuaucaugucacgcacccaaaccaggccuccaagucaagucacagagguacagcagaggaauggauaaagaaaaugugguguauggacacagauagaaugcuuuccacucagaagagcaaaguagaugaaagugaaugaagccagucucagaaagacaaaaaccauauacauucucacuuucaguugcuagaugugauaaaaauauguaaaaccauguauuuguauauaacccugauauaaagcuauagugggagcaaagaggacuaauggagagggaaaggaagaagauagaagacuggaaugugcccggaguugagaaugcacuuguguaaaaaugcccuucuaagaacagggccauggaugaugacuauacacaagaauauuuuuuuugaaacuuaaauauuuaaaguaaguagauuuagcaguagguaaauaauggcacaggugguagaaugcuuaccgagcaugccuaaggccccaagcucagcaaaacauaagccaugcauggugauucagcacaccuguaguuaugccacuggggaaguggaagcaagagggccaaccacccagcgaguuugaggccaacuuagaguauaugagacucugccuuuuuuuuuaaagguacauuuaauagauuuuaaucuaaauugcaugacccuaaagauaccuaagguuaggauuugaaggagaggugcacacagaagggaaaggguuaggguuuuacacagcagagcacagcagugucagcaguuccucuuuaagguaacuaacugugcuguuucacuaccacguuucccuauaauugucuaucuucugcuuuuacaaccuuguuuuuucuuauugaccgaucuccuccucaucucugguguagucacuguucucaauuucaauccauauuuggaugugucacauugaaccugacaaauuacauuuucaaaauaacauaaucgucguuauuuuaugcauucaaaaccaaaagcuagagaggaaaucuguagcuuucuugaccucugauguagagacccaaacuggagaaggcaaacuggaauggauuuuagugggaguggcaagcaggaaaggagccugaauauuguuucuuauuuguguuguuucaguucuuacgcugcugcuguaauuucuucugugcucauuggcuuccuacuagcuaggcuaaaauguagagggcaguuugaauaaguugcuuuaugaauuaguacuugcugaaucccuuucagacuuaacuggcaacuuugguguaugcacguggcaguguguuuaagaugacuaagacuucuauauguucuuaguuaaagggaaauccugaaaagggagagagggagggagaaaaggaaguaugaaagggucuggacucacaaaacgaaaggucuaaacuuaaacacucccuacacagaguaaccagaccuuggagauuuuaaacauugaauuuuuuuuuuuuuuuugaacuucaagcaucagguaacuauuucacaacauaagagaggaaaagguaaacuuugagguucuuucuacagagccaaacauaccaugauaguaaaauagaauaaaagacuacagaccagucucaggaaaguuggugaaaaacaaugcuuaauuaaucaaguggucuccauauaauaauauuguagaugaauuaguguuaggugaacacagguguggaaaaucuaaaggauaucaaaaaguggaagaggggaauuucaaguuauuuuuaaaaagaagaauauagcgauauuccuaaguguucacaucucagaccagaaaccaccauuuugguacaagaaaaugguaagaugcuagaauucccauuuuaguauuuaggaaaaugccaaguuccuauuaagaagucauaaaucaaagccuauugggauguugccuauaacugcauaggaggcugaggcaaaaggagaccuggcugcauaaugagaccuaccugccauccucccuagccccaacaucacuguuagauaacguuguccuggagaugcuccauaauacaguuagaccaaaaguaaauacguaaguaaagccaggcgugaucgaaagggaggagacaggucuacuauucucuaauacuuuauacauggaaaacagccaagaagacaagcugaaauguuacugugaguaaugagauuucaauaugauagcuaauuauaaaauuauauugauuuaucuacagugcuuucccuccuugguagucuuuaaaguagugaaaggucuccaaaagaguuagugacagggaaucucucaugacuuuuuuuuuuuucccuuugugaggaauauacagauaaaauccuaucugagugauauacuuccaugucaaguuuuuaaaacuauuuugaaagaaaguugugguaugaauacauuuuaaguaacuguaaagaaauguuuuucuuaaauuccuuguggcuugugacacuugcuuuauacuugguaaauggcagaggaguuguaaucugaucuuagagccauauuugguaaauaauaauuuuguguggaacccacuauucuaccaguaagagggaaauuauuacccauaugugguagaaggcuauuuucuuuaacuguauaaaaaucaagcuauaucauggauuaauuacuuuccuggguuuguuguuguuguuguuuuaaguucugcauccuagagcuagguucuaacaaaucuauuggcacaccuauuuucuacuuuacuggaagaggggaaaaaucuuguuuucuaccaacuaucuuuauauccuuaauguaaauuguuacaucauuguuuaucuucagcugugagaauugagcugucucauauauucuuucuuguaguuauucugaagccaguguugauaaaucacuuucaucucuaagaaugggacgcacuuuuauuacaucuaaagcuuauuaaacauggcucuugcuuuagaauuuaugaaaaugaaagcuuaaguuuaccucaauguucagagcagaaauaaagcaaauagaaaagaauguguuucauuuuuuagugaugcaaaacaauguauuggaaacuuaauaugcagcaggcuuugggugcuuccuguacacaaugaaacuuaaggcagcccaguggaaugguagccaguugucugccauuugguagaacaggaauuuugggcugggaaaauuuuuauucaaggccauauugaagugagaguugaaccaaggucccugucuucuagggugcuuuucucuauaacauaccaucacaaaacauggaaagcuuguauuucccaccaggagugggaaaguauuuuuuacuguguuuuuucuagauugguuuguacgagaacugcaaaggguuuauuuguucaaccuuuaccuguguccacucacuauuucaucuuuguccauuacaguccucauguuugauagaacagauacucaguugaccuagugugggauucucuucuuagaggaacucuaaaggggccagccuacugagaaucaagugcaaggacaucauuccuggucccuaaaacuuaacuaguacauugacuaccacuuuuaauagccuacuguuugucuaaccucuagaguuaccagcuuguuuuuguuuuaauaugggccuaggaaauauuuuuuuacaaaugacugucuugguaacagaaaagcaguuuuuaauugguuaagaaaugcaucuuaugaccuguuaucugccauccccuuuaagcauuggaacuugagccagugccuuuaaucccagccuucuuccagagacaggcggauaucugaguucgaggccagccuaauuuacagaguuccaggacagccagggcuacauagagaaacccugucuuaacaaaagaaaguuggaacuugaaauucauuucauugcuugaauauaucuaaaauauuuucacagaagugucaggccuugggaaauaggagagcaguuaaaagauaacaggagacacaauauugagagggaagaguaaauaaccugaaaaugaagaauuuauaauuccaaguuuaucagucacaauaggucuuguagcuuuucuguuacaguuugcacugauuucaggcacaggcuaguguuguaaccauuggagauuuccuaaaggcuccuuccuacuucccaggauggggaauugugaggcuuggggcaagugaagacugucuacugaagcaaaucgcuuucccuggcagcugugucaaagaagcuuuuuccuaccugaauguucuuuuugaggcuguaggacugcugcuuucagaccucacguugucugcuccacaguucuaauucugccuaccucuggguuuacuguaguuucucuucuacuuucaaggcuccagacccaguuccuggaccugcucuggaaaagaaguauccaguagagaugagcucacugcaguuacuuaguuaaacauuuguaaacugcaaaugagccauccaaggacagcuacaguuugaauuuuucuauuuccagguaugcaaaacuuggggcacucaagcuuaggcugugugauccauaacaacacacagugcacaacuucuaguucccugcuuuaacccgaguggcauggucaccucccuuacaucuccuaacacauggcgagcauuaacuuguacauuaccuuuugccugaugagucuuucuaguuuacuuuguuugcuaguaguagcaaacuacugcagaagcaguuaagagaaaugauguggaagugcuacagagucaaguccugcaaaugugcaaaauaguacccuggacuccauugaaaaguaagcauaaaacaacuguccuucuccagaguucaugugugagucaaguacuauuggggacuacgugaguguccuuaacuguucuguuucuucuauguucacaugaaguuaacacauuuuccaguuauuugaaaugauaggguuuguuguuuauagauaaaacaaaauucuguauuuacaugguauauuuaccugaauucaauuguauuucaauuaacuugcauauauaugcaauauacauuacuugauugcuuaaaagaagccauaacaaaauguuuaauauacauggacucugcaucuugauauuuuccaucaguuucuuauauguaguaauuuggaugucuuacuacacuaagaaaaagacucauaauuuuccuuaauauagcaaugcaauaguuuauuucuccuugaaggugauuguuguuuggcgugaaggggaagggcauugagauggcucuguaguuaaagacaggcccuugucaccaaauaguacaagaccaccacaugugaauaaauuaauauucaacuuaauuauuauuuucauaugucagguuaacucauuacuuauaaaugcuuauaguuaugcucuaagacuagaacaugaguuuuucuaacauucugguuuucauuucucuuguuaccuauaaauaaggauuuauuaacauuuauuaacaucccuguuuucuuuuagaaauauuuauguucaggauacauuaucugaaaaauuaagugaaagaaggcaguggaaaguaaauuuguuuccauaguaaaaugcuagcguguuggaaaaauaauaagauaugaaguggaaauaugcacaagguagucaauuauauaauauguuugucucagauuuauugcacuuuccuuaauccauagaaaauggcagcacccaccacaaaaccacaaaacgucaauugccaaccguggcugaccugcacauuccuucaagaacuuguacagggggaggcagaaucagugucagcauucguguccuuaaggcacuguacuacgugaaggaauugggauggguuuuuguuugcuugguugguuuugguuuuucaagauagaguuugucaauguaacccucagacuguuccuggaaaacuuacuuuguagauuaggcuagccucaaacucagaucuaucugccuuccucugccucccaaguaaugggauuauaggaaggcuucuuuuuaaaaagggaaggcguaaaucacacuaugacuguuaauguauauggcuuuucuuuagaaaguuaauuguucucagccugcaaagcugucugguuuauauaaugcuuacucacuugcucacuucacguuacuacguguauuagguuagaccauaauggcuaccguaaaaucauuuagcauuugaauagcugguuugcuauauuauugucuuggcaguuaauuugauuuugcagugugauuccauauuauaaauucuaugacagagucagugcugaagauugguuauaaucuuauguucauauuuuguugguuuuguuuucauuaagacaggucucucuagauagcccugguuguccuagagcacuacauaaaccaggcugcccucaaacucacuucauuugucucugccucccaagggcuaaaauuaacagcauucacuaccaggucuggcaauucuuauuuuuauuuuaaaugguaauaguacuuaaauuucagauuuuuuuuauugaauggcuauaauucuuuuauuucuaucauagaaaaauaauacugacagauauguuuagaucaucuuguuaaaauuguaacaucauacuucaagaaaucgaauuccaguaauuuauuagaaaaauuguguugauggcuuguguaugguggcacuccacuuuaguccaaggucucuagaggcagaggcagauggaaugaguugauggucuauacaaagaauuccaggccagcuagggugacauaguaacacccugucugaauaagaggaggaaaagaaaaauacugacuuuuuuaggcugaucaaauaugacauuuauaaauucuuuaaaaauaaaucacauaucaaguauuacuuaccuggccuauaauaugauauauacuacagcaacaguguaacguauaugcuuagauaauuugauucucuuuuuagguuucaauuggaaaucuucauuuaggucagaggauucuauaacguacuauaacuuuaaaagaugguagauaacaucauccaacuauucugacugcacaucaguuuuuuaugggaaagacauuauuucaaaauaacucauugauaaugucagccaauccacaaaagcaacgugaguuaguuaguauuaagacauacugguagggagagagaaaaacugccugccuuuccauugaacccuggagaggcuacuguucuaacaucugacggucagagggguguugauauguaucuaguucuguuaaaauuugauguuuauguuccuaaaaauuacuaaaaguauuccucccuaaaacagugcagagcugauagggaaaauaaaaaagagauacagcuuuuagaaauuugaguuguaaacauuuuuaaagcuaagaaccuuuuacaaauauaguauaguuuuauucauguuaaaaagucaagaaaugaccaggugaugaugacuggaagacagaagcaggcagaucucugagauuaaggccaaccuagucuacagagugaguucuaggacagccagagcuacacagagacccuaucuccaaaauacuguaacaaauauugcacuuuaccucaaacaaaaccuaacauuugccugugagaaugagcuuuaugaauuaaugaacaaaaaguucugaaacugaagaaaaguguaacacaguguggcuaguguacaguguggcuagugcagggccuagaggggcccgauccucuucagcugacgucacaggugguuagagccaucucagcauggguacuuggaacugagucugggcacucugaauuagcagugugaauucuuaacuccagccaucucuguaucccuaccauauacuuuuuaaguacuuaguauacagcagugaacaagauagucucaccacuacaguuuucucuacuguacaguagcuucccaccacucucccagcucagcacuucacgcucuacagaaagucaccccagagucaauucuagaauauacuuaaguggacuccuucccuucuuguccauaaacugagggaggauccuuauguguuuagaagugaaaguuguacuucuuucuauuauuguuugauauucagcagguacauuuuuuucuuuguuaaaauaauuaauuuuuuuuacaauucacauuguauaagggugaaacaguaaccccugaacuugagaguuugaggcacauagacugugaguucaaagacagccugggauaaauagcaugaucuugucucaaaaugguauguguacaguaauaauauuaaaauucuacuuaaguauaucucugggccgcuaauaaaacccacuguaccggugagguuucuucugucagcgacugcacgcccuucuguguccucccuagagugcuuuccgcaguguccccuuuuuccucugcccacacuucccccucauuuccagagccgaccuacuuuaugaucgugcuccaucucucacauucaccuaacuguacuuugaguuuccagcucccucagugaagaucccuuugaauacacagcuuauacaacuucucgagugcuuggccacaggcuuacauauugauaagaucugcauuuagcugucucaguuuuucuaacguacauuaaucauuuguucuaugaagacugaaaaggaacaacucaaagauuaaaucaacuucaaaauucugcagccaggguagcaugaagcccugauuacuaaaaugugguuccuuccuaucuugugagaacccacacuauucaagauaaauaaucauuauugcuaccuauuuauacuuuuuccccuaagcuagacaggcuuaauaauauaauuaacuuacacuguguagucuuguaagcuucugaguuguuugucuguuuuauaaaaauaaaaugauaguauuacuguuuuauugauacuugguuuuuuuuuugcugucauugucaucuuaacaugaaauauucauuggauucuuaugacaguugaauacuuugucauuguuuuauauaggaggauaacuaaaguauugaaauucaaugauuugccaaagaggacauuucaagaauccucagaguuuuacuuagcaacuauuguguguucuauauacguuaguuacuucauuuaguuugugauaagauagugcugguuacuuccauuuuuaacuauuaacauguuuuuuuccucuuuguuucuuuacccuuuuuaacaacaacaacaacaacaacaacaaaagaaaaacccuuuagaaauucccauggcuaaagcugaauauuguuuccuuuacucuuagggaacucuacuuuguaggaaaguuuguucuucucaucuaccaugguuaccuucuuuuuuauugcuuuaauagaaagaaaauucuugucauguuuauguguauuucuuaggaauuucguagaaggaacccuaucaguuccuuuuauuuaaggauuuuaggcuuuuggggagcucagguggguagcuuggucugaguucaguacuagaacacauagauauaaaauguaggcuuggugguguguacuuaaaaccccagugguggggaagcagacagcuggacuccuggguuccuggucuaccauucuagccuuuccauaagcucccagccaaugaagggcuguauuuuaauuucugugucuguaugcagcauuucccuccggcaucuccacacaagauagauaccaguaugugguggugcuccagugaagucugggaaauucugucuugcucgucuucucugcuacuacacaugaacguaguaaagagacccucaaacaacacuccuugaauauauucuaccaaaagcuuacuuuccugcacaacaggaauauugcugaaauacacuuaagcaguaaaugacaaacaagugacaccaaauuuucuuugguuuggcguggcuugguguggcuagguuugguuugguuugguuuccgagacaguguuugucuacauaacccuggcuguccuggagcucacucugcauguagcucaggcuggccucaaacuccgccugucaccggagugcugggauugaagguguacaccaacaugccugccugacucagauuucuuaagauuggaauuauugaauuuguucuuguuccuccuuaacuugagcauaguaccccgcugugucuuaagaauucuguaugcauauuuccugcuaaccagaggucaugguuccucuacuuugcagcacugcucuucacuguguauuuuagaaaaaacuaagacaggaggauuaccccaaguucaaaacuaccuugggcuagaccgugaacucggucuauaaauaugcuguuuaacuggccauaggugucauuuuucagguuguguuuaagauuucuuucccugguuuguagcagacaauauugggccuuuuguauguuuuccuuaaaucuguaaauuugcaacauuuacuaacuugagaaaaauuuaaccacacuuccauaagguuugucuguuuguuucuauacuuacauguguccugguuuccagucucuaauuacaaggacauuaaaagcuuuugguacugccuacugcauccaaagggucuggaagccccguuccacuuacagcucuguccaucuuccagacugcgugauuuucuucucuucuacuguagauaagcauguccaguggaguucuguuucacauauuuuuaguucuuaaauaggucuuacauacaaauuucauauaugugaauacaaaaaaauauauuccacuuauuuccugagaaguccaaguauauucacccuugcagucaugagcuacuuucaaguccauauugcuaaauccaguagcuaagucauuuugggccuguucuccauugguugucuuuuucuuaaguguggauuaguuuuuccuguuugauuuuaaucauuuagaauauaauuaaggacaaggauggcauguagaaagucuggauucuucuauguuuccccagcggauagugauacuuaguuuguuuuaggggacaguuaacuaugcugaacccaaacuauaaacccugggaucucagauuggcuguucuaaccugaaccuggcuguuccaagugucucucucauauguguaguucagagagcaaaccuaguguagagagaguacacaagauuagccuuccaauucaagucccucuuccuccaugaucugcucugaccucucagaaaguaggcauaaaguauaguugggcauuugaauguuucuccuuuguguccucaguguguagaaaagcaagccaacgguaacaugcuguguaugcuuuaaugauagaagagauuagaauucguuuucauucuucaucuuuaguuaaugaagguguuucucauuuagguauuuauuuucccauuccuaauauugccuguaaauuauuuuucuggguuuaagucauuugaaaugugcuuuagaaacuguaauggaaaagaaacuuuacaguaaaacuuuccuuuaaugauguugcaucuuuuaugaaccuagauuuggucuagucuugggaauacagugguuaaucuuagaggucuugauccucuagaggucacuuauaaaugucacagaggaaaaaguaguauguggauauguuuuugguuugguuugguuuuuuguuuugguuuuuugguuuuuuggguuuuuuuguuuuuuugaaacaggguuucucuguguagcccuggcuguccuggaacucacuuuguaguccaggcuugccuuggacucagaaauccgccugccucuaccucucgagugcugggauuaaaggcgugcgccaccaccgcccggcuuguuuuuuuaacaaaagaaaaaugguuagggaaccuguuuuucagugggaggcacuugauagugaguguaaggaaguagacagagccuucaaggaucugaggggauucaguucaaaagccucaacaaagauauaccauaccggacggacgcccauuagcaacagagggaacaggaaugugguaguuaacaagaggccgcaugguaugcaguuuuaagccacacgggugggagaguggcuacucugcuguacuguucacaaagaucguuuauggggaaagacugaggaugugggaggcagggaaacugacacagagcagagguaggagacuuacaguaauagcuaagauggaauaagguggccagaaaaaagcaguaggggugagaaagaaucaucagauacaaaauacuuuugaaacgaaacacaggacuuggugguagaugagcaugaagaagagaaugacugcccaugugagugauaauggagagcugaaguagaaaagacuuaguuauuuuguguagaggaguugauugugcauuucagagcugaauguaaagcaacauauagauagcagcauuaaguuuuagauaaaacacauguggucuuuuagaaccacauucuugaagguuuuaaguaaaacaaggaaggucuuguaccuaaggcucucccguguacucauuaaaaaagguuaggggauccugagucucccuaaaagaacgaggaaagacuagacagcaucccagcagauuccuaauuagaugcaucuucugccauuguagaacauacaaauauggaggaauuagaucauuucaaaauugucuauuagaaacaaaaguauguauagcuauaugaaaaucauuaaaccuaaguaacacuuuuauaguuuauaguuaagagcugugauuauaaaucuauagcaacauucauucuaaaaucaguucucaauaauuuuucuuucuuucacagaaaaugcuuggccagaagagaugaguacuaauuccacucaggccuagaauugccuauugagauagaccugagcaggcgacauacgaauggcccaaggaagccaccaaauugauuuucagguuuuacaugaccugcgacaaaaauucccagaagugccugaaguuguuguauccaggugcauguuacagguuaguauucaaugauuuuuugauuuauugauacaauacuauuuauaauauuaaccuggugguuuuuagauauuggagaaaaacucuguuagcauuacugugcuguaaugaaaaaugaucuuuggugucucauaguaacauggccucuggcaaaauaggguucucagugccugccuguaauacaggccuugucugcccuauagacaagaguucugcuuucuauaaucuuguucccuuuuccucauccucucgucagauuugugaaaucccagaucuuuguauggaaaugggggaaaaauaauugagucagaaagcuuguucuucuguugauugguacauuugucaaaacaguguuggcaugucagucuauuaucucugacaugagggauuuguaugaacagugcauaacuucccaauuaugaagaaaaauguuuuuuauauuucuaaguuuacuuuauaaauuuuccaauuaaucucuccaauuucuacauuuucuuaguauacaaaauucuagaaauccauaauucuuaguauuuagugauaguuguagcuggccauucauuuaaccuggaaaucuuccucccaaaaggcguuuugaagauccuucaaaauuugaaagguuauuuauaaaguuugauaguguaugaaauuuuuauccuauuuuauagugacuacauauaugucacucauacccuuaucaucuuugaucuguauuuugaguuguucuguauguuuucagccuuaaccuaguuugagucccaccaaucaucuuccuaagugaauccuuucuaaaugaagauauuauuguuucuuggcaguguaaauacagguuauuauauauuugccauuuaaaauuuuuuuccauguucuucaagaugaauuauauauaauccagguauauuaacugcuaggauacgugacucacaguucuaaaaagaguaacaguaauggaaguuccccauuaaaauauuugguaaaugagucaguaguuaguucacacuuaucaauguagaauguaauggaaaaaagaaagagaaaagggaagugucuuaguuggguuucuauugcuggggagcaacuaggggaagaaaggguucaauugcaucuuauacucucagauuagucuaucacugagggagcccaagggagaaacucuaggcaggagcugaagcagugccaugaaggaguguugcuaacuggcuuguucaguuugcuugcuuaagcaacuguuaacuaccugcccagggcuggugcccuccaacagcauuccuuaaucaagaaaauaucccauagacuugccugcaggucaaucugguggauucaguuccucggcugagaucucuacucccagauuugucuagguuugugucaaguagacagagaccaaccagcauaaaaguaauaaaguaggagucaaaguuugaagaaggugggaaaagagccagaaacugggaagagggguaagucucacuuuuuuaguuagauagaagguagaaauguguaggaaaauaaagcuauucuaaggguguuuagggagucauugaaaaacuaauagaaaaauaauguaauuucuuuaacaaauuucacagauuugauauugagagaacuaccuagaacacuuauaguucagugauuuuuuuuuuuucuuuuuuggugucuugagacagaguuucucucuguaguccaggcugacuucaaacuuaagagauccacuugucucugccuccugagugcugggauuaaaggcaugagccaccacugcccugcaaccaguuauauuuuaaaaaucagaaaacugggaaugaaacuuaaagucuuuuauagaacugcuuaggguauuuucaaaaaauaaagaacucuaauguauacuugaguguaaucuugauguauugagaagacaaaccaagcauuccagaggcaggaucacugggggaagggggaaguguaucagucauuucuuucuucuuguuugcucuccuuguucaaaugguguguguggaccaucauuuccuaaugaaaguucuggcaugauuuuaucugauugcugguagacauuuuaacauccuugauuucuuuuuggcuccuaauuuuccauccagugcuccgauuuuuuucucccauguccaagauguauuaguuggucucuuguuacucaccugcauuaucagauacuuauuauugccugccuucuaacuggcugcuuugucaaaagaauaugcaucuccuuacaucuuaucuacuaacaggauuuuuuuuucccaaaauacucuuuuguuguuacuucucuguucaucuggguucaguagcucucucggcugcuuauaauaacaaacuguagugccguucauuucuuuaaauccuccauuacuuaagcccaaccaugcauuuuacgaaguuuccaaugugaaccuuuacuacagcuagagaugcuccauucacuguguuggaacauaguuaaccuaacucuaccauucccuucaccaagaaccuagaguuucuauguuaguauuggcuuuguuuuggggaggguuguuugacuguuuucucuuguccaacuugugugugcucugugaaccaucaagcaauaucuaacucauuaauccagggcuguguguguguguguguguguguauacauuaauguguauauuaauguguauagguacaaggaugugaacacauguucaugagaaggggccugagaugagagaaacgucuacuguaguuuucuggagcuuuccguguugucucuucggaacaggucacugagcugucucacucucgugugcauguguuuagggcugagcacuuggaauugaagggcucagcccuggagaagacugagucucccucucucagcagccauugacugccuauagcuccucaucuagggauggugccuuguacagcuucccuguccaugcugacauguuaagugguauugucauugugccggucuuauuuaggcagcuauaauguuaggauuucaugcacguagccucccugugguuccagaagaccacaggacagcaggcguccugguccacuagcuccuaaaguugcaccauccucuguucugugguuagagguugugcuguagauguacccauugaugccaggcacccaccccauaguucucugcauuuugaccaguuguaaauuuauguaauggucucugcugcaaaaagaaacugcuuugaugagaggugagagcuauaccuaccugucugugguauuguauaaauacuuagaauuuagcuggaguauucuaaaccuagcuaacuguccuuggcuggagaggucaggacugagagaacugaccacugccauuuuccaaaacugucaaccugauugaguuacaggcucuuuagugggaugaaaacucaaaucuuccacaagcucaaagauugcugcauauaugauugauuuccaauaaguauuuuucuggagaauuuaugaccaauggugugguacuucguuuaaaaacacuuuguuuuggguuuugcuucuuucugcauauugcucuggaauggguuuuuguuaggcucuguugaaggcagagacaugaacucaguucuuuuguuggcuacuuugugcuuauauuucauuuguggaugguuuuacaagaggaagaagcacagguagaaccguguaacaauuggcucuauaaaugcucacuucuuuuuuaagugcuuugaagaacuuugcaucuuaucauuucacuuuaaaaagaaauuuaauuauaccuuauuauauucuuaaaguugauuacuuuguucauuguaaaaauuguauuuuaauuaggcugcauuuuacuguauuuggauccauccauuuacuaaguagcuucuuagaccaugauuuauuugguuuacauuuauuuguuacuaguaaauguuuccauuacacuaauagugagaguuaauaaaccuaaaauaguucucaaaucaaaagaugucucuugugauuauaguaucuguucacuuguuaguuguguauuucugugguaaugauagucuguguauucacuucucaugacuaagauuaaccuguccuuauuuugcucuguagaacaauaauaaccuggaugccugcugcgcuguucucucucaggagaguacaagguaucuuuauggugaaggagaccugaauuuuucagaugagucuggaauuucuggucuacgcaaucacaugacuucucucaacuuggacuugcagucacagaauguuuaccaccauggaagagaaggaagucgagugaauggaagcaggacuuuaacacacagcguuagugauggacagcuucacggugggcaguccaauaacgaacuguuucagcaagagccacagacagcaccagcucaaguuccucaaggcuuuaauguuuuuggaaugcccaguacaucuggugcuucaaacucaacaccgcaucuuggauuucaccuaggcagcaaagggacaucaaaccuuucucaacagacucccagguucaauccuauuaugguaacuuuagccccaaacauacagacuggccguaguacuccuacaucuuugcacauacaugguguaccuccgccuguacugaacaguccacagggaaauucuaucuauauuaggccuuauauuacaacuccuagugguacagcucggcagacacaacaacauucuggcugggugucucaguuuaaucccaugaacccucagcaagccuaucaaccuucacagccuggaccuuggacuacuuauccugcauccaauccuuugccacauaccucaacccagcagccgaaucagcagggccaucagaccucucaugucuacaugccuaucaguucgccaacuacuccacaaccgccaaccauucacucaucugggagcucucagucuucugcccauagccaauauaacauucagaauauuucaacaggaccucgaaagaaccagauagaaaucaaacuugaacccccacaaagaaacaguucuucaaaauuacguucuucuggaccucgaacugccagcacuuccucauuggucaacagccagaccuuaaauagaaaucagcccacuguuuacauagcugccaguccuccaaauacugaugagaugaucucccguagucaacccaaggucuauauuucagccaaugccaccgcaggagaugagcaaggcaugcggaaucaaccgacacucuucauaucuacaaacucugggccaucugcagccuccaggaacaugucugggcaagugagcauggguccugccuuuauccaucaccauccacccaaaagccgaguguuaggugguaacucugcaacgucuccucgagugguggucacucaacccaacacaaaauauacuuucaaaauuacaguuucccccaauaagcccccugcuguuuccccggggguggucuccccaaccuuugaacuuacaaaucuucuaaaucauccugaccauuauguagaaacagagaacauucagcaucucacagacccggcucuagcacauguggauagaauaagcgaagcccggaaacugaguaugggaucugaugaugcugccuacacacaagguaaugcuaauguuaaagggggguggauagucuccaugcuggauuuauuguccauaugacuucacaacagaagagggcaucagcaugccuucugauggcuuguuuuucaguacuggccuugcuacacuaaguauucuuccacuuggcuauaucccuggcccaacguucaucuuuaaauguccaaauaauauuauuuuagaauuugaaacuauucauguaaaguuuaauaugguuauaaucaggaguuuuauaguucguagugcuucagaaaaucaacuuggcuuguuuuuaaauguuuuucuuuauuuuguuucauaguaugaauaauguuuugccuacuuauguaucuuuguaccguauacuugccuggugcccacagaagucaggagaggguauucuauccccuggcacuggaguuaaggaugguugugaguaccauguaggugcugggaacugaaccuccguccacuauaagagcaacaagcgcucaaaaucacugagccaucucuccagccccuaaucuuucucugauacacuggcuuuauuaauaaguuuccuuccuuuuuauuuuauuggguauuuuauuuauuuacauuuccgauguaauccccuuucccgguuuccccugcagaccucccucuccuguuguccuccccugcgucagggagggugcucccuuagagugcccugacucuuuggucgugcuuuguuuaaacagaugaauacgcagugauucuucauccaugcuacgcuguggugguuuucccauuccauaauccuguaauuuuaaagcaucacguguccagggcccagcuuaaauuugcgcaguuagcaucuugguauagugagcugaugcucguguguguuguagaggucugugaaugguuguguuuguacuagaaauuagguuaaaauugauaguaccccaauacaaugacucccugaaacugguucucuuuacauucagcagugccugaguuccuguaacucgcuaaguucuuccacaucuuggucgccucuccuggcagccuggcuccuggguuugagcauuugcugguucuuaaauguagagcaaagguuuuaugaugguaaauucaauaacguagacauucgcauuuaacuggacaguuuaaguauuaguuauuuguauuuaacuuaaaugagaaaacaaaagguuccuuaaauacacuaucuccauauuguuuuucuucccauucucucuagaaucuacuacaaucaaguuuccccccagugcagucacccagaaaacuacugucaaggucuuuggugauggcauuguuacauccucaguagacacucugagccuuccucucucuucucuggagaucagccacccucuuguccaugaagcacugagucuccccugacucugcucacgucuuugcuccuccacuucuuugguucuagugaguccagagucuccuagcucaugauuaauaaaauucuuaaccucuuuccuaucugcucuuugaguaucucauuugaucucuugauuuuuguuacuuauuuauuuagaaagauaguccuauguaguccaucucuacccaagacaaaaucuucugccucaguuucccaagugcuggaauuauagaccucugccaccaugcccagcucuggccuuugauuuuaaauaacauuauauagaccuuaacuugguaacucuuaagccagacuucuucccugagucuaaggcaccuugugugcacagaggcucugcaucggaauguuugacggauuucucagauuuacugguucuuaaagcagccugugacuuucccaccagguuccuuuucccuuggucaguuacuggcaguucuaacgguuagaauaaccgugggaacauacuugacuccuuuaguucauggucacaucugucagguagccuuccaagucuauccagaguccugucuucccacccacccacauagucccuguccucauaaaugccacuaccucucagauuaguguauuagcaccuggcccucacccuugccuccuugugguccuugugcacccagcagccagaggaauacuguucaaaacggucacugcaggugauagcucucuucacaguaaaagcucucaugccugccaugccuucucaucuacuuuuuggcuuuuucuuuuuuuuacguuuauuuagaguaugaguaugugugguucugaguguguuuauguucacacgugcauucuuauguauuugcauauguggguaggaaugcauguaccucagcauuugaguggagcucagagggucacuuagagucaguuuucuccuuugaccuuuacauggcuuguggggaucaaucuuagguuaaguuaugagugugacaagugcuuugcccacugagccccucuuuuuccuuucagccaguaccucgcuugaucuguccagcuccucuggccuuuccagguugccauaaacauagaagaaaggcaucccuuggugccuguguacuuacuacugcuccuacuguuuggacuuugcugagaacccgcugagcuauaagcuacauuccucuucccuccugauggagaccacuacaaacaguagcugcugaaaaggaggggcuaucuccuccucccccacaguggcaugcugucauugggcugacacuccucaguaagacuguugucacagggaaaagaaagguacauacuaugugugacagaagcucagcggacuagcacucagucucccuucuccaagcaaccccucuaaaaauaauugagggacacacauaaauuauauuuuaauaauuugauuucagugucuugucuccagccauauuugugauucucucauccuguuaauaccaacagaagcauugauuuuacugagcuauugauugccuucacuaaaauaaaaauucuuuuuuuuuaauuagguauuuucuuuauuuacauuucaaauguuauccccuuuccugguuuccccaccaaaaauccccuauccccuccccccacccccugcucaccaacucacccacuccugcuuccuggccuuggcauuccccuacacugaggcuuagagacuucacaggaccaagggccauccucugcuacauaugcagcuggagccgugagucccuccauguguacucuuugguuggugguuuagucccagggagcucuggggguacuaauguuguuccuccuaugggguuucaaaccccuucagcuccuuggguccuuugucuagcucccucauugggcacccugugcucaguccaaugguaggcuguaagcauccaccucuguauuugugaggcacugguagagucucucaggaggcaguuguaucaggcuucugucagcaagcacuugauggccuccacaacagugucuggguuugauaacugcaugugggauggauccccagguggggcagucucuggauggccuuuccuucuccacaguuuucucucuguaccuccucccauggguauuuuguucccucuucuaagaaggaccaaaguauccacacuucguucggucuuccuccuucuugagcuucauguuucauauggucugugggcuagagaaauggcucagccguuaaagacuaggcucacaaccaaaauauaagaaauucaaguuuaaaaacuugugcauugaaaaguuuauugaguucuauguuucucaguccuugucguuucucacagcacuuccuuacaagucacagcuauggagaguuaguaacucugcuucucauacaaagucagcgauuuuuuuuuuccaaaaggaaauaaaauuuaaauuacuguuuuuaaauugguuuaaucuuaugaagugccucacauagaacuuuguuuuauguuaauuguaaucacauuauuaaauaaucaucgcaauaauuacaaguugauaucaaacugcuuaugauuugucuuuuucgagugagucucccaccugucggcucuuccauucuuuaaaggaaccauuauuagcuuggugucacucuuagaauuaaaagacuccuuaaacgugcagcagucuguauccaggguuaccagucuaauuccccacccugcaccaucagacaggagccccagugauggcagauguauuagagcuaccucuggagcagcaugccccaccauuggagagcccugccuagcaagcugugucucaaaacugaugccuugaugggcguugguggugcacaccucuaaucccauugcucaggaggcagaggcgggugaauauuuaugaguuacagaacagccucgucuauacagugaguuccagaauagccaaggcugcacggagagaaacccugucuugaaaaaaaacaguaaauaugucuccacgucugucuacuuaauuguuaaauacaaucucuauuaacauucuuucuccuuauagucagucauauauacacauauauacauacaacuacauauacacacauaaaagcacauuuuaguacauacuauacacauguauaucuguaaauauauggguuaagucacaucuaaccuuaguuuaucaauuggacuuaaucaggauugcaucuggacggcagacauacagacuuauucauuaaacaguacaguauaacagcuguuuauguaauguuuaugugauacuagauauuaucacaaauaaaccagagauaugcuuaugcaaaugagcauauauauauauuuuuuuuuuuucuuuuucugagacaggucuuuucucuauaaugcccaaauaagcuuugaauucaagcucucccugccucauaggcucuguuauuacuagauuagcuggugggcucuguucugcaucaucucaguuuccuuguugugucuguuguuugaauacaggcccugcugcaagaucuagcagcaacuagauuucaacuagccuuagaaaugguaaaaacaaaugaaaacaagaugcuuuuaaaagcugccaucuuugagucuucuguaauucggucaccaaguagauaucuagcggugacacggcaauguauaaaacagauacaaucucugcucugcagaggauuuagauugauuuuaaaagcugacguacuuucuucauucuaacuugaauauggcuuagucauauaccuaguuuagguauauuaaaucauauaaauuuuaaacuugagaaauaagggcuugcuacauuuuagugacaaaaauuaucuuuuuaaaaaaaucuaaaaucauuauaaucauuaauaccugggacauuuuacaauggauagucuuuaauaagugcauucucuucuaauaguucugaguuuuguguuucuguaagaacuaggaauuauuuauagugccuaaaauuuacacuauaaaacuugaaaugucuuuacaguuuuuaauaaaauuaaaagacguuuguguccaucagaaucuggcagcuguauuccaguauuccuguauuccagaagcaguguugggacugcccugguaaccaacagcuucugcuggaguuuuguagcagcgguaggggguggcaugcuuaaauuacuuuuauuucauuaacuuugacaaaaagacuuaaaagcacugaauguguuaguaucacacgcacacacccuuuuucaucuguuuaagguucucuggaguccugauguugcuaucuucucuugcccuagucgcccuguuucugugagcuccacggggugagggauugccugugcauugugucccugggugacuacagugugaucaccucucagcuuauuagaagaaugacugagugagugacugagugaguggaauguuucugcuauaaacaacauagaucuuaauuuauaaaaucuacuuuguggacuggaaagauugcucagcagugcaauuauagaggaccugagguaccagcacccacauggaggaucacagcaagaaauuauuuauuuaguguuuacaucuguuguggucacuaguaaaaguauaaguuguucuugucaauuuuuuuguuuucuaugucuuccauguccuuucuuggugaauagguuuaaacacacauucuuuauuuuucuuuuggucauuuuaauuuagaaacuggguauuucauuuagauauuacaucucgauuccuuucaucuguaaucccuaaacacuaagcaucuuggcauuuaagaaugggcuuccauggagauugaagcgcggccuguagaggaaacacagagaagaaugguugguucacugggcuugggcauucuuuccaagaccuuagcggacuucuuggaagacguacuuccuauuucucuuguauuuucuaguacuugaguuuuacuuggcuuucacagucuccagcauucucucucccuucaccguaguugccgugugguuuuuuucugcagcuuucugucauuugucaugguaucagcauauauuugucugugugucagcagcugccuguuguugcacguucucccaaacuuugaaaauguguguauucaucuguacucuuugaugauuuaguuaguuaggugaacagaacaaauguuccauuaucuuguagaauuauauuuucuuuuucuucaauuuggggacauuuuuaacuaguacucuucagaucuugacuuuucuccacacacucugccugccccuggaauuccuuuuuuaauugaacagguaaacaacauucaggaagugauucagucugaaaacugugccacguagccaguccauuuaucauacaauuaccauggagugcccagaccagugugguaaugcuacugcauaucuagaugcugguauaccuacugacuguaaguggcaagccugcauagcaugcgacuauacuggauauuuggggcagugugauacaauggcaaguguuuguguguauccaaacauuucugaacauaggaagcacuaaaaacagugcugcagucuugagguacuuucucacaucagcuuguuaucuggguagcaccaucccaaggugucuuuccaguccaguguccuaaaagacaagguuuccauuucucaugggcggcuuccggggagagacaucaauuuugacagcuugaugaacguuuccagauagcucagcauuuaugucauaagacuuauugcuacucuaaaugacacuuuuuaauuugaaguuuggacaguuuguugauauucaugugguuugaagucauucuuauuuguuauaaucaaaauuauuuaccccauuccauauucccguauaaaaugucuguaaaaugaucauguuagaauaucucgaacauagaccguggugucacacuggaggaaagaguuuguccuuuccacgagucagaugugaacuacuaaaagagcaaauucgguuaguuuaguaagcuaggaucuuuuaaaaaguaacagacuacugucuucagccauaguaguguagguuucauucaaaccgugaaaaauuuuuaggugggcaguauuugcuuaaguaaugaaaaguuuccaggucaagauuuuugaaaauguaagugcaucccaguauuuuguuguaauguagcucugggguucuuggcaggcugucccagaaaugcuugucugcugcagaguucgcugcuggagugggcggggccucacgcaugugcuccuguugcagcucugcuggugcaccagaaggccaggauggaacggcuucaaagagagcucgagaugcaaaagaaaaagcuggauaaacucaaaucugaggucaaugagauggaaaauaaucuaacucgaaggcgccugaagagaucaaauuccauuucccagauaccgucaguaaguguuaugcauccgccguggccugugcuugaucaggagagcaggcugccugccacaguguaaaggcuugcucuaguuuucugcagaugcucuuaguucauacuuguuuuucuguccuuaccucccccugccaacuccauucuuuguucacugaugacgugagaauucaauacaaaccuuuuuauauggaauuauuuuucagcucgaagaaaugcagcaguugagaaguuguaauagacaacuccagauugacauugacugcuuaaccaaagaaauugaucuuuuucaagcccgagguaaaguucaaugcauucucagcugaaauucauugaauugaucugccaaguguuuucuuguggcuuaccagucacugucucggaguauuuagcuuuggagccagaaagugcuaaagaacaguuggcuucuuugcccucaguaaauauguaccuggucaagaaaccaaauacauccagccuuuagcucuccuguagccuucugcuguagccugugguaagggaagacagugguugucuuucuagcugcaugucaaaggguuguauucguaaggauguguccauauggcuuucucccauucccuuucuucuuucaagaauuguguguccucauaucgcuggcacugucuugguugauaaaauagaaaagugauauaaaaguauguuauagucuauggacagugauaggacuugauacuuuucaagcaguuaguuaccagcauuaauuucuuauuguaguaaaaaguacuuagauuucacucaguuccauagaaaacauaaaugaaacuuuaucacugaaaccuaauucugaaguguggggcggggagggaggauagaaauauacaaaauguaaagagaaaaaagaaacuuaacgaaaagucuugagucccauuucuguguuuaauccagcauccauuaaaaugaacaaugauggaccuuucuuaaauugauguuaaaaugccgucauuuuaccuuguuacguaaaacagggaucugcugcuaauucuuucugacaaguguugacgucacuucuucccugcgaucacuggccuguguuuaugaguacuaucuuauaucuauguucuaagauauguuuuugaagucuuauauguaauuugaaauuaagcggguaucaucucaagcauuucuuuugcuuauuuuuagaauuuguugcuuuaaaaaguaaaauuaaguauuucugagcuauaaauauugaugauauaguuccuuuuguauauuucaggaccacauuuuaaccccagcgcuauucauaacuuuuaugacaauauuggauuuguaggcccugugccaccaaaacccaaagguuagugcauccauuaaaugugagacuguuuggaaagcgaaauccuagaaaauguuuauuuuuuauguucucaaccuuccacuugggaaguguuuccagcuugggcauucuggcaugggcugacuccucagggagguguguguuuguuuauuuacacucugggguggagagcaugcaaaggugugacguauguaacuuuuuaagaguauguuugagaccuuaguacccacuguggacucccaaaauagaaaguuuggguuuaaaacuaagugcaacgauugugucuuuaaauuuguaaacugugauaaggcaggcacuuuagagaaauucaguuuuuugagaacauuguuuuguauauauccugaauuccagguaaauuucaaaaauguauuaucaucuagaaacauuuuccaccauugaaagugacagaauauguguguaccaagcuaagacaugaaauaagccuguguauuugagccaagcauuaggauauguauacgaaugaaauuaugugcaaaaaucugacuggcugaaguuaaauauauaggcaugucuauuuaggucacuauugucacuacuaauuaugaugcauaauuugcuuuuagcccuaagagaaguaaaauuuuagauagcuuucauuaauauaguguuaauaaucuauuuuacuaugaguuacuguucuuucaauauaccuaauuuauaaauuaagcuuuauagguauuuguguuuuaagaaaaauguaguauuuaucagauucaguauuagucauaguuucaagcauuuacuguuaaaaacuacuuagugaauucauuaacguugcaguauacaaaaucaucccacaaaaaucaguuauuuuuuuacaguuaugcaaaagaaauucauagauaccagaaaaauguuucauucacaguaacaaucaaaacguuaaaauaggaguaaacuccaccaaagaggcagaagaauuuuauaccagaauuauaaacacugaagaaggaaauuaucagaaacauucauguucauggauuacaaaaauuauacuguuauuaccuacaauaucuaagaucuacaguuuguuuuguuuuaguguguguuguuuugucuaccuguaucugugugaggguguuaggucaccuguaacaugugagcugucaugugggggcugggaauugaaccucaguccuauagaaaagcugccagugugcuuaacugcgaagccaucucuucagcccaaucugcacauucuaccaaauuccaaugucaguauaaaaaugagaaaaauauuauaaacuucagacaggacucuaaauaggcagagccaccuugagugaggauggagcuggagauagcacacuccuacuucagagcggaugacagaguuacagugaucagaagagugcaggacuggccuaagcaugcucucugacacacagcagugggacagaagagggacaagcaaggugcgucagugcucaccuccucucacgggaccaguuaguaaaguggagucgccacaugcagaaaaauggggcuggccccucuguauccaaacagugacucaaauggagccacacgaagguugagugcuaagggcucuuggugcugaugaccuaaauucacuccccaggcuggcugcacauggaagaaagaaagaaacaacuuccccaagguggccacuggccucuacauacuugcuaugauacaugcauugcugauacaugcauacucaugcauuuacauauacaaaaugcauaaauguaaaacaaauuaacuagauuauaaauuuaaauagaagcugacacuggguagauggaaacauuuggcauugcugaggguggugacuugcauauggcaucuaaggagcuguaggacugaccacugcagggagcuguauaccaaaggacugaacacugcagcgagcuguauaccaaaggacugaacacugcagcgagcuguauaccaaaggacugaacacugcaacgagcuguauaccaaaggacugaacacugcagaaggcucccugcuauucuaaaccagauucagggcucucuuaugccaugucugagguuuaaaaauacaacaagaaaaugggaugauuuuuugacucugucuuacuuuuucagcauguuacugccauaaguguaaacuauaaauguuagaaaguaguuguuucaagugucauagcacacaggagaugaaggcaggaggguuggugacagucagcaggauccuucagucugacaugacagucaguggggaugggaaggaguguucacccuuccuucccuuguacuuggaacuaugaggcuguguucucccuuaggccguggaaguguuugugucgagucacggugcucuucccgcuaggggaagcauggucaguucagcaguuguuuuaucuggucaccauuugguagauuuucugauuuuuuuuuuuuaacuuaaaauuguuuuuucuuuucuuccuuacagaucaaagguccaccaucaaagcaccaaagacccaagacgcagaggaugaggaaggugcucaguggaauugcacugccuguacguuucugaaucacccggccuuaauccgcugugaacagugugagaugccucggcauuucugagccaaaggccccgccuuccucugaaaccacaucuaaaguucaagaaggucgccugucaucgggaaaguguuucaccgccacaggaguuaguccaguugaaggugugacgagacaguggugugcuguguugagugucagcccacagagcuaaugauaccucaaucuaaugucaugggcagugagauucaucaccugaaaggccugagagaccgggcugccugcugccugaccauguccagugucacgugucagugccuagguguucccaggacuccuccccucuugucaccacugauccugacgggaggaagggagagacaggaugauugcuuuuuguguuguuagagcuuuuggugaaacacuacauacacaaagagaaggaacaagguuugacugagaacucugcugccacauagugccaguagaugugggaaacgccacaaaucugggguacuuuuggcccuguccucugucuucugaggacaucucugugaagccagcauuuaggugugagauaaaaggaaagcugugucugucuguacauccacagugcgcuccccaagccucuccuacuguacagaugucucacgucugcuuugauuucuccauuaucuucuuauauuucuauauguauaguguaauagacuuguguuaacuaguguccuuuucccuuuuaguaagcacgaucaugcuccuuuuaagccuuaccugagaaaagcaaugccauaagguagaaagcauuaaugaaaugaaacugugcacaacauaacucccucuccccuuccuccuccuguccuuugucccuuggugccaaugcucugagaagacaugcaggugcugcaugugagucacugcaagaaacacugcagccaucggacggucgaggucacgcuguacacugacuugagcagugggugaccaaacaugucguuuugucuucuccagcagcuuaaagcagaaaguauuuaaacccacugccaucuugccccaucugugugguaucccauagaacuccaugggaggcucuuguugggaaaaugcaguuuuaagaagcagccucagcagccguucccgcagccucuucuucccgggaagaaguguggcugucggacuguuggcacagucauguguauuuauaaagcauagucaucuuuaggacaacugaagaaaagcuggaaaaaagaaagaaaacaagcagacuugaacacugaagcaaccucagacaucucuuuauuuugaugauauauuuuuguaaggaaaauaaauauucauaugaucaggaauguauauaacuaaaugaaaucaagaaaaaauaaccauaugcauuuuaaaagaauuaugaaauuaucagugcuuggaauggggcuaagggaagugcugaaauauaagaaaaaaauaggaaauaauguagauugucccacuguaaauguucacaaguggcuauguuuuaaauaaacaggauuauuaugaaugagcguuaagaaggucagagccuggccuuccgggcuuugcacugugaguauggaaagagauacggcaaccauaggucacuaggcaacagaccccaaaacucguacauuugaugcauuguguuuuaaaaguaggccuuguuuuucagcuuccucugcaguucuaugugaagauugauaaaucaguuuuuacuuguuuuauuaauaaaacguaauuuggauaucuugaguugaugguuuugugauuuagcuggguaaacuaucuuuguaacagauaaguuauuuauaaaaauuaaaaaaacuuauauucuaauguggau

SEQ ID NO: 5414 - RNA, 1169 nt, Mus musculus
ucaaauucacuuaaugauauacucaguagucaaaugcugggcacagagagccagaaucucuuccaauaacacaaacuucgguugucauauuaaucugaagcacaaaacgcuugcagaaaaaucgaacaagcaaaacaaaaccuacccagaauucaccccaaagaaagaagccaauaugccaacaucaaaggcucaauguuuuguuccagaaauuggaaaguaucugcccccauccugaguucacacugccucaauaaacagugucucagcugugugucaaagucgguauggacuuuuuaucaucauuacgaacgugacucuccuggcacuguguuuaccaccuugugcugguuuccuauucagagagauuuagaagagcugaagcuaagacccaggacuguggcagcggggaguacaggcucucguggggcuaccacuuagggccuauuuugaacuuuguuauuucuucugaaacugguuuagaagguccuccuagauuauuuuccauuuuuguuguuuucuguuuguuuguuuguuuguuuguuuuggguaaauuuuacuccuugcuaaagaaguagugagaaccaaggaaaaggggaucacugguucacaggcauacuuuagaguagcagguugucucugagcagauggggcuuuuacaucugugauauccugugagaaaacccugcuaauuaagggggaagucugccauugucuggauagcuagccuuccagagcucagugcuaucuggaggacacacuucauugaccuuuacuggggaguucaaaaaguccccacauugccucuacaugcagaauggcacauaaccuuaguuaaauuacagguucaacuucuuuucucccaguaagaauccauucagcuagcaccugagauuccugaaaugcuuugccaugcuaaugcuuauagccuaagucuuugcccauccuggauauuucuacccccaccaccuccaaaccccccaaguuauauaagccuuaaaaacccaaauaaagugaauuugucucccugcagcuggucccggugucucuucuucaccauaccuacucacagggcuuccaaacacagcccucaucuguugacucuuuucucuuugcucucauagacagauaucagccgacaaucccugagggcagggggagccauaaua

SEQ ID NO: 5415 - RNA, 2338 nt, Mus musculus
caagugaauuggagagucaggagugaaugaccuugauaugguaauuguagacagacaacuggggagcagggauuugaaccaggcuaacuaacuucaaagcccaagacuuuaaccacuauggagaaaacuaaacacuguaucgugcccaaagaggcacugcuaaaacccuggggagcagggauuugaaccagacuaacucgcuccaaagcccaagaccuuaaccacuaugaagaaaacuauaucguuccuaaagagacacggcuaacaccagagacacggcuaacacccuauccauccaagguaaaauuucauccucaguagaacuacuuuccagaacuaagauaaauccauaggcaguuuuaaccacuggccaguucaaaaccucuuuuggggggguuugguugguugguugguuuugguuuuuggguuuuuuuguuuguuuguuuuguuuuguuuuguuuuugauuuuggguuuuuuuuguuguuguuuuuguuuuguuuuuguuuuugggggauuguuuuguuuuguuuucgagacagauuuucucuguguaguccuggcuguccuggaacucacucuguagaccaggcuggccucgaacucagaaauucgacugccucugccacccaggugcuggaauuaaaggcgugcgccaccacgcccggcaguucaaaaccccuuaucagcacagauucagcaauauaugccuuauuguucucagcgccaaacauauaaaacaaauauccuguaauucuacaaacuagaagagcugagggcagagcaaguaaacaccgugguaguucugcacaaggaaacgguuguuuuccucucaugggcacaggacaagcccugugcggauaaacaucaauaccgagaggccaugaggaguccacucgccaaauauuuacaaguaguauuuacaucuacucuuucuggcuuuuuccacgccaacuuuucuaagcaggugucccuaauuacagucgauuguucaagaggugucucugaugugacccgacaaguagggguuuuuuuuuuuuguuugguugguuugguuugguuugguuuuucuaaauuacaguuucaaccccuauauagagaauacagcggaaagaagaagggugaccaauaggugggcgaggggugagccccgcuucccccgccugccuccccagguagcucaccaggaugcccaucacgucgguccagaggcgggagauugacucggagacaccggccucgggcuccagcucccgggcgggauccaccuccggcucaggcuccggcgccgggcuagcagcucccgcguccuccuccauggccgcguccccgugcguccgcguccggguccccgcgcugcccaccgcucgcagcagcgcgucggccgacggggcgcaaguuccccgcccgcggcgucaccgggccgcgcccccgcgucgcaugccccaggcuccgcuggguacgagcaccacugccaggacuggcaccucgaucccgggcgaccgcgauugacaacuccagaaacuuuuccuagcccggccccgcgcagcaacaggguagcuggagcagaguccacaacacuggcugcggcggggaguucacgggaccagggagacaagagccacaccgcacgggugcugcguccugcuucggggaccggcuccggguggcacaccacucgccucuacuggagaguuugugcagggcugggcaggggacagugacgccuguggacccgggcuaauuaguccuggaccccucucuuuagaaugagcucuuccaacuccacaugacucccuccccuccaggcucaagaaagcguuuagcaacaaaaggugcucugaugucaggcgcuuugcauggaaaugagccucagccuggccaacaaaucgccuuuugaaagcgccaccgcgccacgggcccggggcccugcacaaguccccaaucgcgccauucacccgcgccuuccgccacugaaacugcagaaaguuaaucuuuaagccgcucgcugaguucgaguuuaagaggaguccguauggugacaaccccuggaauuacaguccugucugucaggcuucuuggaaaacaaagugugacaaagcucgccuggucacgagccauuguuugggucguaaguccgggcguuucggcucccgaguggccgcagugcugugcacuucuaggguuuucggauacuuaaaugagacccucucugagcuguaaggguguguuuuguuuuguuuuguuuuguuuuguuuuguuuuguuuuguuuuguuuuguuuuacguggaagaaacaggcaagggguauguucaaaauaaaaguuaauuuuauggccgc

SEQ ID NO: 5416 - RNA, 2059 nt, Mus musculus
ugccuugaauuaaaaaauauuaaguaauacagacucaaaaaauucaagaacuguaggacaauagacuuauaguucaucgcuuacugacuucauuccugggcugaacagcuguaauaacucauuuuucuauucacacacucaaaagccaggacagcuagaagagccgucagauuaagaacacuguccccucaagauucuuccauccuuugucagacagccugcaccugcuugcuucccuuuaccuccccguuuuagauagagcugcucucuccucccccucucagucugaaagaaaggcaaaaagggaaaggaacaacaauuuagcuggaggucaacugggaaccccugcuaauggcugcuucuucucugcucagugauuguggagaauaggaaaucaggccgaacucacuguugucaucaaggagaaaaagcuggugagccagcgaaugauacugacugccuuuucccuuugaagaaaaauaauuaccacguuuaagggacacgcuucagggcaaacaccuucuuccgagcucaucacuguggaggacagugcgcuguagcccagcagaguggguugcccgugauggaaauggccugcuucccucacacgaccccguguccccgugucccaugaucucucucccuaaaccagggaugagggagucugaagaucaugucaugcagcucuguauguuuagguggcccgugaugucuggugcuuguaugaaaggcccgagacuucuaguugcuaagaaaggucagggggauaaggcuaacggaagggcugugcuacuguacaaaauacacccaggcaggugauaucuucaauccauccuuaucuccagagcaagguggcuuuacaaauaaacagauuuucugggagccugaagugaaggaugagguaggacaagggucagaguuagggccuucacaccuccucugaagagggggacauuuccaguugaaaauuuguguucagucccugaaaaaaauuagacucuuagcaaguaggauuuuaaacauaucccugaauuuuauuuuuuucauuuacugauagcacacaaucgcucugguagcuaauaaauucuuaagaguaccuggagaaaaaggcuuuaauguuugucacuaucugcaaagcaguuugagagguuugagcuucaacaggguguggggugugguguggggcagucaaagacgucuugcauuuuuaaaggaagaaguauuugguuagcaguucagcaucagucguuaccauucacuuauuaagaaacauaaaucaaguuuacuuaacauacaaacaugacaaaaaaauuagcaaccugugcuucggcuuugcguuacaaacugaaggacugugacuucccuuccguuggaaguacauaugcucuauaaaaugaaagaacucaucucacagagccuuacccuuaggugaagagcuacagcaaucgauggcugcagagagagggagaaaugggcugcccuaggcaugagcuuccugauagcucaccuaaucccaagugguaaauccuaaacacauauucauauaagcaacacugaacgaacguaguagacuguguggugugugauguguguguguguauguauaaaaugugugcaugcauguaacaguaauaaagaagaggaagucaggaguaugaagaggaucaugggaacaaauugggggggggaagaggaggggugagugauguaaacacuguauucauguacuaaauucuaaaaaaaaaaaaaaaaacccaaagccaagcaaccaccucagccucaaccaaaaaagaaaaagaaaaaaagaaaacagggagaaggaauucauacaaaagaauuauuuagcaagcagacuauauccucaguaaaagaaguauuaacaauuauagacaucuaauuuggagggucauuaaauuauuuuuaacagcaauggauugcgaagaaacguuagcaauucuugcaaccccaaauaacacauccaguuuauggguaagcauauccuguuuagcuugauuuucaccauuucaugcuggacaccuauagaaaagucauagcgugc

SEQ ID NO: 5417 - RNA, 10371 nt, Mus musculus
ugugguucaagaaauaugaacaaagugguaggaagucauuuaguuuuaaaauauuaaaauugauugcuauagaauuagcagaccaauuagacacuugagaugguuggagaggaaagugcauuccucuuagcaagacucucuauacaugccuugcuuuuaaagccaagaggggaaaaagacaguacuaacgggaguuuucugaauguuccccuuaacugauugcucauuauuaauuuuuuaauggagaaacacauuuuaacagguauugucauguguaaaugugugugugugugugugugagagagagagagagagggagagagagagagagagaaagggggggugaaagagagaagagauggagacugagacaaagacuuucauauguggacagccugcugguuuucagcuauuuaauacuuucuagcaauauuaagauuauaugacacaugaaacaaccuucucccaacacagacaacaguagccacuugucuucagaaugugugugccccuccccauguuguagccuuaggccauucuuauucaucuucucacgagaagccaacaguggucccuugcccuccagcacucucacuccacgaugaugucucugcuccauaguaagugugaggggaaucccuggcguagauaagagucagcuuccaggggaaguacuucuauuuuaaaagacaaggcagcaaggagggaagacuccucugccucugcgaauauuccuucugacaaacugcuguuugggagacagaugacuuuuuucuaccgccuccacacaucugggugggggagggugugagaaaacccucuguaaugaagauaauucuauucugcacguguaucucauaaggagggaagaaccuuguggagaaaaugacacagggcccuuuuucaucaugugcuugugagagaccuccagaauccacugaaaugggcucuccuagaccaugcacacugugggccagugagacuucagccacguaugauuccauuugccucucagcuaugaugucagaagccagguagccuaagaugugcaaggcuuucuuuauuugaguuguaucauguguuugagcugucucccuaaacuccugauggggcugcuaaaaauacugugacuucugagacaaauagugaguaauaccacgaacagcgcccuggcagagggaggagaauguuugcagcugagauuucaaaaagaaucagugggaaaggggggucaaaacgacugcaggggcugaugggaagaacacccuccuccugcccaguguucucccauguugccugucaaacgaaccaacgcacaaacagacaucaaauagcuucuuaaagagcucugggaaacccuaaaauuaacaaacacaaaaugucaaacaauugguaaauugcauuagacuucuuaucaacugacucauuuguagguagggagaguagguugagaaagguuugaugacugaccugugccacaagaaaaaacaacaacaaagaaaacaaaacaaagaaaaaacaaagaaaacaaaacaaaacaaaaccugguuacucugggaauuagccuuaauggcacaguguuuggaaauaacaaccauucuggcucuucuuagcacacaaagcccuuggauuuucaucauauugcaacaguugaaaagcauuuacagcccuuucuuuuucuguucauuaugaggccugugccugugugucucuguguguuccucugugugucuguguguguuuguguguguauuuuuauaaguauauaugugcauguguuugugucuguguguaacugugugugugcaugugugugugugugugggugugauguugagcacugagcucugagucuuguuucugcuagccagauguuuuacaauugagcuacaucacaagcucuaaguaaggagcaccagcuaccauuaaucaagcauauaaucaauaaaauauaugaguacuuuugggaaaaagauaugaaaagugaccaccuucaccuggagaguaccccugacuaaucuccaaauuuuuucuaaagggauaaauucugaugaccuuuuuuugugggugcagcaaacuuuauugaugguauucaagagaguagggaaggcuaccuaggccccuccuguuauuaugggggucuggaacggaaauugugagggagauguucaguguuggaugccaagcugggauagggacuccucagcaacccgugggccucucucuuacucucaguguccuugcuggggugggugguccaggguuucuuacuccuuggaggccauguaggccaugagguccgccacuccguugcuauagcuguauucauugucauaccaggaaauuagcuugacaaaguugucaucgagagcaaugccagccccagcaucaaagguggaagaguaggaguugcuguugaaguugcaggagacaaccugguccucaguguagccgagaaugcccuucagugggcacucagaugccggcuucaccaccuuuuugaugucuucauacuuggcagguuucuccagguggcacaucagauccaggauggacacaugggggguaggaacacggaaggucaugccagugagcuucccauucagcucugggaugaccuugcccacagccuuggcagcaccaguggauauagggaugauguucugggcagccccacgaccaucaugccacagcuuuccagaggggccauccacagucuucugauggcaugaaccauagucaugagcccuucuacgaugccaaaguugucauggaugaccuuggcuggggggcuaagcaguugguggugcaggaugcacugcugacaauguugagugaguugucauaguucucaugguucaaauccaucacaaacauggggacaucagcagaaaggguggagaugaggacccuuuuggcuccacccuucaagugggccccagccuuccccauggugguaaagacaccaguagacuccacgacauacucagcaccggccucaccccauuugauguuagcagggucuugcuccuggaagauggugaugggcuucccauugaugacaauguucccauucucagccuugccugugccauuggauuuuccauaggugacgucauacuggaacauguagaccaugagguugaggucaaugaagggaucguugauggcaacaaucuccacuuugccauguugagagcagacggcagcccugguaaccaggagaccaauacggccaaaucuguucacacugaccuucaucauuuugucuaugggacgaggcuggcacugcacaagaagaugcggcugucucuggaacagggaggagcagagagcucugaugacuuuuggaguuaggauaagugguggugaaucuugauuauccaggucacaggaucuagagucacaauagaaacagacaucugggcacaucugugaggaguuucuagcuuggguuaagugaagugugaggaucuaccauaagagugggcagcaccaggucauggacugggaucucaggcuaaauaaaaaagagagcaugaacuugguaccauccucuuucucacuguucuuugacuguugacacaaugugacuagauggcccccauuccugccaucaugucucccccacugugauggacugaacauuccagcucugagucugaggagcuagagaaaguacccaaggagcugaaggggucugcaacucuauagguggaacaacaauaugaacuaaucaguaccccagagcucaugucuuuagcugcauauguagcagaagauggccugguuggccaucauugggaagagaggccccuugcaaacuuuauaugccccaguucaggggaaugccagggccaagaagugggagugggugguuuggggagcggggcaggggaggguauaggggacucuugguauaacauuugaaauguaaaugaagaaaauaucuaauauaaauuuuuuuaaaaaaugcuucuuuuguccaguuggaacaaugagaaaaguaacugauggauuuuaguucuugagaauuuuucaaguuaacuuaauuuugaaaauccaauuuuaaauuuggaaaaguacaucuaagagcaaucguuuucaauccaguagcaaugcuuuggaggucuccaaacuugggauuuuaaaaaugaaaugaaacuccuuccccagcuuuauguuaggagcauaguuaaagguucagaaaacaccguuaagaauuguugguggcacaaggacucucaacacagcccaagaugaccaucucauaguuucagaucaauuaagaaggguauaaaucuugcccagucuagaguaccuguucccaaagucauaaccaacacuuaaaaguaguuacguucucccuagaagugugaguccuugagauaauuguuguguuauuuuagcugcugugggaaacaggaauaaaauccacaaguaaaagcucuaccacaaucugucuaaagguucuggauauagaauguggaucuucaagggagagaggucagaaaacuuuaccucuucuaaaucugaguuacguaguuaguuucuuggaaacuuggauuugaaaaggcaugaaggaguugguuuggggauuguuugcuugcuuguuuauuuguuugcuuucuuugcuuauaucauaagaaaaucacaauuaagucagaauguguaagccaauaugcuuacuaaaauaucagaagguuaaaaauguuaauucuagacauuaaauucugugccucuuuagaaaauauuaacuaagugugacuaaacaaaucuuauuaagcaccugagauauguccuaugaucaauuuagaagcagagggaagagaauaaugcaaagauuaguaauuuaauucaauaacuauuuaucaaguuauuacagagaggugggauucuagcauaugguaccaaaacccccugcgaguggaagacugagagcucuuuuaacagcaacaggaagauguagcuaugucuaagcaccacuucccagaccugccaccuggcaguuagggaagaaaaaugauugcuggcauagcuguuuaaauagcuuuuguugagaaaucaugcuugcugguauuucauauuucuauaaauauacuagggaaaggcuaguucccuuacauaccaaauacggcaauaagaaauuaaauuuugaugcuaccauggacacccagacucuagccaggagaauguaaauagaaaugaugagaacacccucucccagcuggaacggcaugugggccucccuggcuggcuggcugguguguguguguguguguguguguguguguguguguguguguauguaucuguguguauauguguguauguguaugugugucccaaacaaaacaauuccucauucuccaagguggcuccauuaauccuuaugguauagaagcagauggguauuaaauaaugugaccugaggcaaggagcugacucugggguacuuagcauuguccuucaugaaaauaaaaggaaggaauuggucugugauauguguuuuaacauuuugcaauuucuguuucaucauuacauaccaaaaguuucuacagccagccacagacaacacauacaaggcuaaacaacuugaaagaucugugguuuacaagccugaauaguggccuugagcccacugaugaugauugaccacagcgucaaccaggugagcaagauuugagaaucccauagaaccauaagaaaaaagagcaggguuuuggcuguugaggaauaaaaagaaaagaaaaaugguagaccuuaaaaacaaaaacucagcugggaucccucuaagacaucacaaggguuaacaagcaauuguugacuuucuggauggaacuguuuuucacuaccuauuauuugguuaggugcaaaaauauaauucuugguauaaaauucuuagguuagcacaaaauagagggcuuauugucuaacuaccccauagugggagauggaauaagcccauuuucuggugcuaugguucucucauuugugaaccccacaaaagacugagcacaaaauguaaacagcuuuuuuccuuccaauuaacggaaaguuuuauaagcauaaauaaaucaguggaccugguuucugcaaguauacaucaggaagcauaauaaaaauauggacuguugaaccuuucuuaaacagaagaacacuugagcugaauauguguuuuccagcaggggugggcucuaugaggagcuuggucuaaagagcaguaggcuguguaguucauccccaguacuggggguaggaguagggacgauacuucucuguauacugagauagaaacaggguuuuucugguauauuuucuuuuauaugaagacuuugauagcauucuaguugaaguagagaaugcauuguccauguaaagaaaauuaugagaguacacuuuccugaaaggaaauguugagcuugguucuggagaaucagugguaguuuaaauaccuauuauccuuuaggagucgacacacagguuuacaaaaaacuaccaacaaauuaaugcaaaggaaugcugcagaagaucuggguauauaugaagaagugcacucauugaguuaaucaggagagauucaaucaagguucuauuugcaauggauuuuauagacugaauuggagaacuggccuuacauggguaauagggcagagccuggucaagcagacaaaagcacaugcaaaugucagauaugguacuguggugguuugaauagguuuggcucccagagauucaugucuuugaaugcuuggcuauagggaguggcacuauuaggaguuguauccuuauuggagaagguguggccuuguuggaggaaguaugucacuaugaaggcuggcuuugaggucucuuagugcucaggcucgacccaguacagaagaaagacugcuucuggcagcuugcaaaagacaaucuccuccuggcugccuucccauuaaucuguagaacccuuggcuccuccagcaucaagucuaccugcauuaugccguguuucccaccauaauaauaguggacugaaccucugaaacuguaagccagucccaaugaaauguuugccuuuauaagagucacccuggucauuugugucucuucacagcaauaaaauccaaacuuaagauggaagguuuuugagcaaauagcaaacuguucaucauggcugagguguguugggacacagauguggagauccgguaacaacaacauguaggguccuggaaaucuucuguguuuccuauaaauuauuguuuccauggcccccaagcuaauaauuggugugcagaugcuuaauggccaugacuuccugacugcucuauaucugcacaguagguuggaaugauguccaucauaguuuauugucuagggaucaaagugauuucucauacaaguucaauuucauaguuuacacauaugccuaauugugaggugauuaauuuacauagccauaaacuacagaaggcuaauuaugugcauucucuccagagggcuguguaagugcauguuugcagcaggcucucuguguuuaauaguuuagcagaugcuggagacuagucacagcacagggacaggauacuucauuuuuuugacuugaaaguuuacaccucacuuggauaaaacagggugauaaugaaaucaccaggauguguaguuuucuugcuucaggaccacagaugacacacuuuaucuagaguuagcccacucauaaaugcagacuuuauuuccccaaaggaacuuuauuucaaaacacugccaaaucacagaguuucaagcuuagaaguagcucaguauguauuuguugauuacauaacauuucuaggcauugugcuuaaagaggugcauccagaaguaagcaaauaagacaaagacaugggaauuaaaagaaagaaauggucaaauauauagcauaaauacagaugcacauacacauauacauauacauauacacacauacauauauccaugcaugcauacauacauacaugcauacauaaauacacacuuucauucacacauauacauauacacauguacaugcaugcaugcaugcauauacaaaugcauacauacaaacacacaacuacauacaugcaugguauuggaaaaggaaauuagagugaggaaggguuggauguuauuuuaucuccaggacaaagggaaguuuccucaaugugauauucuagagacaacaugaaaaccagaaauccauaaacuaacaugaacugaaguugugugcugugaacuauuauuacauaugggagaagaacaaggaggccguugugccuggagcaggcucagaaaagagaaaggccacagaggggaagucagaggaacagcaagggcccagaucacauggaagcuacaggcucugguaaggacuuuggauuuucucugcauugaaaaaucuuugaaaaugaagaaagaacaacucuagaaugaagaucagagccaggaagaugguccagagagaagagaaacaaugucccaaucauguuuccuagauucaaggauguugcuuggucugugaaguggagaacucagagcugaucacagaagaucacaguuauuucuacaacagagggcaggagaagauuacuagagagaaucauaggaccaaccugaauuucacuuucuuugcuuuuaacaaagagaaagaaaaggaagaaaauagugacuggauaagagcuguaaaugaggcaaaacagacugucaggaagagguacauagaggcagcaucagcaauagacagcaaacucgauagacccugguaaccugcagcuaacacagaaaagguugaccaacacuuucaggcucacgucaauccuuauauauuguugcaauaaagugaguagaagauuggcucacugaugugauaaccaguuccaaaguguguucuugucugugcaacugcuaaccucaaccucagagauuugccugccuuuaccuccugagugcugggauucaaagcauguaccaccauacccagugucugugcaacuccuauccucucuuauuccuccuccucuccuccuccuccucuuccuccuccuccucuuccuccucguacucuucuuuauaaacagaacugagcaauccaccugaguucaucauugguggcagucuuucccucucugcuuguugaguguuugccagucucuggaucuaccucuguugcugccuuugcugacaauggccuccgcuccagacccccacuccagguuuuuuuccccacagagacaaaagaugauuuucuucuuuccuacuuuuugacagacagaaaacuuaaaauuaggagccaaaaucaaaagcaugggaggcagcaaaauuguuucacaguuuuguugaagcuagccugaagaaugaaauauuuaaaggcaagcaaauuguuaugaaaauuuaaaaauucauucuauugccauuucugaagcucuuguggugggacagcuaggcauauuaacuggcacgguuuucucaaauaagcuggguaugcauggaagguaauagacuucaggauauuugggaaauuaaaaucuaaugagaaagcaucuacaguuuaauucaucucauugaugcaugccuugggcaaaacauugugaggggaucucugaaauaugcaacggaaugaaaaauaaguucccuaauuaaagaaggaaaaccacagaacaagaauaaacuguuggauuauuuuuaguaaccccaacccccacacauacaccaugcuaaucauucugcaaacacauugaguaucuucaagccuagugguuucccccagucaucccaacucccugaggugccuucagugauucccuaccuuagaaaugguguucauccuuuaagaugcagcggccugggaauuuguggaccucuccuguggggauuaaucccuccuccacucuucuuggcaacuggguguuuuugcagcugauauauagcugucugcuuacauauccucuucagaacacuuugaagacagacauuauauguuacucuuuaaaaaaaaaaaguucagugucuuucccaguaccauagccaaaaaaagcauguaagauauuuuuuuuuuugugaagcuaauuuuucucauaggucaucuguuugauaaaacuuaaccaaggaaaaauuaaaaaaaaaacuuacaaauauaaugucuugagaacuggaaacauuguucaccuuugcugagaaauauaagaaaaaugagcuguauaauauuauuucauuuucuacaaaacucucuuagaccuuuugaagauaagaaaauugaagaccacaauauuuagcugacaagucaaaauccccacagcuucaaggagaaaauaucaaucaaggcuggguagaaauuccuccagauggacuccaaugauaacugacucaacg

SEQ ID NO: 5418 - RNA, 68171 nt, Mus musculus
ccucagcuggcgcuggcggcuuccggccugggugccaggcuucacccagcgugcagcgcgcaugcgcaacucccgcaggugaguguggcgacugugggcccgggaucugcagccugcgaggagggccgggcccggcgacaggugccugcagagcggcugagguaggugagggugcgugcgggcucugggguuagagucgcggcggagggaggcuggcucugcgcgucagggaaacuccgagggcuccugcgcagcuccgggauccggagugaucggcccugcgaggccccgcggcucggccccagcccggacgugggccgagcccuucucgcgugggacgggugcuugcugcccacgcuugcgugcugaggcccugucacgagcugucccuccggcuccuucuucgaggauaacuugccuugcaggcuggcggugcgugggacgacagguagcugggagggaugcagaggccgccaaguuaggcuggcaaacucucaagcauuacagucgccugcagaagcgcccuggcuccugugcauugugugcacuuugacgcugcagguagcgcuagguuggugaacgaagauguugguuucugguuaagguacccugugggaggaacgguauuguuuacagucuugccuuuucaccguggugccuuuuaauccacuuggcuugaauuuaucauggcaagucuauguuuuucuccuacguguuugccuuugcuccuguauuugccuaggucccaugaucgcuaacaccacuuuauucuuugucuaagcuuuuacucuuugucucaguuaggguuuuacucccgugaauagacaccaugaccaaggcaagucuuauaaaggaugacauuuaauuggcacuggcuuacagguucugagguucaguccauugucaucaaggugggagcauggcagcauccaggcaggcauggugcagaagaugcuuagaacuccacaucuucaucugaagccugcuagcagaauacuggcuuccaggcagcucuugcagucacacacuuacugcaacaaggccacaccuauuccaauugguccaaaccuuugaauagugauacucccugccaaucacacuguuaauccauaaaacuaguguguguguguguguguguguguguguguguguguucuucccuccucuguauaaggaucgaucgaaguuuuguuaacgcuuugggauugucaagcucauuggaauuaaaagagcaguggugugggguuaaauacaacuaacaugugagacaggcauuuauuucugauguagugagagguuugucuuccuaguuguuggccaucaaguauaguauuauaauuugucuucuuuaaugggauuguuucuuaacugaaaauuucuaccaaacaugagugaaacugucacagcauuugauacaugagaucaugguuaaaguguuucuuaccuguuaguuuuguccuugaggugaccaauuaccaaucccuucugaugggaagacacagugggguguucuuguugcagcagcuuggucacaccuuguugcucacaccuggguagauaagaaaacagacaggauaggaaacaagacuggucccccaggcucagcaaccagcaucggacucccuacuccuaggccccaucucaguucugacauguaaucugugaggagcuuuuauagccaaagcacagcagcuauuacuugacuuaagucuucuuaucaauuuaccuauuuugaagaguucacauuauauaacagacuuaaguuuuguguaagggcuacugaggaaugugccuaguaucacaggguuauuguuaagauaaggaacuggguuaggaugugcuucaugaaaugaggauauuuucacugugaaugaaagucagagucuugugugugagaguccuagaaaauauccaguagaggagugaggcccagccuagguuugugcacauuagggcuguaagccugaauauugcaauguuuauguuuuuguuuggaacuauuuccucauaaaagauauaucaccucaguguugguaaccuucacagcagauguacauuguuaauuuuccuggagucuagauuugcaguuagccagaggcuuuaaccagacuugacuguauggacucuauucucuuaguuuuccugucuuuauccugccucacaccaacuauuccauuugucauuuagaauucacauuuacuuaucaagaaaguggaagcgugaaaaugagcagccgaaggaaacgugcucccccgaugaaggucgaugaagaaaggcaacagcagcuucacuggaacaugcaugaggaccugaggagugagccgcucaccaugacggucggggaacaggccuguucagaugcagacucuucuucugauugcaucaucaucgaugaaggcccuccugagagugcacuucacagagauaagaagaggcguucagagacugugagcgucuuagaggccaccgaggaagagacccguuugucugugacuuugaauguuacaguuucucccuaucguguggauaauucuuggaaagcauuucugggagauuuugcucuucagcuucuccccaaagagaguuuaguugaacauuuuucugaaaggacuuuuacauugaguccuucagagucaagcagucaguuccugaucuauguucauucagaauguaaaaauguagagaaacaagaaaauguucuugaaggaucagccgguguuuguagcaagggaauccgaguggaauccuccuucaguagugacauguuacaggauuuggccuggcuacagaagagaagaggaauaaaacucuaccagagaccagacggcacucacacaaucaagguacucagggucugugguguuguguaagguucuacacugguaauucauugauguuaacuuugaaagucucaaaacccagcaguaagcccccguuauuaaguuucaaagaauaacuuuguauggggcuuuaaguaacuguaaaacugugucuuccugccagucccaacuagccaggcugugcuucccuaaggagacucuccugguuuucucuuccugccucugugcucuguuaacugcuuugguucucaccaucuugcauuauaauaccuucuauuuucaaaucuuucaucuauuuuguuucagaaaugguguauuugaaaugugacuuaauuuccugauuguaaaacuuaaguguaaccuugcuauucugacuuaacaacuugcuaucauaugucaugaauuuuacccuuugucacuauuuuuuuauuugguuccugaaauuccaaaauuugucucccaaacauauucuguccuucugucugugcuuuuuuugguuuccucuuccccaucucugauaguccauucagaaagaaugcauggaugcauagagaagguuuuuaagucccaggcaugguacuacauauccuugcccaguguaucuauuuucuuuuuucuuuuggcuacuugugaugguuuguauaugcuugguccagggaguggcauuauuaggaggugugaccuuguuggaguaggugugucacugugggugugggcuuuaaaacccuaguccuagcuaccuggaagcaagucuucucauguuugccuuuggaacuagauguagaacucucagcuccucccccaucaugccugccuggaugcugccauacuccucccuugaugauaauggacugaaccucugaaccuguaagccagccccaauugaauguuguucuuauaagaguugccuuggucauggugucuguuuacagcaguaaaacccuaagacacugcuugaaacacacuaaaggcggaaagaaaaacccuaagaaauuguuucaucuuugugucacugaaauguuuuucuuauuucucaaaagaaauuauaucuguaggcuaauuauuauuucugaggagaucugguguguuuaggguggaauggccauagauuuauuucugacuaaccuaaagaauaagagaacauuuaaaagcauuauacagcaauuaacuuuuuccuggacaguggaucucaaccuugcaauucccugccuacugauuuugaggaccagaauuuugcugagagcaggaaaguaagaaaucauagccuaugugucuguauucuacccuuaaaaccaugucguaaugucuuccauuuucccugaccuugauugggcuaaguauguaaauauuuaagccaucuccaggugaacagaaugcaaauaugaacgguucugaaauggaaucuuugccacuuguuccaguguaauguugcuggauucuuaaaauuucagcagaaaaaaugaaggauuucagucauuagggaauuagcccaggauugcuggagaaaugaagaaaaugcauuguuugccauuagaaaucuuaaaaauuaaacuauuuagacuacuucauagacuuuccauuuuaaaaauaaaaacauaugaggcuaaauaaaaguuauguuuccuaaauuucuuuuacuccuaaauaucauugucucuacuuaaauuugaauauuuccacucuuaggauucaacagcuccauuguuuuguaaguuaagauacuuaccauagucaaagucuguuuuuuuccacuuuuacuuccuaugacuggguugauccauuauaaggaaucccaaacauaaccucaaaaggcugagcuaggaaagccuccuuguaccaugcuucacugauuguucagaugcccauuagguucagaaaccaguguccugguggguagaguugagguucucaucacacuguguuuugguccccuuuaagggagucuuuuuguuuucauuuuucuaauaaauaaugcaucagauauuuauagaacgaaauuaaugaaaauaaaaguauaucuucugcuuguggagcagacauuguuaaaaccuuuaaaauugugaaucuggagacuggaaaacuggcucagugguuaagagcacuggcuguacuugcagaguuuaauucccagcacucacaugucaucuaacagucaucuguaacucuugucccugggucaccacuguccuuguauagccucgauggucacugcacacaugugguacacagauauagaugcagauacaaacaccauauacguuacaaaagaaaaagaaagaaagaaagaaagaaagaaagaaagaaagaaagaaagagucugaaaaagccuuucuguguccuuauaaagaauuguauacucccaguaaaacguucuguguguuaauuguuuguagguuggaauuuacauuuuggaagcuggccuaacaagacuagacuucaugagugaugcagguuccagaaugaaaaaguucaaucagcucaugaagagagugauggaaaaguuacauaauuucauuauuccagguaauuaccaaaguaagaauuacaguugcauuuuagcauugccaguuucuccucaacuuguacacauagcagccugaaaaacaaguaguaaaaugaagaaacuugagugcucuugaugcacugcugugugacaaacucugaaaugccuuacugauaacaauuugcuuuuuuacuguaauugcuuagugucgugcccagcauucagaaauguuuguaaaagcaguagacaaaaaagcuaaaagccacucagaacacaucuaaacuagcugaauuucuauuuauuuauguauuuauuucuuagcuuccuacaaaauuuuuaugaagcugguugauggauuuucuuggcuauucugcaacaauuuucaguagucagagauuaugcuggccuuuagucuguuucccugcagucugauaaagaagcucaagagguacaguccuauaaggaacagguggcuugguggguuguuggcaggacaugcaauucgugguuagcaugcaccuaaggccugugaauacuaguaaauguagcucagugggagagauaaaacaaacaaaaagcgcuguugguucaauacucucugccacagauagacauggggagugacugagggggcaccuagcucugcugcuggagaaacagcuugguucuccaaauuacaauggagaauuuaaggugcuuguguuuucagguauaauuuuucuucucucauuccuuucuuuugucuugcuuuuuuugguguugguuuuaguuuugguuuuuuuggguuuuuuuuuuuaaaacauuuuuucuucuuuuuccuuuugugcuagaugucaaacccagaacugcacacaugcaagggcuacacuucugagcuauagccucagcccuauacauugucauguuagaguguuuugaaaaucuuuuuuugaacauaguggguacaugguugccauagcucauucuuucaaaacuucacaauacuaguaauagugacuuugcaaguuagagauuuacaggaaagaaaauaucuuguuucauaauuagaaaugcuaucaaauccaucuagaguauuuuuuucaguuauaagaauuuuagccagcuauguuggaguacacgccuacacugccaguguccgggaaggacaacuucaagcuuagcugucaaugcuugaucacauuaauuauuuuguuguugcaauaguaagagauaaguguauaauuucucugugugguugugauaauccuaugugauacuuuguauugaaaauaauuuguacauuauucagaacacucuuagucauugagcauauuagaugcauuugugcucuuugagcacaaauugaaagacuaacucaagugugugugggauuuucauuuuguuuaaguuacagugugaaucuucuacagggcauuuguauuuguaguaaaaugggauagccugacaugcuuacauuaauuaaucuuucagcaugucucuucacuaauuccugcugcuaccaaaggccugcccuuccuucucgaccugaaaaauuaauaaaccuuuuuuuuuuuuuuuugguuuuuuugagacaggguuucgcaguguagcccuagcuguccucacuuuguagaccaggcuggccucgaacucagaaaucugccagccucugccucccgagugcugggauuaaaggugugcacuaggauuuucuaugaaauauaaggauuuuuuuaauguuaagauauaaaagugauaaaguaguuuauaaauaacaggugaaauucauacucaguuacccauauuuauuaaauacuuauaagagcagaacaugucagugucucugagguucugugacaaguacacaggugauugaaagagcagauauauuacagucaaaguauaaaauaacacaugagcacugagcagaaaauagaugacaugcagcauuugaaugcuuuuaaagaaugcauaggugaauauuuuuugaagagggauuuccagucauggaauacacagaacaggacuguggagcuggcuggcugcgugggguuuccuggaauaaggacuagugguuagcaagccuuguauagcacaugcaucuccauucccagcuccuugaagaaaacugagccgugaggcucuuaggggugagaccaauccagagauuauugaaaagugucuaaaaacacacgugggaaggguuuaaaaagaaacaauugcuuguggcuuacaaugcagacucuguuauauaccuuuguuggauauacagaugugcuggaagaagaggaggaggguucagagagcgagcccgagggucaggauauugaugagcucuaucacuuugugaagcaaacacaccagcaagaaacacggucaguccaaguggacguccagcacccugcguugauuccgguccugagaccuuaccagagagaggcagucaacuggaugcugcagcaagagcaguucagaagcgcuccuccugcuggcaaguauaagaugcuuaaagaagggcuuaucaggagggacguguuacagauaguuaauaguggggcauguauuggggugacggcaaguaaucauacugaaaggagaauaauuuucugucuuucagaauagaugccuagauaaauuaauaugugacuuuucuuauuuguaaaaguuuaaacuacuucuuccuucagccuuaaugggaauguaugaaaaguauaaaagaaauaaauugaagucauggucccugcuuguaauuucauuuggaagguaguagcaggaagauggggacucaagucaccccaggcugugguguggauuccaggucgccuguuugggcuacgugccuuggugucucaaaggagagaaggagaggaagagggugggggugggggaagggagaggaagaaucaugacuugcuuacaaagaagugcuuuuagaacuuuguuaauuauauguaagaaacuuccuaacuugacaguaaauauuaucaacagacagcagauuugcaaaugugacuaauuuuccuaguuuauauuuuuugcuuuccccacaaaaucaauaaagccaagagauucauugcagggguguacuuuagucauaacuuuuguuugguuuugaggcacaaucuugggguaacucuugacuauucuggaacucaauaacuguguagaucaaguugaccucaagcucuaauuagaauucauuucccugccuccuaagcacuggacuuaaaaguaugcagcacuaggcuggcacuguuuuuaaaugaguagacaaauucugagauuuuuaccugacucuguacaaugaguuauuaacuaguucugauucuucuuguauagauuuacuuuuagcuaacuacagauaauuucuuccaaauauucuagcaaccuaacuuuuuuuuaaguuuuccuuuuaggaauuaucaauugauaggcaguauuauuucuucuugcucuuuauccuguuaauaccaauacauuugucuucuccaaauuaccuuccucaucucuauuucccuaucuucuacauucucauucauucauauucuucuucauucucuuccccuauccugaaaucaacaucuaacuguggaguuggaugcucuugguaaaguuucauaaucuguauguuuugcugccuagcucucauucagucuuuuccucauuauuauuuguuugggaaauuguuaguccuauaaagucccacauagaccauauuauuuuuucucuaaaauaaaauaauuuucggauacauaauuuccacaaggaauaacuuacauacaacaaaacaguuugaucuuaaagguaauauuugauguauuuugacaaaucuguaaacuuggagucaacaaccaguucuugucaggcuuccaccagagugacagagcauaucugagaaaaucaucuccagagaaucacugagugggaugguucagugcaaggaugacuagccugauggcuuuggaccugaguagacauuaggugucuagagggacgaaauaccuuguuucagaaguagaggaaugcuaucaaauacaucuuagccagcuaugguagagcagacuuuagccgcaaguguuugggaaggauuacauccaacuuagauaucaguacuugauuguguaauuauugaguuguaaugguguaaaguaaguacauaauugcacauugguuuuguacugaagguaauucguugauuauucaguguagucuuagucguugagcauauuguguguguucacaguguguacacugcagcagugacaugcagcugaggagcuccuccucucguauucuaaaacagggagaggggaccaggacuagaaacaguccccaaggccaguuucaguaaggaccaacucccuuuacuuggcuaucauuuccaguuucuacuaauuuucagaaagcccucaaauuaaaguauaguaaacacagagacacagagacacacgucugcacuuagcaaaugcagaaaacccuuaccagguuggaauuggugcuauauauuaguuuucccccuuagcuguguguugugcuuugcucuucuguguuauuacuggcuuaugagucugugcaaaagcaaagggaacugacaaauaguauuagaggaauacugugagaggcaacucuguggcauuucccaaaugagccuucccaaggaugugagucuucugaaucagugucccaugccauuuuguuuaucuuaguaucacuauugacaggagaaaaaaaaucaaaacaaaagcucuuauaacuuauacuucucuuuagauaacucccugcacuucuuauggcgagaaauuguuacaccugauggcuugaaacucuacuauaauccauauacaggcugguaaggcaaaaucuuuuaugucugauuuuuauaaaauauauacagaaaaaacuaugagaauuuaacacaguguucaguauugaggaguacuaaaagucuuauauauuucuacaguuaggauagacuuaaauuaaaaagcacuugccauuuucucagugaauacaguuauaauagacuguagcugcugagcuaucaagauugacagagaugacugggcauggugaggcaugccuuuaaucccaguccuugagagcuagagaguaaaggagagauuagauuuaugucucaaguaaugucguuuuuuuuuauaaaggccaacuuuuauacuuuuaauuaucaauuuauagauuuaagaaaugugaugaucuuugagcauaauuagugaaucaguauuuauuaucuuuuauauuuuuaaucacagauucauaaagaccauagagggaaaauccugccuucuaaaaauguuauaaaauugcauauauuuauucuguggccaaggauggagggguagcauggcauaccauugaagguagaagaugacuguguuuuaucaugcuuaucauaaggacugguggcagucacuuuugccuauuuagccaucuugcuagaccgcauaacauuucucuuuaauuauagaugagauaaauguugauuaaguacuagcaccauucuuauuucuauguacuuaguugucugcucaauuauuguuauuauuuuauuccuguuagguaggauuuggaacuuugacuuguuuccuccuaaaugaaguuucaguaaacuuaaaguugcauucauuucuucaguucucuuugggaacuaauaaaagacaggauuuuauuuaaauguuucuuggguuguauuuucucuuagcaucauucgagauuucccacaugcggguccacaguugcuugguggaaucuuagcagaugagaugggucuuggaaagacaguggagguucuggcucugauucugacacauacccgacaagacgucaagcaggacgcucucacccuuccugagguacagagaaaugccgugcuccagagaauaggagcaaaggaugucaggaggccgugcagugagcacugagcauuugcucgguucuugcgucaaccccuacugugguggugugaaaauggcuuguauucaggguugguuaccugcaaguaacugcagagaaugggacuuugguuuccugggagguuuucuuaagugaugaagaccaacuaguaagggaauauacaguaguaaguuuaucagucuuccaacuaauuagcaggacuuuuacaguaaguccuguuagugcgucacauaucuugucaacacuagaaggucaauauugucacugaaugaagaacugucuguuuaauuacagaucucagauucuguuaaguagaacuuagugauugacugauagcuuaguauuaauagauuguuagauggaguaguuuuuguauaaauaucugaauuuuagaguucacaaaauauaauuuccuauaccucccaguaguaaaaucggaagccagcacguuaaaucgugcugaauuuagccuaccaaucaaagguuaaacuaguuaagaaucucuaggaaccacugggcccacaauuuuaauauuuauauaauauguuaauaaauucauguaugcauaaugaaccuuugugauuucaauaguaaauaguaaagaaaaaucuuuauauaucuuuguauauauguuuauauauacauauaaauacauuuuuauaaacuuauauaaauauauagcuaugauaggggagguugaagaaaagauucaacaguuaggagcccugagcucuggcugcuguccuagaggacccaggcuggauuuccagcacccacccauggggcaacuaaccaucuguagcucuagauccaguugaugccucucccucuucaggccucugugggcacuguaugcauaugauauacagauguacauguauacaaaauucccuuccacagaaaacacaaauaaaucuuauuuuuaaaaagacacuauauaugaguuaaaguauuagcaucguugagagauuuuuaauuaaacucauuacauauuuuauuucugaacuuucguuauuuuaaauuuaauguuucaauucuauuuuuaacugugucuuuaaaaguuacuuucaguaauucccuacauuuaggaaauuuagaguauacaaauuaaaacaugaugguucguuauaagcuccaaaguggaaacauugauauauaaugaaugacauuuaguuaucucccaguugcauaugaguauaugcuuuuuuuuuuuuuguuuuuuuuguuuuuuuuuucugagacaggguuucucuguguagcccuggcuguccuggaacucacucuguagaccaggcuggccucgaacucagaaauccgccugccucugccucccgagugcugggauuaaaggcaugcgccaccacgcccgacuuauucuauuuuucuaauagaagggaugauuauaacaaauauuucaacuaccaaaauuauguauuucagggaaaagugguaaauuauuucaucccaacucacuguccuagagaaaaagugaaaaauagagaaauccaggauacagaauaugaaccaaaagagaaaguucacugcccucguaaguguggucucuucacgugacuucuuacagugauuuuacuguaguuuaaaauguuauucuuauaaagauauuaauaguaagcacuagguuucaauuuuggggggcuuuugguuuuuuuuuuuuccauuuguuuguauuuaacacagagcaucguuacaaguuacaucaaauauaaagaauuggucccaguacuaccugguuagccuauuauauaugcuucaguuucuucaguuuuguuuaauuucaaguguaguuuuuauaauucuuuuuagcagauggauuuucuuaggaaucguagcauaacauguacuaggauauucaagagauuguuauuuuauaauuugaaugauuguugugucaucaaauuaacaauuagccuaaauaaugcuuuguuaaauuauuucuacuacaguaauuuuucuuaauucaagguaaauuuuuauuacauauucuucagaauacuagguuguauuaagucuuuuauuuguacccaguccuuaauaaagauuaagauugaauuucauaucaauuauuuugaauaauuaucauauccuuuugucuaucuacuguacauuuagcuacacgugugaugauccugacagcugugaaagaaaugaaugggaagaaaggaguuucuauucuuucuaucuauaaguaugucagcuccauauucagauaugauguucagcggaaccggggucuucugaagcggauguugaaauguuuaaucuuugaaggucuugugaaacagaucaaaggccaugguuucucugggacuuuuacacuggggaagaauuacaaagaagauguauuugauaaaacaaaaaagcagguaacaucauuuauuaagugcauguacucauauacaacgccuuacagaauaaaugauuagguccugccuugccacugaagcuuucagagcuuagugacaaaagucagaaaugagugagaaaagguacuguggcaaugacggacuuaacaguccuacuuucugaaugugucacaagaguaacaacuauuuuaguuaccauucaacccugagaaguacucaauggaaucaacucuaaaauuaguugguuuaccuuaaaguuuaagguaacuugucuauuguuaagaugcugucuguauuuacaaaccuugcucccagcuuuagaaauguuaaugccucaaauuguguauaccuauguauaaaugccucaagucuuuuauauaaaguuaucauguucccaaugacgucauccuguaaaacuuuaauauuuuucuauaaaacuguuuucauuuggcuaguaauuucaauuugcuuuuagaaaaauagacacaguacauguaaacaccauuaaggaaaaaaugacgacaaaucagaguaugaaagccuuuugcuuggcuacuguaagagauaguagagaaaauaggcacaguucaucucucagagcagagaguguccagcuugugcccaagcacgcacagcaccaggagcugggaccucuaaccagggccauuguucuguauuaauauccugguucuucugugugcccucaauucugaccccauuuugggggagcucuuccuaucaccuaccuggcugucacacuccgacucucugacaugcucuuuguaagcccuucuauagugugcuuuuacuuccuguucagagacaaugccuggccuggaacugauguucaaaccauaaugacaagagacacccauagaaaggcaaagauaaaagucuguguaccgauggcaacaaauaguaaucacccuucgcuuuauuuguacuugaugauuuggaguuguauguacucuaaauuucugguuuugcuugauuuaagcagacuuuaaaucagaaaauguuaauaacaaagggauagcuuaccuucuuucucaucagcacuguacagggaucaaguagaaccuuugcuucucugaagguuacagagagaggucuuucagaggguaaauuagaauauguuuaucaugaacaaguguccuuggguaaagggugguaaagacacuauugacuuuguuuguaaaggauauauguauauaaaguuuagaguuuaauuucacaauuauaacuuuauugguacauguuaauuaaagaauacuuuucauaggcaguagggaguccaaggaaaauugagaaggaauugaggaaaucagugaacaaggaugcagauucugaguaccugccaucaaacacuucugaugacgaugagccuuacuauuauuacuguaaggcgggaaaaagccggaguaaguugaagaagccugcuuuacuaacuaaaaagggaaagggucagucuguucaucuggauucccaaggugaugcuccagcugcuggagucugugcaaguacugauguucaugugucagaaaauacaugugucucugaagacaagcaaacccaagaagcaaaagacugugcugagucgccaaacccugcugccgaggaguuggcacagucuaacacuucaaguccuugugaaaccucugauuaccgcuuugaguguauauguggugaauuugaucaaauuggccacaagccaagaguucaaugucugaagugucaccuguggcagcaugcaaagugugugaauuaugaggagaaaaaccugaagguuaagccuuuuuacugcccccacugucuuguugcgauggagccaguaucaacaagagcaacucugaucaucucuccgagcuccauuugccaccaguggguggaugaaaucaaucggcacgugaggucaucaucucuccgaguucugguaaggcacugcagcuagcgagggguuagaaccuguacaguggugcuuaucugugauaguucucauuguggcugagcaagaucucguguaacccaggauaaguuagcuccaaggaugacguuggaauccugguaucccugucucuguuucccaagugcugcauuauggcauguggacucugcccagcucauuuggaugaguaugauuuuacuuuuuuuaugcuuuuuccccccaaagcucuuaauaaagagcuuucauacuucauuaauaaauguuuucaugcuucauuuuuuucaauaaauugagcucaaggacuugugcaugucagguaaacauucuagcacugagccauauugccaucauccucuguuuguauauuacuaaaauuauuuguuaugauacuaguacugguuauaccagagcuugaagagaauauugaaaagaagaaguagaagaacaaacuauauucuuuuuugacuuccagauuucagaaguugagaguauauuauuauuaaggcuuuuuaaaauucucaaucaucaaguugaaaauguguugguagaggcauuuguaauuucagagaaagauacagucccagggugguauaguauaauugcagaugccauuuaaccugucaucuuauugucuuuuggagccucaauuaccucauuagaauaauucagauauuuauuugguccuuggcauuuuccaggagcugagcucaggucuaaaagcagccucucauaggcuugcuguguagguucaauuagguggucaagaacuugccgaggggcauugcuuguuauuguuggcugccuuccuuccucccaugcaagaaguguaguuuuuccauaguuggacaugaagacaguaacaauaaauaaagcacaguuuuugccauugggcaguucuuuuuagucuuagcuccuagguuugagcaggucacuguguccucugugugaggaaaaaauagcacuuaauaguauggcuguugaaauuuggagacaguguuucauacagucugaggcaggaaggauaccucaugaaugauagcugggauugcucugcuccccacaccacuggcuucucacaccccugcugagucgcuccaucuaccgaccugcucacauucuuucccuuuuuuccaguugaaagaaaguauuuguuucaaaacuuuuuuuguuuuuuguuuuuuucgagacacuuuaccaaaucauuagcuccucugaguuaacugucaguugcaugauuggucgucccaccagugcugucacaauugcucugugauauuucuauucguguuguuuaugucacuuggcucccacacuaaagcauaaccuuucuccagacaguugugcaaucugucuauaguauguauggccaaaagcaaauuuagaaaggccucaauucaguaggaauguaaauaaaugaguauuucuuuggcgugugccaggguuuucuguaauaacucuuggugcugcuuauuucccagguauaucaaggagugaagaaacacggcuucuuacagccucauuuuuuggcagaacaagauauaguuaucauuaccuaugauguucuucguucagaacuaaacuaugucaauaucccacauagcaauagugaagaugggcgucgccugaggaaccagaagcgcuauauggccauucccagccccuugguagcgguggaaugguggaggaucugccuugaugaagcucagauggucgaguguccuacaguaaaaguaagagucuguacaucuuacgagugcagaggaaggacgugaauggaucaguaguugggauucaguuaagccacaguacugaugguguuggcacauuuguugcuaaauacucuuguguuauucuaauugucuggaugauaguuuuguauggacuacuuggauaucuguguguaugacacaguucaaagcaaacuaugcuuagggaacuuuaaaucuucucaccuaauuggaagguuaaucaaguguucuccaguagccuguagcaaauggcuaaaggaaauggcccuuacauauugauuuuuauuauagcuaucucuguguauauguauaccucaggcauuccucuguuacucuucacccuguuguuuaagauggucucucauuagaucuggaacuuacugaguuagccagcuagacuagcuggcuugccagacgcagugaucacccugccaucauuucccagugcuaggauuuaacugcuguugugcacguuucuuuguacuuuggugcuaaggauccaacuucagguccuaguauuguguagcaauuacuuuacugacugagcagucucccaagccccguuauuuaucuuuauaauaucuccagugaccaaucuguaaccugaacugcauugaugagucauaucuccuagcacaaacgcccaccucucuaguaccaagcggugaaggggguguauucauccaggguauuucuccuucucuaugugcuugagccagcccugcaucucuggcucaugagaccacugcguuggguaauggcuuauugagucugacauucagcagugagugugaagacucaugauuaaagcagauguaucuuaccugaaaugggcuauagugggccuuuuuuuuuuuuccugauuuuucgagaccggguuucucuguguagcccuggcuguccuggaacucacuuuguagaccaggcuggccucgaacucagaaaucuaccugccuuugccucccgagugcugggauuaaagguguacgccaccaugcccggcuagugggccauuuucaugaggaaacacacaccugaguucuguguuuuguuuuugcucauaauuuucuuucauuaggccgcggaaauggcccagcguuugagcgggauuaaucgguggugcaucaguggcacuccaguucagagaggauuggaagguagguaauacaggcuuuccacggccaccauccuugaggagcuuacguacggggaaaaguacugcugugcuugaucuuugucagaaucuuuaguaaguguauuuucacuuagaguuugcucuuuauaguuuaaaacaauuaacuuguaaauggaacgugggugaugcuucaguuuguuuucuugaggucagauacauagugaggacucccauugcuuuaaauuggccaaguguuguuggacccauuccacagaauagcuauaggucucaacucaaccugaguuccaaagguuuaaaccugagaagaaaggaaagcaugagggagagaaaaauuucaucuaagggacgcugaagaaaaugacagcugaguugagcucugcagcgcugcuaagugaugggagaggcaaggguucucugaaguagaggagccugacacuugaagguaauaauacugcaggagaccuuaaacaagugucaguguggcuagagaacaagagccagggcaaucauucuugaguggauagacagagagaaaaccaaaauagaccuauuagacaccauaggaaaguacuuuucuuauucuuuuggaaaaacagauuuugaauuuugaaaauuugggaaguuuuugaaaacuuggaaacuauuagaaggauuuagauacaauguaauagauuaaucuuguaaaugaauuuauuuuucaaaagaugacugucauuguaacagagaaugauuugucagagagcagagucuauaguaggauaucagcuguuuggcugcagcaauuaauggaggcaggcaaugcuagcucugugggucuagacuagaguuguccuagagaaacagagaaaguggacgaggaaaauuaacaaguugcagugugcugauaaauuucuaagucauacacaucugugaauuaugcuagaagaaaagcaucuuuagguuguuaauuuguuuccagcagauauaauuagaggaccucggugaagcagaacuuaaacaauuggacugacgugaucugaacuauaaaucucugauuucugcagauaaaagugcauaauuccuaugugcugcuaccagagucacuugauucagcuacauagcaaggcccugucuaaacaguaauuaaaaccuaaaauguuugcuggccguccucaaaugguggaauagguaguuuauuuguuucacaguuuuauuaguuccuuuagagucaugcaauguauucugaucauauucaccugccuccccuauuucuucucaguucacucacccaccuagguuuuaauccuucaagacaaguuugugcucccaaauauuuggggguauguggucuugcacuagagaguuguugacuucacgaggucugcucucccuuucccaggagguaaugauacccaauggcuccagggauuguguuuccaacuccccucuccaugaugggauuuucucuggcuggaaaucaugaaauuuuaaaaaauaauuuuuauuccuuuugaagagagcauauauuguguuuuuuuuuucaacuaaugauacauaaaagcauaaagaaaauuucacucagacauggagaaauggcacagugguuaagaguggugauucacuaaguuuuguguguacuucauuauugucuuacacuaguucccuagaaaugaaguuaguagugaaagaucaucagagauguuaggucagagcauauucucugaaucauacgaaauuagcugcuacuuuuguuuuuucauguucuucuccuuuaacaagucuugcuuuaaugcacgugucuuaacacagcaaaucacugacguucacugaugguuuuugaguaaagugcaagguuuugcgguaguucuuacaucuuagguaucccagaaauuaaagcagaaccuagagcacaguagauucucaaaaauguaaauugaucugggauaaaaugugcacauucaagaagcuacaagaugcacccuacuucauggugaguccugucucuuugugguuugugagugagcuuaugcagagacaaaauaaauccagaaacauuuagcccuguguccugugacuuuuccuuuacagaucuuuuugggcugguggucuuucuuggaauugaaccuuauugugucaaacacugguggauucggcuucucuaucauccauacugcaagaaaaauccucagcaccuguacaguuuuauugccaagauaauguggaggucugcaaagaaagaugucauugaccaagucaguaugccaaacuuucauugacuauaacaaauguuuuacggaaacaaagcugcaaugaaguuaaaauuccaggcuaaauuguuugcaacuucccaauacagauccagauuccaccucagacugaagaaaugcacuggcuccauuuuuccccgguggagaggcauuucuaucaccgccagcacgaggugugcugccaggaugccauagugaagcucaggaagaucucugacugggcccugaagcucagcagcuuggacaggagaacugucuccuccauccucuacccacugcugaggcuccggcaggccugcugccauccacaggcuguucguggggaauucuugccacuccagaagagguguuaccaccaacucacuucucuugugggauuuuuggugcaguagugggcaguauuuaggcacuuuugacucccaguuugauucagggauuucuggcuagguagcaguuaaauuaguaguaguaguaguaguuguuguuguuguuucaugguuuugugucuguggagccucauuuguaaaagagucauaaaaauuguuuucauuucuuuuaaaauuuaaacuuuuauaacagguuuugugguuguauuuuuggcuuagagaggauucuucacauguauuuuuaugcuuucaagacaggguuuuucucuguggcccuggcugcccuaguacucuguguagaccaggcuggucucugccucccaaguacuggguuaaaggcaggcacccccacaccuggugaaaaauuuugcucuuaauaauacgucuaguuuuccacaugagggaugugcuagcuguaaucuuugaugugucuuguuccauaauucuuuuuguggauuggacuaaaccuuaaaagggggcccguguuuaguaccugguauuauaagaagcucucuugucugucaaagggcuguaaagaugggggcuuaacuuuugaguauauuaaagacagaaauagcaaaggugauaaauucauacaauauaagcugaaugugauaaaagcuuuacagauuauagauugcuguggaaauaguuucuauuuaaguaguuuaagacaucucucuaguggaaauaacauccgacuugacuacuagaacaucucauuuuuuauuuuauaaacuaaaauuugaauuuacaguaaaguauaagucuaauuaauuuguagagaugugguucuaaauaaacccaguccuacauuguaaucuuuguacuauuucaaguagaucauauuguucauuuucaauaaauguaaaagaaagcagaucaaguaggagaauacuugcuggauuaguaacaauuaaguauaagccauaacuaaaacugaaagggaagggagugguucagcaggucagagcccuugcuguucuaccaaggacugagugcagucccaguacaauaucagguuuuuuacaacacccuaaaacucuggucugugugcacgugcauacucauccucucucucucucucucucucucccucucucucucucucucucucucucucucacacacacacacaaauacaugcacaucguacucagaugcucacauacucauaaauacauuuuuaagaguggagaugaaagcugcugaaggugugauauaaaugcuauagagcacugcacccugacauuccagcaugcugacuuuccugcugagguaaugcuaggagguuucaauucugguuuugaaagcuguuucuucuuuuagcaccaugacaauggaagaguugcugacaucucugcagaagaaauguggaacggaaugugaagaggcccaccgacaacuaguuugugcccuuaacggcuuagcaggcauucacaucauuaaagguagaaggugauugcuuuauuauauuugauucuuccaguacuugcugaggaagguuaauuacagaaugaugcucucacacacuacugcuaugaguuuaauggguuccauuacauagcaaggacuuaugcagaacaugucuagaacaaucaguguacauguaccuuaagcaaacauuuuuaccuugagaagauuaguaaauuggaaaauuuuaggaaauuaagacaugaacaaauauucucccacaagauauuuaucuuagucuuuuauagugaaaaauuaaaaacaggcagaaaacuuagaaauagaaaaaugauuaaauuguaauacauacuuggacauacguauuuuuaauugauuuuaaaauugauauuguacauucaguuuuuauaucagagugugugccaagaaugguccagaaagaacaugcaaaauaaaaucucaaaucuuucauauacaacuaaaaccacaguuucuaaauaaucacaauaauugauagacuuauuaugaggauaggcaaaucuauaauuguaguagcagguguugcuaucccuuaccaacugcagaacaagcagcuauuguugugucuugggugaaagugguguagucagcacucacugaacacugcccagccccagaggaaugugugcucucuucaaguacacaucuaaaguaugaacaagucaguaagucuaagguuuaagucuuccagugcuuguuuuauuaccacaguggaauuaccccagcuaucagguugcugagggaacuccugccaagcuugaugauaugagcucagucccuggcacccagcuucuggauggagagaacccacaaguuaaccucagugugcacugugccaugcacccccuccugcuucauaaguaaauaaauguaauuaaaaaauagauaccaauaaaaaguaacuagaaaugcuuucacauauuugagggagggaguaauaguauaaaggguaauucaaaagagaagcuaggaaguauuuagaagugaaugagaacaaaauaucaagauaugugagguccuacauaucaauaaauaagagguuuuuuuuguuuuuugggguuuuuuuuguuguuguuguuuucgagacaguguuucucuguguaguccuggauguccuggaacucacuuuguagaacaggcuggcuccgaacucagaaauacugccuccgagugcugggauuaaaggugugugccaccacugccuggcaaauuaagggaaauuugaagcagaaaauauuuuuagccaggugugguggugcacgccuuuaaucccagcacuugggaggcagaggcaggcggauuucucaguucaaggccagccuggucuacaggcagaaugaguccaggacagccagggcuacacagagaaacccugucucgaaaaacaaaacaaacauaaauaaauaaauaaauauuuuaaauauguuuauaguucuauuacaucuguuccguuaauuuauaaauuuagcuuuaucauaggauuaugugcauaagaaacuaugcauugggcuugcacuguacacuaucaugcauuuaugcuugcugguggugucuuuguuuauagcccuugcuaaugagucuaaauuugcuucaagguguguuggagggagggagccaccuugugauaaauagcauuuccaucagucguccacauguaacccuccucugcaccauccagcaccaugagaguuacuauuagucuacuuugaugugcagucaugggucauuuuauagcugcucucauuuacauaacaacuuaaaacaucauuuaaaggccuggagugguaaagcuccuggccuugaaagcauggagaucugaguuuaauuccccuaaacaugcuuaaaagaacccgucugcugguguuggugcacccuuguaauccagcauugaggagacaggccaucuagccuagcuccuggggaacaucaggccagugaaaagaugcugucucuaaaaauaacaguaccugagccacagcagccaccugacauugucauucgggcuccauacacaucuguauacacaugcacguccaucacacagacucaugaacuugcacgcucauguacaacaacagaagacugcuuguucagagacauauguaguuucuguagaguacaaaauaagccuucuaagccuccaaguagccuuugcuaucuguuccuuggcauggcagaaccgcccuggguagugugucuuccuuugcaggaugcuugaggagcacuagagcaagccauucaaacuggguagaagcagcucugguagggcagaaagauggcuggccucugacauccagcacgucuaugucuguccuucagagcacagcauagaguagcccuugcuuugccucccccagaaaguaagugucauucuuaguaugaaacagggaaacacuggaaacuuggaaaccagaucuuccucauguuauggacuguaauauggagugaccucagauacucugaguuaaccuugcucacaguguaaguuuuauuagcaaugauuaacagaacaaaaauauggguuuagagugggucugauaaguuuuucaaauauggcaccuacaacuuuaacagaaguuuccuuuugggacaggcucuuuuaaguaauaguacuuacgaauuuacauugccuauguuuuuaaccauuuugguaaguguucucuguaguaguaguuguccagggauuaaaauuaccugggccuuauagucuguuaaaagacugaauagguaagcaacucugguaaagaauuuuacaguugaacuuuauuucauaccaacuuggacaaaauuaagcaaaaauugggaaaauguguaucacaucuaauaccagccuuuuacagucucaacuuaauugacuagaguaacugugauuagaguuuauagauuacuugacuacuacaaauaaaaaauauggccggacgugauggcacacaccuuuaaacccagcacucgggaggcagaggcaggcggauuucugaguucgagaccaaccuggucuacaguuguccuggucuacagugaguuccaggacagccagggcuacacagagaaacccugucuggaaaaaccaaaaggaaaaaaaaaaauaugcuuuccuuugaaaaugugugaauaaugaauguaaugaaaauacuuuguggucauuaaagucuaucauccugucuaagaaaugguauccuucaaccccuaaaguaggucucuauaauccaggcaggccuugaacuuggcugugugaccuuggcugaacucaaacauguguucuuucuucaccccaagucacauuugcauuacagcuagaagugaucuuuuucuuuuuuuuucuuuuucuuuuccuuuuuuucuuuuuuuuugggggggggggacuucugcggcuuuuauuuuugcauguaaaccacuuuggaggggggcuugauggugggcacccuagagauuacacuggaguucccagggcuccagacacuagccgggaagucagggugaucuuuuucuauaucuauuuuauauuauguguaggaguuuuaugacugcacuauuuuauuugcaugacugcuuagugauuagaauauuacuccauuuugcuuaaugaaacauucacauggcuuaguugcuuucccaacacugcuaaugccucacaugguguacacaugccugcuaucccagcacuugggauucagaauaucugccacagaauuuguguguucuagugcuggguuacagacauguaccaucccaccuaccucccucuucauuuuauguuguuguaacaugcucugacaagaaguggaucucugucccugggcuuuuaucuugucucccucuuggauugauugcuucuuuucccugcuccgauguuaggguugggguagaaucuuguuugcuccuuuucaggcggucaggcucuggcaggacgaaugugucgguuccugccggacaagcugcacugcugaucugugcucugugugugugguuccacugcacucccccucuggucuccugucuguaggugggauuacagggcugagugcugcuuagacuguuuauguauggaucagucaguaaggacucaacuucgaaaagaaaucuacauuuucaaauucuggaaacacuuucuuauaguauggaaaugugugauagauaacgaauacuuucagauccucagugacugguauuuuaaacacaugguauuccggguuuaagcaccaugcuaucuacagauaaucuuuagaaguaaaugaguuuggaauucucaagucuauugaaguaacuuggaaguguuagugccaucaaguggcugaaaauguguauuuccaaauuuggcuuuggcuuguauuuguaaaacuuguuguguauacauauuuugaguuuuccacagacaguguauuucuagaaacaugaaucagaugcuauaaugaaucauuccugaucagcugcuuaaauuauggucuaagccacaaugcuuccuuuaaauggaaauuuauuaaaugauuguuuuuuauaaauagauacuaauuguguccauaugucugaaugccauuucagucuaagcaccacaaaaguuggagcauaaaaaugggaauucaagguuaauugagguuaaauagguagauccuguuucaaaaaaacaauucacugcauaaagauaauugaauauuacuccucauuauauuaggugacuuauuuuucugaaaaucauuuucuccaauauagaacugaauaaaaauuaguugaguccucaguauugugaaaguauguauuuuagaaugcuuucuauuauguguauguauaugggaauauauguauuuacauauauacauguacauauauuugaauuuaggugaaagaagagaggcaaauuuacagaaguguacauaucuauauagaaaacugauuuuaguuauaaauauaacccuaaguaaggauuacuuuaaagaauaacauaccucuuggcagagagacagcaacaucucugcaccuucuuuguauuucauagcuuuucugacauaccauuuuaaauuucacuuauaauguacuaguuuugagauuuucuccagagagcaagaguagaugcuuuauucuagcuaugaaccaugacuccucuccuuccugccggugucaccacccuucuuuauaguaagcagacaagaccuugcagcucugugagccacagggguccccagcauccacugggcccugcuugugcaaugcagaagcagcugcagacagcacaggagugagcggagcugggcuccaguacaccuuuauuuaugguuguugaauuucucauguuguaaaacauaugcacucuuaaaacauguaaaacuaggcuugcuauguagcucagugacaguuugcuuaccugucuggcuuacauagagccuaauuuuaaucuccagcacucaaauaauaaaaauauaaagccauucuaaacugagaaauuauauaaagauccagaaggucagauuugacgcgcaggcgaaugccuggcagucugugcuucccgagauacuguucgaagugugaguccucuuaaguacaaacgggaaacugcguaagcgugagcugcuggugguggugugaucagaagugcaaguacugcuaagguugugccugcuuucuguaugguucccuuguuuuguucuugagauggggauugacucuaguccaguuggccugcagcuugcuguguagugcaggcuggccucaaagacccagcgucgucccucauagugcuaacauuacagacagcucuugguuuuugaaguguuguuuuuaaaaauuauuucgucauuuuugagaugauaacaguuacgccauuucccuccuccuucuaaacccuccuaucuacuucuccuugcucaugcucaaaauucauugcuucuuuuuuucauuaauuguuguugcaugcauauguguauaugcuuacacaauauauacuuaacuauagcguucucaguauguguauuguugcuuguauauugguucucagggcugccuauauccuacccagugauggacucuucccugggggagaccaguucuccaccuccagugcugcugcucuaguucuuugugugggaaugaagucuccuagucuucccucccacccauuuggccuauuacuguuguucuuguuuagcuuauauguuucuaauugaaaauuauuuaugccuuauaccaggaacaaauauguaugucaauaaaaguuuauuauuuuucugaaaauuagauguagauugaccagagugucaugaauacuucuuuauuacugucgaugaccaaaauuugucuuaaccuuaagucauaaugaaugcuaauuggcaaccuuuaugucuaauaacaguaagguuauuuucuaagcuuauuuuuucaguaugaguuuaagucauucuaaguauacuuuauuccaaauuuaucucuauaauuugaaacacuaaaauauccugugaaauaaaggaaccauaaucaccuuuaaaaaaaaaaaagacaggaguaaucguguaugaggucagauucuuuaguaagauacguaucugagaguauuaccgugguggugaggcugcugugcagcauguguaaagccccgaauucaucccggcacugaagaaucaauaauaauaaccauaguaagagguaaaguuguuauuuuuguaguaagacuuuuuagauuaaagguaacuggcuaacacugggaguacugcgacguguguccuuucucugcaggugaauaugccuuggcagcggagcucuacagagaaguauuacguucaucugaggagcacaaaggaaaacucaaaacugauucccuucaagugaguguagccugaaaaaguucaaguacauauucaaauuguucuaaacaacacuuuucaacauguuaauguuaaaauaaaggguuacaaugaacugagucagaauacuagagagguaaaagcaggcauuccuuuuuacuauugucuugaaugauuugaguaauagaguuugaaaaucaacauuauucucuauggaggccuauagccuacacugggagauaguuuucauuaucuguaauucagagaguaggcuaauuuuauaauuuuucauuugacuucaacauguuuguuaaauagcuuucaucaaaaugaaaaaaaguuagcuaaacuaaguaaacugacuaaauaaacacacuaaauaaaccugaccuuuuugaucuucugugcuagacucucagaggccuuuuagaaagagauguauguuugaauuauaacaguaacuguguuuccagcagauuauagguaagacuccagcaaaguaagaagugaagacauaggcauuaaacuugguaggccuggguugcuaccuagggaaguugacuuuucaggcuuuagaucuuaacaucgccaugugauacaguggccauuuagaaaggaguaaagagccgggcaugguggcauaagccuuugaucccagcacucgggaggcagaggcaggcggauuucugaguucgaggccagcuuggucuacagagugaguuccaggacagccagggcaacacagagaaacccugucucggacaaaaaaaaaaaaaaaaaaagcagaaaggaguaaagaaggacaggauuguagcaaagcuuagcugagcagcaaggccuuaaacagugaccuuaaacacaugugaguaccuaacaggaaaguuguucugcucuugaaaaaaaggaaauaaagaugcaagaggggcaaggagauagauuugaguaccaaaauuuugaauucaauauccaaagaggaaugaucaguuugguucuugcuuuucauuaguucaucucugcggacaagcaggguggugcucacugaaugcuuacucgguccagucagcucagcacuucucuuccccucuaacaacaugugaaaaaacugaaaacucaucuuccacaaguauacacagagaagcugaaacacauaucucuagcaucauuuguacauuuuuacuauuaaaucuauuauuacuaugcacugugugauuugagaagccauguugaaaauugucaagacauuugaaguaauguagacuccauagagacuuaacacuauagcuaguaauuuaugcccggauagaaugaaucccgaaagucucaaaucauauuuuggcaccaaaucauauuuggccagaauucucuccuaauaaucuugaggcccuagcuaucuucucggguaaaauauaaauuuaagagugaaacugugauuucauuucaggucuauucauugcuucuaaccuuuagcaaguugcugacucagcaucagggcgggaaguagguagaugcauucacacagaaauaaagagguuuuucucuuccucugaucucuucaacuccaacuuucccucuuuucauacuuuaagcuugguguauucaaguauaccuauauacucugcuccugaguacagagcuguuguuguaaaugguaucaauuagcuccguuauuaauaugccccagccagccccucaguaauccuauugauuuauuuaaccaucuuagcacagcuacugguugauaaucccuagucuuauuuuccuaugcuaaauuugacuauuucccagcugcacucacucccaaguuacuugcuauuugagucucacccgggcugcuuuuguuucaucagucugucuucagggacacuucuuuuggccccguauugggcaccaauuaaugcgauuaauuaacucugcugguucuuaauaugaccugcacacacacacacacacacacacacacacacacacacacacacacacccgcccaauaauacauaguccuacuugauuuauuuaaucagcuuuaguacaauuacuaggccauuaucccuaaacuguuucuuuacacuaggcuggcuauuucccagcugugcuuuccaagugacuugcugguucgagucuugcccugguuauuucuacuccuucagucuguccuugggguauauuucuauggcccugugcuccugguccaucccaucuaauggaaaccucuuuguucucuuaucuucuuuguucuucucucucuccugugcucccuaccugagacuuccagccuaguaaccaaaaccccgccuaccucugucuccccagguauuggcuguagccaguuuuaauuggcaaucauaggagauuggcgagcaaaguuuauacaacaucauuugguguaugugagagucugcucauugggagugcagccagaucuuggagccaguuucuagcguuuggauacauagcagcuccaaaccaaucccuaacacguagccaugcuacagaaaaacauguauuuuuuuauuugaaaauaauccaugucauuaucauugaagacauuugauguccauuuuccuugguggugguggggcaauauuacucgaauauuuucaaaggaaaacuauuugacaauauaaauuuugacuucauucuguguagauucugcggugucugcugcauugcaucauagccuuaccuuuuaccuuuuguguguuuguaacagagacugcaugccacacauaacuuaauggagcuguugggagccaaacacccaggaauaccucccaccuugagagauggcagacuugaagaagagguaauuguuauucuuuuauuuauaaaaguuuacuuauagaaguaucuaguugaugcuucuaaugcauaacauuuaaauaaauguagccagccauguuuuccugugauuuaauguuccaaacauugcuguggugguuuggaauggcagagaaaguuggacucuauauuacuuuguuugccuggugaucuguuugcagauagguuagauggcuuguagauacaacauuauugauuuaacagaugaaaacauuuugauuucaugguaggacuauaaagaguauaguucaggaaacagaaacauuacagauguucucuuccuugcuguguuuucuuuaagagaguaaaugucucaaauucucaguucaaguuucucucacugaacagaauaauacuauaccuuauuuuaauagaaauuccucauagcuuguuauacuaagucuccccagaauauuugccuuuuuuaagaucaaagaaaaagaaagugaccauugagagaguagauaugguugaaguauauuaaacuucaaaguaggauuuuuauuggaaucagcaagauuaaaaaaauggauuugauaaauauauuuaacccuuuguauuuguuaaaaugaguaauuuuuauugacaaaauugcauacauuuauagaugcauacagauacuguggaaugggguggcuaacagcauaaauuauauauccccauuaucucaugagcuugguuuuuauaguaaaaauauuucacaucuacucugagcagcauacuguaacuagucauugugguauaacccuuugauguauugcaggaucccuaucucugcagucccuagcaaccaccauucucuauucgcaugaguuuuacuuuaagucccacaucugucugaggucaugcagcauuuauuuuucaaugcuucaauuauguuaauuaguauauuguccccuguguuuauauauagugucagaaauaacagaaauuuuuccuuuuugaaagcugaaggaugugucggguguguguguguguguguguguguguguguguguguguguguguguuuuaucacuuuuuuuccaacucuguaugugugugucaugcauaugugcaugcaggcucucauuuguugguagaugugugugcaugaauauggaggcccaagacugaugucaggagucauccuggaaggcucgcucuucugucucauucuuugaggcaauuucucucagucaaaaacagagcucauugauaaagauagucgugccagucaucuuguucagggaauccuuccuccaccuuccaaggcuagauuuaaaggcaagcuuucauguccacuggcaugcaugugaguucuggagaucugagcucuggucuucuaacuuguugggcaugcguuguaagcacugagcuaucucccuaccucuguacaccauauuuuuuaugaauguuuuuuuguucacuguucauuuaagaaggugaaagaguggcaauaacuuuuuauuccuguuaguuuuaguccacuaggaauaucauaacagaauacuaggcugugaggcuuaaagaauaaauauuucuuacaguuguagaagaugaaguccagagucagcaucuacauccucuggguuuaguuucucuucagccccuggcugggauuuagaugccacuguugcuuacugccuuccguuugcacuugcacaucccagggcuucuuuccuccuaaggccuccauucaccucaguuagcuugcaggccucucuccaggggccgucacauugagcuuaggacugguacauacaaauuuuguaggaauggguucacuucuaacaccuuuauuacuguguaacucaagaguuauuuuuaaacaauggcaguucuuaaaguacugcaacaacuaaagcagacaaggaauucuguaagaucucggcucacuggugacauguuaaugucuuuuuauccuauaaggaagaaaucuuuaggcuuuuuaaauuuuguggcuucagcauaccauuuuuucuuuugauuguuuauuuuaggaauuucuagaauauuuuuuauaauacaaaauucuauguuuguaucaaggaacuuuaacuauauggagcaaccacauuguuccugaaacacaauacuaaauuaugaucaagaucuugagugaaaguguuauugacuugcuaucuccacacaggccaagcagcugcgagagcacuauaugaguaaguguaacacagaaguugccgaagcccagcaagcuuugcagccugugcagcaguccauuagggagcuccaaaggaagguacgugucacccaguagcauuuuggaucuauuuauuuguguuuuguuugaacuuuuuguuucccuucaaauucuuagcaguuacuugagugacacagauaucuuaguugacuuuucuguugcuuucaccaaacaccuuuaccaagacaacuuaugcaaacaauugaauuauuuaauuggacuugguuucaaaggucagauggcagagcaaaggcacagagacugaaacagcugagagcucaugugucgucccccccaccccccuuggauacaauauuuuuauuacagcaacagaaaaguaacuaauucaucagacagaagauaaccauggagcauucacauuuauaguagaaaagcgacgcugccuguggccuggcccgagaaggaaagggagcagauccagggcugaugcuguggggcugcuggggcccgaggugcaggaaagaccguucauuucucaccaacgugggcaucuuguggcuccucagugcuguugccuuuacugucagaguucgagagcucaugucuugauccauuugugugaggcagacauagaaaguauccugggaaagcagagagucucuugaagcccaccugcgugacauaccuccuucaagccauaucuccuaaucuuugccacacacuucuaccaacuuggaaccuagaaugugagcauaauagcuugugcaggccauucucacugacacugccacaauaaguauauuuacaguuaauggugucuauuccuggaguggauggacuaguauguugaugagucugcuauauugaaaaucuggguuuuuuuuuuuuuauguuggauaaauaacaguuuauccuuuagagaaagacuuugguaaucucuuuuugaucuuagcaauauauguucccacauuuaggaucacagguauuauucuugcagacuagauaccuguccuuucugaguuucuuuuuuuguugacaccagagcaaaaucuaacaguaaacaacacaaguacguaggcuuuuacuucaaauguuuuaucaguuguuccccauguugugcuuccuaauucauuaauuacuugguaacaguuguacuuuuguuauguauuggguggaaucuaguucauugauuagaucuaaccuuucuuuaguguguuacccuuuacacuuagcuuuuauuuugguaaaaaucuuuuuaaaacagcuuugaaacacaaauuuuacauaaaauaucguucgucuagaguauuguuguuaugaauacaaagagguauuugcccaauacacacaguuuguguguuuuucugugugauauagauauauacaguaugcacacauuuaucaguuauaauccuuugagaacagaauuuaucaguauuuuuucauuuuuuguaucucuuuucccauugaaugcuaauauaugcaguaacuggucaguuuuggccuuuuuuuccagauucauucuaauucuccuugguggcugaauguaauccauagagcaauggaauuuucuguugaugaggaacuuguucagcgggugcgaaaugaaauaagcaguaacuacaagcaacaaacugacaagcugucuaugucagagaaguaaggcaauaaugcagaacugagucacuguguacaagcgugcaggucauuuaguaucaggagcugcaugcacuucagugucccgccauggacuuagggacaucugggguuuacagauauuaagucuaaaacagagaucuuuuuuucuucuguuagccauuugaaauguucuccuuuuagagccuugaggucucuucuuuguugcuguuguuguuuuauauguauucuuguugguuugaaauccagucucuaaguagcccuauccugaacucuuuauguagaccaugguguucuucaacucacagauccaucuggcacaugccucugccucucugccucucugccugccucuccaccucucucucucucucucucucucucucucucucucucucucucucucucucucucugccucucucucucucucucucucccucucucucucucucucucugccucucucugccucugccucucugugcugggauuaaaggcauguacaacgacauuuaacuuaauuacauuuuuauaacaagaaauaugacucuuauccauuuuucuccucaauuuuguuucagacuguauagucuacucucuuuaaauagaaaaagaaugucagaaaacuguagucaucuaaccuuagaaagcuagacuauauuaguccugaucuugaaagauacuguauccucucuguuaggucccaagaauagaauuaccaaacacacguugucaucuuuuuguaacaggcauugcauuuuauuaaaccuugaguacugguagguaccaguggguacacucuaaagggaagucucagcagagugugugaauuugacaguuucuuuaacagcaugauugacacacguuuucugaagaaacugacugacuuucuuugugcugugcugcugaugggaauaagguuccgugacugcagaggucuucaguucuuacuuacaacacaaauggaagagcuccauaaguuccagaagcuggugagggaggcugugaagaagcuggagaagccuccaucccgggaggugauugagucugcaacaguuugccaccugcggccagcuagacucccucucaacugguaggugucuguggaaguuagacaggggcccgcaugaucucagaaaugguuguucauaaguugaaccauuuuaccuuaauucagacagauguaaacauuuauuuuuuaaacuaaaacaaaccaaggaucaugugcuugaaaaccauuucauuguuuucuuaaaugcucuauuuguuagaaaaauaaaauacaaaaugcuggggauuuuuguguuuugggaauuuuuuuuuuuagaaauauguuauugugggucauauuuguaaauauuucucugauaaucucuuucagcugcgucuuuuguaaagcugaugaauuguucacagaguaugaaucaaagcuauuuuuuaacacguaaguucacugauuauuacucaugaggaaaaggaaacauuucaaaggauuaaagucuugaguaugugacugaauuuucuauuaugaccuuugguauauuuuuccuuuauuaaaucaauuuaauaauccuuugggauuuaacaugcccauuuuuuucuccauagaagcuacaccuaaauguuuauaagagacagucuguaauuauuguaauugagaagcaauugagaguaguaguaagauccuaaacucaauacuuugaugaauuugaacucaaaucccugaacacugucaagagcaaauuaccucuuuaaccaugaagugaagguaauaacuuaaucuacaauuaaguauuaaauaagaaaaaaaauacauauauacacauauauguguauguauauauauacguuuaggagaaugcuaguacauacuaaauaaccaauaaaaaauugaaguucuuguuaauuucuucaucagaaaacuuaugcuguguugggauuguuguacuuggcaugucuguguccugauuguggccuuugcucuguugccacugugucuuuucuuugguuuuuaaugccugguaauugugguugcucaggauucuuagaauguaauuuguagaaugagauuuaaaggguuuuguuuuuguuguuguuaucagggauugagcucauggaguacaaaaacaggcacauguaaucuuuuuuuuuuuuuuuuuuuuuuuuuugaucuuuaccuuugaaaguuggaggaaggacaguaaggcguugaaggccagucucugcuacauagugacuaggaggcuagucugaacuacaugagacucugccucaaaaauauaaaacaaaacaaaaauggaaguacaagacaguuuucaggauuacuauuuuuuucagggaccuacaaaugcucuaacuaacaugaaaauugcuguagaguacugaacuggcuuuucuguguuuccugcucgccucgcucauuugcagugcuaguuagcaggcagcaguuagaauuacuuguuucugauauuuuuucagagucaaaggccagacugcaaucuuugaagaaaugauagaagaugaagaaggacuuguagaugauagaguaccuaccacuaccagaggucugugggccguaagugagacggagcgaucuaugaaagcaauauuaucauuugcaagaucacauagguuugauguugaauauguagaugaaggaaguguuucaauggaucucuuugaggcauggaagaaggaauauaagguacacuauuuuuaaacuucugaaauuaaaaaccuuuuugcauuaacuugaaaaucugcuuuggagacugugugucuugugucuuucucuuuauuaaauuaguaaaaaaguuauuaagcugacacuugcaguuaaaauguaaaaauauuuaauuguauguuuuauuguaagcugcuuauucuuaacagcugcuuuuugaaacuagcauuugaauuuauuuugauuuugcaaugggaaauagcaaccaaaugucaguauuuacaugggaagcauuguaaauaucucaaguuggaaaucuggaaagcaucgcaauggauauagcauaacuuggccuuuaguuuucuucuuaagugguuccauugcauucuaaugugugagauguacaucuuuuuuuauuaaaucaguuucauauuuguuguauuuugaucuuugcguaugagauggguaugggagauagaauaccuuuacaguguaauaucaaauuuguauauugauauuuuuguaauuuuuuaaaaacaaaauaaaaaguuuuguguugagaagauaccuugucuaaaaugccaguucagacauuuuugaggaaugaugcuuuuauaaaggugaacucauuaguccaucguauuuguuauaaaggcaaugcacaugcacaguguucuguacagugcccugccuucccuguaguuuucucuauccugugcucaccaugugcucugggcuuaggugagugcuuaucaugccucucuccaucuuugugcaucuuuccuuuauaccuuugcacaagaaauggaaaaccaaugagcuacuacuagauguaucaacuaguaucugcuuuaaaaugugauagugaagacagcuuaucaaaauauauauagugauugguagcauuuuuauaaguuucaaaacucuuauguaacuuagcauuuuuccagugaaaagugggauuaaaaguaauugccugcuugacuuugaaggagaaagaauaaggaaagaaugauaauauuacagcuuucuaaggaauuugucuuauuaagucucuugaauuggauagucuauggucaauuauuucaaaaaucuauuugcaaauuauuuugaauaucucuugaauuagguaguuuauucaguuauuucagaaaucucaaauuuguaaauuauuuugaauaugugaauauaauauaaaaauguuuuaagccaaaaacaaagugguaaucacauaaaucuaguauugguuuauguagauuuuugucucccaugaaauacuuagguguucuguuccugagaacugcagcagcauacaagguaguuuucucauacauccucauucuaaauuagccugaagaauugcuuuuccuugaagauuaaugaaaacauguaggccucuuugaagccuuuugcucaaaguacaucuuagugauuuuggacaauuuuaaucuuauuucuugcuacugucuuuauguuuccccaucaguuacuucaugaauacuggaugacucugagaaaucguguaucugcuguugaugaacuugcaauggcuacagagcgacuaagagugcgccaucccaaagagccaaagccaaacccacccguccaucacaucauugaaccacacgagguaguugagaaucgaucacaagaaaggccccaacaaaaauccaaaauauauaacagacauaaagccaaagcagcgaugucuucuaguaauaguuacugucauaaaaaugggcaauuucauucauaugugauacaugcuuaguguguccacuauuuggguacauuuuguuugcauauucuucuauuuuugaauacuuuauauacaucaaaucaaauagauauccuuggucacuuuuagaaggauuuuauagccucaguuuuaccagaauuugaaaaaacauguuucuuagaaguaacuaauaacuuugauuuuugcacguuuuuccgucuugcuaauagguauuuagaauguguacucuaauaaucuccauucgugucaggauucagucagaauucuaccagucuuuccuguaacaaaaauauugccuguguaauuuauuuuuaaccuuuauggauauuuaauacuuaaaccgauuucuuuuuguaaagcauuuagacuaugguuuaagauaauuuuuauguuauauacuaucuuaacuauaaauugguagagauguuuuucuuuuucuguuguguuuguuuguuuggagacaggguuucucuguguagcccuggcuguccuguaacucacucuguagaccaggcuggccucaaaaucagaaaucugccugccucugccucccaagugcugggauuaaaggcgugugccaccacugccuggcgauguuuuucuugaaacguauguuuuggacuaaguuuacagcacuaggaacauaagaaguaauaaaaaggaaaucccuucuauuuauuucucuuucugucugauguauugcagaagaggaagaacagucagggguagugucuccauaugauaaaccacucacaccaagcaguguguugugucauugucuucaucccacgcuuguauuagugaaaaguggcacagaaauagaauucagagggauuuuuauccgauuuccuauauaucaugaggcuucuuuuuaaaagaacuuuauggaagucugacuucagcuuuaaaaaaaaaguccuuucaaacuauauuuucaguauuaaucuuguaaaauuaaguuuuaauguauaaaugguauuucauaggacggggcgugaauuugauuauucagaaaaaucauacauguuuaacauaguugacccaucuuuuugagagggaauaaaggguugguuuguuucuagguugaacagaaucguauaaaacuggugaaugauaaagcuguugcuacaucacagcuucagaagaaacuuggacagcuucuuuaccuaacgaauuuggagaagguauagcuuuuaaaauuauguuuucccuauacuguauuucaagaaacacuuuagugguaauuuccacuuacaauuccagcccugcaaugaauaguacaggcuguguguuaguguuggaugaaucaagacuacuacugccugcaauaguuaugcagaccgucugcuaaacccucaguucagccucugcccucccugccuagguagauacgcuaccaaccgccaugaccacgacucguucugucuccacagccaucuaucccucagcccagcccagccaggaaaguaccuggaugaccugcaaauuaugaaaaauauaugauuaauuauuuuuaagcacuauguuguaggugguuuguuuuaugugaucugaaacagaucaauacuaagaugaacuaauuuauuaaacucuuuuaaaugacuguauaagcaaauuucuggaucuuuauagguacugaauuuaaguucugguuuuuuaucacuacuuagaaguuaaaggguuuuuugguuuugguuuuugguucuuuuaguguuagaauauuuaguuagugaaauuagaaagaaaaucucuaguuuucuccaguuuuaaagguugucuaccuugcugacuaucugaaacucuuuaaaauuuuaugagaauuuuaaggagguguuugaaaaaucuauuauaauuugauacaguucuauacacagacguuucaaaucaaucguauaucugcuucccaguuauuuguuuaguuagauuaaaccagggaugcugaguggcaacacuauuaaaacagaauugugccaaaucacagccuuucccaugccugaucuugggcuacauaugcaugaggguacacuuguacuauaauagcuaagaagcuguuuguuucuaagcucuaaauuuaaaguguuuuuuaaggucuucuuuuuuccagcaacaaaaagagaaagggucucauguagucagagcucccucaagacuaccuucaagauuaccccugauuuauuugcuucuaucuuccaagugcuaggauuacaguucugugucaccauaacaguuaguaauuuguauguauuuacaauaaagcauagucuugagaauaaacuuucaaaaauuaguucauauuuugauuuuaaauuuacuuucuauuguaauuacaaguauaguagcauaacacuauaagcugugguuuaaaaaaaaaauugguuuuccuuucuuuaauugugugcugaauaaauuccagaaauaguaauaguaguauuagguaacauguacaauauuaggugaucucacuaguuagauaauucagguugaaauuacaagcauauacccuacaaaugaauuucacagcaugcaucaaauccuaaauauaaaacauagcuaacauguuuuuugaucuuuuuuuccuauagucucaagauaaaacaucaggagguauuaauccagagccuuguccaaucugugcucgacagcugggaaaacagguaagguuauaauaaaacaucacaggaauccauaaaacaccuuacaauguauacuguuucuacaucuagccaggcuuucuuugucuugugcauguauacaaauauauacacuuucucauaacuguuagagguagggucaaggcuuaguuaacaugcuuaagguuacaaauauauaaacuuuuuccuaacuaaaaacuuaacccuagaacaaccaaccauaccuuuuucauuaaagaugcauaguuguaaacauuucuaaacaagacauuaauuuugccacauuaacauuugguaauugaacaaaguauaacauacuacaaauuuacuaguacagagacagugauguaguuccuaacaacaguaaagucucagaucuuaucuuuaaaguacagauaccgccuccaaccagaauuacagagaaagauauucucaaaagagacuguaaaucuuaauaggaaagcugcuauauuaauuauugagcagcagaauaaaaguauauaauaguguauaaugucugauuuaaguaaaaacaacacuauuaaggaagggauugggccuuagaguucuuuagugauuuugugugugccuaucauguaguuagcccugggucagggcuuuuauaaaguuccaugcuguagggccucuguguccuacauuucugcugcuacuguuagagaugcugccacuuguucucagagucuguuuacugaaugccucguuauugcugcuguucagucauuucuuccuguugugagaaaagguggaccagucuugcucuguaccuuaugaacugaauuccugugaaaagagaaaguccuauccuacauuuccagugucauuugaggugcacaggguacucaguaguguugcucugcgaagcaaacuugaaugggacuaaagggucugaagaucccgguuucagccuuugcuuacaugggugaaacuagggagcugcaagaaagguguccccaacuggaacaaaaugaacuuuccucauaaacuauuucaaagccacacuguuaccccaauuucuccugccccuaaucugaaaucuuuuuaaggagauuccuggacacauugcagaguucugucugucccuuucagugcaaauacagauguguccaaauccaggaaaaaauaagcugagagccuaaaacccauugccacaaagcagcaaacuuaagacaaaugaucucacaaaaggguccacaaaaaauuucuugugucuuuccaaacaaaucugaaauaucgucuuauuuucugaauaaguguguuagcaagugaaacuguaaguauguuaauaaguuaaguagcaaugaguauauuaccuucacauuaauguucucaguucugcauuaucugcuguuaaguacugaagguguaaucaguacugauguuuucuuuaaaucugaaaugagaacacuagcuucuuacaaaauaaugauaguugacuauuaaggaaaaugaagaugaaaauguaauucucuuagacuaaaaauaucuuaccaugagguacuuaggaauuggaguuguaaguccucuuugccuguguauguguucauggacaggaaggucucauugacccguucucaccaugacuugccaugcaugguuuuuuuucagugggcagugcugaccugcggacacugcuucuguaaugaaugcacuucgauuauaauugaacaguacaguguggggucucaucgaaguuccaucaagugugcuaucugccgccagaccacaucacacaaagaagucuccuaugucuucaccucagagaaggcaaaccaagaggaugauaucccugugaagguaugguaagucaagaacauacacaauuaaagcagugcaugccaagugaagcauuaaagacaguuggcacagugagcguagaaaccacuguugaguauauccacaguagcuggagacucagcuuuaucaccugcuccuuguggagagagcuaacuaauacagucagccgcagucauaucacuaagagcugaagaacugcauuucccugcccuguaugcugcuucucgucacuacagucaguuucagacuaggaagagaccucagugcuagaauacuuggcuagcuugcccaagaugcggugucuacuauuuaacauugaaaaagguuuuugguuuuuuuaauccaaauauguaguuguuaaaguuauuuuguuuguuuguuuugcuuuguuuuuuuuuaagcuuucuacuuacuuagucuaagccaggaaaaaauggguuccuagcauuagcugauuaucccaaagacaacacaguguucuuuaaaacuguguacugacauuucagaauacagagaaacuugaauuuguauugacuuuuucauguuuuauucaaaauaaaaauuuacuaauucagcauacaaauaggauccacuggacuuucuaccccaaauguguucauuuauaaaaaaaacacuagguguuuuuauuuuuuauuuuucuuacaugugcuuuuaaauuucuuuucuaaucagacuuggucaaaagguaaauuaauaugucauuuaauaggcacuaggggcuagcuguauagaguaggcagcggugguacuaaugcuuaagcaggaagaggacucauccucagauuccuugacauucuuauauuuuaagaauguguuuucugaguagauuugagaacaaguugaaauuacugacagagguagguauuuguuagaguguucucccuccuaagaaaccaacagguaaguuagaagauugguagcugcuuuuugaguaaauuuaaagugucagucacauugcuguccccagaguuggaaugaauuuccauucauuccuuccaugcauacuuauuagaugcuuccuaugcccaggcagugagcggccuugcagauguaauacacagucaagauguggcugcugaucucucugagguuacaguuuggugguaggaauggagaggaguuugaguuacagcaaaaaguaaagacauuaaacaaugauuuuuuuaaauuauaaauauuauaaaauuaaagccaaucugagcuuuucugaggaaaugauuguuaagaaacacaauguaaaaaaugaguggauuguccaacauggaaagaagguagaacugaucuugccaagaggauguucccagacugaaaaagaacucacaauaugugaucagaccaagacagacaagccuaacacagaagugaguggcugcagagcaguagcaaaacugaaaauaaaauggaaaggcaggcaaggcaggcacucaggcucuaaaccuugccaagaucuuccuugcuacaaugaagaaaaucaguuagcaaaagaaaaagaaacaagaacaaaaguggaaaaaauguagguguguuuagggggccacacaguuggcuaagauguauuuaggguggagacaguggaguuggaaagagguagguauguucaagggccacuaauguaacugagcauuagcagguauagcagggaaauacccugaauucugaugugaaaaaucagauaaaccaagacuuguaacuagaggcaaguguagaaaguaaguucucuguuguuucauuguauucaagauaaaagauucuaaagcaugcuuaagcuccaauaaaagacuagacaggagucagugagaggacucagcaggcagaggaacgugcugccuagcccaacaaccugaguucuuuucugagaccuauaugguggaaggagaggacacccaaaguuguccucugaccauaugcacacuguggugugugugugugugcacacaugcacacacaaaaauaaaaggguaaccugaagauacaggaaagaaaacuaaacuguaguauuagacccuuggaaaaaaauagaguauuagcuuauaaaaaguagagaucucauugaauucaaauaguuauagguugagcuguugagcaaacaaacuguaaguguguguguaucuuuaucuggaaugggauaguuuaagugagguaaaagaaaauaaugcuagaugagacuggaaugcauauguagcagaugaugaaugucucaauuugagguauauaaugauuuuaaauuagguacccacgugcugaacaaaugaaaaauaguguuacuauaugauaccaagaaaagaguuaaaggggaauugagucucgugaggagagaaugcaaauuuauuuguguucgagaccaaagaaaguaauguugauacucuaaugcagagcccaaaggaaaaugauugaugaugaugaugaugaugauuuuuuucaaaaaacaaauauuuaguuaugucgacgagaacauuguugcuaucuucacacacacaccaaagauggcauuagauacuauuacagaugguugugagccaccauacgguugcugggaauugaacucaggaccucuggaagagcagccagugcucuuaacugcugcagcccccagugaugaugaucuuacagcacuuacucugccauaaaacauucaagacuguaaggagguacaugggagaugaauacacagugugaacuauaggacaguugggaagaagcgaggagaggaucaugaucugaggauaaugcagucugucucugaauuccuugggugaauguguuguaaaaacauguguuaagaaguugcaaaguaaagugugugauuggagcagcccagaggccggccagccuugagacuuuguggucaguguucuguuccuagaauuguccuucgcagucucucccacguucuccacacuuucauguuucucucccucuuguuaagacgcugucuguuuacucuucuuuucucuucuuucugcuggaguugcagguaugccaacagccacaagugguauugaugaauaagauggggcagcucagccuuacacaguggaaacaccaggagccaggaugaggcagagcugccuccaugcccugugcuggaggguuagaaggaggcuggucuaguugccaguaaacugugcggcuguggcucugagucacugagccaucagacccacacaccuguuccuguauggcagcuuuccuauacccaguacaguuagguuugcagcccugcugggaaggagaugucaguauugaaauauuacuaaauacucuugcuguuauguaucuuucacagaugucugaacacauguauuauacugucuuauucagaaaacuaaaagauuagagacuuuaguaaagauagcuuuuccuaccauugacucagacauguuuacauuucuucuuuagcaaacaugauuaaauauuuuacauauuauauaagccaaucucauccucuuccacuuccucacuguaauucccaccacauuuguguuuguuucugucuacguuuuuugucaccauuccugucugccacuucuaccuguuguuaccugucaccucuuugacacugucacauuuauacucuacugucugucacucgcucuuucaaacaucugcuuaauauguguucagaggcuacucuacucuucugacuuggucccuacagcuccuaaaccugaaguuuuuuuauugucaaauuuugcuacuuaguaaaaauaugaauauguaaguuucuauaaccuuaagggguuuuuaauuucacucuuaaguauucaugacaagacuucuguacauagcagacaguaugcuggcauacauagugcuuaaucauauaacuugagaucauauaaaagguauucagagaaugcaaaaauaguaauaaauagucuuugguauuuuguuucuaaagauauuuuuggaacuugagauuucacagauuaaggcauccuguggauuaaacauagaaauaagauacugauaucacuaguaucccuuugguguaugcacuuaaauaaaaguuguaucauccacagcaacagugacaguauuccuaagugaccuuggaaccuacugggcauguuacaaaguaaacaaaauuccccuugcaaguuccaacaacugcaaggcauuuggauguggugaaucagaccuccuggcagaaaauagugccauguggcuuguuccauguguccuguguuuggcaagguuucagacaaagcacuuuugcugguauaaacccagccccaauacugaacaggauucuuaguucauaaguuucuauucaauacaaaauuuuaugcauagauagacauagcaaaaccgcucccucgccagccacccagcacauaugcacucuuacuuucucaucuuacagugaguaccucauaaucagccagugugcuuugagaaauaggcuuuucagacucugucucaaugagauugggcucaucgcagauaggauaugguucagugucuuugguuuucacaaagcauaucuacuaauuuuagagaagucuuaugcaacuuauagagaaagcauuguauuucuauucuaauuccaagacaaucagugcagcaauaagacguguagaauucuggggauagcaucacagugcauuuucuuuccuucccccucuccucaaguuaucaaaaguuggcguguucguacuuucuaacaugucauuaaauaucuggguagaaaaaaacuaauuauaaaauugugaguuugcuuaaaguaauuguacaauaacuucagaaaucaaaucuauacuuaauuguauuuaaauguguacaucuaaauaucccuauaugagcuaccauauauguuauauaucaguguuaacugauaaauugaaaauaguacugauuuuguuguuuaaaugaguuuauguagauacaauucugauugucagaaaagaaaguuucuauucaucgacacaguuaacaauuauaguucugaaugaugaguguguaguucucuuagucaugcugaaaguuggccaugcuauacaacaaauugaacacacaguugagacugaagauguaaaguguaaauuacuuuuauuuaauuaucuuuuugaaaaacauaguccuacuucugucuuaguuaggguuuuauugcugugaagagacaccaugaccaaagcuacucuuauaaaggacaacauuuaauuggagcuggcgugcauuuucagagguucagucuguuaucuucauggcagaaagcauggcagcaugcaggcagaaguggugcuggagaaggagcugagaguucugcaucuugauaggaaggcagccagcaggagacuuacucuuccuuacugggccaagauuuagcacuaggaucccucgaagcccaccuccacagugacacacuucucccagcaaggccgcaccuccuaauagcaccacuuuucauaggccaagcauauucaaguacgacaguccuuucuggaccacuaacacuaguagacuguaaagagacauuguucuugagauucucuucuggagccuaagcaccuggcgugcgaugggcacuuaguaaaaaagguuaugaaauauguuugauccaaauaugauuuuuagauuuuuuacagauaauaacuuauuucugaaauaauucugcaaauuguuuuaaaagcuggauaauaauuuugaggccuaauuauauaaauaagauugugcacagccuggagaggguuucuauugugcuuuguaagguaacgcauacgugggugaaaaaggcagccauuguuccugggugcuugagaagcaccccugcugugugagggcugucagaccacuucaaaccuccacuaugcugugguguuugaagcagcaugggcuuuaccuuggugaaugggugugaacggaaaagacaugacaacuuggcucuggaaagagcuagccuuauucuaaauggggaaguacaggaugaaagucagaaaauaccaaaauaggaacggacuuuguccugaacaaucacaggagcuuuugcacauccugugcaaguuacaaacuucugaggaaagcuauagaaaaaucuauuacuaucgcaguuguucaaauuacugacuaaagaacauccuuuuccuuauuggaaaguagaggaacuaagcugugugaauaugucaucauugaaauuauauuucucagaggaaauuuucaaaaccaguagcgucgggccuuaauucuaguaguaugcauuauguauguauguacguaaguuuucaacaguuacucuuaguaagcacuacacgaguaaaacgugagugccccacaucuggucacggcaaccuucucuucugugcuagguacugacugggcguccaugggcgguauaaaguacuguacgcacaguagccuauggggagacaguguguugguucugaggcagcucacucugguaaaugggcaccugauuuuaucacugaguaaugcauuaaaaguccuagaauuacacaccucccacuuccuccccuaaaaacccaauuuauaguugauaaaaaauacaggaaaaugguucuuaaauguuuaguagaaauaauuaauaaaauaauggaaaaauaaguaucuugaaaaugucauaaaguaaaaaacugaucuuuaccuccauucuuauuuugcucuauuacugugaacaguuuuugauuuuaguuccagggagagccuguaugaccuucaauacauacauuuuuuuuuuucuugauuacuagcaguggucagaaucuacuggcuuuucuuuuuaaaauaugaagaaauuaguauaaauauucuucucccucauuccucuuuaauaugcuuaauuuuuaaauauauauguacauauauauuuuuuuuaaaagauuuauuuauuuuauuuauguaaguacacuguagcugucuucagacacaacagaaaagagcaucagagcccauuacagaugguugugagccaccaugugguuucuggaaauugaacucaggaucucuggaagaacagucagugcucuucauauagcaugcaugagagccauguuuuauuauauaauuguagauauaucuauauccagaaaaaggaacaguaguaugugcaguacuauaauguaaauuuuucaucauagaaucaaguagaaagauugaaguuacacaucaaagaauaucucccuagucuucuaccacugagcuuugccuucaaauagguuuccaguauauuaaguguguagugagauucuucuaacauuuuuauaggaguguauaauauauuugauuauauucaaccccaauucucucuuguccuccucccauuccuacucauccccuucacagaauuuucuaagcacccaaaucuaauuuucuuucuaauuaucuugcuguuuucuaaggcaacuuuacucaguauuuauuuauccaugaaaucaucauuaacauucuucauucucuauuagauggcuucaagaaauuugccaggaaauaugaaugauuaguuuuagaauucucagcuuuuuaucaugaauucauuuugccuuuaaagugauauuuccucuacaauagaacuugacuagauguguuuaugacacacugcacuguacauuuauuuuacaugcauaaaauaucuauuaauauauaguagguauaaaaucucuaaaaauauggcuuccuuauuuauguaagaagucuaaacacaaaugucauuuguucuguuugugaauagaucauguuggcuuucuguggaguuagcagagacauuggaauccccaggggaggaaaugaauagaccaugaacuuacacacauucucauauucauucauuuucucuuucucuuucucccccccccccccuuccgcccugguguuguaaacagaaaggcuggauacgauaggcuaugcugcucaaugagcuaacuguuuagcaucaugaacuggcaugcccuacuuccaacugugugucccccacauuauuuacuuuuauuagaaguuauuaaaauacaaagcaauaauauuuuucuauuugaguaauuuuauuuauucaaaucaaguagacaaaucaaguaguauugauacugcaguaaggaguucuugaauaucuucuacuuccuugccucucuuuuaauaagggacuuuagcagccaggagcagauauaaagggaccagaguuaagucaacuaugaugugucuuuccauuucaugcauguaguguuuaaauauguuugguccagggaguggcacuauuuggagguguagcccuguuggaguaggugugucacuguggguguggucuuuaagacccucuuccuagcugccugucccuguuugccuuuggaugaagauguagaacucccagcuccugcugcaacaugccucccuggaugcugccauguucccaccuugaugaaacuggacugaaccucugaacauauaagccagccccaauuaaauguuguuuuuauaagaguugccuuggucaugguaucuguucacagcaguaaagacagcccuaagaaaagcccuaagacagaaguugguaucagagacuggauuauugcugugauaggccugaccaugcuuuuguuugaaagaauguggauuuggggacuuuuugauuuggaaagccauggaauguuuuaggagagacuuaaugagccauccuaguaggaauauggaagacuuuguugcugugagugauuugacugugcagaccuggccugagaaguuucaguggagaagaauuuaugugaccuagaagcuguuuuuguggaugaagaauguggcugccuuuugcccuugucugaagagucugcuugaggcuaaggugaagaaacucagauuaauugcauugacaaaggaagucucagaaacaccaucauagacuguauucucugcuuaaaucucaugaagagcauuuugcauaagcauagcaaacgugggaaggaaaaauauaaaauguauuguuugaguauuaaaaggacaccaggaagugaacauagcugaauccuguguucaaggauauuaaauugaauuaagaaaguggugacccuggggcaagaucucaccuaccuaaguuuaagucaaggccuggugcuauacaccuuuaaucccaggagacagagccuugcagaucucugaguucaaggucaaucuacagagcaaguuccaggauagccaagcuuuggcagugaggagcugggaaacagaaagcuaguaauagaauaauggaggccauguuccagccccagcagguaacagacuuggacuuuagugcugauauauuuuuguuaauuuuuuuauauguuuacuuucuauccaaaacucuagcuuauucucuauuauacuuaauagaaagguuugaggucauuucuuuauuauuaacuauuuuacuauuuugccugcugauaucaucuuuugaguggaaaaacaaaagguguacuguuacaggguauaugagugguucuaucugaaggucugaauuaucacuuguauucuuccuguuuucucuuuauuauuauuuuaaaucaguaguaugagauaguaugguccccuuuacauuuuuuuaaaccuuguauauauaauugagaggcuguaugucuaaagaaauaaauguaagauccuuauuuuagcaugcagauuuuuagccuuuuuuuuaaaucuuguccucccauuaaauuagaauaauuuucuuccuuguuuagauguuuuggugguuuucguuuguuuuuguuuuuuguuuuuauuuuuguuucacuuuguuuugguuuuuugagacaggguuucucuguauagcccuggcugucuuguauuuuuuccuguaauaaguguauugaaagcuuugaggaaagggcaagugcugcugugggaacccauuuacauuugguugguauccuccccacaccuccauuuaggucauggcaguguucauguuuaaggucugaaagcuguuacuugauuauuuacuacagguugggucaaacacacugaugguugguucaucauuuguuuauuccucacauuuucuguuuccugugauggaaccguuuugaaagaugaaaaaaaaaaaaaaaaaagaaaagaauucuuguaaagugacucuaugccuguguguuaguccacaucuuguauaucugucguuguccaugaucaugccaccgcaaaagaaauuuuauuuauuguuaaauccuucaguuuucaaggugccuugagcuuuuauucuuuguauccuuacacuucuaauauuaaaauaucuuaaaugaauggaguagugaggaauguuuuuaaauauacauucugcuuccuuauuauaauagaauuuaguagauauaaaacaaaguguuugguaucaauacugugugacuuucuagagugcauuuauguccaauuaacuggauguaaauucuuuuaggaaauccuuauucuuagauuugggggacaggggagaaagugcgugacauggcacgugugcagagucaggggacaccauguagauaaugacagccuccaugcuguaggcuuggaaaugaaauucagggucaucagacucauccaaggaugcugcuuacccauugagcugucuauuaaauaccuuggugauaaacucauucauuucugcaauuagacacuaaagaaaauucccaguaaacacaaaauaaaaagacuaauuaagcacauguauauuugcuuaguuauguauauauguauguauguauguuuguauguuuguaugcucugacauauauagcuugaaugaaguguuuuauaccaaauuucuuuccuuccuuaacuagguuuuguuugguucuaauguauuuuccucuuuguguucaaaggguagccauucuacaaaaguggaagcuguggucagaacucugaugaaaauacaacuuagagauccaggggccaaagcgcucguuuucucaacgguauaaucaagacuuucugcuucagucuagcugguuuuccaccucuacuuagugucuaagaacuacuuagaaauacugaaguagagcuaagacucggaauuacugucauaguuuuucuguguccuuauguuuauauagagagaaaugugauaauacuuuauaaaggcaguuccuaucauguauuauacuuuauguuaauaucauuuagagauauuuuugagauuugaacaaauagaaucuauaaccuucaaagauucguucauaaaugaaauggccuauuuaagaaaaaguaguuaauguacuauaaaaaguauuauuuauaaauauaguaaaauacuaguuuuacauuuagaaaguugaacuauaacuauuaaauacaccauuguuuuuuauuuauauuuuaauuauuuucagugaugcuugugguuuuuuauauuaucauucaacuaguauuugaugagaaaagaaaaugucguuucccaacugucuuaguuaggguuuuacugcuguaaacagacaccauggccaaggcaagucuuauaaaaacaacauuuaauuggggcuggcuuacagguucagagguuaaguccauuaucaucaaggugggagcauggcaguauccauucaggaauggcgcaggcagaggugagaguucuacaucuucauccaaaggcugcuaguggaagacugacuuccaggcaacuagggugaggaucuuaugcccacacccacagugacacgccuacuccaaccaggucacaccuauuccaacaaggccacaccuccacauggugccacucccugguccaagaauaaacaaaccaucacaccaacagagcuaguguuguugauucuccaucugaggguuuuguuugguuuugcucauuuaacugaaguacaaaaguuacugugguuuaguuaugauuuauucucuucucaaaucucuuuggcuaaaugcuguguguaaacacuuuuuucucacuuuuauauucuaguggcaagauguauuagauauuauuucaaaagcucucacggacaacaacauggaauuuacacaaaucagucgcauuaagacauuccaggugugucaaaauuuugcucauguuuuuaacagaucaguugcaaacugaaacugcuguuuucuggcugacuuuguuuaucuucuguccugaacccuauaagaagguuuuaaguucuugauuaucuaggaaauuaacaucuuaaaacaaaauaaaaaaaaaaacuguagauauuuuugauauagacaaacuaaagauugucuaaaagacagucuuuuauaaaacauuuuugucuuuagaucuuuuucuuuaauguaggaagaaauggccuuguaguauuucuuuugaagggguccuuguacccuggaauuguuuucuguguacacccccacacacacucauaaaaaaaguauaugugguuaaaauuuugcuuauaucaaauucaguacagucugaccuauaaucugagaugcacugccugcaagaauaagugaaaaugcaguagcuuacuaucuuaccucacaugagcuuugcauaguuuuccuuucccucaucuuucucuacucucauacaguucaguugucauguaucacauauaucuaugauguaguuuccacuacaugcuauaaaagcaaaaguguucguaugauucucuucaaaaucaggaaaaacaacaacauuccaguuccuaaaauugguggauuagcauuuaaucuucacuaccauguucaucuugagcuguaacguaagugcucugauucuaauccauccagcuaaaguucaaauguaccuuucuucuuucaggagaaccucucagcguuuaaauacgauccccacaucaauauucugcugcugccccugcacacaggcucuaauggauuaacuaucauugaagccacccauguccuccugguggagcccauacugaacccugcccaugagcugcaggccauugggagagugcaccgaauuggacagaccaaguaaggauggaaauuggcauuugucaccuuccuucagguuaugagaaacuaauucaacauuuaaauucuuuauuuauguuuaccauacccugucugauuuuuaaguacacauucugucucccucaccuaaaauguuuggaaccagaaauuguuuaggguuuuuugguuuugcuuuuuguucuuugggggauuuguuuguuugguuggcugguguuuuuacauccuggacuguuugaggaaagggucuauauuuaaauauaagauugauuuaugauucuuuuaccucauacauagucugaaaauaauuuuauauauuauauuuaguauguauuuuaacuauagcccaucacauuuccacguuguuacaugucugcauguucuguggcacgugcacccacacagugaaugacccaagaagucuguguaguuaaaaauaguuugauuuagugcaguaucugaaccaauagucauuuuuaugugauagguacuuucuuuauucaaauaccagauuguaucuguaacucaguuucuuacuuauuuuuuuaggaguauuagaggccuugaauguuugaagacauacagauacacaagcacacaugaccacacacuaaguacuuacuuagucuuacugagcaucuaaacugugucagacauuaugcuacguacuggagauuccaaucauacgacaaucccaucuagaagcauacauaaaaggccauuguguaguacaaguacaagauaauuuaaaguuuuaugaacaaacacaauaugcuaauguguguccugaagaaacacauuaggcugaaggauugauuauuuuaaaguuaggcuagaaaacaaguguggaagaguugcauauguagaauuaaagggcagauaagcugacauuuccuaggguugugaacaguuuggaacugcugagguaaaacaugagaagcaguaaaugaagucuuacaugccagagucggaaauauggauuauugauaaacuucagugauuaacuggccucugauacacugcaucugacuuugguuuuuuaaaugugugugauaggcuagagacugagcuuagugguuaagagcacuugguugcucuuccagaguuccuccugaguucaauucccagugccacauggugguuuacagcaaucuauaaagggaucugaugcccucuucuggcauacaggugugcaugcagcagagcacucauacacaacuuaaguaaacaaacaaguaaacaugugagugcuaaggaucaaacucagguuguugguugacguuuacuuuuacuaguugagccaucuugcccacccccaacacugaccucuuguuauaccagcuuuuucuuaaaacauagguggacuugucuuagacuuagaaggcuaaggccauuaaggcuguugcuucccaguauauagccuuucuuuucuucuucaagagacuaucuuaguguuuguauuguucuccagugacagucuagccuccuccuucagagugccuuaucauuccauuaucacuuacguaguugguguuuaucagucuccacaugcuuccuucaguggucuuuugcuggguacuuucugugugccauguguaguuuuaagcauuugagauaaccuuaugcaacuucuaaucuaguuguaugcaggauaauguaucaaaaguuaguaugcaauagauugaggaaguaaagaguauauuguguuaggaccaaaccucaagcuggugggauaguaaagaacacagaugacuuggaagccagccacacugagaagguaacaucuaagcaaagcaugaaagagacuggaacuauaaucauacuaauaucuuaagaaagaaugacuaagcacacaauaacaaucagugugacaucuguaagucaagaguguuccuggguuuuuguuuuauuauguuuuuuuaaaaaggauccuuuaggacaguuugguaaucuuuaugcuguuauaucguauuuagacucauccuuaaauccuaacaugguggaugucucagcaaaaucacaucaucuaguaagugcagauacuucaggugugagugaaaguaaaaacaaacaaacaaacaaucaaagaaacaacaccagagacuucuuuugauguguauguagaguagauuuggagaucugauuuauagacuaagcauacuucuuuggaauuuuuguauuuaagaaacaaaacuguguauaauauacuggaauucauguaaaaacaaauuuccaucaacuuaaaucacucuuuaccauuaaaauuauuuuuaaaauuguauacccauguaaaucuuaauuacacgauuuaauaauaaagagcuauacuuguuaacaugcuaaaaagaaagaaaaagaggauccacagaugcuacacugaaaucgguaggaaagaaacucaguggggcuugggaaucauacugggccuuaauugggaagcugugagcagaggaaggacacaucucacuucagccuugaaacaaucauucugaguacugugugcaggcuagggaguaaggggagcagggaggccauguaguccugaugacaguaggaggcagcuuguaugguaauggcagugcacccagugagaaguuuugaggcucucgguuuauucuggaguagaacugacaguguuuguaggcauagugguuagugggugagcaacacugugggcuuuggccuagacagcugagaggauagaaagccuuuggcugaguggaggaagacuaugagauagaacagguucaguggcaagaacaaaggucugcuuuagauauguuugagauuuuauuagcuauccaagauauguauguucagagacagggagagaagccagggcuagaggcacacacuuagacaucaggagcaugugaugguauuuuugaguuaugagcaugaauggaauuauaaaggagagaaaaaauagugaugggccaugaacuaaauaaauucuggcacaaguaagcuacaaagcccugggaaaagaaaagacaccuacaugcuuagcuguuaccugcugcuaaauaugucaaaauauguuaaaaugucaaaauagaaaucuuccuauuagaguuuugaccauuaauuuuauuuuaucaaaagcaguuuaaauggagcaguauaggcaacuacuuauaaggauuuuuuguucaacucuaguucaacaaacacaaauaggauuacauagcuuguguagugacacggcuagguaaacaguggcaggugcaccccugcuaccugccugucccugcuuuaaccauggcucccuacucuuacugugcagcccauaggaauaggauuuugagagauuuuuauugcagaguaaaagaagaagagaauaaauuuaagaauuauuuucuuuuuuaaauuaaaauauuaauuagagaaugauucuuuuagaaauagaaaaacuaggaaaauauggaagaagugugcugaacauuuuccaugccugggcaagaggauacgggaccuaacacugauuguuuucaagcgagaagaguguggcucugguaaugguuaagagagcauagcauaggggcuggugagauggcucaguggguaagagcacccgacugcucuuccgaaggucaggaguucaaaucccagcaaccacaugguggcucacaaccauccguaacgagaucugauucucucuucuggagugucugaagacagcuacaguguacuuacauauaauaaauaaauaaaucuuuaaaaaaaaaaagagagcauagcauaguguuugucccuuuauuacaguggaagagugucuuuuuuuaaucccacuuguccuaaaucccaccucuuuucauauucucaagaggcuucaucuugaaaaauaucacauaaauaugucugaguguuaaucauuuuuaaagugacacuccuuuauagucuaccuccacccgcuugauguccucuucugucagccuuucuauuuugguggcugccccugaguguaccacugaaaugaggcuuagaguuuaacuggugccuacuucuugcuguggucuagugguuccuuuuaucuacucucccuaguugcuaguuuacccagugccaugacauuaaguaguaugaguggguggacgaccuucaugggaguauccuugcgccucgauaauaccagcuuuauauaucuagcuauuaucuguacauguaucuaggaacuuuauauuuccccuauuuccccuaggauaucgacuagauagcuuaaguuugacacagguagagcaaaacuacaucugugcuacucuaagccagcccaagcuuuccucauauuuuaaugugucuuuugucaucuauacuugcucagacaggaaucuaggacuuuucuguaucuuauauucaaauuauuuuagucuugauucuuguauuucaaagauauuccucauuuuuugacuaauucuuaucccgcugacacaaaagcacaauccaucuccucuugccaggaugaccucaaauuauaucucuucucuuccuccauagcagccaaagcauuuccaaaguacagucuaguguaaaucaaaauauguauaacuacuagagcacauuucuuuauaacuacaaaauccaguuccugguuagauccugcaggacuaccguuuaugaucugaacccugcccgcccguaaccucauguugaccuguugcguuuauaacacacuugugccaugcucgucugcuguuggccccggaaguauuuuuagcuuuucccaagcauguacucauccaguaauauauaugaacauugguuucugucugcaugcauuccugucccuccugugcuuagugccuaaugcccuucucuaacugaacuugccauacguagucugugcaugcaacugucucccucgugagaggguuaguucaugaagaucacauuggcgguaugugcuguugacuugucccugagcucacucauaaagaccugccacaagugggcaccaguggacuaauggauguagcauguguauauaaggucauuuucuacucauuugucuuaagauggucuuuaaacuuaaaauuauuauuugccuucuagaccuacuauuguacauagauucuuaauuaaagcaacaauagaagaacggaugcaggcaaugcuaaaaacugcugagaggagguagguaacaacuuacaagugggauuucccaucacuugagaguuugagaucuucuggaugacaacaaaugauguaaacacuaaauacuuuuucuaaaaaccaaagaaaagcauguuauccaaagcaugucccaauuaauguuuuggacagucuauauuuggcuuaagauaauuuaauagauuacaauaugcacaauuagcuggcuuaucuuugauauauuugauuacuuuuuaaaugaaauguauuguucucucuuagcuaaacuuuuaucugauaugugucaaacuaaacaugcauuaauguuuuauaguuuaugcuuaccagucacgcaauaggcaugucugaauuuaaagucuuggcuguugauuugugucaaauccauagacaucagaguaguagaaugaucagagcagucugaauuaggacuuggucuugcagucauuacucuucuaacauuugcacgguaauuuuccuucaaagucauauugaaauaaaccaguaccuuccuccuccccgugaaaugggcggauuggaagucacccaaagagagaugauaugauagcucuuucaaagggagggcaucuccaggguauuuuguaacagaaaccuucucaaaccagaaauuccauacucugauguaacaagaaagaugccgccauccgaagggcuuuucaucuaaacaugaaagauguuuguucuuguugucacaugcugcagacauagugauuuucguuucaguuacaauaauacugaacuucuuuguaaauggcgaguuuagaaccugcuugacaacaguugucagauguuuuaucuucuguuuuuuauuuguuuugauuucuuauuaauuguucauagaaagcauuuucugacaaagcuucagaauuauuuagacauuuucacugauuuugacaagauguaacaauuacugucuacuuguggcucagugaugaccacguauggcagaucugugccucacuuuauugucaugcauauagucucuaacuccuggccaugccuucucucugugccucugaaacucuugcagccacacaagcucauccggaaagcauucugaagccucuguguugacuguggcuggccuggcugaccuguuuaccaaggagaacgaggagcuugaaugaagccgucacaucauuccacacaauguuaagauagaacuucacuuccagagaugucaagagaguuacaaauuaaaaacaaaaaaucaguaaauauuaguaaauacuauuuuaaguugaaugaauuuauuuuguuauacucuagccuaguaauaauuggcaauugguuccuuuucacuauaccgauuucacaccauuuacaaugaauuuuaacuuuacacuccuaauagaacauuaauuuuuuuguuccacuuguauaucuauuacuaauaaggcaggggaauuaagaaaagggguauuaaauaauuuuuccauuaguagauagauguuuguuauaacaggagagaauauauaagaagguuacuuagucuaguuuuguaugaccugauguguacagccaguguaaauaacauuuuugaaagggccuucagcaucuuuagcauaggauucaccauuauauucucaguaauguuuuaagaaaaugcuaaacuauauaauaaguaguuauuugcaugaguuuaaacuguaacacugucauuagcuccuaauaauaaaucacuaggugguuauauuguguuuuguuacuaaauguuaaaauacugaaaaauucauuuuucuauuauguuuaagugguaucauuguuaauauuuuuaaguggauuaacauuuaccuacaaugaucucuuuaaccuuuuuaguaaguuuuuuuuguguauguguuuuaagaugauguaucuguaaauauggcuuuuuaaaaaucaucauuguacugaauucauuucuuguguuccuguaacuagucauuuuagccacuaguuaucuaaaccuacaauagaguuuauucauuucaguuacucuguucuuagaaacuaacuaguguuugaucuacuacaagagaacgcuguguucacacaugcauaaacuguaagugguuaaacucucucuucugugaagaauucauggaugacuuugaaauuacaaaauaagaaguagcuuguuguauccuagccuuguguuggaauauaaauguucuuguuuccuucccuuuagcuguugaaaucaagggacccucaagguucauuagcuccuaccuaacuguccauaaaacuguacuagaaguaguuccugggucuccuuuaucccgugagcucuggugcuuaagcuaaggugcauuuucuuauccagguuuauaggugacaggucagcugaagaagacacguuuuuugggugcuuauucuuuaguugaagggagauauacauugauucuuuuauaugaaauuaaacauaauauuuuuacagcucuuuuacauucacuaagagcuuuucuguguauucaugugguuaauauucacaacaguccugugaaauggauaugauuaaugauauuccuauuuugaagguaaagaucuaaugcucaggaggaaacucgccuaugauauguagcaaacagacagagcaguccaggcccccuggcuucaugucuacuguucuuccaccgaguugugugccaugcugggguucagaagccuuguggguaugacuuagaaugggauuguguaaguacuuauuuuuguuuccuaauauuucaugugcuauguucuaggaaaaacaauuugauaugcuucaauuagaaaauaacauagauaucuauacugaucaguauuagaggaaaacuauucuuauuuauuucaguaagauaccucaauuaaauaaauauuuuaguggaaaaugaaauuauggauuguuuuauuucuaagguuuagaucauaugaacuuugguuuuuauugacucaacagauaguaucaaauugccaauucuacacuauuccauauuuuauuuacauuugucaugucuucuaaacaauuaugauaauacuacuacuucagaacuaaugaguccacauauauaauaaauacccacaucuuggcugcaaacaaaagaaauuuuagauuccuuucucaauaauuuuauauucucugaaauaucacaguauggcacugugcuagcaaaccacugaggaugagugaaaugcccaguccuuacaguuuaaauguauuucuauuuagggaauuguuuuucaaguaacuccagaugaauuuacuaggacugaagauuuaucuauguaaauuguaaacaucccacaaacugggcuuaaaauccaaguaacuuuacugugucuauugcaucaauauuucucuuucuauaugaucuuaagguagguaaaggaccauuuuuagaaauugguccuuuuggaaaguauaacucagucuuuuuaaaugcuuaguauguauaaaucucuggauuucagaccccucaaucccuuucacaucuuuaauaacauuaauaaucucaacauagaaccagugcucaacaagcaguacauaacaaaagcaacuacuuauaaauaucuagcagguugugacuaaucaucagcugaaaaccucuuccaagggacaaaagcaaaaaugucuuuccaucucuucucucauuuacuaacccuucccaaaaucaguaugauugaauugucuauucauuaaacuuggagauaccuuauuagaaaugcagaaacuacacuucuacuuaaaaggacucucuaagacauacuugguguuuguagcauuaauuaaucagaauuccaagcauaauaugccauuuuacauaugcagucacuuugcuguguccagguaguuuccuccuaguuguccauugcuucuggcucuuagagucuucauccuggaucccuuaaccuugggguggaggugugugacagguguccuguuugaugaugaguguucugcagucuguuauuaucuacaccugaaccgguggugagucuuuguguuaaucaucuacugaauaaguuucucugaugaggauucagaugcauuaauuagugaguauaagagucaguuuagccagaccaugguggcgcacgccuuuaaucccagcacucgggaggcagaggcaggugaauuucugaguucgaggccagccuggucuacaaagugaguuccaggacagccagggcuacacagagaaacccugucucggaaaaacaaaaaacaaacaacaaaaugaguuuaauauccauuuaguagaaacauuguagcagguucuuuccuagguucuaugagacaccacagacuacgaaagcccugcaacaggaacuaguugccucuuuugcaguuuuuggcuauagagauccuacacauccuuacguuacagguuauugccagugcuccuguuuaugcuauagaauuugacuguaagaaccuauugcugaagacacugcauaccugagucauacaacauggaacugccacugaccuagaagccucuuccuuguuagggucauggaaggugcggugcgugcuaccuagcaaggaaaggaguuuucugugucccggcugugaaccauaugcuucucaaccuuuuucauuucuuuucacuuaauuaaagucuauauuauuucccccucccucaccucuguccuacccauccguguucaagucugcucccaaauucacagccuucucuuuaaacauuguugauacauauaagugaauaacauaaauaugccugcugaguucuguccaguguugcuugucuucguguaaauauuucuagggcugguuauccaauauccaguacugcuuugguauuggauaaccauuugggggcucaucucuuaggaagaccaauuuuucucaucaauuguuuguagcucuucauugaggaguggagcccugugagauuuccccuauuuauguugggaugucaauugugauuggaauuauucagguuucguuuucuguuuuaaucuuacaguugcucucucagaucaaaguuguaugggaaaaauauagacaaaucaugcugaguaucauauuucuguccuguauuauuaaauaaguucauuucuagaagugcuuaaccuaauuuauuccuaauuauggaugauuuuuuuuccaaauaguguuuaugguagucuucccaggaugauucuuuuaagauaauggauccaacaauaaauauuauauuuugagaaacucaau

SEQ ID NO: 5419 - RNA, 1269 nt, Mus musculus
ugcauugggguuccgucacccagacacgugaaggucggcaagucgcuucagugcucgccucggcccgcguggucgugccgggauggaguccuccacguccucuucgggcucggcucugggcgccguggacccucaguugcagcauuucaucgagguggagacgcagaagcagcgcuuccagcagcuggugcaccagaugacggaacuuugcugggagaagugcauggauaagccugggccuaaguuggacagucgggcugaggccuguuuugugaacugcguugaacgcuucauugauacaagccaguucaucuuaaaucgacuggaacagacccagaaguccaaacccgucuucucagaaagccuuucugacugaucucagcauuaccucuuuggaaaaguaguucaagaauugaagagcugcugaugaggugguugaagaaauggcuaugggggggauuaaacucccaauuuucuuuaucgucuugggacaucuugucaccugagaaugaacaaagaccaauuuuuauguaugggaguugagagucauguguauuugguuguguuuuuaaagcuaaccaugugacaauaauugacagauaaaugaaagugugagaugcauauaacuguauaugggacugcuuucucaaggucccuuuacugcuuuauaaaauaauuuugauagguggacugcuuucuagaauuugauagugggaccacauaggguaaaucuugauuuguauggguucauuucugauuuuuuuagggagaucuuugugucagucaaauuggcaguggggaaagauccuggcacuguuaaacugugagcuuucuuucaugucugaccuggagcugaaaaaaaguccuauggaguguuccugcaauccaacuucuuagguugucucuccccuauacugugacuuacuuaacucgcaaauugaaaauauggucucaagguagaagaggaagccugagaauccaaagggcuuuagucauaaaagaaucuagcucaugaguacuauucuuauuaccagacagccacgagaagaaguuaacuuacuauguauauccagaugcaaaacauucacagaugugccuaaagaaaccgcgacuuaggccaguucagaacuaacaacuguuucagguagaggugcaugccugaugguagacaucgauuccauuaacugcauucuuuuggucacugaaauaaaagcucgcaagauuaaaaaaaaaaaaaaaaaaaaaaaaaaaaaaaaaaaaaaaaagaag

SEQ ID NO: 5420 - RNA, 1269 nt, Mus musculus
cuucuuuuuuuuuuuuuuuuuuuuuuuuuuuuuuuuuuuuuuuuuaaucuugcgagcuuuuauuucagugaccaaaagaaugcaguuaauggaaucgaugucuaccaucaggcaugcaccucuaccugaaacaguuguuaguucugaacuggccuaagucgcgguuucuuuaggcacaucugugaauguuuugcaucuggauauacauaguaaguuaacuucuucucguggcugucugguaauaagaauaguacucaugagcuagauucuuuuaugacuaaagcccuuuggauucucaggcuuccucuucuaccuugagaccauauuuucaauuugcgaguuaaguaagucacaguauaggggagagacaaccuaagaaguuggauugcaggaacacuccauaggacuuuuuuucagcuccaggucagacaugaaagaaagcucacaguuuaacagugccaggaucuuuccccacugccaauuugacugacacaaagaucucccuaaaaaaaucagaaaugaacccauacaaaucaagauuuacccuauguggucccacuaucaaauucuagaaagcaguccaccuaucaaaauuauuuuauaaagcaguaaagggaccuugagaaagcagucccauauacaguuauaugcaucucacacuuucauuuaucugucaauuauugucacaugguuagcuuuaaaaacacaaccaaauacacaugacucucaacucccauacauaaaaauuggucuuuguucauucucaggugacaagaugucccaagacgauaaagaaaauugggaguuuaaucccccccauagccauuucuucaaccaccucaucagcagcucuucaauucuugaacuacuuuuccaaagagguaaugcugagaucagucagaaaggcuuucugagaagacggguuuggacuucugggucuguuccagucgauuuaagaugaacuggcuuguaucaaugaagcguucaacgcaguucacaaaacaggccucagcccgacuguccaacuuaggcccaggcuuauccaugcacuucucccagcaaaguuccgucaucuggugcaccagcugcuggaagcgcugcuucugcgucuccaccucgaugaaaugcugcaacugaggguccacggcgcccagagccgagcccgaagaggacguggaggacuccaucccggcacgaccacgcgggccgaggcgagcacugaagcgacuugccgaccuucacgugucugggugacggaaccccaaugca

SEQ ID NO: 5421 - RNA, 491 nt, Mus musculus
acuuuuuuuuuuuuuuuuuuuuuuuuuuuuugucaugcaagcucuggaagcagagaacuuagggccagaguaccagacuaucugcugccacaggcaucuucucaguucaguagaauggaagagaaaagaagugucuccuugccaccuuuuccugauuuauuucuauaccgcucuuuuuaagucaugcuuauggauuuaaaaaucaguccuugcaguuuggauuauuacagggcuuguuuucacgugauaccuugcugaaauacagauugcuggccugucugucugucuguccuuucuuucuuguuuguugaaagauuuucuuuuuuauuuaguguauugucuagaaggaucuggggaaagcaaaagaauaugaucaaaagguauuguucuguaugauuaaaauuaaagauaauaauaaaauuaguguguauuaagucccuccaacucaagauguaaccucagagacagagaaacuuggcacauauguggca

SEQ ID NO: 5422 - RNA, 487570 nt, Mus musculus
cgagacggcggguccgaccugcgggauccacggcuccgaggcugggcgauucgugcugggagacgcgagccccuacccgggguggcgggcggacccagcagcgccccacccucgcucuccaacaaaggggccggcggcagccggaggaggaccuggaggaggagccggagcggcgagcagcucucgcgcacaaaguuguggagucgcccuucccccgaggaggggagcgggcagcgccgggcgcgggauuucucccgcccagggccgaggaggagcccugggcuccucagccgaucgggccaccucggggagcggcgccccuuuucuuucgggucauuccugcagagggaaaacuccugcgugcgccugcccccaggcuagcguuuggacuguuuuguuuuuggcggaacuaccgggcaggaagauugcacaagucagggggcguuuccaaucgggugucaauuuuggaucucccccccccccaccccccuuuggaucuugucgggcuuuccacguuucacuuaaaaaaaauucuuguaacguccaaggcaagcuccccaccacccgaacacgcccagaggaaccuuggggccucugggacuuggcuagcagguaagcccaugcauuauugaagcuucggucuggguaaugugaccgcaguccccuagggaauggggcggggguugaaaggaggugggaccuuucugcaguuccaccgcccgggucccgaaguagcuguagccaacuucugcacuuucccuggaagcucagcguccccugccugggcgggagagagcuggguugagaaggugggaaucuguacuggucgccaaggucucagauuccuaggucuaguuuaguacuguuguuuugucucucccugagaggagaggcugucugucgccuguccguuuaccgccccgagccgggcagcaggacuagcgaucuccaagaggggacguggccucuucugagagcuugucacacaccuccggucccgggaaggcggggcccgggcgguguccgggaggagaggguggggagggcgguugugcggugggaggguuggggagagcuuccuagccggccuccaggcugggggcgugcucgaccucucugugguugccguuccugaggguggggccccaguguggcgagguggcaagccugcagcuguggagagacagaggggauagggguaccucauuggugcgcagucccgcccggccgccugcuuuuccggacucuuggcaucccucacugcaacugacaagguaauucaugccccucuuuggccugggucugaggcucugcuugcccaaggccacuuacaaaaccaacaaagggcuaauuguaggcugugcaacuuuuagaaggcacauuguucaaagagacuuuucaagucccuggauuccgaccguguggcguuccaggguuauuucaaggggaggagaaaacgugugugacucuucagagucagggacccgccuuuuuuaaacccccaaauuggagauccuggguguaauuccgggccccacucucuggagucacugagguaucauccuuuauucuucuagccuucagaucaccugggucaccaggaucuggagagguggccucuccaugcguuuaagugggagggucugccgcggccagagcgcacgaauuccaagagagaugggaucuccaggguggcauggcagcagucucaucgucccguuggaacuugcccugggccugugaagucaggcuggacccucgggggcuggcugcugguggcgcuggagaagcagccugcugauaacgcuagugccugccagagcuggaggaauucgaagcucuugugggucguucagucccgaggacaaggcagugaggggcaugggccauuccugcugaaguccccccacccccucaccagcguuuaugaggcuuucgagauagcuuuaacucuccuuuggguguuuacucaaaauuuauugcgccuguaaacagcauuaaucacaguggcauuaaccuucccuggagcgcuucuuagugugaauggcaguucuuggcacucagcgguuuccuuuacaagcagaagggcaaacuuguucuucggcaucccucuucacuaucgccagcauuccuagcuuuugguuacuugugagugacuagguuuccuccacagccgucuggaugaauauucccuuaggaugacaccguuugaauguuguguauucuugaacuuuugccuauaaagccaucaccccuggcguucuguucugguauaacuaagaagcguccacccugaagggggaacuggcgccugugcuguggugcguguagguuucaguaggggaaacacucggucaacgucaccagcugucauuuugagggaagagaacggaggacagcaauugcauaggagcccuauacaaccuccgggucauucaccucuaguuucucccuuauccggguguagaguguggcuacuuccauuccaccaguguggauggcggcagaaugucuuugggacacauuguuacuaagaaagccuugguucuagcccaauguaacuugaacagccugauagaguugcaguagcauuuuauuuauguuauuuugagaaagggucucacuguguggccuaggcuggccuugaacuggcacuccucuugcuucagccucugaaguagcugggguuauaggugugcaccacuacaccugguuggcaucugggaguuuggaaggagguauccuuaaacucuccaacucacauggagcuccugggacauucguggcaacaagaguugguggcucuuaaauguuguuguuuuucuuuuuucuuuuuauuggauauuuucucuuucuuucuuucucccuuuucuuuucuuuucuuuucuuuucuuuucuuuucuuuucuuuucuuuucuuuucuuuuccuuuccuuuccuuuccuuuccuuuccuuuccuuuccuuuccuuucuuuucuuagacaggguuucucuguguggcccuggcuguccugaacucacucggauauuuucuuuauuuacauuucaaaugauuuccccuuucacgcuguucaauguuuuagugugucccucuucauucuuuucuagcucauugauuuuuuuuuucugauguuuuugcaguguaguagggauuuguauuaggaagaagacacgacuggaaaaauuaucccaaugugaaaggcagaaucaaacaucacgaugaaauggcauuauuggaucuaugcaaaugaaacgcaacccugugcacaaguuaacuuuaccucaaaaucaaaucggugacaguguuugugugugagugcgugugugugugugugugugugugugugugagagagagagagagagagagagagagagagagcaugugugcauuuuuaaaagauggcucagugguuaagagagaguccacguucacuaucuuauguccauuuuuggccuccuugggcacuagacagucaaggcagacauucacacaaaaauuuaaaaaauucauuuuucgacauuuauuuaucgaauguguggugaucagguuuaggggcaggucucuuucuaacagaguggaaacauuuuuggaagccuaacuggaggucccugcauaaagccccuugggaaguggcacuggacuugucuuucaaaggaacuucauuccaggaaagagacuuuuucuuagacagccgggauuuccuguaauuaaauguuuacauauucuguggacaagauuuugguucucuaauauauuaaggauacacauaaaaguuuagaaaaucuuucacacucuguaccucaagauaggaauauauuugcuuuugauuauauucuuuguagggagcuguuccgugacccccuagucucauguagcucaggccgcccucaaacucucuguguagcagaagguggcguuaaacucugucuucuccaacugggguuacuuguucacuccuggcgaaagcugcuuggcaaauggccaggcugccaguccucuucgcugguuacuuuugacuuucauuuuguuuuuguaguucuggggaucgaacucaggaccaugcaugcacacccugcaggcuaccauuaaggcucauccucagcccuuuuaguuuauuuuuaauuuuuagacagguagccuagacuaguuugggauuuacucuguagcucaggcuagccuaggauauugaggacccuuuuuccucugucucuuaaaugcugggguuacagcugugagucacuauacccaggucuguaaauccuuaauaaccauaaagucagaauaaacauuuaagaauuuuuuuaauguccuuuaaagucugggagacugaugaagcaauccauauauggagaggaaaugguucuuaaagcuuuaacaguuucccaguguuccuucgcuucuacugcauucacucucauuuugcucuuauuaauggacucuacucauuuccugacuugcagaaagaaaaguuauuauguugcauaauguuaauauuuauauaauaaaguacuguuugcuacggugaaugacuauugaauaauggaacacacaacuauuacacaaauaagaaauuuaaaauaacaauauaguacaauucauucuucgaaguaaggauucaugcuggagagauggcuccuuggcucagagcacuucuuacuuucccagaggcuccagguucaguuccuagcacccacugugggcgacucaagacuacugguaacuccacuuuuagggaauggaacacucuuuucuggcuuucgaagguaucaggaauuaacagagacaaaaaugcaggcacucacauguacacauaaaaauauuuuaaaaucguaaagaagaaccacuaaagaauuggugguccauuacuaccuagaaagaaacccuaguucugacauuugcuucucucucucucucuuuuuuuuuugagguggugggggucugacuuggcagcucaagccgaccuagaacucagugaucugucaucucagggaugacagacacaaaccaccuugccuggcucugacgcguguuuuaaugugugaauuaguguacuuucucugcagauuacuguugggaugucuugacucugauauuccuaaguagugauuaaguucauugacauuggggcgcucuuaaagggggccguggucuggaagagacagagagacugagcugagagacugagcuuggcuccucucugggcaguguaauccaggaagcucgggagcagagaggagcaguguuugcuggcguucuuaaugaacgggugcuccugcagggcagaucuucagaucuuuaggcccuggagauauuucucacaguuacugaagauuggauuguuuuaucugagugguaccuacccauguacagcagaauuggugucaugacccuuccagaaugaaguuuuuaucagugggcaacauggcuaucuacauuucuacauacaucuacaagccguaccaccccugagguccagauccguauuucccgaaugcucccuuucucuuucugugucucagaagcaccuuacacugagaaaauccaaaccgcauccauucuucucuguaauguccucagcgguucccaaccgaguaguaguucgucuacuucugagcugcccugugccagcugagucacucagcaugcuaguauccugcgucucuaaugccagggcugucccugagucuuauugaccuuuuauuuaauauccuguguaucuauuuauuuuuuuuccaucuaauccauugaggccacaaucacauauugcuuauauuaacagcguuauaacagagagauuagcacaacagauacagagcugcucguauuuucuuuauaacauuuacuuccucugccuguguguaucuuugcauguaugcuugugcguaucgauuuguauauauauaaaugcauagacgucgaagauccugucauacuucucacuaaugacuucauagugucuccuacaauggaagauauccuccucccuaacaucgcugcuaacuaauccugcaguguaacauugguauaauaauauugccuaaaguaaacccuaaaauguuuucuuugaaaauucaacccaggauaguauuugguggucaggucucuuuuguuuuguuuaauccaugaagaaacuaccuuucuuugggugguuuuuguuugagugacacugggccugugggauguguguguuguuuguguguauuauaguuuggaggccagagauuggcauagugccuuauuuuugagacaggaucucucauugaaccuggggcucgcugguuggcuaugauccuuuguuuccagaggaaguaguuggaaacaggcauugcuggcacaugcccaugcuugcuucccucuuuuauuuuuauaaaauucgagggauugaagucagguucccaugauugugcaguaggcucuuuacccacagacccaucuccuaauucccuaggccuuuuguuuugauagccucuuccaauuugugugcccaugauaagccucaugauugauucuccgacagacagagauacucaacagagggugcgcugugauuccauuuaucaccugaggccccauugaugcuuuuguaaagucuggucaagcgugggauuauuuuucucuaacgcaguagcaugaaacaauuucagaugcagagaagagcugaaauguuuccauucgacaucuccuuucucacggccuaaguucuuuaaugagagcacugcucuaauguacuguaguccuuggugcuuccugaguuacucuggucuacugacaagccauggugugaacgggcuuaugucaccucucugauuguccuucuccucagacagguauccaagccucucuaggaaucucuggccccagcuuucuuccucggcugugugacgugcuucccaaaagcaggacuuagcccccugccucccaguucucagcggcgcuaauauuucacauaccaagcucuucucuuuucuacuugcccuguagcuagugaacuucuuccucuccuugaaggauagacccaaaugucauugcuuaggaaggccuucucaguggcccugggcaggugugacucguccacuuuaugacuuuaugacuuuaucuuucucuuccggacugcugucagucaucaggguuguaaugaggucauugauuauagagugaauuucauuuuauccgugaagcucgguguccauaagccucacucacguggaagaggcugugcuaaauaaagccucauguggaugugcucaggaagccacuccguaacugugucuuagacuauauguggcuggagauggcuuagcaguuaaguacuugacaccccaccucaguauccgugcagaugcccggcacauuuggcagccuguuuguaaucccagcacgugggaugugaguucaggggaacccugggguucaaacagagacccugcuuuaacauaaaagguagagagcagcaguugaggcagacacccaagugucagccucugaccuccacgugcacaugcacacauguacaugcacacccaccccuuucacaugugcacacacagaccugugccagaagcaaaggaaaaaacaaauaaggaauauguuucuguauuucuacucaauacuuucucuuuuccuguuagguauucaugcuagccuggaccauuuuucagauuuagccuucagaagaggaucugggaaagccuuuggauuauacugaaacucauucaagauggccaaguauggggaccuugaagccaggccugaugaugggcagaacgaauucagugacaucauuaaguccagaucuggugaguaauggaugcaucacuguggagcccucuguauagacuguguugaagacagagauuucuuagcuuguugugcauuguucuuguuaaguaaacuucugagaaacugaauucugagccgugagugacuauugcucugugaaaggcaaucuccagucucuguguggccuaucuuacacucccagcuugccuuuguuacauugugugugcaguaguuuuacugggagaaacuccugccuacagcauaacugaugcugcgcaguuaugaugucaauaagauagacaagcuuagucuaacauuuacccuuauuaccugaaaacggaaaggaaucacaugcuuagaguagcgaauaccauaguuucugguggaaagaucauuuuguggugggauuccuuaaccuuuugcccaccugcuaauugcuguuggaugcuaacacuggcaugugaccuucucuuuccuuuuagaaauguuaguuucuaaagauacagucuuccccagugugaucaaaucagccagacuaagaccgacgaaugacuuucaugugaacauucggauuggaggucuuuggaugccaccccacccccagcuuauuauauaaccacugcuuuucaauucuggcucuccaaaugaaucaacugggaguuuuuuuacaaaugcagauguguuggcucugcuccaaacccacugaaugaaaauuucuguauuuuuaaaagagcuucaaacaugguuccgagacaggcucaaaggggagauauuuuugagcaagcauggccuuuuuaagcugggaaaauuauauagaguucucaccugggugugagcauuguccuuuuguaacuccagcauuauaaacauuccuucgugucacucuucaacaacaacaacaacaacaacaacauugaauagaacucaaaggugauauuuccuguuggaaaugucuguguguuaugguaagaguucauuucuuagucgaaacugcuaaaauacgugcaggaaaugagaucucaguaggauaugcauugcccuucgugaugcugguugugcuuggucugugaaacgucuggauguuacagauaaggcugugacuaugcagugguuuuuguagcuuuaaggacucuuugggaagugcgucggcauguugugugguguauucacugugaucuccuaaaugucauuuuagggguacagaauucauauguagagauguggaaagugacaggaaaguggaagagagacagcuagaugucucuguacgucucagagucuauaacuugugaggccaggugauccuucgcaucgucccgaaucaaccuuuauuacagaagaccuuggauucugggguaggaagguggcugcguggguaaaugcugucgaagccuagugauccgcgcucagcucucgggaccccaguaaagaaagggagaggagagaacccuuuccacagaaacuguccucuuacuccauacgugcacauuggcaugugcgcagacacacauauacaucaauaguaaauaaaauacacuaaaaaaaagacuuuagauauuugucacugguucucugucuuuguccacuagaaaauaguuuuauggaaaaauuuaacuuuuagaguauauucugaguauccacacuuccaaacuauuucuuaaauuuaaaauggcuauuuauaaaguuaguaagguccauacauggcuggggguaauuuguuacaguguauacuuuuugguguuaagauaguuuguuuauaaaauauuguggugguuugaauagcuaugguccccauagacucaauguuugagugcgugacccauagggaguagcacuauuagaaaaugugucacuguuaggacgggcuuugagcucuuuugugcucaagcgacacccaguguggcacacggucuucuucugcugccugugcaucaagauggcuccuccagcaccauguuggucugccugcaugcugcugugcuuccugccaugaugauaauggacugagccucugaaccuguaaggcagccccaguuaaaugcuucccuuuaugagaguugccauggucauuguaucucuuuacagcaauagaacccuaaggaagacaaguguuauuucauuuacuuucucauugguguguacauggggguuuggaugcucaugccacagcacgccagugggggucagaggacaaaugucagcuuucugugaugugccacgugcauccaggagaccaaacuuggguuucuugcugagccauuuugccaaccuuccgugcugcuuuuuuuaaauagggaacaucaacuguucgaaugacucugcuuauagaguuucuuccuaggcagaggauauaaauguacauuuaagaaguugacuguagcacuguuuacaauagaaaaaaagagagagagagaaagcaccauaaaaauccaauuuggacaugaguuaggucauuguugccuagaguguuuagaaaugaccgccaguucuuagguuguuacuauuuuauuuaaagucuguguucuuagucaaauaacucuagaaauagcuaggaacuuacugucuccuuacuggggucgcacagcuguguggaugacgcagcaucccaguggagguaauuaagauagagcgcaugacugaagcagcgacguguucauaagaagugaugauauugagguguguggaugugaguguauauaaacauuacaaacauggagggugcuaugagguauuguuaagugauuaugauacaggaggcuguugaugugaaaaguacccuuuaaaagcuugccggugggagccggaagaugagucagugguuaagagcacuuguugcuuuucuaggugaccuggguucauucccacagccuauaugguggcucacaacccucuguaacuccuaggguagcuaaugcucucuucugaucucugaggacagcaggcacucacacagugugcaugcauacacgcaggcaaaacacucguacacauaaaauaacaacguaaacacacaccugcucuccuaucaggugggaggcuggaacagggagauuuugaguuugaugccaaccugggcuaugagauccugccuccaaaaagaugugagcuauaucccagaaucuuggcauuugggaucguucuuuuucuuacuguccggccacacguguuuuccaaagccgcuugauggacuuguauuacuuaacuucuuacguuuuaaaaaauucucaaauugcuuuuagcauuuuuacugucaguguuauaacugugcccucccuuugaauggcaccuacuucaaaacacgacgaaaauuuagcuccugcauagcugagcuaugaaucacauuccucuggcuggauuguguugcaaaagcuggcagaucaauuuggauuugaaugagucugugagucaucucuuugauuucuggaagccauacucuugauuuuuguuuguggcaaaugcuuaguacacaggguaggaucucgggacacuccaaaguuuacacauuauuaagagacuuuuagaagucuagauuaaauaguuggaaugauccauauccaauaaauaaauuugaaagauuuuuacugguuauguuauuccaugcugcauauuaguuuuccacuuuuuaagaaggaauauucacccuguaccuguugcuuguuuauaaucccagcauuugggagguggagauagaaucgagaguaaaaggccaauaaaaaaaaaaggucauaacaucauaaacagagaguagagaacucaaguguggugcugcaugccugcagccacacuauuugggacccagccugggcaauuuagggagaucccaucucagcgaaacaccccuaccuccuauaaaggaauauuuuucuuucuauuggagauuaaaagacuggaauaaaauugagaaucuuauacaugcauauaauguguuuugaucaaguugaucuccaauuaccucccuuucuauucuucacgucucucuucuaguccuguucaauuucauauacucuuuaaaaguuaucuaucuauuucuaucuaucuaucuaucuaucuaucuaucuaucuaucuaucuaccuaucuaucuaucaucuaucuaucuauucauuuuugaaacagagugugguggcuacuuuugagucaauuugacagaggcuggagucaucugaaaggagggaacuucaguuaagaaauuggcuccauaagacagguccagcuagagggcguuuucuucaucaaugauugaugugggagaggccagcccauuguggacggaccaucauuugugggcuggugguccuggauucuuauaagaaagcagccugugcuagccaauuagcagcaucccucccuggucugagucaccgccuccugccugguucuuguccuauuuagguuaugaccuugacuuccuuugaugauggacuauaauguggaagucuaaaccaaauaaacucuuuccuccccaacuugauuuuggucacgggguuucaucgcaguaauaguaacccaaacaaagacauaaggucucauuauguaacuguggcucgucuggaauucacuauguagaccaagcuagcuuuaaacucacagagauccaccugccucugccuccugagcucugguguuaaagacaugugccaccauaucuagacuuuacauuuuaaaguaggucuuugguaauuucauacaauauauuauggucauauucucccccuucuuaaacaucucucagaucuacucuuccuucccuacucacacaaauuugcuuccuuuuuuuuuuuucccccugaauccaguuuguauuuccauauacucuugaguggcuauccacuggguggccugguugaccuuccagggguugguuugaaggacagcggcucccaugggcucuguguuugaauacagggucccucacugauggaccugcuugggaaaaaccaggaacuuuugcccuuguuggaggaguuggaccacugugggugaacuuuaggguuuugaaagucucagcccaauaccaguauuccucucucuguuuccugcuuuuggaucaagauaugagcucuuagcucacaaaaccaaccaaccauccaacuaaccaaccacuuauugcccucguuccaucuuaaguugugcaucagauucguaauucaguguuuaaaagccauuuugccaucugaagagaaauaccuagcaccaguuacuugcaugucgcccccaggauucggaugagggaugaaaacgacagaaaagcgggggucuugugggaugcgcugacugauguagcuuagcgugcuuauuauauacaguuuaacagggaggugggcuuauuacauacaccuggaaauagaggccuguuucccuaagcuugcuaggagcagucucuauaagagagcagccucuaagacuguaaacauuggaggaauaggggaguuauggaagacauuuucugcaaacacugucaagauccacaaucuaauuugaggaaugccuagccaucccuuugagucucacccagggagggcguggccacuuccaggaggcugaggcauggcugugcucacaucaacaacacacucacucugggcuucacuccugcccuacaacuaagugaucaaagguaggcacugggauaguuuaaagaacaaaagccacacacuuugugauugccuuagaugugaagccugugggucacuuuguagaguuauggccuagcauucaugaggcucuggguucaauccccaccaauacauaagcacguuguggugguccacaccagcaaucccagugcucagaauguggaggcaggaggaccagaaguucaggguauccucagcuugucaugacacacugacacccugucacucuaagauacccugccucaaaaaccggcaaaccaaccgggccaccccacccccacccaauaaaaaacaaaauagaaaaaagaagagucuagaaagcauuuguugucuacugggcuaggguuuagggcugcugacagugagccuucacugucugcuaaagcacuugagauaagguugugagaaguggcuagaauagugacagcucuuaaucugugucagucggaaagccuaacagguuuauaaagauuuuaaaaugguaguccaagaauaaucuucagaagccgggugugguggcacacgccuuuaaucccagcacucaggaggcagaggcaggcggauuucugaguucgaggccagccuggucuacagagugaguuccaggacagccaggacuacacagagaaacccugugucgaaaaaacaaaaacaaacaaacaaaaaaagagaguaaucuucagagaaaaugugcuacugguggagugugugguuuauuaacuuuucuuugggacaugaugaaaugucaaagaacaggcugggcauacacacacacacacacacacacacacacacacacacaccccuuuuugccucccacgugcugggacuaaaggcuugcuucacuguggcuggcuaccuccuugguuuuuuaucuaacucugcguucuaauuguugaggaaauuagagcccaugcaaagcugagccucuaaugcuagcaucuuagcggugaugcugaugcugauuccugcaucacagcugcacguucacagguggcaaucaaaagccauagaggagucauuuguuacacuagccuuuucucuguuuccguaggaccuucccaggugcaccugguucccugccauuuagguuaauauuuaaaugcagccuucauugaguggccuucucuguugacuuuggaagucauguuuuuuguuuguuuguuuguuuguuuuugaccuacacuuuuucuuuauucuucucuuuuuuuucuuuucuuucuguauuuauuugagaaaagggcuugcuuuauauccuagucuggccucaaacucaugaugcuccugccucagccucccaagugccggaguuacagguguacacaccacacccugcuuagucacccugugcccuaucacugcuugugacuucucuguguuuucuuucucgcuaucugguacuuugcuugcauuuuguacuugcugauauccuuuuucaaugcagcucgacuccaugugacuuggggaaccaguacaccucuggcaucaagcccagggcacaguggauuguagccaagugauaaguacuuacccaauggaaaagguuccauggcuuggagauucacgcgcugggauuugaauucaggaucagguuagacgggggaaaccuggagucugaacucugcacagucuucauccugugccugccaggagggucauuauuuuaugcucagaucuguuccuugcgaauuugcccgguguuaacugugcacagguccucucuugcucccuccuugcuaccuacugagggugacccugggcugaagucuggggcugcuuugguucccuagugguaucguagcccacauaagagacaggaccugcugcugcuuggcugccuucuuuucuaucucuguccugucauucucuuccgggagcugacaaaggggauaacauuggaggacagacaguccuuggggcggaagaugagagacugacacugucucugacguggauucucuuucucucuuccucugauggcuguucaaggcuuuuaacuggauggcaaagaagguaggauuucagaugcacugacauuuggcacaggguaggcccugaucuggugcccagggagguaacugugcuaucgagauguguugggggagggcagaggagcccaugaaacuaaaggaaagcaaauuucuuugcugaugguuuacgcuguguuccauuauagccagcuuacugaaaacaugcccugugauaucugguguaaauuagagcugcccaacaaggucuggagugagagaaagguugaggagguuggcuuucucuguugaccuuucagaagguccucuucagacaacacaguggcuaaguugcguuuagggagugaguggucugguuuuuaaaagguuuacacugaucguaguauccaagagagauuuuucuccacaguuuaagggacuaugaaaacaguuccuugcuccuucuggagauucccuuagcugaaauaucuguccuuugaagggaagccuuucagcgggcuugguuuuuuuccacaagcccuugggacuugccuugagggacagacagggacccggguggaaacucaagucuguuagagaacagcagucuugggacgagcaaaagccuugccugugucacagguccucacgaggcugaggaggagcgaucuaagaucuugucugugccaauauucuagcagaggcgguguguucauuauauagacaggacugaaaacucaauuugauugaaccuuauuugaacccagaaguuugcacuggaugcugauaucaugauuuucccugggaacaagggaacaagggagaucaugcaggcaguuguaaacacuaguuaaaguuuaaucuaaagcaguggagaauaggaugcagguagcuagagucccgcccucuuucacuguguggagaaacaagcauuuacuaugguguuguuuugauaugcacuuuuaaaaauuaaaacugcugaaugagagcuaugcucaacucaauauuuggaaugcgagccagcgugagauugucugcacguauguguaugugugcgugggugcauagagaccaagggauggccucaggugcuguuucuuagcagcugcgaaccguuuuuguuuaagccucucgcacugaguggcuccugguagucugccugcacacugagccccagagguccuccuuucuccaucucccuaguucuggaauuauaagcauaccaaaugcugccaccauaccaagcgcuuacaaggcaagcgccuuacccagugagcuacaggaugauagagauuuacucucgagaugauagccuggggaccagacccagccuuggaucccaggcuuccuucccauuugccauugcuuccuccccucucagggugcaggugacacuuagggacuuaggaaguccucagacuucucagcuaagcugugugucccacgcacggggcugcuuuugcugaggcuggcuuucauggcacgaugacucacaagugacuuguuggucucuuuugcauguguggcagcugagauuccgacuugguguggcacagccaccaacuaguuuugggaacucaauuuuuguuauauuauuguuuaaaaaugauuuucuuaacauuuauuuuaguguguguauaugugccuauguagaggucagaggucagguuaugggaguugguuuucuccucucgauguauguggguucuacaaauagauuuuggugacuauauguguguguauguguguguuucaguucugucaaagugguggagcucaguuacacagcaaacacacaaauagcgugugcuauuucacacgcuaggaaucuuauguguccaguacaauccuuguggcccuuacuucugucacaaaacuuuuuuucuguccaaacaguaagacucugggcgggguggugguagugaaccccuuuaaucccagcacuuggggagcagaggcaggaggauuucugaguucgaggccagccuggucuacaaagugaguuccaggacagccaggacuacacaaagaaacccugucuugaaaaaaaaaaaaaaaaaaaaagacuccgggcuggguguggcagugcgugccuuucauucaggaggcugaggcuaguggaguuccucuguaaguuugagaccagccuagucuacacagugaguuucaggucagccaggagcacacaguaagacucuaccuuaaaaacaaaccaaaaccaaaaccaaaacaacacccccccccucccccaaacuaaaaaccaaaaaacccaaaccaaaccaaaacagcaacaaaaucacauccccuccccuccaccagccaaccaacccaaaccaaccaacccaaaccaagagaaugcaggaccuucucagcagagaaaucuauuucaguauaggacuugguacuuggcaucugacgugauaaagccugggacguuggccuugcuucccgcccuuucagaaauaccaauaugccugcauauuagaaagguuugguugccuuccuaugauuuuuggcucuacaguauuuauguggaggagauauauuuugagacugauauaccccgucaagggcacccgugaauugcauuauuuaaaguaaauucuguaaucacauagaucgauguguguucucuuauugggaacacugggcuuugagcuucaggcugugucagagucgcccuccuggauucugacucaggaauuuccaugagcccugagaguuuuuccuuccuagugccuuggcuuagauagugaaagucaggccugugggucucagccuuagagagcagccugaguucccccgaagggaggaaagggagagucaaguguuguuuauuuuuacucagaaacauuuccugguaaauagauuuaaaagguaauggcuuucauacuauuggccuuugaugguuuggugucucauaguuuggagcuuggguuuggcugagaggaggugaaacucaggaaagugggucaggggagggcugacagaugcugcuucaguucuggggcaucugaacuggaaugucccucccaaauacugacuagggcugucucuguccgcucuguacuauagucacaccucagcgugguuagcccuuuccugaggcuaaccuugguuaacuuuccugcccacagcuccugagcaaggacugcucugauugcuucuuugugaaagcuuucuucuuuucuuuucuuuugguuugucuguuuguuuguucuucuguuuuuagagaggguuucacuguuuauuucugaccauccuggaauuugcucuguagacugggcuggccucagacucacugagaucauccugucuuggccuuccgagggcugggauuuguguuguguacuuggauggcugcuuggcugguucucuccaccccgacuccaccuccaucgcccuuuuugagacagggucucauguagccucagaugcccaaaguucugagacgacagauguaugccaacaugccugguuuauggagaacuggggauuucuaccaacugaggccccuccccagccccuuaauaugacuauauaguuucuaagacauuacuuccuaaaaggguguauuugucacugguaaugggaaaagaaaaaaaaaaaaucugugcuacuuuccugauuuucuuuaugcucacagaaaaguuguaaguauauuugccucucugcuuuuuaaagucuaaguacgugauguuugguguuucugcucccuuugagaugaagcagucucucucuuuucuuucucucuuucuuucuuuuuuaaaauuuauuuacuuauuauauacaaguacacuguagcugucuucagacacaccagaagagggcaucagaucucauuacagauggaugugagccaccaugugguugcugggauuugaacucaggaccucuggaagagcagucagugcuuuuagccacugagccaucucuccagcccccucucauucuuucaaaaccagugaauuuuaggaaagggugauuugugugucaaaggguuaaaaaguuauaaagggacuggagagacggcccagugguuaagagcauugccugcccuucuagaggacuuggguuugauuccuagcaccaugugguagcucacaaucaccuguaacucuagacccaggggaugcgauacccucucuuggccuuugugggcauggcuugaacaugguucacagauauucacacaggcagaaggauaaaaaaggauacagacaggauaaaaaaggauaaagggaaggagggggaguuaagugggucgugaccaugguagcauguuccuuagggaucuacaagaacauccuggagggcuuguaauaucuuuauguuucaagaaccaaaacugaaugaaaccaaaccaaaucccaaaucuuucauagaccucugcaggaauaccacugaguuaaacaucucugaaaguguaggaagggaugucgguucauuccuagagaaggcaacccucaagguugaagauaguaauuuuuguguuuguuucuguguauggaauuugagcaccccccccccaaguuuagugggagccauuuccugggcaguuucagauggauacguggaagggcauuguggguugggccugaguagcuugcugucuaucugugacggggacacagaauuuugugcagacauuggcuacaaugaagaguggggcaagucuuaacaacccauuuaggaaaaaccauauuuagauugacuuaaaagaaagagaccacaaaauagaaccaauaaaaucuauccuaaacagacuaucccaaacagcaaaaaagguuuccaagugauacaggauccaguugucagugaauuguugucgugucuugugugaaaugauaaugcuuuuugaaauuuacaauguaaauauugacucagaaaugagaggauguuccugaauuuaauuaguguggaagauuccaggccauuucccccaaagccuagcuugcagugagcucugaguuaagcucuggauguguucuggucuuuguaucuccauguugucucugcaaaggguuagaggaugccuuacuguagaguguagacauagaaaggcgucaugcaacgcagaccaagcguucuuuguaaagacagcaaggaaagaacacuaaccucacuuugaagcggggauaaucaucuccgacaaguaaaaucugcaggcaagagagcccagaaaacgguuugagcucaacuuuaauugaagacuggggguguuuagccugaugcugugcagaugaugucauccuguguuaccgaauucagcuucagcagagacgauggaguaaaugcaaauuaaaaauaaaucgagagcagauguugaagaauaccuuucauuuagggaauaauuaagcaguggaaaggucauuggaguuuagucaauaaagcugagaugugcugaagucauaauuauucagcuaacagaugccugcuuuugguugugcucugcuggggagcauuugggauuggugacuggaggaagcuguuccuaucuuguuggauggaaaguuccaucuuccaaaguugcccauccaguggacuaacuugaauguacacugcaugagccaccaccacaguaacuuugaagcagacuggaggagccccuuucaaagcucucguaaugauuaggccugugugcugcugauaccuguguuuuugguuuggcaaaauacauuguguuuugucauugcaaucuugcuagguuucagucccugaaaaggguggcaacuuagaagaaagccuuagggcuuuagaggguuauagucugugccggucuugcuggggaguguggcagugggcaggcacaguacugcagcaauagcugagagcuuacuuuuuuuuguuguuuuugauuuuuuuuccuacaaauaauugggaaugacuugggcuuuugaaauuuuaaagcccucccccacugacaugucuccuucaacagggccacaccuccuaauccuucccaaauaguuccacuaacuggagacuaagcaugcaauuacaugagccuaugggagucauucagaccaccacaggacucuugaugguuuucucuaguaaauuauagagcauauagugauagcauugagggagcuagagagugguaguuugccaguuaagaacauaguacugcuuuuacagaggauccaaguucaauucccagcacacacaaggggugccucauaacuguaacuccaggucuauguaggagaucugauguccuucuggccucugagagcuugauguguacaaagugaggcucacacgauaugggcacuaauuaaagggcacuauuaaaacuuuuaucgauguuuugaauauuuuauuccuuucguauuuucugagguuuuagguuggcuguggagugagcauuagagagguaauaugaaagauggaagaugccaggcggugguggugcacgccuuuaaucccagcacuugggaggcagaggcagguggauuucagaguucgaggccagccuggacuacaaagugaguuccaggacagccagggcuacacagagaaacccuaucucgaaaaacaaaaaacaaacaacaacaacaacaacaacaagaaagauggaagacaccggaaggugggacagugagugguuugggaggcuuaauauuuggguaggucauugaucuaggucauaggacacuguuucacagguaaaauguaguuacucucagguuaggaaguaacucacuuagugugagggcuugaguuuagcucccuagucggucccugacacuguagggacaguaacacauguauuugcgaccccagugcugggggugugguggggcauucucaauggccagccagcagccuaccccaaauuugugaacuaugggaggaauaaaagccaugucuagaacuauuuguuugagaaugacagaggcagacacuugauauugaccacagcuuucugucucugucuccuccugccuccccuaccccauacauagagggauagccugugacacccaagagcagaucugaggcugcuagaugcuccaggcaggguggugcacugucugguuuucugugucaacuugaguuagcacagagaaaggggcuucaguugggggaaaugucuccaugagauccagcuguaaggcauuuucucaauuagugaucaaggugggagguccccuugugagugguugccaucccugggcugguagucuuggguucuauaagagaucaagcugagcaagccaggggaagcaagccagugaguaacaucccuccauggccucugcaucagcuucugcuuccugaccugcucgaauuccaguuccugacauccuuuggugaugaacagcaauguggaaaguguaagcugaauaaacccuuuccuccccaacuugcuuuuugaucaugauguuugugcaggaauagaaacucugacgaagacacagggggcuggagguggcucacaaagguuugucuuccagggaagugauggcucugccaccuaguuucucugccagggugccgcggucuuugacugccuccucguagcaguuagcuuguaauucaugcuugauuccuguuaccuucuucuucuugauggcauccuuggagcuggcacagaucauuuuggucuuaaugggugcacucucaggggcccagaagaugaccaccaggucucauagguugcaucauagagcgcguagcggcagcaucucgacaaaagugguguaggggucguccacagucugcccugcaucucguaccuugcccucccccgggaugauguucuucuuguccucacucaggaaaaagagcacugccuuccuguguuucuucacuucuucuggcuuggaggacuugugaacuuucaugucauugaacaccuugaucagagacagccacgccagaggccauguuuccagaaacgaagacagaaagggcuacugaagaacugagccgccacagcagcugcugggaucugacugaaccaauauauaguuuuguuuuguuuuuuuaaaaaauacuuuggcuuaugcgcauuuuauuggaaaaauuucccaguucugauacauguucuuuuuguaaaauauaguuuuaccauauauauauguguauuuauuuauuuucucugucucugucucucucuguguacaaacacaugugccucauucucacauguggaggucagagggcaacuuuuguguauugauucucuccuacuuguggaucuggggaucacacucagguugucgcgcuugcugucguggacccguagucacugggccuccucucugggcuaugauuauguucuuccaggagaucuaugcucuaagaguuaaguuuuagagaggaaggcaugauguguaacuaggguucuguguucacgguacuaauaucauuccugauggagauuccgaugguaguacgcagcugggaguucuguggcucacaucguugcugucacuccaagucccccuuacuuuggcccuuguuuuccuagaaccagucagucacuagauugcucagaugacacaaggugagaagacacaaagugugaaggacagaauuugugaucuuguuugacccaguuuugcauauaaugaauuuuuauuuguugacaaaucuuucccuuuugcuaaaaguggcaaauaaucagacauaaauuacuaauuaacagccugguugagguuuuaguuauuuauguuuuaauuagugaaacuugugcugcaucaggcucugguaggguugguaucaaaaucuuuuuucuuuuuuuuuuccugaugugaagaaaaugucuucauaacccuguuuucaauagccaggcauggaaugacgacugagucaguguauuggaaggauauuaguggguugccaacauugcccuuuagccagucauacuuuuuuuuuuuuuucaagagaaaggaucucccuguguagccuuggcuguccuggaacucgaagguuggcuuugaacuuauagauaucugcuaccucugccucccaaguacugggauuaaaggcaugugccacccucuaccuucaucccccacaugaugcgugcuuuuaauaucagcacuugggagguaguggcagguggaucucugugauuuggaggccagccuguccuuauguagugaguucuacaccagccagugagacacuguuuuaaaaggacaaacauauaaaggccuaguuaguaaaaugaugccaguuuuucuucuagaugcaucuuugaccauugguucagaaugauagggguuuaguuucacgcucccacauguagacuucuaguucucccagagccaauucuuaagaugcuaucuuuucaccaccacauguuucugagagcuuuguaaaucaugaggugacuauggcuguuggguuugguuuugggccuucuguucugcucugaugguauaugugucugucuuuaugacuacauggcacugcaguguaaucugagaccaagcauugucauacagccagcacaguacuuuagcauuacuuuggcuauuuggggucuuuugugcauuuaugcaaguuucugauugcuucuucugguuauguagagaauauuacucaaacuuugauagggauuacauuguaucuggagauugguuucacuaauacagccauuuuugcagcauuaauucugcuaauuaauucaugagcaucuugccuuaucuuuugguguguucacuuuguugcagccagaggacaaccucuguuguucuuaaggugcuauuuaccuauguuuuuggagagaaagccucucggcggccaggauaucaccuaguaggcuaccuggucagugugccuuggagaucucugccagucugccugguguuguuagucuccugguaucaugaguauguaccuaguaaugccuggcuuuccucucuuccuucuccucuucuucucuccuuccuuccuuucucccucccucccucccuugaucuccaucuuuuggugauaaaacuaagggucuuaaguguauaagcaaauauuuuauugacagagucauuaauuuugcauucuuagauaguuuuaaaaauugcuuuucaaacacugcuagccauuuaugaauguauguauguauguauguauguauguguaaguuuguuacugggauagccaaagcuacugaguauguugguaugcucugcuacuuuacuggcuguguuuauuaguucuaggaguucucugguggagucuucaaguauccuaaauaugaagaacagugggggacauuaugauggaaaagagaaaggagcaagauauuugaaacaauaacuaaaaguaaaaaagaaggaagaaaguuucccaguaaugaaaagguucaaauauaaaauuguuuggguguaagaauaagaaauaaaaaagcccaauauggucaaguugcaauacugcugcagguggggcacagaggaauauaaaaaagggaagaaacgggacaaaacauuggaaaaagaagagagguaaaucaugugugggguggcguugcuguggccagcugagccugugacuguugcucuugguuucugcugaugcugagugugugguggccaaggguuugcugguggcuggugcuuccuucagcuccguagcuuucuuuuguaggaacccaugccuuugugcugaguggguccuuuuacucucccccacgaccccagauuguacucacuggguggcuggacuucuagccaagaguugucuccagauuuuugcaagugugcagagaagcaacugccaugggucuaugucuacauguagaggaccuaacuuugucuuuuuuuuuuuuuuuucugugcauuuagauuuuucaaggaaucauuuauuguauauuaucagugauuacauuucacagcaaaauuaaauuaaacacacacuuuggacaaacaugaaauggaagucaaaucugucauccaaaugccgagcugagucuuccuucuguuuuuuuaggcugcaguaguggaucaugauuccagauuaaugcaacggauuauuccuuacaugugacaguuguuuccacaacaggcccucgugugggcuccucucguuccuguugagcucuuuccuuuugcucugcucugucgcccgaugucaucuauucccacguaaaaggaaacucugagcccaguccuccaguaucaggcaccaauuguauauaccacagacauucacugguaugaacugaggcucggucaugacacagggugaaaguuccuguccucagacaccccaugacuucauacucugaagacuuccugugaguaaaaaucucccugcugaagagauggcuccuguugcuggaguguagcagucacugcaguuuugggguuccugggcucuucagcaguguguggaaguuaguaagcucuagagacuacccaccuugugaccucaggcucagagcuaucagacuucagaguuagucucaguugaugagaugugcuccugucuaucaagggugggagcccucucuuccuagccacuucccuacaugggccagccuucugccagccgcacccuacagcccagcagaauugggcucuccuguucucugccaccacauccccagaccauuccucacucugcagauaugggauaccaacuugaaacucccucaccugaaauugcuccguguucucaggucuccaggguagcucagcuguuaauaacagguucucucuggagauggugccagcugugacgcuucggggcagucaaaguaacaaaaugggauuuauuaccauuacuuguccuggaaggaucaccgucaccaagacccacccccccccagccucccaccucccccccccccgcccccaguuggauuugagucuugugagggcugagggcuugcuuguccuaggggugggacagcuuguccagccccccccccccaugugguuucugcuccccuuuccacugcuaggaagcagcuuugcugagggcguguucagcucuuucuaguguauucugcuguccuuuccuuuacuuccuuugugaauuucugcagcuucccuuccucuguuuuuggaauagucccuuuagcucugccuuucuccuuuacuccuagccaucgugugaccugcugugacuuccaggaucucuugacccugugaacucuggagaaugugacgguggcagccacacacucuuccuuuuugggcaggaagcagagugaagugcagcuaaaugugugucuuuugugugugcagugcauguaugcgagugugugugugugugugugugugugugcgcauuggugcuugcugaggcuggacgaugauguugggauguuucucacuuucucucccauccuguugccuugaaacugggucucuucagugaaccaaacacuuccuguuuugcuaggcucucugacccaccuaccucuuaggaucugccugucucugucacucagcguugagguuauagguacacauaggcaugccuggauuauuaaauaacuugaaauuuuuauuuauuacucaugugugugccucugucugugugugugcuccugugugcgugcgagugcaccccugcuuaugcaugcacauguguugguaggaugcugugcacacgugugaggucagagaacaacuucacggaguuuguucuguggguucugagggucaaccuuggguucccaggcacaucaucagguguccagucccuuauucccuuaggcaucuugccagccuggccucuacgccuggcuuucaugugauuugaacuuccguccucaugcuuacaaagcaaagacauuuagcugcuuuaccucuaaacccgugcuuuuauuucuuaaauauguccacucuaucuggaucgguuguuguuguuugcuuugagccaggguuuugccaugcaguuuaugcugcuuuuagaugaagcuccuccuucuggugcucccugaggacuggggugggaguacugaguacuggggugagaguacugaggacuggggugggaguacugaggacuggggugcaggcagaggcugucauucugggccccuccuguuuguuuuugaugccuuuaacuuagaagaacaucugagaaagacuaagcacuuucagcucacuucauggauuuuggaugaucuggcucauuugcauaugaaauucuuuuaucuuuaucuucuguuauuuacugacacaguuuucuggaaggauguuugaaaucaugacugcuucuuuuuuuuuuuuuuuuuuuuaauuagguauuuuccucauuuauauuuccaaugcuaucccaaaaguccuccauacccucccccccacuccccuacccacccacucccacuuuuuggcccuggcguuccccuguacuggggcauauaaaguuugcaaguccaaugggccucucuuugcagugauggccgacuaggccaucuuuugauacauaugcagcuagagucaagagcucuggggguacugguuaguucauaauguuguuccaccuauaggguugcagaucucuuuagcuccuuggcuacuuucucuagcuccuccauugggagcccugugauccauccaauagcugacugugagcauccacuuauguguuugcuaggccccgguguagucucacaagagacagcuauaucaggauccuuucagcaaaaucuugcuaguguaugcaaugguguuagcgauuggaggcugauuaugggauggaucccuggauaaggcagucucuagaugguccauccucuugucucagcuccaaacuuugucucuguaacuccuuccauggguguuuuguucccaauucuaagaaggggcaaagugucuacacuuuggucuucauucuucuugaguuucacguguuuugcaaauuguaacuuauaucuuggguauucuaaguuucugggcuaauauccacuuaucagugaguauauaucauuugaguucuuuugugauuguguuaccucacucaggaugaugcccuccagguccaaccauuugccuaggaauuucauaaauucauccuuuuuaauagcugaguaguacuccauuguguaaauguaccacauuuuuuguauccauuccucuguugaauggcaucuggguucuuuccagcuucuggcuauuauaaauaaggcugcuaugaacauaguggagcauguuucuuucuuacuaguuggaacaucuucuggauauaugcccaggagagauauugcgggauccuucgguaguaccauguccaauuuucugaggaaccgccagacugauuuccagagugguuguacaagcuugcaaucccaccaacaauggaggaguguuccucuuucuccacauccucgccagcaucugcugucaccugaauuuuugaucuuagccaucaugacugcuucuuacaguaccccuccuccaugauguuuuuauuuucucuccccuccaccccuuccuuuccuucuuacuggaggaggcaugaugcuuuguucuuagcugugauccugagcguugucugacauugcugugcugccugcuaagucuaacuugaaacugguugauuuagaccaugugcaaaugcacuagguggauagauuuuuaaacuguguggcaaagaaacuucaaaaugcagugacucagauaagguuaacauuaauuuuucucaucuuauuggucagcuuucaugcacugcuaugcucagcagggucucucgggacucaggguccccucuuccuuuuuuuaaaaaaaauaacugacuuauuuguuuguuuguuuguuuauguguaaguaugugugccuaugugaguuuacgugaaccacauuugugcccagaagaggggguuggaucugcugcuccuggaauuaguguugauuaugagcccaccaauauggguguugggaacugaacuccuguccuacugaagaaccaacaguaugugcucuaaccauugaacuaucucuucagccccaggguucuuuccuguuuucuaguccuucuacucuugucuauguuguauaguccaugaagagggaagaagggaaacuuaaaaagaaagaaagaagucauuucccuuuuuaaaggcuggcaggaauagguggcugcccuggcuguagcuaacucacguagcuucauguaucugcgagggugguugaggaaucugcucuguggcaugcaagccaaguguucaguuauaacuggggguugcaggaggcaggauuuuugauggaaagaaaaaagagaauggaaaauaacaaauauacuugcaaguuagggagccagacgugauugaacuacagcccaucugagaccugugcccaagcauagcacagggaagcuggagucaguucguaggcuuugccuucucuugguggcgcagcccuguccuaacccaccucugcucaccugcuucaacuuccaucuguaaagcugggguggugcgcaccuuuaaucgcagccuuugggaggcagaugcggguagaucucugugaguucuagggcagccagggcuaccuagaccugucuaaaacagaacaaaacaaagcaaaacaaaaaccaagcaaaacaacaaauacacauuggcccugacccauguguaagcauuggugugguccagcccuggcuggugaguacagggcucauuuaagcagauugcggaacuugggucgguacugcagaaggagaugcauggguuucugugcuugggccuggguaugugugucugcuagauucugagaucgcuaugggucagaaaggggaagaaggggucagagagaagggccucucacauguaggguuuagggcaaggauucuuucuugucuuacaaagaaaaauuauccagugaguucuccaauugagccacuuuccugauauucucauuucauuaauauuaauauucauagucauuuauaguaugcauauuacuuacuuauccauccagaguagcauaacuguguagcauaaaucgagugucauuuuaauagagguacagggagggaagggacagggaaggaggcuagugaauagucacuuauuuagcuuaggguucucaacagcuuaaggcaaaaaaaccaaaaucuuuugaguggcccuugugacucaauggcagccugcccagaccagagggagccagugcugggagugaacacuagauucacuuugaaaagucuagaaaugaaaagcugcuacucaaggcauaagaauguaccugauggcuccagaccugggagccagugaaauccugcagcaugucuggcuccccuccggcucccauggucucucucugagcaucccaguggcuccucccauucacucacucuggucacugacuuggaagagaccaggauacuucuucuaagcugucucaggguugagccacugcugugcucagggaggccaggccuuaaugugcuugugauaagccuuugauguugaugaagggguggcgcacgccuuuaaucccagaagagacaggagggauuucugaguucgaggccagccuggucuacagagugaguuccuggacagccagggcuacauagagaaacccagucuagaaaaacaaaaacaaaaaacaaaacaaaccaaacaaacaaacaaacacugagagagagagagagagagagagagagagagagagagagagagagacucuaaccuauagaauguacuugguugaccagggagccucuuucaacuugggaccauggcaugguauagacuauuaauugcuuuucuucuguaaguguacagaugguugugagccaucaggugguugcugggaauugaacucaggaccuucagaagagcagucagugcucuuaucugaugaaccaucucuccagcccuuaauuccuuuucaaaauucuuggaacugggacuaugggugauaguaagcuuguguugugauucuauccuuuucccuuaaaacagaaccaaaccaaaccaaaccaaaccaaaccaaaccaaaccaaaccaaaccccaaaccagauaaggggucugaggguuaguggcuuacccagccucccuugguaaaacaguaugcuugcuuugugaaaucaauuauguuuaaaucaauauuccuuagucuuucaguggugggacuuaaacccagagucucccacauacuaggacagucccuaaacuucagccauucucccugcauuuugcuuuguuaucuaaaguugcuaaucugcuugucagaaacuuuagaaaguaagccugcuuuguagaaaggcagcuucguacuuuguagaaguauagcgggaaagggccuucgauugucacuaucugcugugaucuuguuuccggaggaaaaacaggacaagaaccagguccuuggccugucuguccgucuuccucuuuuugccuuguggcuucuccuugugccuacuccuugaggccugacagggcaaucggucagggcacugugguggacuccacagcagugugggcagcuauggugagaauguggccaagugggugacuuguguuuuggggcuggguguggguagaagagaaggcuuggcuugauugagauugugacacccucuggggcuggcaaacucuaaccucacauuucuguucucacuaggcgaugggcguuaaucugcucacccgcuuggcagugcuuuguuuuagagaauauuaggucaggccauugucucucaguagacauuuggacaagguagccuugcaggagagacagugccaugggcauucucauguccuuguuuaugccauugugccagugggaggucaguccuaccugccaccggagaaagccauccagcaggggccagccugccgugcaugaguucagacagugcggcaccagcaggaaccugccuggaaagaaaacacuuguggauggcacagcccuggggaucgcccacggucuuaggcacagcuguuguauugccacuugacaggugagaacacagcccugugagcucaugaugguuugaaacugguccuauugcuggccuaaucagaucuuaauggaagaggcagcuaaggugauucaggauacguuuuccccagguaguccuuucuucaguuuuuuuuuuuucucaagucugugcaggggugagggagggguuggggggagaagggaagggccuggggagauggcucacugcguaagugcuucccauaaaagcuggaguaccuggguuugguacccacacccacgucaaugcugagcaagaucucugugauggcuaaucgugguuguuaacugacauaccugggaagaaagaauauugauugaggauagcauccaucaaauuggucugugugcaugucuguguggguugguauuuaucuaucuaucuaucuaucuaucuaucuaucuaucuaucuaucuaucucuuucucuugaacuuucccccuuucuuuaaagauugauuuauuuuuauuuuauguguaugaguguuuucucugcauguauguaaggacuccacaugcaugcaguguccagaaguggauuacuaguaacugaaguuacugauggucaugaucugccaugggaaccaaacuugagucuucuguaggagcaacaagugcucuuaaccacuguaccaucuuucuaguucuugggaugcaggacaucuucuugauuguuaauugguguauuggggcccagcccacuguguacauugccaucccuugguagguggguuuaggcagcacaguaaagccaauugaucaagccagagaaagcgagccuguaagcaguauuccucuaugguuucugcucaggcuccugcuuagccuucucugggggauggacuguaagguggaguaaacccuuuccucuccaagugacuucuggacgugaugguuaucauagcaucagaaacuaaagcaagauaacuugugugccuguaacccuagcauuggagacuggcaacagguggacccaacagguggagcgugggagcaaaaauggcaagccuuaagguucagugggacacccuccuucaaaagggaaaguagaaaggaauaaagaagacuucugauguucuucuuugggcucugcauacguaugacaugggcaaguguaggcacauacaugucugcaaauuacacgcagacaaccugacacacacacagacauacaugcaguggaaagagcauuccacugugggacugugguuguagcucagugaaauacagcucuguccagcagagcuuuggauucuaucucccaguauuaauuaaaagaaaaaagaaugaagcggaagaagagaaagaagaggagaaagaggaggaggaagaaaaaagaggggaaggaagagaaaggaggaagaagagaaagaggaggaggaagagaaagaagaggaagaggaaggagaagaaaagaaaagauuauugguuccucuuuagauauacaugguacuugguggcucuuacugacuucauguaguugaaucacagugaacucugaguugggcuauguaccuguguugagagaaagccuaggcaauuggaaggguaagcacauuggucugugggguucuuuguuagugcuguuuucauuuacauuacuuucuuugaaaauuaaacacaaucuguuaaucuuuuacuuuauguaauacaugagucuaggagucuuagccaauguccuaugggaagugucuggagacauauuaacuuuuaaaacuucagucaguuauuuacagcauaagagcuaggaacaugggaacugauugcuugcuugcuaaauaccuagacugugaggaaaauucauuuuaaauggagaaaauauuuccuaaaaaagucgagggagguagagagcuagguaggagaugaaccuucccagacuuuugucucauuuauacuugucauuaauucuguggggaagauacaguuguuuuucuuucuagaaauuacucagauuuugaguuuaucgccacucacauucuaaauucauccagagaugauuuugaaaacgagagaaaacccaacaaaaauacagagaaaagaaauaaguaucuugucacuaaguuaaggucaaaaggcuaucaaaacacacccacacauaucacauauaaaaguuauguaugcauuuuauacacacacacacacucucucucucucucucucucucucucucacacacacacacacacacacacacacacacacacacacacacacacguuguuuuugagagugaauuuccugagguagcuguguccuaggacucacaauguagaccagacuggcucugcccuuacuuggcucucccuccucuagaggacugggaauaaagguguuugccgaccguagcuggcucuacugaacucuugccugcuauauuuagagaugauguucuaucuguugccuuguuaaacuuccgaugcaaauuugucucaacuuguccugcugggcagaaaaauaaagaaaaugauuaguuacaagauugacacugcccaucaauuuuccaaacuguguuugccaaaguggaccaguuuugcuuuaagcuccugacacaaaagaucucuuuccccccagaaccucauagauggggcagaguagggcagggcagggagccacuucuucaacucuagucaaccgaaguaaaucuuucuuacuacucucucuuguuuuugcaacuuaagugaauuucacucuucucaggguauggcacaaggugucuuucucccuuacacaugcuguuguugaccuugcuaggguuucugcaugugcauauugcauuugguccaggugacucugcuuuacggucccaucucaguuguuggagugcugagaucacagaugugugcccugaaucuggcuuguucacacacgauuuggugaucaggcuuaggcuguuaggccugugugguuagugccuuacuaccugaaccgagcaccaccccuucugucuguucuucacaucauuuuugacuuucucuaggcuguugaugggcaacaauggggcaucuuuaggaguuggacuuaaauuucaggccagaguguucuaaagagacagcaacuggcuauuaaugucaauuguauuauuaauuauaauaaguuauuucguauauaagucagaaggugccugaguuucagucgucuacacuguaguguucuuaugaaauuucaugcucuagcaggugaggagacaagagggcgaggaagagagggcuuacucuguggccaggacaguugcugcuaaguaggauuagggagggaaauacugaacaaggaaauuagugccugccaguacucuccaguccugccagcuucaacgugguguaagcggcuugcaggugguugcuauugaauuagcacaugcaucauugagugcugggaccauuuaccugaccuggcauucuugagacuaucaaguauuuuuccaacaccuucuguuucauuggugccuuacuuauuggacuuuauugugccuuugacacgaauggagaugggcuggggaaggugcugacugagucuaguaggcuggcucuggcaaaggcuggagggcgcagcugccuggaagcagcugaucauuuucauugccuuuggcucaucauauuaaacaugcuuguacacgcuucaguguuuguuuaauuuuuaccauaguuaugguucaguuccacaaggcccucgaagggcuauaugccaaaaggcccaucgucagccuguggcacuguuagauaauggagauuugggggugagccccagaggaaggaagcuguuaggucagggagauagaggaacugucuuugaaggugaugcugggauuccuuccucucugauuuuugcuuccuggguaccgugagcagcguugguauuccccgugugcccuaccucaccauccauaggccccaaaggaugcgaacuaguaggcuaagaacagaaaccuaaaacaaggggcccagauagaucuuccuucccuuaaauuauuguugcgauuuuguuacagccagagaaagcagcuugggaaguuuccacucugugauagccucaggaucacaggguuugugguggaaugcuaguguccagcuucaaaguucuuucuggcccaaaaguuuucccuuuaaagugucuaagaaaccauucaugucuaagacaggaaauaaccacugcuugcaaaaaucauaaacaugcuguucucugggcuggggugucacagacagccaagcacugggguuauagaacuggcuuugguugcuuuucuacuacuacuacuacuauuauuauuauuauuguuauuauuauuauuuucagaacaguuacagauuauuuaguaaguauauaguaaggacauauuuaguaaguauuugaguuucuuggcuuacauuuccagggaucaauuguauuaacauuuugauaaaacuuuaaagcaauuuaggauuuuaugcacauaaagugacuguacugagguacuaaaauaacagcaguaauuuggccguauugaagaauaauggccaaagucaagccucacauucgaaaauggaggaaagaccauuucauauuguaacuagaauuucucucucuguggagucauuuuguaaauauugcaaucaaauuuccuauuggcugucaccauguagaaaacaacaguuaacagugauguuauucauaguauugucuagugugguguaaucucaucucuuaggaugcugaggcaggaggauuaccaguaagagugaggccagucugggguacagagugaagccaugugccaaacaaacaaauaaauaaaaacaaaacaacuauaaauaaacaaaaaaaaccccaaacaaacagacaagaaagaaaaggcaaaagguccauccuuugaccucuggggucacgggaaccauuccuuucuuggcuacugucaucaaauacaacucaaguccaggcguguggagaugagacuauuuuagguuauuccaaaguauaaaccgaagaaagcaaaacuuagagucauuuauuuaucauucauuuuguuuuucuuguauacgcaugugugugagugagcguguguguacaugugcacacaugcaguauguacucuugccugugaagaccugagauugacauuggauguucuuccuaaauuguuuuccaccuuauuuuauguguguguguguguguguguguguguguguguauguaugcauauacuugccuauauguccaacacaccaaugcaguaccauagaguccagaagaggacuuccauccucuagaaauggaguuaugaaggcugugacuaggacagacuugcugcuagcuuggguuuuaguccuauuuggcuaaaaccaaacuaugguuuggagagauggccccuuggguacaagugcuugccuugcaaacaucagcaucggaguucaaauccccgguucaaaagcuaggcauggaugcucuuguccuaccaaugagaaauggagaugggcagauccugagagcucacuggcacacuaguuuagccaaacauuuagaaagucuaucucaagagaaaacggugaagagaguaauagagagaaauacugauguccugcucuggccucugcauacuguaugugggcacuugcacccauaacacauuuaugugugugcauugugcauaucacacacacacacacacacacacacacacaauuuaaaaacacacuuuauguguuuauguuagaauugagaaaugcaaaaugagagguuuacuuuagaaauaauuuauugcgaaacuauauugggaguauaggaaauacaacaugauuccacuuuuuuggcagucacauacagcucugugagcaauacaguccccucaauguuuccccuauagugucuuuuacuaauagcaguauaugacugcgauugcccuaacauuuuuauauuccuucuaugaggcccgauagacuccauggcuuuagaaaucaugcuccuggucacacuauacauguggguuuuuuugaggcaaguuucucuucucauacgguccuuacucauugcuuuuugcauugcuagugauaguagaauguuuucccauuagauauuucacuugugguauucaguuuccuaguaaugcuagggccugagaguuuugaaauagucucuuuccaguaucuucuguuguacacaccauguugacaauuccucuccuaggucagacacagcugugggugaauguguuggcucagccccacacgacauguagagauuaagaugauugaagggaccacuagucucucuccucugcuaugucguaucaucacagaacacggugacauuguagagauauaagaugcucagauagauguaccagucucuucacuuugucacugagguaugucuguucaggaggaagguaugauuuuccuaagauuaaguuguucuauuuagauaguuaaaaccccagacucuccauucuuucugggucucuggucaccuggaccucaaaaacucucgcuuuauuucccccacauuucaccuucuguagacaguggucuggugguuuuguaccagaaaacgggagccuucaucaguuuaauacauccucagaugagcauacugggauguuugcauuuuucagaggacuuuggguucugucuguagugugcggcuugagguggaauuauaaauauuaggaaggagugagacaccuguagcaagcugacugcacuacccuaggaguuuaagcaucagagauacaaggauacugggugaggaaaggggggggggggcgggaggaugcagggguuguuucccuuuuguuauuuucccuuuagccugagcgauggagagaguuauugggcagaacgggagguacugaguaaaacuggcuagaaccuguguuaacucuguguuacagaaguguugcagugagcauucauuuagaacagccuagauuaugcauccaggguuuauuggucgccagcgagacauggcagaauuugauuuugggguguuuugggaaucuuucccgugugaguccacaagcuggaaggugucccaugguucucaaacuccaccuaggacucuguauucacauugaaacucuuucuuguccaucagcuggcuaaagcagccccuggucaggugcugcugacacaccucugcugguccuggucgacguguacagaugcgcacugaguggcuacagcuaauaaggaagggcagaucuccauucgcauugcugaggcagagaaugccugggggagcgaggggaacagaugauguguaugugugccugguaacccacuccaaacccaugggcuucaaggcucaguagugaaucguucuuaggagaaucuuuuugcuuuucagagugagugaaaauaugucagccuacugggaacaaaaugcaaauguuucuuggugcauccaguguguuguucuuggugcugguuagguuuuucuuugucuuuccucgaaucccuuucuuccccguuggaccauuuuagcaguugggugaagccagauagaugaguuuaaaugcacaagguaaaauucauaugcuguaaaagaagcuaauuauauugccacauauuuaccaaaauaauuaaaaaggcggagcuaaaugauauuugugccuggcuagugccuugaacagcacacucuaauggcucuuaccgugaugguuuccuaaaccaaaugguauuuuucaaaguacuugaucuagcuguaagguaaugugaaaauguggagugguuuuuuaaacgugugugugugugugugugugugugugugugugugugugucagaggacgacuugcaggaguugguuuucuccuuccaucaugugggcucuaggaaucuaacugagguuuuauuagcugugaugguaagcaucuuaccuacugaacuaccuacuaccucucagcucugugugugguuucuguuggugaucccugcaaagacuguaguguguuuuaugaccucacaucccaguggaaggggauacagauuccuguuagaaguuagcgggaauaccacuuucuucuuccugucugaauucaugggcuuccugccaggucauaacccaggauaaagaugauaauaucaagugcaugcugguuugcucagagccuggcaauagcggccgaguguuucagaaaaccuuuauagcagaggugacuguuugacauggaguugacuguucugugacuguccccuacugcacaaucuguagcaggcagagcaacagacuuccaccaccauggugucuggacucuugaaugugcccaguagucggaaaaaaaaaacaaacaaaaaaaaaaacaaaaaaaaaaaccccuaauaucauaauauacagauaguugcuuagcugcccaguugauacauauucugcaguguucugaggggaaucacgaggcggcugagauaggcuguggaaguuaaggaagagcuccuuaaaagaaucaucagcuccaggacuucaugcuugccagguuugugcagagccaggacaaagccagcaauugugggcaaagugugcucaaggcugugugcugagguuggccaggcugcacuuggcauuuuauucaagaauauuugucauccugaugggacaggaguccuuuaccuuucagucagagagcagguauuauuuaguacuuucgcggauagaucccuaaaagcuuuagggauucauauggauuaccaggggcuaaacauuuaauugcaaaaccgagagagaccagauugcaaaauuuguaagaaacucucuugcaagaguuagaaacugggagaaaaguauuugcuggucugaaguuccuuaaugucuuugcucagucaguuuugucuuuggcuugaaugaacagggaagccuaagguggcaggagaggcgagguacgggugugugugugugugugugugugugugugugugugugugugugugcuugccuuucuguuugcugaaccauuagcccugugguguuuguagaaauuugugcuuugcuggccuaggcagauaagggcugucacaagucuggguuuuuaaggcgacagacucaaugccuggcagaggcucugagguacacaccaggauugggcucugcucagaggcaagaauguaaccaaucuggucugggcaguuggggagggacucaucucuccucacucccauauacuuuggcccuguuuuucaauuugacugcaucaaagccaggucucccuucagccgagggggacgugcaucuucgugacuccacagagcauguacugcuggcuugggaacugaaaccacauuuggagggcaugcugugccagggagaaauggaagagacaucuguggccacagauggagccagcagagagucacaggcagguaaaggagacucgcccggaauggugcgguugcuuggauauuuuuguucauaggaaguaaacggaggcacuguucagucagacaaaaauugguaugacagauucuaaaugauuugguuuuuggauggccgguuccuguaguuuuauuuugaaaugugucaguuuuaaaggaaggauuugacgucacuuauuaaaagacaucuuggaaccacgauucacucgguugaccagacuucuuguccuucuggucugccacuuacugccuaucuguugaauguguggagggauuugcccagaagugucuguucuaugagaauccuguuuggguaagaaccucacuagcuccucccaacccccaaaucuucaguggguaaaggggauuaacgguggcaccaagucuccaacaagggugucuugaauaaacacccaccccuguauccacuuagcuugucuauuucuuccugguuuguuuucuuagugacuugccauuuguuuaaucucugcuggugcuaaauuuugugaugggcuucuugaaaacauaaauacugagagaucccuucucacaagcuuggaacugcagcccuguguggcuguguaguacgguaagagacaaguucugagguuuauacuagguugggcccagcagucacaugggacacagauuggaacucuccugccucggggaagaucaggcaaagaauguuucccaaacaguggauguuugagauaucagaggaaagucuagaagaacacuaggccuaugggaacauaugggugaggacacaucuucaguuaagugugugugcccaugaaucacguggugaggugaugguuuccagucugcgaugugccuguucucucugccuacugcuccauccagcuacaugggugggcuuuuggcuccaugguuagugcgcucuguggucugccucuccugccuguuaagcugguccuuagcccuuagcucgcucccucuccaucuccguccugacucccuccaggguggacugugcccuguaauccucugccucaugccugcugguuugcuucagggcaccugccaaaguugcuucucguguuguuuaaugcaggcuucuuggccuuccaggucuuguucucugcgcuuuggagagugucuguccuuagggugacagauccuggggaugaaggagucaagagaugucguucaagaagcaaaagcacucuuuuuuguuuguuuguuugucuucuuguuguuguuuuuuucgagacaggguuucucuggguagccuuggcuguccuggaacucacuuuguagaccaugcugcccucuuacuuagagaucugccugccucugccucccaggugcugggauuaaaggugugcgccaccacugcccggccgggcaaaaagcacucuuuauucguugaaauuuggggcuguucugauguaggcaccaaggacuuucacuacgaucuuauucaggaccuuugggugugaccucagugggguuauucuggaacuauuugaaaaaguuaaguguuaaaaaaaaaaaauccaaaaaugcaaggaacagagaaacacucuuuggaauaauuguuauaaacagaagguaaauuaacaguuucaaagaaaaugacauggugagauucuuuagauacaaucauacuuuauaauauuuuauaguugcuucccacauuuuauuuaguuuucugacauggccuggugguguugcuugcugacuuauucuuguccgugcuccaacgacgguacuguauuccuauaauuaauaucauuauaauuuaacccaauuaaacccuuuacauugcauaauuaguagugauguucucacgcugauagcauuucuuuaucccaguaacagacauuugaggggucaauaccaucauaacauuucuccacuccuucugucggauuuuguuguuguuauuuuuucuuuguauuuguuuuuugaaaacaggauuuucuguauagcccagucaauguucacugagcucguaggguggccuccuucugugaccuuucugcccccucacaucccaaguacugggacugcagaccugcccugccacaacagcuucucugacagcuuuuagaucuuaccaaauagcuucguuucugagaacuagaaguagauggcuuaaugaccgugacuugucacuuggcuucuaacugaugacgguugcccuacacuguuagcucaagggauggcaagcuggcuaucucuggggaggcuauguucccaggcaugucucuugcccucugucucugcuucccaauuuguguucucuuuuugggagaauggaaaaacaaacaaaaaacaaaccagaaacuuaaaauguuuuuauucauuguuugagaauuucauucaaucuauuuucaucuuguuccucauccugaccccuccaagauuagccucacgucccaacucccuccugcucauguccuuuaaaaacugcauuuauguccuacuuugggggugagcuuuggcucucuuuauuguggagagcauuuucugcuccccucuugcuucacucccguucacucucacucacuagguagcuauggauugcuuacccagcaugcaccagucgcuaggccuuaaagaugguguacgacggaugacuagugucucggcuguuuuacggucaaguguguuucaggcggcuacacgggagaacuuaaauuguggucuguuugguguggcuggaggacgguggcacuuuccacuucugacaucauugccuaaugucaggcuucugggcuuggcuuucugcccugcugaggugaaaggcgcucagagacuucauauuuccccagaggcacacaccuguugcugacucuucuugaauaugaaacccacagccuagagucacuuucuuugguuucucuuuccucucugcucuuucaggugccauuguggggugggguggggguggggugggggugggagugggggugggguuguggguuucagggagugacuuggagaagagcuggccaacaucacgggucccucaggucugugacuuaaaugcauucagggguaguaaggcuguccgucauuguccuucugucaugacaguccacagcuaguguuugugcuggaggucagggguggcacuggcucuggcagcugcugccaccugacaccuggacuuguagugcuuugaggaacgucuauuuccucuuggcaucaaaugguuuuuggccguggccgugagugaggaaaggaaguauuguauaguaucauuuacuuucauaaaaauagcuuuggacucucugggcuuccugugaguccagucagugccuuuggagccagggagcugccuucgagggcaaaugauccggcagaauggagcgguaccaggcugggccacaaaggaagaaaagaacacuuaaguuggcuguucuccuugcugucaugaaaccuuacauaccucaucuuucaagugggagucagaguccugacacagcguaaccuguaagagggccaugggcaucaguggcagucagugucaaugaacagugaaggccagccaucccucaaucugggcaccaccugacuuauaugcuaaggacugagccggagcauucguugcuguagcuugccauuggauuggcauccagcuggaagugaucugagcccaauauucuuaauuucagaaucaacuuuguuauacuuacuguauuuauacuuuguuggccagacagccuuacucacagauauuccccaggggagaagacuuuacuggcgaggguacagacuggcaagcuuggggaaugucucgcuugcuggaggggcugcccugggccugcaggccugucucucguuucuucuuugaaucucuguguuuucuccuugcuaacccugcccucugaucuucuuucucuauucugccuuucucuucaugcugaugaucacucucaucacaggccagcucugugcuucuccuuuagcagagcucguuacaaccucuuuuucucagccacugccuuuccuuguuccuuuugcagccucuggcuacucggucccaggacuugagcugcuccuugcaguagggacacagcaggugccaugauaccuguggccugcagacugagucccuuggcuggccugggaaccagcucuuucagggcuguggugcacagaagagagcaauccucuuuccucuccaaaccuauuggucgaaugagcagcccacaucaccuggauacugggaacuuguugcugaguguccugauuuggagauacugaaucgagaacuaacacuuguccuuucugucccucauuuggacacuuucuugugacucuuccacauuguguuagaaacugcaagggcauggucugggacaauagucagucaguaaagugcuugccagggucaggucuugaauuuaauuaccggaaauuauuugaaaaagucugagugugcuaacacacauuuguaaucucagggcagaggaggcagagacgggagcaucccugggcuuccuggccagcuagcuuagaugaauuccagcaagggcccuuucucacaaaaacaaaguggacagugaucugggaagauacuugagguuaauuaaccucugggcuuuaugcaccugcacccaggaaaacacacacacacacacacacacacacacacacacacacacacacacagauacacagauagacagacagacagacacaugagacacacagaugcacacacacauauauaaacagacacacagacaacacacaagacacacaugcacacauauacaaagagacagacagagacacacacagagacagacacacacggacacacauacauagacauauauaggcagacacauacucuaucauguauacagacagacauacacagagaaacugacagauagacacagauagacaaacacacacacacauacagagacauaaaugcagacacaaauucacauacauagaagacagacacagagacgcaggcagguguacacacacacacacagacacacacacacagacacacacacacagacacacacacacacacacacuaccagauggcaaauaccucugguuccuuucccagggaugacccugucuaguuauuaccuggguuuuuuucacuuuccccucaguucuggcccuaacugucauaaauagaugcuuaucucauucucaguggagagaaaugaugacacacaagaguccgaguggguggaguguccauguuuggacgagaccgucucuguguuagcagcugcaggcuggcucuucgaugacucacauguguuaauccccguaucuucugaagagagagcacccucggauuugcauggggacauuugcacagggaaagaaacaguccuguggccaggguugacgugcagacaacugugccugguggacuguaguggauggugcccauggaagccgguuuguaagcagggauagaguugccuuuuggacggggcagcugauagggcugggucuuugaggcagacuucaguauuugcacaggcaaugugagcgggugccaguaguuaggaacuggggaaauuaguauguuuagcugcagagagucaguggggagacaggcaguggcaggugacagugggguaguguucugagcaacccuauuugaacccauaggcuggugggcaucauuuggucagguuucccguuggguuuuguuaucgaggauaauaaaagaaaaacucuuggauaucuucuucacgccuugccauaaagcuugagcauucuagaacucucuagaaacuggucagguuuuucucacaaucccaacaaauguucauaagaaaagccacuuacugccccucgcucuacaauaugcaggaugcuuacagauuucuaaaagacagaacauguaacuucagauaugcuggcacaugacuguaaucuccgcacuucggaggucaaggcaggaggauugcuaaauuugacuauaguguaguccucagggucucaaaaaucccaagcuaggguuggagguaugauggcucagcagcccagagcauguauguaagugauuuucagaggacuuggguuuaguucccagcacccguguugaacagcucacaacugccugucacucagcuccacugggaucugacagcccuggucucuguggagaucuuacucacauacauauaaccuuccacccacauacccaauugaaaacaacaacagcaacaacaacaaaucuuugaaaaaaaaaaaaaacccucuaaacuaaaccaaacaaaaacaaagaacaaaacaaaacauguagaugauucagaaaaucacauguccuuuuauuuuuuaaaaauaguauuucuaaauugaggcggugguggugcaaagaggcaggugggucucugaguucgaggcuacccuggucuacagagugaguuccaggucagcuaccacuacacagagaaacucuugucuugaaaaaccaaaccaaaccaaauaguguuucuacuuucuucuuugucuuucaguguuuuguguuuuguuuaucauuugcggucuugguuaaguaacuguccuuccuuccaggaaucgcccaggcaauggccuucuuuccugccaucaggguaggugcugguagugggaguggcuaucugaaggacuccugcucuaagcaguugacuaugcugguuucuccuaagucucugacaggcccaucuugcugcugcuaagagguugccucaccgggcauccuggaguguuguucuguucuuccgcagagcccugugagcuacuacuugauucgugaaagcacuggccacuuacaccagaaagcaacuccggccuucagauuuagcugcuuccuacugugaugugugcacccugucaugagagaagagagagccucguuggcuuacaaccccagcuucuucccaggguuccaaagcuaugauuccugcuuuccccuccuccucaccaagagcugugauguguuguguuucuccucuguauaccuccaugaugcuuuccugauugugaggaaaggagucauuuuaaccucaagcuugacucuuaggaauucccuucccuuccuuauuccaaguuaccgcccucgccguugcaaaaacaggugauccuucaagcacauggugagugugucgggggcacauuucucagccucugugcaguuggggaucuuaccuuuccacgugugcuguagacuugacucucuguaacuugguuuugugaaugauaauguccuucaguuccauuguauacuaauaugguagugaagacaugacuuuagauuuuauuuauaucuuuguuacuuugggaaaauagucugaugugaaauuacuccacccaugaaauaccauccuugccuuugcuuuuuuuggcuuugcuuauuuuuacaagaguuuuuccuggcguugacuuuuuguuguugaaucauaucagcaauaauaugaacauucucaacauauguugucagcaucgcgugaagaguucuuuucacccuaacguaggauuuuugcuaaugaucuuuaaugugauuaaaagccaagauagaauuucauagugagacaugaaugaauuaaagaaauccuagaauguuuugugaggaacuauuguuucuuaggguuucuauauaagugaauucagcuaguuguggaucaaaaauuuuggggaaaaauugccuuucuacuguauauguacagacuuuuuuuucauaauauuauuccuuaaaugagacagacugcuuauauuaugauaguuaguaugaguaauuuacagauaauguaaagauugucagcgggugggauuguuacagcaucuuacauaagggaccugacccucuggguuuugauaucugcaggcaggcuuggaaccaaccccuuucagauacucaggagaauugcaucccaaguaaugucacucugaugagaacaugagagggaaggcugaucauguggcucguggauaaagcacuugccccgcaugcccaaggcccuagcuuuguagguagagugcucugagccaccagaugaacaaagaugugagaagggagugugggggcuuggugaggcugugggguucacgaguacagacuugggauccgucuucugcagcuaugauauccaaaggaagcuccggauauaaggaaagggauuuuccuuaucacucauuugaaguuuaaccuggacuugaccugggagggaaaccaaaccuggucugugggcuucuuucagucuucucugauucuguucaccaccccuaagcaugucugcugcagaaggcauuggguuucguuccagggagaugccuugggucuugcuucuuuuugauuuuuuuuuuuuugauguaaccuguguuuucugauauaugauuucucuucucucauggcagggguuuaauuggcaacacuuuguuucaggcuggguggggacaggggcuaugaaacucagcacaugaagugauagcagaaaugaggagggcugaaugucuagccuggcacacucaggguuaguaacgaccagcucaucagcaugaagcgaagcagagcacagacauagauagagcacuguuuauggauucuucuucauucauaugugugaucucugauggaagcaugggccagaaacaggacagaaugggaagucugcaccagaucuguagacuuguuugcaccauuguuaucaacguuaacucccugucaggaucauuauuccgugguuauguaaaaggcucacauuaugggaggugacaugaaaauuuugugugccauuuuuacaacuuauuuuaauggguguaaggucauuucaagacaguuuauaaggacaugaaacaaaagugcucaucacuuucuauuucgaggcaggcuauuauaaagaggugagaaggcuaucagagaacagucuuauacccacugcuguuaaguagagauugcccguuagcagggcagggcguucgcuggucuuagaaauccgcaggugaagucaggcgcuauuucagagucagaaggacacagcguaccguaccggaccucuuucuuuucuugacaugaaugaaaagcaaagcuauggcuuccgcugaagggcaguaaagaagagcuggcagccaaggacagugcugugcugagucugauggaggagcgccaaggcccucccacuuggucacccugguguugggguguggcuuggcacuggcuuuuaccuggugcuuggcacuguuaagaguguagguucauuaguuuggacugacagucauaauaugauguucaaagccaagaggguuuccccauagcaggauaaggagacuguguaccuucuguggcucagucagcugaccugggcuugaaaguuugugugcuuuuauauuuguguauauguuuacauauguguauauauuuguguguguguuugcauauagguguauguacacaugccuguguuuauauuuauauauuuaugcaugugugugugugugugauaugcuggcuguguuucuuccauagcggauggguaucugaaugucuuuccuucucuccccugcuuugcugugcugcguguguuucagcuguuuauuuguucuuuauucucuuuccacgccauuccuuucuuucccugcuggugagaagagaccuagucucacagccaguugcuucggggcuauaauagaguuagugguauguaccaaaugugauuacagcugucucaacaccagaugaaugagagugugcauacccuggacagauaauucugacagaaauggccuauugguuucacaugagcuaggaccgaggccaccguguaaccuaucagaagaacagaucugugaggaacagguucccacaggcccgaagaguuuuugggaaagagccugucaugagagguuuuuaggaguuccuucagauaacccuagagaacugauggucacgucauuuuuucccauucucagggguuagggguagccccagcgcuuugcccaaagguugcuccaucuuucaucgguccugcagagaagccagggugguggcuaaaugggccgauguguggcuucuuugcuuucgagcuuugaugucauuucuauuuagcucagugagauuguuuuagaaaauuucccacaguggaaaguucucuuggacauaugaaaguucaauggucacuuucaaaaucagccaugugccaagaaauaacuaaaacaauggauugcguagugcagcagccuugggacauggaaaaauuuaaaagauguaugauucauauuauuaauacagguuguaagacaugaggccuugcguuggaaaacagaaaagggccuuucuguuuuuguuguuuauaauuucucuuucuggguaaaauaauuauucuuauuuucuaugaugauuauuuugccuguaugcauucaguguuugugaaggccaggaaaggguguuugcucccuuggaaguagaguuuucgugguugugagcugcuaugugguugccaguaacugcacuugguuccuccccaagagcaguuaggccuccuaaccacugagccaccucuccagcuccaagugcuauuuucuuuugaacuuauguccuaucuuaggguuuuacugcugugaagaaaaaccaugaccaaggacaacauuuaauuggggcuggcuuacagauucagagguuuaguccauuaccaucaaggcgggaagcauggcagcaucuaggcaggcauggugcaggaggagcugagaguucuacaucuucaucugaaggcugcuaggagaagacuggcucccaugucguuaggaagagggucucauuacccaccccuacagugacacauuuccuucaacaaggccacaccuacuccaacaaggcuauacuuccuaauaguggcacucccugggccaagcacaguucaaaacaccacauggucuugcaguauuuucuuugcuguacuuuauauagauuuuguucuguuugguuuuuaugagggaggauuaaaaaaguuaaauucuacaguagaauguuacauaaagagguaauugauaucauccuacaugaauuuguucagacaugcuaagguuugaaagaacuaucagaccuuugauuuggacucuuuuccucguuuacauuuucaaugcuaucccaaaggucccccauacccacccuggacucuuuuuuugaguagucauuguauucucccauaucaauacuuuugauagggaaagguaauuuaaaguuacugucugcauaugaacuugguuaccuuuaaccugugugugacagcucaguggguaagcaugcuggcuuccaggccaggcaaccagaguucaagcccuaggaccaacccugagugucucccugacccucacagggggugacuuggcuuaugcccuugccccauaaaugucacaaaggcucuuuuuuggaggauuuucucccgaagaauauuuacaaauaauaacuuaccaaagccugcagucauuuggucuacuucugguuaagaagacaaacuguagcaagugcagacccacacaacuaugccaggauucccuggucccuuucugaagcuggcuccugcuguagauggguaccucuuuucucugggauuaugcggggucaggcuuccauucuugcuuguugcuuuggcuacuuagcucugccuaugggaacggagaugcuuugguuuacgauggacaguggauauggagugucgucauggaacugcuggggagaauguuaagugguagagccaguuuggaaaagugcacagugguucuucacuacauucauaguguuauauaauuccuuuguggcucuccuccugggauuuauguuaucuccaggaggagugaaaauguguccaucgacguaauuuacaugcggauauuuagagcugaaaaguuaauaauaguccaaaggugagcccaaugcaguugccugugaacggaugaaggcugcgacgugccuuauccacgcaggaaagcaucauucugccacacacgaugagauauugacguccgcuucagugcagaggcuugcaaacaugcuaggugaaagaagccagacccaacgcagcaaauucugcugauuucacuuauaggaaguaucuagaaccagugaaucucuggagaccagagggagaugggaguagcugccuugggcugggcaaggaagccugugaaugacugcuaucugcaggagugaagggaggcuauagcauugauggugggguggcugcagagucugcaaacacacugauaucuguugacuugggcucugcauguguacuuacgauuuccuacuacguggguuauagcaguaaacuggguuuugacuaagugacaugacuggagccauucugauucuuuacugucucaccccaucuuauuccguuggaggaugaggaucagaggacagagugcuuaguuguuuuuuccagagucucaagucuauggucuucugagcuacauagauagguuccuuuuacuuggaacuccuguggacccugguaggguuacauauucugugagaaucuuugugcuagguacggauucuguuucagaggaggaaagaaagcuauuagauccauacuaaggaugcaggcauggcaguacaaacaccuuuccuucucuuuugcacguguguggagaacacauaugcaaaugaugucaagagaacaaaacaaccaucuaaaacagaagucuggaaaauaugagucugugugguuauuguuuuuuuccaccguagcaguuucuuucucuuuuccuuugugguuuuuggagacaggguuucucuauguagcccuggcugucuuggagcuuacacuguagaccaggcuggccuugaacucacagagauccaccugccucugccuccugugugggaguaaaggcguguaccaccaccaaaguaaacacuguugugaguaugcauaguggggugugugugugugugugugcugucagacaccaucaaacaagaaaaguuagcaucucucuaguugcuuuggaacauucaaaagcucuaagcugugacuauuaaaaaccaaaaguaccucaagaguucuuaacugacugcggaguuuaacuuccugucugaggggagguggaguuagauuuagucagauccucucgugggaaaaaaucaaagggacuuuaaaaaagaaaaaaacaaaacccaaccuaacaggacaucccagugugcaguucgcgggcggcuuuuguguugauuuccuucacaguuucccucaucucagccacuguaggugaugagcagccuggcagccaccacauuucguuggaaaaaguggagguuggaucugccugggcaggugccucuccaggcuugcaggagaucccccgguaaguuugucaguggccagacugcaguugcuaagggaggcuuuggacagaggguguucgaguuggcagagccucacuuucucucgauaagucugauguguaagucaggaagcggcugaaagcagggcuuaucugugacaggcagagguggccuguuccuccagagacuaggucucuguggagcggaagagcggccacacaucaggugcuuuucuucuuuggacugaagcuguugaacgccuuuguguccaagguuugccacuuuauucgaggcagcugguucaguauugagugcuuacuccuguuucauuuuuauuaaucaugcauugguguuuugccagcauguauguaugcauguauguauguauguauguauguauguauguauguaugucugugugaggauguccgaguccccggaauugaaccagugcucucaaacacagcagccauucuccagcucccugacuguuuacucuuaaagagaaacuuuuccuccguggcaggcuacugauguagcccaggcuggccuugaccucuaggucuuccagcuccaccucuggugagcuggauuuucggugugaggcaccaagucagaugcugagguguggacuguugacagaucuuucuaggaaggcaacauucuaggaaguacagauguaguucagagcugagaaggagcacaaggaagcguugcacuguugguggauuguuggggugucuguuuacuacauuggggugagugggggaaacugggggcuucuguuucuuacagguuuguccuuggaaaggcagagcuuccaggggguugguguccugaccuuuuuccuaauuaaaguccauuuccagaguggcuuaguuuuucugaucguugcagacauccauguauucuuagauggauucauggauaugcuggcucuguggucugucugagggaaaaaaaaauccuaaagauguguuuucaugugcuguaaguucuuugaguuaauacuuucccuagaaaagaacagaaaccaaaccagauaacaacaaaccauaaaaaaaccaaacaaacaaaaaacaaaauaaaauuaaggguaguuuuuuuuuuuuuaaaacacuucucuucauugcaauucuucccuccuuucaauauuuugguucguaguaacauaggaacacugcacuagguguauccuauaagcaugcuaccgaaauaagagggccagcuuguguuuucuuagagaugagcuuucuuggccaacagcucugggguguucgugugcugcaauuaucuacauugccccugucuuuguuuucuuacugaggagcucuaaggucccaacauauaaucaugagaccuuucagggcugugacgaacgcucccugaacagagguagucacaguggcacugugaccuuucugaaaucccuuuaagucugguggacuucucuuuucuccugccccagaugucagccuacaccuugucuugcugcagagagucuggagcagcugcugugguugcagucagagaccaaccagaagaaaauuaugggccggaguaaacaaaguuacuagaugacaaggucagauaguuuaaaaacuguccuggcugaguucugcucuguuuagguaguacuccuuccuuugcucuggcugcuauagagacuuugugaagauaacauuuaaaaaauaaaaauauuucagggauguuauuuucauaaaaauagaaaaccaguguuuaccuggucccaaauucuauaggaguucagcaucuuuucuuuuaaauuaagcugggcucauucuaguuuuguaaugcguuauuucuucagugaucuugauagaaguaaagauaauagaaucagugguuaaagugguauuuugauggaacacacagucaaguaccagaugaugcgccugagguuuccccugcucagggaacaacuuugggagagccugcuuagcuugccacccuucccacucucuuauuggcugcugagacuccaugccuagauuggcauuuccuuuuuagauggauggagcagacgauccaagacuccagcugucuauuguagccaccuguauccugaggcucuuuccagaggcucugauguggcugaacugagacagugacuuuguagcuuugccauagcucucuggaguguccuggauggagcaguguggcugggccuguggagacgaugacuuuugugccaacugaacuggcaguuaguuccacccuagauggauaagaaggcauuaucucccccauacccaggucaccaccugaggaagcagaagucugaagugcuguggggcgagcaaguggauuccauggguaggaucaggcaaagacuuagcuuccagugugugcugauguucagggcguggugugugaugcugagauugacagcugagagggagaagcucaagaaagugaucuuaaggaaugggugacucacucacuggaauguucugaugaagcaaggaaaauugggagcuuuagaaguuagauuuacaccaggaaguguguguguguguguguguguguguguguguguguguguguguguguuacagagauuaagagugaaugagagaggggaggaagggggagagggagagggggagaagaaagggagagggagagaagguuggagggagauuuggaaacauuggcaggaaguuccccuguacucuaguggcuucuucuggugcuuggguuggcagccugcaaguuugauuucccuugaauguugaggucuucuuuaauuccuuuuaguuaacauguagcuaccuggugguacaggcuguacccugggaagcgcuaagaguauaaaauugccucuauggggcaugggcuaaaaucuggggcuggguaagaggccugggccauuguugucugacuugccagaugcuugaccccaugauggagcucaggcuugagagcauagugcaggcccugaggugccucuguaacccugcuggcuaaagggaacugagaaguugguucugaagaccagguagccuaucaauuacaaaggcacaagaaugccagugauuuggggagaagaaaggcagaaggugaccagagaaucgucaucaagaagacccuggagcaaugguucucaaccuguggguugagaccccugggcaucauaagacccuuucacaggggucaccuaagaccauuggaaaacacagauauuuacauuaugauucauaaguuguguaaccgguaggacauaaauggauugauaauggacuuggacugcugaucagugucuaggaaaagcaaaucagacauaucaaauaccaaaaguacccaaagacauguaagcuacaggcucucaccuccucaucuccuguguauuuuuccuugguaucacuugaauggcugcucauggacaugguccuggaucuguuuaauguuuucccauccguuucucugacccgugcuuagagggcaccaggugcuuccuguuucaaucauuagcagguucagcacuuguuggaaaucgauguuagguacugugugguaauuugauaggaucugggucuagugcucccccauuccugucucagcacuuugaccuucaucucaacaguucagugaccuggcaacucuaaguaguuuuuucccacugcaccaggacuugcauuguuugguggaggaagaugagucauagccuaguucugccauugugugaggugaaaugcuagucuagggcuaaagaacacaggucaggcuuuuuguguaaaucagaauaaucgaacugggggggggguaggugggggugacgggauuaugggccaggguggccauuuuggugaaauuacucucaucuuggaggaacauuuuauuuuaacggauguuucacuucaaaccuaauucuuaauaaugcuuugaacaaucuuaaggagucagacuccuucaaacaaaaaucuauacagaaucaaaauuauaugggacagaagaauguccuccccucccccccuuuccucccauccccauaaccaggguuacugccuuggguguucuguguaacccuuuugcuaugaguauaaaaauauaaaguacaaaaguuccuuuuuguaucaaauaaaaaucguuguguguuaguagcaugcaauuaaaucaaagcaaagcaaaaacaagccacaaacaaauaacugaaaauuacaaauauuaauaucagggccuacacaucuuagcguacugggcugcugugagagcaugugugcuuuuauuauuacgcugccaccguagagggugggugagaggauuugugugugugugugccugugugugucccugugugugccaaugugucuugagacaaaccuuccaaucauccuuuccuaugcuggugcccguuuucuucuguuguguggaucccugauuuugaaacucuuagcgauuccaaaaccaauuccuacauaaaacgggggaguuugaauaacuugcuuuaauuuuguuugacuuuuaaggugguuaaccucuaacuuaaaagauugacauccuuuugcuggucugugagauagagguuuacgucuuuggacucagaccccacauuuucccucucuuuuugguggcuguggacacagcugccauccuaaaccacacgagaccagucauuauuuagguacccucaauauuuuauuacauuuuucauauacugguaauuaauuucacauggaugguaagcccggaauucuuuaagguccauacauuguggagccuguuacagucagggccaggaggcuguggagugaaacuugaaacuaaauagcaguucucuuggcacugaaugcagugaagccuguggcuggagggcggccucagugcuaaggcuacuugaugcucuugcauaggaccccacaugggguggcucuuaaccauccauaacuuucuucccugagacccaacagccucuucuggcuuuaaaaggcacccacacaccgaugaaccuacauauacucauacacacaaauacacuuaaaauucaauguuaguggugccucuaccucccacccccaccccccggcaggguuucucuguguagcccuggcuguccuggaacucacuuuguagaccaggcuggccucaaacucagaaauccgccugucucugucucccaagugcugggauuaguagugucuucaagaugaaguugguaaggcucauuuuguuuuguaaagacaugugaaaauacaaauuucuuaucuaagcccaguugagggaaggauuauaacaaacgaggaccacuuaugauaauggagucuuucaaguugauauagaagaaaguacaugugguuauuaaaggaagaugagacuuuuguuucaaucuggcaccgugcuuaccgccauuuauuauuuguugcuacgucccuauucuucaauccagauagaucccuuaggaauuuuccacguccgagcacugagccuguaauuuuaggcuggguucauuuaacuguagaugcucugcauggcaggagcuacacagccauacaggagacacgagcugugugggagaugugaucgaggcguggugcccaacgugguguugcuguuuuuagaguucacuuucauuugcucagaaaggaucuccaucucuguuugcuggcaagcagagagccugggcaccuagcugccccucuaguucucugccucaugaccuaguugcuuucuggugucuuguacaaaaagcuuuauuuagucugcagagagguuuauuucuccaacuaaaggagcgcugucaccguagucuaggagcaugauggaugcccagugagugcuguugcucagauacuacaggaggcugacccuaaggugcuaggaagaaagacaccgagcacagauuccuccagcuagcuuugcacaucaucaucaucagugaaaauacugccagauagccauuugccugacccuccacaaagcagcuccucuuacugccccagcucugacccuuuucucucgguugguacaacaagcuccuuguugagaacuuagugccaagguuagucuccuggcuucugaccuggccuguuuucuugcugccuucugaucugcaugcuuucagcuucugcuugguccauggcauuuaccccuuuucugauguuugucgcugcugggugguuuugcugauccccuuuugugauaacucaagagagagacucagccaugccugguagugucugcuaguugucugaauuaguuaagauggcuguaaauaugcaucagcugggcaucauggugggcgugcacuugugaugccagcacuugguagggggaggcauuguuucaggccagccugguggacacagugaggucuaggcaagucaggauuaaauaaugggaucuuguugaaagcaugcaagugagaaugaaaaaaaaaaacguguauuuauuaucuaacucugagucacuaguguauaacaggaaaaguauagucaggguguuuuugcaugcccugccagagagcaguucuggucugggguccuaugaugaaaaaucccuagccuguugcuaugcucuggggaaaaaaaaaaacaacaaaaaacaaagaaaugaucugcuaagcacauauugagugccugcuguuuucuuggucuuaagaccaaguggaaguauuauaguguuuuuuguuuguuuguuuguuuguuuuuaaggcuuuaaaaauuuauuuauuuauuuaguguagguaaguacacuguaguugucuucagauaccccugaagagggcaucagaucucauuccggaugguugugagccaccaggugguugcagggauuugaacuuaggaccuuugaaagagcagucagugcucuuaacagcugagccaucucuccagaccacuuguuacaguguuuuaaauauauguauuuuaaagauaagauuuauuuuauuuauguauauaugucuauguuuaaaugaaucuuugccauaugucucuagaggccagaaaaggguguuggauuccccccacagcugaaguuacagguaguuauaagaagccugauuugggugcugggaauggaacucaggucuuuuggaagagcagcgggugcuuuugaccuuugagauaucuguccagcccugggcuagacuguuuuauccucaagucuuugggaucucuuuugguggguuccuguucuauggucaguucccaggcaacagcuuuuaggauagcccaugcuccaguuguuugagacccacaugaagaccaaacugcacuucugcugccuauguguggggaguuuuaaauagguuuuguuguauuguuuugcuuuguagcccagggucacagcauacacuuugcagacagugcacagagcuagugauaagcguuuguccugaguaagaggagcaggcucaucagugaugguaagguagggccucaucucaugcuugaguguuggcuuugaggucuagauccguccugugaaaagguagugagugggugugagugucacugacaucaacauccugauaguacugaugugcccaccagcaggcagauugcagaggacaggaaaaaaaaacccugcagugcuaagcaaccuggucaagagggcaccauguugcuguucaaguaggcuaaaaguggaaaaauaauuagcaugugaaaaggcuuguuuguggaaauggcuguaaguuaauggaagcagguugauuuuucugaguuggaacacccauucaaccucaaaauaauguuuucacauuuuguccuaccaaaacaccaacuccccccaccccccaccccagcccugguuuuccagccugaguguggcuggaguugagcucaucugcucugugggcuuccagcuguuugacuggcacuugaaagccacugagaggcauuccaaagcuugaguuucuuuguagcccaaaccaaccuggaccuucugauccgaaggcugagaugacagguguuuaccacuggaaaaguaacuuguauuaaccugaugcaauuguugacuggucuccuuggcuuaucaccucagucugcuaaccuaggccuaguucuggaagcuucuagucuccauacaaucuaaucuaggccuagaguguuuucagccacugagacuuacggcugaauaggcucacccuuuuuuuuuguuuguuuuuguuuuuguuuuugcgagacaggguuucucuguauagcccuggcuguccuggaacucacuuuguagaccagacuggccuugaacucaaaaauccgccugccucugccucccgaggcagaggcucacccuuucuuauucuuucugagcucuggcuggcugauucaacucagcuguucuggcucaaaacuccucuucaacugacugguccaaucuggcuucucucucagccuauucugaauggcccugccuggccucauacuaucuuuggcaauauguucuaaucuucuggcuccuucucauucucuagcucauucugucuucaucagugucuaguuuguucucuuucugcaaccugucucuguacaacuguccugauaaaacugccuccuucuuucuccuuuucugugcugcugcucccucgggucauuucccuuuccucuugugaaacuugagcauauccuacucugucaaaucuuucucugauuugacacuuugucugccacucaauuagacaccacuuacaagcaugggugcuuccuucuaaaaacuaacguuacuuucauuguuugggauuaaaggugugugcuaauggcugagccacaccauuacuagaaacaggauauauauguauauauacauacauacaguaaauaacaaaauuuugggguucacagugugaucaaauaaccugcaacaugccaccaugccugguuucucugagccugagggcugaauccaagguugcuuguaugcuagcaagugcuggacaacugaaucauacucccagcuagcugcuuggaaagccaggugcuuggaaagccagguauguccucacaguuuauucugcuuuuagaauaauucucuauucaggugaucaaguacaucuuguccaagaauucuucccugacuucuaaauaugaguuuccuuccucucugaucuacaucuuucccaagggaucaaguucagauaucccuggauauauuccccaacacugccuuuaugagauaugcugcugaucugugcuguugaaagcuagucugucucugccauguagggccugggaacaucuuuuuugcuucuacugcuaugugucugagaaccuucuuuuaggcucucaguuuaagucuugucuguucuuacuaacuugauuccucagacccaucccaguuccuggguuauuuguuggcuuagggauuuuuuggccagugaacaauaauugacucagaguuguauggaugcaggccuacgugcugguggaauccagacaucugaaugaagucauaugaggaauuccagcccacuaaucuuuauuguuuuguuuuauagaucagcaauaugugagaauuuaauacacauuauggcuaguuuuugcuuuuguuuauguuugagaaaacauauuauuuguauuuuaacucuuaaaauauuuuuccuccucucauuuauuugcuuauuguacauuauuuuuagugugauguguauguguguuuguuugugcauguauaugacuaggaauggauauggaggccagaggacaacuugugggaucaguucucuuuuuauaacauauagacucuggggauugcacccagagugucagguuugauggcaaacaacuuuaugcacaucuugcuagucugcacuuuuacuuuucuuuuagaagguuuuacauuuacaggaaaauuguaaagaugguucugagaguguacucagucccuucucuacuuaguuaauaucuuaccaucauugcuacauuuuuuaaaacaaauggaccauuaguauauuaaucaugaagucauuaucagaaaucccaaguuuccuuaagaguuauuauugauuuaaaaaauauuuauagcuauuauuuauaacauaucacauuuugacuugaauuguuuuugagugugcucaggcucagagcuuuugaauccuuacaugucauacuuuguaaacacauugacaaaacagaugaaaacuugugacgugggagucagucucugaugagccuucugggaccuggugaaggagaaggcuauuuuaaaggcugacuuaugucuaaaaucucugcauuacuuugcaguaaugaaaauaauuacuugcuaguaccuuagguuuuauuacacaugcguuugaguuacuuauaaucuccucaaacagaaaggaucauucgaaauaauagguauggaauagcccuugaccaaucagauccaagagcaaaugaccagaaaagaggcccacucaaaaaugaauaacugcccugcuaacuuuugagugcccuauaaaugucucuagacauugucguaugauucaguugguaguccuaauguaaggcagucauagcagccaggcucucugacagugaguacuguauaaauguuugccaugguugaugucuuuuuucauuuguuauuucugaucaauuaaaaacauuuagcuuagugggacaucagacgguaagucacuauguguuaaaaaugagguucuaggccagugagguggcucaggagguagaggcauuugcuguguggcagcccucugaccugaguuuaaucucuggaacugauggugggaagaugagaguuaacuacugcaagcuguccucugacuucuacuugugugcucuggcugguacagccacauacacacaacacacacaugcagacaacacacacaugcacacacgugcacauacagagacaaagagagaccgagagagagagagagagagagaggacaggcagagagggagaaacagagggagaccgagacagacagacagacagacagacagagaauaacuuaaagaaaaccugagaacuuguuuaaaaagauaaacauaaguuuuucauucuuuuaugaugcgguugcauuuugguguagggauauggcugaguuggcugagcguuguccaguauguaauccaugagacccugccuucaaucccgaguagcacacacaucaggagagguagcucaugccugcaccagaggaucagcuacucagugucauccuuggcuacauagagaauuugaauuggaggcuagccugugugcugcgagagccuaucuuaaagaggugggggggggggcagggguguauuuugaauucaaauuuucuuagagacucccacugcagaagagggauauagaucucuagguugacugcugcucucugcacugucccuuugguucccgugggaagaggagaccccugaaaggacuaggagguguggaauuuggaggccaguuucucccaaaccccauucagcuaccugcugccugcuuugagugaucgcagcagcaugcuuggagccuguacuuugguuccugccaaaucucccucauuuccccaugaugauauguuauuagucuccugaucccuguuauuuguuaaguuaaucugcgcuuugggaaucuaguaagaucacagcauuuuguuuuugugacuucauuuuguaguauaugcccugggugggugcagcuaugcuggaguuggugaaacccaauaacuuacugucuacaaacaucauuuuauacuuagccuuccugcccucuucaggguuccagaaacagacaccuccauuguuuaagcaguccuucugcuauguuuucuaagguagccauuuuccuauuaacagaauguguuuuuuuuaguccuuaauccacugaaacagaacagugugugggagcagagggugagaugaaugccccauguagcaucuuccaucucagcccuucuguggaaacgugggcagccuuacugugcuuugaaugacucuguuguguuucucaguaaauacuuacuugcuaauauugguugauuaugaaguucuucuuguuauuguuuuuucuuaaacccaggcugaccucaaacccauugguaguugaagauggcaggaaccucggauccucccgccucuaacuaguguugggauuacagaccugugucaccacacuuaguuugaugugacaguguggacucugcccaaccauaggcauugcugagagagaauuagauacguauuuucuuguuugguuuggauuuucaagacaggguuucucuuuguagcccuggcuguucuggaacccucuguagaucaggcuggccucaaacucagacauucgccugccucugccuccccaaguuugcccagccuuguucuggauuuuguuacuuucauugucauugguuccuuucuggauucuaguuacuuauuuccaauaacuuccuaugaaccuacuuuugggauaagaaguuuaauuuuagguuguagggauggugcugauugguccuaucccccaauugguuccugaucugucaguaaagaugccauggaccaguuacugggcauaaggaauaggcaggacuucugggcccccgcaggcaagcaggcagacucaaggagaagagagaggguuuuggucaugcuuuggaaggacaaaaggugacccgucugucaugugagauauuggacaggauggccacaggcugguucuacaggcacaagguugggauucuugagcuuggacuaacaacugagcagcuaaaauugaaaacagauuuaggguugugagcuaagaguauugggaagcguacacuagccacgggaguuuaauaaugcccagcaauugagccaaugaggaaaguugaacuugagcaacuuuugucugugguuuugugugugugugugucugugugugugugucuguguuuuucauccauggaucaaauacucucgggggggugggggugcugguagugcaguccauuucuggagcugaggcaggguagcaaaagcuacaugcaacacugaaacuauuaauauggauuguuaagugaucuucaguagacucagucaaguuuaguauguuugaugauauuguuuucaugcaguaucuuguuuguauuauguguuuuuuguuuuuuaaaaaagaauauuuaccuuuuauguguguagauguuguuauuuccaugcacaucuguguacuacauacaugccaugucacgagaggccaggaucccuugguauuagagauauagauaguugugagcugccaugugguugcugggaauugaacccaggggcccucaauugaguaaaugcuucuauaagcuugggcugccggcaaaccuauaggguacuuucuuaauuggugauugaugagggaggacugagcccauuguuggugaugccaucucugggcugggucauggguucuauaagaaaucagauggagaaagccauggagaacaaagcaggaagcagcacuccuuuauggcuucuguaucagcuccugccuccagguuccugcccuguuuguuuccugcccuuacaccuuugauaauggaccaugauguggaaguguaagcgaauaaaccuuuucuucucaccuuguuuuugguuaugauguuccauuauaguaauaguaacccugacuaggacgauuccuaucacaucuucauauuuucuguguuuccuggugcuacuuccaagagaaaugacaaagacuugauucuucaccuuaguaucuccuuuguaagauaagccaaaguaucauguuagccagcucaucucaugaccguggcugaugagagaagaaggaagaacuuucccccuagucuacaggaccggucuaaugcauggcagaauggaauuuaguguccucaauugaagugacacucaacccacugucucacacuguccuggggaccuugcaggauuucagagugacuacaguuuucccuuguggccuggcucacacagaacaugacuaauauuaggaaguggggagggaccccuuuauagaguuuucuaauuuuguccuucauuuucagcuaauuauucaugccuugggggguaaaauagcuuaguaggcaggacaauauuaguuuuaauugugagcuuaguccagagggcugugcuugagugaaaaccauccaggaguuggggaaagagcagaugguucuauuucuggcugcugagaggggcuuugcagggcuguaaggaaagaugggcguguugauugcaggcacagggcacuuccugggaucacauccauuaugccacugcuuccucacugauauuaaaagaaauuaaaagcacaggccagauucuuaaagcuaccaucaccaccaaucauuguggaaacaauccuaaaacaguuguaaauaucuacuucauuaagcuacaacaacaauaagaaaacccaacccaacucaucauuggugaugauuucuaaaaagucaucuuuggaaagaguaaacaaauuagcugugugcuuuggaucuguagggaacccuccccagccccuaccuccauguuuugaccauugcuguccagguggugauguggcuuugugaggccgaggaacacuugggaggccaagcauagcuggugcagguaggucucugggucugggcuuucaguucugucgugauugucugaaaccaucagaaccaugaaccaagguaaaauguucuuccuucaaguugugucugacaggugugcugaugaccacaguuaugcuaauguagcuaauaaauggcuuauuauuauuauuauuauuauuauuauuauguaggaaugcugaagaaggccugguguggucauuggaugcuagaauccuucuauucaaauguagacagcaaaaggccuacuaggaagggcaagugcugggccuccucagccuuacaaccuucuuuuccucucagccucugcugcucuucuuugccuguaaauuuccaagaacauuugucauagauuuaaguacuuuuucuguuuccucuccaacaaaauauggaaggugauuucagaagaguggaggccauugcaugggucucggugaccuuuacaacccagacaggaugugggccagcagagguacacaguuuccaagggaaauuucgcccuuuguuuuuugagauuaauaacugggugggauagaaagccaaaugacuucauuguugagcauagacuuccaggucaugagauauugcccgugugaacuaaacuuuggcaaggugugguagacugaugugcgugcacaccucaauaauuucagaaauggagcagaagauacagggacaugccauucuccaugugauuugcuuugccauuuaauuuuauuuaaaugcugaggcccaagccuagggccuguguauuccagggaagcauucagccacugagccaaucccuugauauuaauacauacuuuaaaaagcacaucaagggggcuggugagauggcucaguggguaagaacacccgacugcucuuccgaagguccgaaguucaaaucccagcaaucacauggugguucacaaccauccauaaugagaucugacucccucuucuggugugucugaagacagcuacaguguacuuauaauaaaaauaaauaaaucuuuaaaaaaaaaagcacgucaaggaaagagcuacuuccguccuuucucuacuaauagcacuccguggcagaaugggacugccuagaucuuuuugaaguccaucucuucaugucuguuuggauagaggguuucuuaucacaagaucuagcuagcaguuuuaauuauaaaugacaagggcagauuuaguuugaaguugauagagggagagucuauuaucucugaacaaguacgaacuaaggugguugaagguugacuuggcaaggugacuucccuuucucugucaaguuacuguuugcuugcauuaccacagggucuccagucucuuaccagacagcuuccaaggccuuccuaacucaucuugugugaacuuagguguaggguagaggugacuucaggcggguagagaugcagucuucguuggacucuacccaucagcaucauuucucuguguaaagaaguauggggaagagugaagggauaagacuguuucuuccucuaaggauuaaggucucauuaggagagcugaugacgcaggcauggacauguaaagugauuuguaguaagcaaggaauuaaguccugucuaaauuccaaaggaguggacagagugcuacacugcuaagggagaggcuuucuuuaaagacuccgugaaagcuaauaccauuugggcacaagugguacacacguguaauccugucuccucaggaggccgagucagccugauucuuaauucaggcugucugaggcuucagggacuucaaccccagccugggaaaauuuggccaugucucaaacucgaauucaaacaaacucuuccagagccuguguggcauauaggaggcccagaguugaaccaucaguggcaccuacauguuggccucaaggaaagacguggggguugaugggaauccggaucugagggaaaaugcuccagguuugaggggcugacuuguuagggccgacacagagaccacagguuuugagcaucguucagaggugcagaauuaauuucaaggucaggggcauguguggguguggguguggguggauggcguggugcucaugagagagcuggaaggggaaguuggggaggacuucccuccugaggcuggaagucugggcaugauuauccuggcuccagugagugauuaaaaugagugauggcaaagcucccugcauggauuuuaauauuuaagauucugcugccaaaggcugagcucacugcucuucagagugugacugugaccaagggaugaagugccccccuguugggucagcaccaucuaggcugaaucccagcuaacaccugcugaaggcacuucccauggacaucugcuucucccuucuguccucuagcaaaagguaaaaggagccuuggaggggugcggcugucacauuucugucuuccaggucugcaccuauggaaucauccuguggauuauguguggagacccagagcuuguaauuaagcccugcugggcucgaagcucuggcucucugaaggcuccugcugcuuucugcuucugcuugagaccugcucucucucucucucucucucucucucucucucucucucucccuccccccucucugugugaaugugugugugugugugugugugguggcggcggcugugucaguucccaugucaguucccucuugcugccagacgugucccauuaaugcugauuuuccagccuagcaguccuuuaaucuuucaguugugggguucuguuguggaucucauugggauaaaaugaagauauuggugggcucugcccuucuugaaaguaccagggaugaguccguuuccuuuuccuguccaacaggcugcuucauuccuuggcucauggucaauggcacucucaaaagcagcaguuauaggucagguucuaauacauugcugacgccaauucucuccugccuuccucuuaugcauauaaagagccguguggugacguugggcauacuggaauaagccaaaaugauugcccuguuccaaaaucagcugauugucccaaaugaacacaugcugcuccaugucucacacuaugcuucagguagugaaaugcugucaccaucaggaucucacuaucaguacaugaaggucuuuuguggggagacuggaccagguaguuauauuguuuugucuuccauagugggaacuucugaucauuucuuugucacaagaauguaagcacaaagaauuuaagauggacgcucauuccucauuuuguccuguaugucuggguuuagugucagcaugccuuuuuagcaaucaauuuguuguuguugcugcugcugcuacuauuuuaaaacaacagcacagagaguuguucuuaaaaguuuuuguguaugcugggcgugguggcacacuccuuuaaucccagcacucgggaggcagaggcaggcggauuucugaguucgaggccagccuggucuacaaagugaguuccagggcagccagggcuauacagagaaacccugucucgaaaaacaaaaagcaaaaaaguuuuuguguguaucaggaugucuguuugucuggugaugggggaagggaaggaccaucucaaguuguuuuaacauuagggacagcaggaugcuggcaucugcacacauuauagauguggguuauuaacucuacugugacagaaaccagagaacguccuugccaucuacuuagucuacuaucuucugaagcuacacguuacaguggcugugacucaguagcuuucucucagugcuguuggcucugagagcauccgacaguguucaagaguguuugggaagaaaacaagugaacagcuaagcaaacaguggaacucaagugauuccaaauucaggggaagugcagaaguucagagguuagauagcaagcauuaaaaaaaugaaccguaugcuuagugggaaucucaucucuggaauggauucacuuaaaacacauuuuaaagauuaauuuauguuuauuuuauguguaugaauguuuuccugaguauaugugugccuguguaccauauauacacagugccugcagaggccaagacauuggauuuccuggaacuggaguucauaugguugugagcugucaugugggaugggaucagaaccuggguccucugcaugagcagccacugcucuuaaccaugagccaucucuccauucucgcaaauguauuuucgguaaauugucuuucuuguggcagaggguacagauuuuauguguauuacaauuuccuucugacccaauaacucagaugguauuaucgccauaugaauauaaaaaaagaaaauggugucuuaaagugauaugugguucagccaggcauggugguguacaccuguaauuucagcacuuggaaggcugaggcaggaagauugcuacauuuuugaggucagcucaggcuauauacugauuuauaggccagccagaaccacagagagagucuuucucuuugaaaagucuacccugucaaucaaaaccuugauaaaauuaaaauagcagggcuuguggacaacauugaaaauaugaauauaccuguucauggcaccacaggaagucaacauacauguuuaagaugagagcaucugugaaccagagauuuguucugaaaauaccucucagacauaauaaucacuuuggucugccacuuuuuuguuaguuguuuguuuuuuuuuuguuuuuuugguuuguuuguuuguuuuuucaagacaggguuucuguauguuauagcccugccuguccugugaguguuugaagaccagcuggccucgaacucagagagaucagcuugccucuccucccgugugcugggauuaaagguaugcaccaccaugucugacuuuuuguuaguuuuauagauaugaauuaaauucuguggagaaaacaauuuucuuuacccacccccccccgucaucagagauaacacauuguuaaauaguuuaauuaguuuagaauguacuauccugugcucgcuucggcagcacauauacuaaaauuggaacgauacagagaagauuagaauguacuauccuaaaauuuagaauccugauauuuugaaugcuuuuuggaaaacacauauuucuggaagacucggguuucuggaaguacaguauccgguagacagauagguauccuggcagugugauaaugcccuauuucagguaccuaaaucuuuuauguucaaauggauaaauccucccagcuucuguuuuucaaggaaaauauuuccuucaagaaaauaacuuauuuguugggccaaagccaggaggagagguaagaaugaaaaggcccccguaauaugcuuccuuuucuugacauaggaaaggcuuugcaugguguuuuauggaaaaagaagcaucaacauuaauuccuacaaauaguauauuuaaccaacgauaaaauuauuucugugucaggcaaagaaucacugagcagggucccaaagaagacccagggcugcuugccugauuuugaaggggucgcucuggguuugccgucuuagguauuugauuuauuuacuuuuuuuguuuuuguuuguuuguuuguuuguuucuuuuuucuuucuuucuuuuguuuuuuguuuuuuuuucugagacaggguuucucuguauagcccuggcuguccuggaacucacucuguagaccaggcuggccucaaacucagaaauccgccugccucugccucccaagugcugggauuaaaggcgggcaccaccacgcccggcuugauuuauuuuuuaauuucuaguuuggccuuucacaacugagagguucgaggacccaguggugacuuagagcacggcuuguaaugucccauguaguuggugucuauguugccucucccucucccuccaccuucuuuuuagauuugaucucuggaagcucaggcuugcuccugacuugggggaaggccuugaacuucuuaucgucuuguuucuuccuggagaguuuugggcuuacaggcuuguaccacccgcacccgcguccccaaacccauccuguuuggugcuggagauagaccccagagcuuugugugugcugggcaaguacauccacugccuucagaaauacuaccuauaauacuguauuacuucuaugguuuuauaaggguuuuuguuuucauuuugucuuuuuuguuuuaucuuuuugccuuaccuaaaaaaaauuuuuuaacacaguaccaguaguuugaauauauucuuuuuaaaaccuuugaagauuuuuuuuguuuguuuguuuguuuguuuuuuucuuuuuuuuuuggugguggggguugacgcuucaagcagucuaggcuggucuugaacugucugcugaggggaaaaccuugaauuccagauucucucgacuccgccuucacuuauuaggauuauaaaaaaacaggagcuaccacaucuagcucauguuauaaaaaugauuucaaugauuaaaucuaauuaauuuuauuuuuuuucugcugagauacaccauaauugaauaucugaaggggcuacaagugcauuucaagucuauccauccguaucccuagcaccuuuguacuuugcugauuugggcagagugagcguaauguuacagccagagucaaagggcuuacggaugagcucugcugugcaguguagcuggaggcuggacucagagggagcuccugugaccucugaguugcugaggccucuuuguucucucgccccagugagugccugggugggacugggggaggcagacauuuaaaagaaggggugaguguugacuaagaaaucaggcuucgccucccagaacacccacugugacucugugcaauguuugacucucagcaaaaauaccacuuguauucugaggccuuuuguuucaacgacauaacucaacaaccaaaacagcaaguuuccuacaauugaaaagaacagaggccacguagaggccaaguuuugccuucuaaggcuaaaugcacuugguuuuaaucucuucuuccucaagagaagagccaggagacuggcccucugguauuucuaggcacggcuucaguaauaugguuucuuucuaaguaaggacuuuugaauccuccuuguuuuauuacuucuauugcuccacuauggaagaagggcaggcugggacaguuuacuauccgucagugucccguaucccgcuuccaggagcccucuuucucuucugaggcugcucauguugucugugggaagcuggaucauauuugucgauaaacccugcgcauaucacuuguauagcccacugcaaugugaaugcuaugcaaauauuuguuuagggaggaaggacaagaaagagugcuuguacauauucagucagacacaagauuuucugaccacuuuggacaugcagcugguugauucugaagauguggaagucucagauugggaggacugacugugucuuccacucgugauggaagcugaggaccuggacugagguguaugcugcaccucuugucagcugcaccucuugauuguuguaaggaguaaaagaagacaaucuaaaugaaaagacauuguguagaaaaacaaacacuugcacauuacaucugauuaaagucuagaaugcaauauauaaagauuuauuggacagccacaggcacaacgcaagcaaacacaacuguggagugggcaaaggaauagcugucucucuaaggaagauacacagauggccaguuggcccaggaaaaggugaucaguagcauuauggacaucgaaauucaaaccacagggauuccacuuuguacauacuagggugggugugauugaaaaacaaacaaacaaccccuaaacguggcagagaacaggacuugaaaaggcugagaaguguuaggcuuacccugcugguggaaaugcacuaugcucuuggaguuuucugucagcuccuaagagaguuaguuaggugucaaguuaccacauaacagcaauuucuguaugaguuaugcauuuaaaggagaagaaacccuaaggccaccucgaaaauaauacacagaugccugaaacagcuacccaucauaaguaguaguaguaguaguaguaguaguaguaguaguaguaguaguaguaguagaaacuacuaaaauuggccuggcagcugaugaacugccaauaaaucaauauaaucaauaaaagauggcacagaguuugcucacaaggagacaugagguccuggcgagggccaugcuaugcaugguuguugaaagaauacugcuagguggaagaagccugcagaagcagccacacaucaucacacucuaugggaugacgucucucuacugggcaagugcacagggauagaaaggagauuaguguugauguucucaggggacagguagggcagggaauccagggaugacagcucaugaguauggaggcggggggugggauggguggggggagguucuuuuaggaauaaugaaauaacaugucugacacgagugguaauuauggcacaacuuuguugaauguacagaaacacuagcacguuaacgccucuguguguguguguguguauguuuaaagaauuaucuacuuaacguauauaaauauacuguugcugucuucagacacaccagaagagggcauuggaucgcauuacagaugguugugagccaccaugugguugcugggaauugaacucaggaccucagaaagagcagugagugcucuuaaccacugagccaucucuccagcugccuguguguguguuuuuaaaagucugcauuuaugagcgaguccugagaugaugagaugagaugagaugagaugagaugagacgagaugagaugagaugagaugcugcugaauuauuguuggcuaauguguuuuucccaucuguacauucugcaacuucuuacuauuuaaguaagauaaaggacuucuuugcaggucauauuccauguagagaucuuuuucuuuuuugcucucuuugguuugauuuauuagauggggcaguucaaaaaguugggauagucccguggaauucaucugacgucauagaacuuaugcaugcuucccuuugggagagggguuguggugugagacuugcgggagugagguacacugauaaccacaccuggggucucuuaccagguacauaacaugcauuucagacagacaucaguucuuggugauguagaucagugguuguacccucugcaaaaaguguugauguaucuugaagcccugugcuccugucugaaccauucacagaugagacuugggggcauuucauaauuuucagguuuaagaaguguuugugcucauguaaaguguaguguuaauaaauauuguugguaaauaauauuagacuauuuacuuauggaguacgcuaugaaucugaaauuaaucugguucauaacuucccccuuuguaaguuggcuuugaaggauauucuaacuucaucauuagcaguaccaagauuaugucacagucuccuaguagcuagacaucauggugacccucugagaucuuuguuuggcuaugcaaccugguuagauuugucuuugauuucugugugucuauacacucugugguuuuuuugcuggccucugacucuucuuauuucccuuugaccuucaguagaacuguggcucugacucuguaugccccaguaggcgaucaaccuggcuggugugugacuugcuauggggggagggguggcacacaguguguuucacucacauagagggaagcaagguggcauguuuccuccacucuuccucugugucugguggcugcccgggacaccucucuucuggucagggcacagaauaauuucugaaagucaccaccuuuggccugauagcuugaggucaugcuuucuuucuccagguaagguggccacgcuuugagggauuuacuguagguuuaauggggagauuaguauucaaauuguguuuacuuauacgagacuuacaaaugguuguugcuuugcucucuggucucauucugcuuugaauuuuuugagacaggugauuguguucagaauauagcauuuuuuuuuuuuaaauuguaguguucagaauaagucauuucagcaaacacugggaauucagcuguuagagagcuuuguauacaacuguaguugccuugguucaacucuuugauuaagauuccacuuuaaaaaaaaaaaagauuuccacuuuuagcugugucugguaccacaguggagugauaacaggacugaaguggugaaggcaaugggguggaucaggaguucaaggucacccucagcugcauaugagccaccccgggcucugggauacccugucuccaaaccccaaauaauaaauaaauaaauaaauaaauaaauuuauuuuucugaagaauuuaccaaaguaaaagcagucaaagcagucuagccuucuaauuuuauaacuuggcuuguaaacauaaguuguuguuguuguuguuguuguuguuuuuucccccuuaaauaucuuuuuaagcugaaagagguuugugcaacacucuuggauuuuggugucuguagugugggaaguuggagguaagggugguuucuguguuuuuuucaucacaggagguauggacgguuucuguucugggugguuguauuggucugguaauuguggggcuucugccuguguguggccccauagcccacagcaucuacucccuggagccacacaucucugguuacagcaagcauagcuguuccuggaagcuggagaggcagggcaccaccauccagugcuguuuuggcuugcccuuauuaguaguaguucuugguucucccacuaacuggccucugauuucuucaucacagaauacucuucgcaugaaucaggauccucccugcauuuauaaccacugggcuuuggaaugggagccgaugagucaugcgaucucugagcaacggaaugagauguuccuacuuagaucaaucagggucgauguccuccucuaaugggcuuugagcugcuuuucucgcuugccuucagggacuauuuuuauaccugauuuccuugcuuggaauguugcuagaagucagauuuuuaucuuagucaauaaugagaaaggaucuucaaacacgugaauggaugggauggcaaagagagucagcaggucaucuugauguuugugacucgaauuauuugcacaaguaugaagacguaauguguauaacugguucaugcucuuuuuuuuuuccuuugaaguguacauauuaacaguugauaugaaauuuugguaaauguaguucauugagacuuacagaacacacuaaauaagcccauucaguaauuuucgauuggcaaucuguaucaggaacuacaacuuuuauguugaccagauuacauauuucuugaccuccugaacucaccucaauguuaucaacauaaguaagcauugguguauaagagggaagaaaacggggugcuuuaagugcuugggaggggggaggggggagucuagaaucugcuuugaggaaagguauaaaauggcaccuaaaaccuuuuuucguucauucauuaauuuauuuuacaucuccaucacagucccccuauucuccaggucccccucucucacagccccucccuccauucccccuagagaagaagggguuccaacccacccuggcacaugccuguggcauguagaauguccagagagggugagaauggugugaagacucgagggaaggagaacagcacaugcguagauaucuggggcaggaagggcugggucuuuacagguggcacaaaggccggcgcuuagagcacccugagaagauggggcaggguggucaauugguuuguagccuuguaaauguguuaauuugguuuuuagaaauuuuacuguucagccagcugcucuuuagagagccagucugagaggagaaagaauagaauuuaggaaauagugagagaugguguuggcuauagguuggaggaaagaaacgacaauaucuuaggaugauggauguauaaguuuuaucuccuguugcugugauaaaaugugcccccccaccgccaccccaugaaagccagaacagggaggauggaauuuaagcaugcauaauuaugcucaguucauuuugugugcuuuuacacaguucaugguccuagacuagggaauaguaaugcccacauugggugggucuucugacaucaauuaauauaaucaagauaauuccuugauuaguccucaggccaaccuaagcuaggcaaucucgcauugacacugccuuuucaggugauuauagauugugucaaguugacaauuaaaacuaaucaucccaggagguuacaguggaggugugcauugauagacugugcugaggagaaggaagccacuguuacagauacugacagguccaggcaggaauaauugaaugagugaagguggaccaguggauuugagagaacaucagucuucauucaauguguuaaugcugauacaagucuaugcuguauuucuguggcagugucaggaagaugcuugguccauauaugaacccuuccauacucuaaagacucuaugaguuguacaaaauagagccauagcagacagguuaacaggagaacacaugcauaaauguauuauguacacaugcacaugacagcaacacaaacuauaagaugggaaaaaugccugagguuuucacuugcacaggaccugugugugaauucccagggcuccguugucuccugccuguaauuucagaacuaagggaugaacgcccaugagacugaggccauucugaacuacacagugaguuccaaucuaaacugggcuaaaaacaaaacauacucucucucuuucucucucucucucuacacacacacacacacacacacacacacacacacacacacauguaugugcacauacgagaaauagcuagguagggcaagugauaaauacauuaauuuccaggcuacaaaauaugaauagugcuuaaaaaugcuaucauuaaagaauacaucuaaaauaauaaauuuauucauaauauauuuuaaauaaagguuauauuugcuaucugucuucauuuuuugugaaaaacaaaacaaaacaaaacaaaacaaaacaaaacaaaaaccaagugggcaagaaugucuagaaagcuguguaaauaugucaauauuucacuuccuccuucaggggagagaaaguaguuuacauuuucauuuuguuuggguaaaucuucauaaauaugguuaguuguacaguauagguaauuuugcaaaucaaaaaugaaaugauaauacuaaucuuuaaaauuugguggaggaaguuauacaguauaagacuuggcucucgacuuuggagccaccaagccagcugauacacuagcaacauugugccauaggaaagcugcucucugaugccucugaauagcuuacuuaacugcacccagucugagaaggagugacauccacugucccccaagcaguuucagcagggaguggcuuaggaagacaaguacgcuaaucauuugggguaacaguguggcagcuuggugcauucacaaagaccugauuugcacaugucuacuugacugggcuccaccuaacucaggccugaggguuaaggaaucugcauuuuaagaaaauucuucaugccgggugguggugcacaccuuuaauucuagcacuugggcggcagaggcaggcggauuucugaguucgaggccagccuggacuacagaguguacagagugaguuccaggacagccagggcuacacagagaaacccugucuggaaacuccgccccccccccccccaaagaagauucuucaucuaauacagguguucaaagagcgugggaaucugcaguacauuguccuuuaucagaugaugacagauuuuauuuauaauuaacccuugugugcauguagaugcagauuauaguagcauuuacucuuguagccauuuacuggccuuuuucuuucccuucuuuacagcaggaauaucaaagcagguaguuuaaagcaugcagguuuguccaccuuuugguauugugauacauuguagccuacaaaguucaugcuggagaaauauacaguccuuaucaaaaagaagaaggaggaggaggagagggaggaggaagaaaaaaggaagaaaggaaggaaggcaaaaggaaagaaagaaauagaagagcaaagagucucgcuauauuuuaagugaguuuaccauuuuggguuuggccccaauuuuacaugcauccaagacuaucaaaacacaguuccuggggcuggagaaauggcucagcucuugcaggauucaguucucagcacccaugugguagcugacaaucaucuauaacuccaguucccugggaucggaugcccucuucugaccuccuugggcuccaugcaugcgcauugugcacauacauacauacauacauacauacauacauacaggcaaaacauucauacacauaaaauaaacuuaaucuaaaauaauuaaacaaagaaauaaauacacagucccugaaccuggcaggauggcucagucauuaagaacauuugcuuugaaguuaugagggauggaaguucagauuauaacuccaagguaacucuccuggcuuccaugcacacauaagugcauauacucacacagaaacaaacaagcacacaagcacacccacaaauauuuagauaaaaauaagcccuuaaaaacccaauucuuaaaguaggaauauggguucuuuguuaagggcuauugaagguaagguggggauggguuugaagugaacacaccagaaucuggcaaguaaacuguuaguaaauguuaguuuuaguaugagaacacacgauuuguggcucgagcccaugacuuccuaaucaauuaauucaucucauuauuucaguuuccagucuuuucgguauuucuucaaucaaugucacauggccuguuacauuucguucuuauuaaugucaauuuuagagagggagaguguucucauuucaucuuguacuccaggaguauuccugaaauucuucccuuagauugaccucaguggcauuauaacugaauuuaauggggaguaggaaaguuucucuggguuuugugaagaggaauuuuuuuucucaagucaacuuuauagauagaaaagucagggcuggugacuugcuuggggaccugacuaagggggaagggcaaccaacagcaaggaggucacugucacucucggcaaggaaauaguagcuuucauggauuguccacucagugugcucagugccuggccagaaaugcuguguagccaucccuguuuguaagagcaggugggugucuuagccauucaccuuacuggagggacaaaaccccagaauuaucuuguaaauaagaagguggaaaggugccuuuaaucccaguacuugggaggcagaggcagguggauuucagaguuugaggccagccuggucuacaaaagugaguuccaagacagccaggaacagagaaagccugucuggaaaaaaaaaaagguggaaagguuuuguguguguguauguugguaaccagccccauucacuacagugaccuugaacagauauguuccucuuucacaguaaagccaauucugauucuaaaauuuagguuacccggugcuaauauuccuaaggaacauauuaaaccuuggcuguuguugagcacagguugaggaagaaggaucauaaguucaaggauagccugggcuauaggguaagacccugucucaaagugaaacaagagauagguugaaaguuugguuggaaacaaaaagacucucuuuauuguuuuuuuuuuuuuuuuuuuuuaauuuauuuauuuauuauauguaaguacacuguagcugucuucagacacuccagaagagggagucagaucuuguuacggaugguuguuagccaccaugugguugcugggauuugaacucuggaccuucggaagagcagucgggugcucuaacccacugagccaucucaccagcccaucucuuuacuguuauguggaggaaugguugcacuagagcacccugcagucuccuauaaaauuacacuucgguggccagagagauggcuucacaguuaagagcauguauugcucuugcacagggccugaguucaguucuuaguaccaacaucuacuugcuugcaacuuccuguaacucccaguucugggggaucugacaccucugguccccugcacucacguacauuaccccugccacaaauaccuauauuauucaaucaaugaacagagaucacacugagcggugucucacaucuauaaugcaauuacucagggggcugugcuaggggcauuauggggcuacauaauggguucuagauuagcuugaacugcugaguaagauucugucuaaggaaccagaaacaaaaggcaaauuaagacuaaucacacugacauggcaaugaaaauugcuugugcuuuucaccauuauauaaaauuuugguagcauguauauaauauucacaguuuuaacuguauauucauauugcaaugugcaacaauuacaaucaucuuucccaaacuuuuuuaauguuacaaagcuuaaacucuguaucauugaacaauuaauuucucucucaccucuccccucagccccuggaagcuacaguaucgauuuuuaucucuaugugugugacugcuuugaucguggauuuacagaacagcugugcucaugugacaggaacaugaaacucguuacaaugacccaagcguucauccauguguaacauaucucauaggauauuguuuguaaggacucuguaauaguucaugucuugcuaauuaauucuauugaagaacuuuuguguugguuugauccauuugcucucaugaauaguaaguaccuuuugugagcaugaggguauaaaguccaagagucuguuucagauccuguguuuuauuucuuacacuguuuugaguuugcuggugccguuguuguuugagcuuuagcgacuggguuguauuauguaacccagucugcugggcagccccuuguccaagcccuagagucauggugguugguucacugucauccagcagaaacugcuaaaucucgauugaaugauuaaacauccagaucuuauuguuaagggucacucauucaaacaaggaaaaaaucuuucauuaugaauuauaguugacacaaucugugagauggaggaaggaaggaagagauuauaguguucccagaaugcacuggcuguugcauagcuuuggagcagaaggacacacguccuuggcagcucaucaggaaggaagugaagaaggaaacuggacauuuccacucuuugaaaagccacauugcuaugagccuggaugacugacugagguccugcucucgugccuaaaugauuuaacagugagaguguucugaaggaaaccccagcccuagagagaauacauuuguugucuccuaagagcgauccaacgauaaggcuucuccagucuaagaagguggaaguggaaauuugauaggguuacuggcuauaaggucacauaguucagaaaggcaacuguacuggcuaguuuucugucaacuugacacagcuggaguuagcacagagaaaggagcuucaguugaggaaaggccuccaugagacccaacuguaaggcauuuccucaauuagugaucaagggggaaaggccccuuguggguggugccaucucuggacugguagucuuggguucuauaaaagagcaggcugagcaagccaggggaagcaagccaguaaagaacaucccuccauggccucugcaucagcuccugcuuccugaccugcuugaguuccaguccugacuuccuuggugaugaacagcaguauggaaguguaagcugaauaaauccuuuccuccccaacuugcuucuuggucaugauguuugugcaggaauagagacccugacuaagacagcaaccaugaaaagaagguccuucuuguaggcuuagauuuuuaaaaaccuacuuuaauaaggguucuuaacuggcucaaccucccuuguagcccaccacucacuagaguugguggggaaagaaagguuaauaggaaauggggucuguggaccaauuuagaaauaguucuuuggggcucuuucagucuugguugucagcuauuaguugagcaccacucuagggucagcaacagcaguucaauccugaagaaaccucagagcuccaccaauuggcaggaguccgaggaagcugcaagaagccacuagaguaucuugaaguucuuuggagaguuccuucguaugaagccaugacaaucaaagauuagcaacucaagaggcuccucccauugucugcggucauauuuauauccuuuguaaacaucacaaauccucucacauguccguuucaggaaaacaucucucaccugagucugcuucagcaaaauaucccuucaccugucugacccagcaaagcaucauaugacauagcggaguuucagaagcaaccagaaauuuccaccuuacuuuuuaaucuucagcugugaaacagagcugaacuuuuuuuuuuuuuagauaggguuucucuuuauagcccuggcuguccuggaacucacauuguagaccaggcuggccucgaacucagaaaucugccugccucugccucccgagugcugggguuaaaguuaugcggcaccaccgcuggcuacagcugaacuuuuugaugccuucaagaggcauguguugggaagaaaaagaaagagcuaguucaugcagaagccaguaaauaaaauugccauucucugugaugguguauacaauuuucuuccaugugcaccaguguugugccuccuugugugucuguguaccaugugaaugccuagugccuuuggagaccagaagagggcacuggauccacuagagguggaauuauagauagcugugaacugccuugugggugcugggaauaaaacccaugucuucuggaagagcagccacugcucuuaacaacugagccacaucuccagccucuauaauuuuuuuuuuaauuuauuuguuuaguuuuuugagacagggucuuauaauguagcacaggcuagucucuuuacuugcaacaauccuccugucuuaucuucugugugcugggauuagagacuuaccacauuuaugggguguuggggauugaacccagggcuucguacaugguagguaggcacuauaucggcugagguagaucccugagaacuauaauuuuugauagugaugucaaggauaauauauuaauaucagcacucuagcggaaagauuugaguuugaagugggaucagaguuugccugcacuaugggugucaucuuguccuugccccgaccuaucaggcauuuccagaaauaaaaaaagguuuuauuagcucaugggaauacuuuacauaucauuuugugccaccucaaagugcagaggucugugcucccugggcuaauuucucaagaagguucauugaaagaaaucuuuucucuugacuucuggaagggcacacagcguccuuccugacacuuucccagcuucuuagaaauauuuaucuuggacagaagauugcacuuuaguggacuugcugcuuugaaauuuuaauuauuuuaaauuacuugaaaauaaucauuuuuagugauucuucuccucacguggugaaccuguggaggccugaggagucugucuuuccaccucuguaagguuccagggaugaaacucaggucaucagacuggcaaacaaagugacuuuacccuccaagccaucuuaccaaccccucuucauuugguuuuaauuuaaggcucaauauaaaaaccuucaccuagagaaaagaaaaaaaauucugaauaccauuuaaaaauuugaacgcauuugcagcaggugacaugccauuaaauaaagcacaggaacaaauggcaaaugugucuugcuuucccucagguuugucuugcuuuucugaaagugcuuaaagucuugguccaugacuuguucgugauuucucuuguauauuauuauuauuauuauuauuauuauuauuaucauuauuauuuauaguuucuaucuuuauaauugucauuuugucuguugguacuugaggguuuuuuucccccugaaaguuguaagcuguguaguuuugucccccucuugcucaguguuucucuacugagucaacuuggagauguaugguuuccauagcugcaguuguuuuauaccuaguuacaucaacagacuggaaaguaaugcccacuggaaaaucagauagaaauauaagcaguuuaaucuggugaguuucuguuuaacaaauauaugagcuucacuguaaaacagagucagguucauuugcuucuaacucuccuuuugaccucugcaggggacccuucuucuuagcuacugacaccuaagcaucucccuccagucuugauccugccuaccugucuguaauuacagauacagauggggcgccuuauucuuagaauuccuaucagcauagacagucagaccugccaggcaaguugugucuuggucaccaaucuuucugcuuccuuacaugucaaaugggagguagaagaaaaugcacuuuuuuauaggacagacaacuugagaugcuguaguaugauuucuuauaacacugaaaaaauauagaaauuaacacaaaugaguauaagaauuucuuagaaucucuuuagaaauacagugguauuuuauuucuugguuuugcagucaugcaucguauagucauacguacauauaauguuuaagggaaaagcuauucuucaaggguuuggucucuauugcuuccauaucccccuuucuuauuccuuuucuccucagcccugcagccuuucagagguuuaucauggauggcucugaauccaucuauaccuauaccuauaccuauaccuauaccuauaccuauaccuauaccuauaccuauaccuauaccuauaccuauaccuauaccuauaccuauaccuauaccuauaccgcccccgcccccauuucacuaaagucaccuucaaucaugucacaugcuugcacagugaaagcacaugccuuauaccacucucauuucaucuguuugcauucauuaggacuugccugcggcucuucaccuuuuuauaaaugcucuuucuggccauuuacaugccucaaacaacaaugacgaaauaucuuuccuauauaauucugaauauauaucuaccuaacauaguaguuacaauugccuauuguuuucaauuccugucuuauccuuccuugucaacaauaaucaugcuuucuuuuugugcguguguguuugugugugcacagucuaccaaagcacaugcauagagaagccauaggauggccugggugccauuacuuaggagcugagaccuugagcuuuccagucaaucuggccaaucagccccaaguuccaaccugccucugucucucucaugcugggaucccaagccuguaucaccaugcuuggauucuuuuuaauguggguuuugggaguugaacucaguuccucauccuuucugcacauguacguuacuugagcuaucugucaaguccaaaaccacugccuucuugaaaaugcuaaugaugcuugauuuuggaaucaugcauaguagacacucgguauagugguuugaauggaaauacuccccauagccucaaaugcuugagugauugauugccaguuaguggaaccuuuugggaaggaugaggggguguggcuuuguuagaguagguugagcuuugagguuucuaaagcccaagucaggccuagugucuuucucucugccugcugaucaguaaaugucauuauuuggucuuuuguauaguguuuucuauaaauuagguaugaaacuaacugccauuuacuguuacuagccauugcaaaguuucuuuuguuuaaucauuuacuggggcagaaguucuauaaaaggaccuaggcuaaaguaaucauuuacacuguaaaauuuucuguuucuuuugguugacaauauuagcuccaagugccugacaaggagguguaugaguauccauccaucuucuagggauugaauggaggaaaguuuuagauaaaauguugccaccaucauuggcauucacaagacagucaauauccgcacugggcuccuuagcugucaggccgccaguuagcaggagcgauaagccauuucucucuguccuucugaagggcaccaaggcuuuaguuacagugaauacaaagauauucuagagcugagcugaccuucuucauuguugggugcagggcaccugcaguguggcugauccagauucagauggugcuggaaaugaaauacacauuggaucacaaagucuuaguaugaugaaugguguuagauggcagugcacaguaaagcauugaguaugugcugaaauagcauuuuagauguagugggcuaaauaacaacugaaccuggaaacagcacguauacuaaaaugagcuuuacuuuuuuuuuuuuuuuucuuuuuaaguguggcuaguagagauuuuaaaaguuuauaugucaggguaggucuaaggugcaggguuaucguuccugcuacuucuucagcugaggcuggagaaucguagccuaugguagacuguaaauccaagaccagucugcacaacuagugagacacuaucucaaaacaaaaaacaaaacaaaaacaaacaaacaaacaaacaaaaaacaguauaaaaggggcuggagagaugacucagcgguuaagagcacugacugcucuucugaagguccugaguucaaaucccagcaaccacaugguggcucacaaccauccgaaaugagaucugaugcuucuuuuguggugucugaagucagcuacaguguauuuacauauauauaaaauaaauaaauaaaucuuuuuaaaaaaaguauaaaaacugggcugguguggguggauggagagaaggcugagugguugagaacacugaccacacuggccacuuuugcaaaggacccagguacaguuccuagcacccacaugucagcucacagcuggcuauaacuucaauucuaggggucugacacccucacacagaaauacaagcauucauaauaccaaugcacuaaaaaccaauuuaauaaacaaaaccaaacccaaucagggcuggggauucagcuucuugauauguguccuggucuugacuaucugaugagguuucauguuaaaucucuaacaucuucaaaaaaaaaaaaaaaaagaaagaaaaccaaaacaaagccauaaauucuauaauguuacuaauaugacauuucucuagacagcacaauuuuugcaauaggauuuggggucauguuguaauuggcaucagauggcuagaaccuaucuagcuaauggcugacaggacccucauggauuuagcaucuagacugaaggaauuguuuucuguuuaacugauaauaugggaugucuagggaauauauucaucauucaucaguuuauucuagaugggaacaacggagacacccugaagucuuucaggcuucuguggccaugaacccucuccugguuaagcccaaggcugcaucuuaggugcuuuccuuuuguuuauccaccuuucauugucaccuuuccuguugcugaaagaagagcguaccuuccagcauuccuaacucauguagugguucacuucucccaggcacuuaguauaagcagaauucaguuacacccuggauaaggcuuuguacccagucaccauuccauccacauuuugaucuguccauccaccuaucuacccaaccauccaccuacucauccauccguccguccguccguccguccguccauccauccauccauccacccacccacccauuuucccacauguccacucauucaugcacugagucacccacccauccaccuauccauccauccaccuauccauucauccgucuauccuuccauccaccuacccaccuauuuaucccggauagaggauucugaagugagauauuccucugaagauauauaucagugugauuuuuuuuuuuuaaagauuuauuuauugauuauaugcaaguacacuguagcuguccucagacacuccagaagagagaucuuguuacggaugguugugagccaccaugugguugcugggauuugaacuccugaccuucggaagagcaguugggugcucuuacccacugagccaucucaccagcccucagugugauuuuuaaauagaaaacucaagucugccuucucuugccagagauuuaaaugugaugugccugguuggucugacagggaggagaagucucagcaguuagggaacagagaagucauccucuuauuauuuaaggagaaaaaaccuugcagcuagaaauuacauauuuuugccuauuuaaauucaugauaaauauuagcugucaacuuaaacauuugagaauuccuugggcuucuugaagaugaaccuuugacuuaaaguaauagacgugauguugugaguuucguggcugagaucuccuaauuauaugguaggcauuauauagggauguuaagauaaaagaugugaaauguacacauauacacacacacucacacacacacacacacacacacacacacuagauaaauguaaaacaaagaugaaaaauguuuuauauaucagcuauauagaaaaauaauauugcuauuuacaaauggaacaagauguuuguuacuggcaguauuguucccuauuuuauuuuauuuauuuauuucuuuuuggucgaacacacuuuuaaucccagcacuuggagguagaggcacguggaucuuugugaguucaagaccagccuggucuacagagugaguucuagccaggguguuaccaagagaaacccuaacucaggcagaaaauauuuuauuaagauuuuucaagacagggaaaauauuuguauauuuuuagacagagccucuuuaggugguccagucuggccuuaagcuuacccucaucugcauauuccuuccuagugauggaauuaccggcuuggauggccaagacggagccuccaagcuuuugugaguauugcaaaauuuucgaaaaaaaauguauugugauuuuuuuaaauuuaugagggauuuaaagaaucccuuacaauauggggaaacuaauagaauaaaugaauuggaaugagacugaucuaugaugacugagucuuguaaggauauauuucuguuguugacaagcagaacucaugccaaggcugacagaucacugcaguguuguccagguuuaguuuuuuaaaacaguuuccauacaucucaaauuauuuguagaugaaaacagauacucugccuugagauuuccuaguuaguaagagcaacaguaacaggagggauccaauuguauaggaauuuuucuucaugagucaauuuaaucucuugauagucauuuuaaaaagucagugaccccacugcucucuuccugaguaaccuccuucuauuccgugcuaucacaauugauuaaaacaaggcucauaacaaucuggagggaagcauuuguaagcgugguggagcugccccucccaccagagucuuuguucugguauguuugcaacacguguacugugcuugauauuucccacguggcaaacuuucuccuucagcaucagaggcuguuccuagguuccuggggccacgcgaauucuaggugagcccucuaccugugaguaagcugaaucuccacccccaaggcuuaaggcuuuaagaauugauuucuuuccaaaaacacaccucuagagagaggguuuaaggcagugucaggccccucuaaaucucacacagucuuucaagauaagcuuagggaguuccaggaaguaaaacaggaaagggacaguuuuguguuucucauugcccugacacccaacaaacucagcauuucagcagucaguuuggaucauucucaaggcuacccuuuccauaucaagguguuuuccuuuuuuuuuuuuucuucuuuuuguucuuugaaaguaugcucaguauuaaaggacucugcuugggggaguuccuugucuaggaaaagauugcauguuacagauuauuagaugauaccuacuauuucuguaugauauuuuaaaugcauagucugugaaugaaugacuugauuucauuuagacagcacagaagacaucagaguagaaggcgcguccgugucucaucaugguguguuaagggucacucaugggaagagcccagagaaugagggaaugggcuguaggcugagcauucuuguugcuucuguaauuacugucauguucuaggauguguuaaaucugugaaugaggcuuuaauuuauaaagcagauccgaggucuaaagccuccagccacacauuccuuauaguccacauuucuuuucugaauucucaaauuuuguggaguucagguuagggugagcugguugaccacuauuaaauugcuucaaaauauguuaggaggaugcugcuuuccuuuuaagcccuuuuaucagggcuugucugucuguaauagauacagagguguauguauguuauauauuuuugugugugcacauauuugugaugcagaguuaauguucagugucuucuucaaccacuaucuauuuuuucggagcuggggucuuuuacuggauccagaauuuaccuaauucaccuagaucaggguucucaaccucacguuguggugacccaccaaccauaaaaucauuuuuauugcuacuucauguaauuuugcuacuguuaugaaucauaauguaaaugucugcuaugcacuauggucuuaggucaccucugugaaagucguuugacccacagagggaucacaaccuguugagaaccacuaaguuagacugucuggcugcaaggcgcugggacccaucccaccucugcuuccccaggacagggauuaccggcacguacuaccaugccuuauuuuucacacguguucugaggaucugaacuugggucuguauucuuuuuuggccagcacuggaccuacugaccaucucccuuuccccucauggcaaaggucuauuaaaagauauuuauuucauuauacauuuuagcgggcgaacugaagucauuuuaaaccccauagucucauugguguuuccuguuuuacagauuacagcaauaaaauucuaggccaggcagcaucgcuggcccuuggauuuguaugagcaugucaggaguauuuaagaagagcaaaauauuuagaagaauuuggaaaagcagccuuaagggguuuaacacauuuuucuucuccuaauucaaccccgugcuuuuuucccuaauggagagaggucauugaugaugagauuugcuaagacagcaaaggcucuuagaagggaauucuaaaauuccugucuaaugaauacauugcuuucaguuugggacccugaaagaauacacauugaggagguagaucagcugcaugcauuguucuuacuauuucagucuguaugugaucagcuuaauaagaugagggguuauauuguauguuucuaaauuuuuuuugggggggggucaggaauuaaaccaaucaauuggucuguuugaugagaauuguaauagaaacuguuugaaucuuuuucuaagcauuguuuuauuuuuuuuauuuuguguguguuuaugugugugugucugcauguguguguguguguguguguguguguguguguguauguguguguguauaugccaugugaaugcaggugccuaugaaggccagaagaggguguuggaugcuuugaagcuagaguuacagguggcuuugagcugcccaaugugggugcugggaacugaaccuagguguucuagaagaacagaaaguacucuuaauugcugagccaucucuccaguccccuauuuuuccuaauauuugcauuucuuuauuuugugaauaugugugugcgcacaugugccaugguguguauacagggauuuucagggcucuguuuucuccuuucaccauguaguaguuccaaggaaucagagcagacgaccaugcugggcagugagcaucuucaccuguugaggcaucuucccagacuuagccugagacuauugaaguucuuugaucuuuuucuguggaacuggaguugauccuggauccugaggcacgcuaggccaucacucuacugugggcuacaaccccagugaggcucuucaagcucugugucauuuuauaggaaguugaaggguaaaugauaacagcauggcagauuuucaguuguuucugaguuaccaaugaggacauggagagcaguuacucuacuaacaauggcuucucauucuuuuuuuuuuccuuagaaaguauuuuauuuuuaauugugugugugugcauguguguguacaggaauaaaaguguucaaggacccccaaagccccuggccccuugauuuggaggcaguuuugagcuguccagcccaggugcuaggagcacaucuuguguuccuugggagcucccuuccuggcuguucacauuuuuuauauuuuccaugacugaaaagccuuuccuuuacugaaaauuuguagaucaugggguuagagaggagaggaggggagaaugggcaaaggagugggcagucuauagauguguugaauacaaaucuuucaaguuguuuaggggaaauaaauacaaaagaguaucuguacauuuuggaauauuuuugaaugccuggauguuaucuuugauggccaaacacuccauuucauguugggcaccgagauauagauauguguugauuugacuaaaaaguucuaggcuauguuaggggaaacacugcuuuguucuuauaaacaucucuuuaugugggacuuuauuuucaaauuuuauguuauucuacaguagauggcauagaaagguaaauugguaguuacuccuuucuguggucaaccuacagagaaaacucuguacaucauuagauacuuuaauuacuccccagcaccucacccuucuggggauuggaggcagagcuuugggugugugcacauucacuacugcugggcuauaucaugagacuuaauaugaucaugaaaguugaaacuuuugaaauauguuuaaaaauaaaauauuguuauauuucugugaauauuuuccauuuuucuuaucuuuauuguaaaggauuuuguuuuguuuuguuuuguuuguuauuguuuuaaugagucaggauuugucuuggcuguccuggaauucuuucuguagaccaggggauaucauugacucagagauucaccugccuuugcuuccugagugcuaggauuaaggcugcaugccaccacugcuuagcguuaaagaacucuuaaauugucugaacauuaugaaaguaagagaauauuuauuugugaacuuucuauuucuucuucauaagauuaaaggaugguggguacaacacaauuuacaaaaguaaaccuccuuuagagucauggaacauauuauuauguuaaguguuucaaacacagauguuuaaaauuaaauucuuuucagccaagcugguauagugacuguuuauagguagauguaccuaguauagccuugcacgcuggcuguauugucagcucuguccuucugaaguuugaugguaaaggcugggacauucuguguauguaagcaagucuccuugauuaaugacuuuguagcaucgaucagauaauguauaaagcuggaauuggggcugaugacuuucuucccuguccuuucugagaugcaggucaccuuucagcaccauuaacaucaagaaucuucuuaguguccuucuauacuguccccuuugagccuuaggguugcucuccaauuuccuuuauggaucugcaaacucucuuucuagaacuguuauauuuaucacagggauggccuuucaguuacaaauuuuccuucugucuuaguuacuuuucuauuggcuguggcaaaacauugugaccaaagcaacuuauaaaagaagacauuaauuuggaacuuaguucuagaugguuagaauccaugaccaucauggcugguaccaugguggcaaauaggcaggcauggugcuggaauaccuuacauucccaucuacugacuggaagcagagagagcuaccugaguguugcaggauuuucccuguccaauuacauuaggguaacaggaggccugugauuggacagagaaaagggaggcagagcuaagaguugcagggacagagaguguagagagugagaaggagaaagaaaaauggaggcagacaugaaccaguguaccuuuaaccaaccacaaauaguuaugauaucagaaaguuagaacaauuggaauaaagcuuuuaucauuaucaauugguucugaaaugauuguauuagcaucuuguuaauugagaauuuauugaugcauaaaucugauugguuauuuauaagcuuuaagaguuucuauucuaccagguaaauggguuuuguauuagcugacuguggggugggugguuguugcaugccaaugagaggaacuugggaacuccagccccaccagaaaauuggcagguagagacagagccagcagggccaagaguuaccagcacaugugcgggaacgugcugguaccuuuuuaaaauauuucuugcaacacuugagaauggcaugagcuuuugaaaccaaaagacugccccccccccuagugacauuccuccagcaaagcuaccccucugaguccuucucaaacaguuccacuaacuguagaccaaguauucaaacaugugacccuauggggaccauuuucauccaaaucugcacacuuuccauaagcuauuagaacacgaauuuaucacaaacuugauguuuuagccaaucaucuauaugaacaauggaguaaccaagauaaaguuaaagaacaaaaccaacuugagaggaaagauuuauuuggcuuacauauucugagucauagucuaguuaggaaagccaaggcaggaacucaagguaggaaccuaugcuacuuauuggcuuguucaguuugcuuucuuauauauuccauaacuaccucccuggugugguacuaucuacaaugggccaggccuucccacguugauuauuaagaaaauguccuauagacuugccuauagguuaaucugguggaggcauuuucucaauugagguuucucuucccagauaacuguagcuuguguccaauugacaaaaaagaucaaccaggacagauaguugacuuauagaagaaaaaguuuauguuggcuuauagaucugaagaucagaguugaugacugaauagaccuuuaguuucuguaccauguggcaauagccaggaauggguggcagagaaaauggguggagagccaagggaggacgaagagaaaguagggggaccucuuauccccuucauagacauucugccagugacuuaaguacuucaacaagguuccccuauugagguuuccaccuuucccagugcauccaaaggggacgaaagccuuuuaauacaugguccuuugaaggggaccuucuuuuuccaaacuauaauacuagauguagucagucuuauuuauuagugagauguuccucuuuaccaaauacaggcagucccuuuguggugugugcuuggcuggcagaacacacaggucucuuccugugaugauguugccuagaagugugcuguaguaggugaggcacuuagauggacccauggcuuuauggacuauucugaauauagacugcuuucagaacuacucacagguaguuaagauauuacuuuguagguguucaaccaacaaugacuucuguuaguuuuaauagaaaaguggagagugcuugaaucauauaaugggaaaugauaaaacuggacuguuguuuuccuguuuguucauaguuaugccaucauuuugacaaccaaaaacuaaaugccagguaccuuauuuacuuuucuacugcuuugacaaagcacugugacccaggcaaccuauaagaagaagcauuugauuugaggcucauaguauuagaggguuagaguccauggucaucaugauagggaacaugggucagacagcagguaugauugcuagaagaguagcugagagcuuauaucugacccacaagcucaaggcagagagaacgcuaacugggggugguauaggcuuugaaaccuuaaaucccacccccaguuacacaccucuucuaacaaggccacaccuccuaauccuucccaaacuguuccaccaauuagagaccaaguguucaaauauaugagccugugggagcuauucuuauucaaaccaccacaucaagucuuugcggaaaaguuucacuugucagcauaacaauauaucuuacaauauaguuaauauuuauuuccaucuugcagaugaggacuuuggggguggaugacucuucugguucuuaacucagaaucccaugagaaguggaucagaaugugaucuauuuggcccuaauacacauugcuuuugcuguuggugcuauuguaccauguagucuccuuacauacuucauuuacuuggcucauuuucaagcaauuugagguucuucagauguuuggugcuaguugugccuugcccaauggauuuguaauugagccagaguugauaauguuuuuaaauucuucugguuuauaugcucauuaaaauguuuguuuaagagggcuggaguggcuaagaccacauacuguucuugaagaauggcuggaguucaguuucuagcaccugcaugguggcuguaaccucuuguaacuucagcuucagaggauccgaugcccucuucuggacuccguggguguuugcacucgcaugcauauacccacacauagacacauauauacacaugauuaaacaugguaaauuaaauauuaaacuguacuuaaaguuuaaagccacugugacucuguugcuccccccauuuugucaagaaaauguguuggauaacugacuagaaaucuuauauucccccccuuuuuuuuucuagaagggguaggacuugugugaagaaggaguagcuauggagucuuaaguuucuguugaguaacuuuuuggugggauguguuggucuagcuucauuaccugaaaggaucuuuuugacccugaaaggguccauugucauggggauucaggcaggagccuuaagcacuugcacguguccacagucaagagcaaagggagaauucgugcacaaaucccuacuguucagcuugcugucuccaguuuccuauagucuaggauucuaagugggaugcugccauuccccugaggagcaggucuucccauaucaacuagcacaaucaagacaguucaucacacacauucccauaagccagcugguucuauagacucccugaugcagacauacuucccagaugauccuagauucugucacacugaaaauuaaaacuaucacacauauuuaucauguuugauaguauacuuaaaauguaauugaaaguguuacauguaagguaacaucuauaguguagcacacaaacguggauuucauaccaggacucuugggugagaugacugagucucacuuuacuguagaaguuggugguccccaucaguggguucauuaauagcuaugugucccuugccucgugcuguauacaugucaaucuuaagcugccaagggaggagaugguuguauuuauuacacucaccaucaguacaaacauucauccuguucuugucuuuucuuucucucccgcagaugaacacaaugauguacagaagaaaaccuuuaccaaauggauaaacgcucgauuuuccaagguauccaagaugcugguggauuuuacuguguggucagugccuccuucugacuuuagcauagcuaaaaaagaugaccaguuccuuuagcaugguuaaccaugaaaacucaggcauccuuucugcccugugcaacagugauaggcuuuuccuccugugaguauggcuaauagcauuauccauccucucucuccuuuacuugucugcucuuuaucagcaucugcaaccaguggaacauaaucauugcuaugcucagaauugggggagagggagggagagguguggaguaugguaaaaugagggguuucacauuggcuuuaaaugugaaauaguuauagaagguaggaaucccccacccccaccccuuccaagucuuauaugggaacagccuuuggguugauugacucuaagacaggaacuugaagaagaaagguuucuuugguuaucuuuaaacuagucuggaagaucccuuuaaagagauugguuuauuuuauuuuagauguauugccuacuuguauguaugugcacaguuuucaugaaggcaaccucagaggucagaggagggcaucggguccccuagaauuggaguuauagaugguugugagccauaaccugggugcuucaacugaacugggcccucugcuagagcagccagugcucuugugugggugguaaucuuuccagucucuuggaagcucuuuuagucgaaaguucuguguuuacaaguuguaaagucagggccaccgacacugguguuuccuggagggaaggagaggcugacuuacggugacuuuaaauagugacacauuucacaguugccccaugucucacaggucagguacaguggcacaugacacuugggaggcugcaucaggaggaucacuuggcccaggaguuugaggucagccugaacaguauaaggauaccccaucuccuaaacaaaaccaaagugccuaucuccagacucagagauauuaauuuauuuauuacuuuauuauuacucaauuuauuauuuauuuauuacucagagauauuaauuauuuauuacuugacugcaguguuucuuagguuuuacagcuuuuuguugaagguuguuuuaucuugcccuugagaguagaaggggugugaaaacggacagauagaguagugaggauugcaggauuuugggucagggagcugacuuagugugcaaagacaccuucugccaauccucacaucuugaguucaaucccugggacucacgcggucgagggagugaagcaaugucaccaaguucuccucugaccucuauaaauucauuucccucucuuccccuugcauauugcauacacacuuauacauacacaucugucaauaaauuaauaaguaaguaaaugcaauagaaugagucacuaagcgguauguguauaccucuguaugugaucguccgcaaaacugugcagaaucaugucauauuguuucauauguuauauauaaaaagaauucagagagugagccacuaugugguugcugggaauugaacucaggaccucuggaagagcagugagugcucuuaaccucugagccuucucuccagcccaagaauucagagagugacggaagaacacaagugcuucacgacugauggcuucaggugccugauugucuuacagcauugcuagguauguuugguaaauguuaaaugguuugauucuguaguggcaaggagcccauaacacggacuugacaguauucacaguucugucucugcauguguuacauucucagcaagguuuagugacagaguguggccagaguuguucccucccugcaaucuccugagagcucaugugggugggauuauccagccugguuauuacuggggucauggccauuuucuaugcuagaacuagugaagacgcaugguuuucagcaguuucacgcacuuauuagggaaaggagugcccuaguuuuaacauugaaaggccauuuucagagacuugggacaccuugaaugaggcaaccuuuaaaauugggugaauucuuuuugccuuacuauugagaauggugagcagaagauagaugaaugaaagaaggaagaggguauggaauaauagaaauagcugagaaagaauaaaggaagaaaaaucacuauggugauagucuuggcaguuucagggacccaaauaacacagauucuacuaggaccacccuugguuauuuaaugaagcugauauuuacauauguguauucauagaaaggugaaggggucucuuuaacucagaacuguguuguucuuuuguagcaucacaggggguuguaauuccauuucuuuguccuaggauguucagaguuccugcugggagagucaaaguuacuggacagagccuagugagcuggcuuuugggcucccgcagagacugugcggucuugauuuguuuagagaaaagaucaaaggagggauggccuugaaaacuuacuuugucagacuguuuccaacaggaagucauuuaucuaagauaugaugaggaugugacuggaaggaagggaauuccauccauguucaacagccuucauccacguucuguuuuccuuccuucugcugacuuuagucuacuaguggguaggagagggcacaguacauuugugggcuuggaauuccuaugcaguuuaauacucauugggauugaaaagcuugcauuuccauuuuuguguagccucauugagcaauccugaagcuagucugucugacuuuccauccauccauccauccauccauccauccauccauccauccaucauuuuaaucuaucauccaucauuuuaaucuaucauccaucauuuuaaucuaucugucuaucuaucuaucuaucuaucuaucuaucuaucuaucuaucuaucuaucuaccuaccuaccuaaucuauccaccuauauacaaccuaccugucuauaucuccucuauacacacagguuguuaaaagaaaauaaacuuauuauuuuucuuguuuaccuaggcccuuuugcauauauuuugaugaacucugaaacauauuuauuuugugugucuguuggcucucuucacuaugagaccuccacauagacaccaaugguaucuucugccuuuuaggaauuuguuuuaaaaccgauauauuguuugauauuucauuucaggcuaccccccuaucuagagugucuaugagacaccaucuuguuaauucuacacuugaucuuagccaaaaggcagagaagugaucaucuuguuaauucuaaugccugcaugcauccagaauucauuuacucauuguauucacugaucaauaucuuccguuucuaaguuacuauuacguauauuagaaaaacuuuuuaaaguucuaaaaaugggaaaaaauauuaguggauaccuuguuuggcucaguccucuggauuagcucuaccuuccauuacuuaguacuuuaauuucuucuucuucuucuucuucuucuucuucuucuucuucuucuucuucuucuucuucuccuucuccuucuccuucuccuucuccuucuccuucuccuucuccuucuccuucuccuucuccuucuccuucuccuucuccuucuccuucuccuucuccuucuccuucuccuccuccuccuccuccuccuccuccucuuuccuuccuuccuuccuuccuuccuuccuuccuuccuuccuuccuuccuuccuuccuuccuuccucuucuuccucuucuuccucuucuuccucuucuuucccuauuauuauuauuaucaucaucacuauaauuacuauuacuauuacuuauuauuuggggaugggcacuccuguaucucaggcuggccucaaacuugcuuuguagcuaaggauggccuugaacuucagcacauaugcaaucagaccucauuuuugagaugcugugguuuggauuggcccuaaaucuucaugcaugguaggcaagcacccugucaaccuagcuccauccucagcccuacauuuuguuauuugaaaguacauuacagcuugauacauuguagaaaguagaugaugaaaauuaucucauccauagauaaaucuguguuauuugggucucugaaacuuccaagacuaucaucauagagauuuuucuuccuuuauucuuucucagcuauuucuauuaccccauacccucuucucucuuucauucaucugucuucugcucuccauucucaacagugggggaaaaggaauucacccaguuuuuaaagguuagcugaaaaggaauucauuauugccauagagcaacuuaugcauuuucgcacuacauuugauucccuuuucugccuguagaugcguagcucuuugaauucuccuuugaagugauugugguacuguauguguucuuccagugaacaauguauuaguaaagacuucagaccaggcuagugcuacauuugccugggaguuaucaucccaucuuuuugggaccuugucuuugaacauguggagcacuaugaccagcuaugggcucuuuccccuuucuucuuuuccuuccaagcuuugaugaaguagcugguguggccucagaggccugguugccuccuuuucuuuuagaggaugcuuaauguucugcucauuguuaacuguauuucuuuugaaaauuagaauuguguguacuuaagauguauagugcgaguuugaucucuguugacuuucaggcccuuggccugauuugcucuuaauuucuuuguuucugcugccaccuucucaccauccuagauccacauugccuguguuuucaaccgggcagcuuucuuuucuuuuucuuuuucuuuuucuuuuucuuuuuuuuuuuuuuuuucuuuuuucuuuuuuuucgagacaggguuucucuguauaacccuggcuguccuggaacucacucuguagaccaggcuggccucgaacuuagaaaucugccugccucugccuccggaaugcugggauuaaaggcgagugccaccacacccggcaaccgggcagcuuucuacagccucugugcaugcuuuccuuuucagccccguucuagucugcucaugggccuccuccuugccugaguugaaaugccauuuaguaguggauaccuuuuuuuuuuuuuuuuuuuugagcuuaaagauaaggguagauauguuuuuguuuguuugcuuguuuuuuguuuuuucgagacaguguuucucuguguaguccuggcuguccuggaacucacucuguagaccaggcuggccucgaagauauguuuauauauuaaaagauuauaccuuuaaaguagcuauaauucaaaucacacuuccagaguguacuggcuggcuugguguguacaagcuggaguuaucauagagaaaggagccucccuugagaaauuaccuccaugagauccagcuguaaggcauuuucucaauuagugaucaaggggggagggcccagcccauuguggguggugccguccuugggcugguaguccuguguucuauaagaaagcaagcugagcaagccaggggaagcaagccaguaaggaacaucccuccaauggccucugcaucagcuccugccuccaaguuccucuccugugugaguuccaguccugacuuccuuuggugaugaacagcaguguggaaguguaaacugaauaaauccuuuccuuuccaacuugcuucuuggucaugauuuuugugcaggaauagaaacccugacuaagacaguuuacuaaagaaaugagugacaguaacacagacauuuuuuuaaauaugucuaaaacuauauguucagaaaacagcuagagacaguuuuauuggaaagagauauauaauaauauauuaauuuuauaauauauaaaauaauaaagauauauaaauaaaaauauaauaauguuuugaguacaaaauaccuaguguuauuucaugaaaauagauacaauagguugagauucuuacuguuuuuacuaaaaaugaaaagaguaggcuggagacaugacuuagcacuuaagagcccuugcugcucuuucaggggccuuaggcacaauguggguacugggaauugaacucaagaccucuggaagagcagccagugcuaagcuaucucuccaucuuucaguagaauucuucauccugacccucaacuacuuaauucacagggaaugaaaaaacuuaaacuugacuuaaagcuccaugauuuuuuaguugucuccuuaauuaaggaugaagggcuugaucauauugaaugauauggaucuaaaacuaucuuuuccuaggaaguauauguggcuauacagaagcuaaaaacaauucccucaccggaggacacuuacguguauguuucauguugguguaucuucccaagcagaugucugccuauuaucgauguauauagcuggaagugcuuguuaauuugcccgaguccacaaugcuucagagcccugggguccugaaaggcaguucacacugcagccagucauggucugauguuuuauagaggugaagagcaaaggagaaacuggcugcauaaaggguuaagaaacgcucgcuccugggugugcugcucauuuauuuacggccucaggcaaaccugggggcaguuuuaagaggaacuguguuuuauguuuuuauccauuaaacaccccuggucaucauugccuuguaguguccgggaguauagcugugcaggaauguuaacaaaaacccaugaggcaccacuaauuugugaauucccugcucucugcuacacauuuccaaauagaaauaagcccucuugagacuguugcaugguguguaaaaccaugcaacaaaguuuuggacuuucuaguuguuggagucugauuugcauguggcucucccaggggagacagggaagcuguugggcaauguguccugacuuggagccugcgcuuucuuuggcucacuuucagagcugcucaucuggcagagccgagagacuacaaauuacagaagcucuuucaucagugcaguuaggggaagaauaugcaaacuugaaaaugcagaaaaugcauguuucugcuuuccuccuuuugaaaagacaaauucccauggguaacaauugcagacucgaaaucuauauccacugaacaggaggcagggcugugaagcauggagccuggauucuggugugaguugcugcucacaugcaguugcccuuuaaacagucugggacacggaugugugugcucugcuguuuucugcuccuugaaucuugggaguuaauagucauaaaaaugggaucuggaaaagaagaugcuacagaauguguggucagagcagcugggagcaccaucccccuggagaugguucaucuccuugugaguacuaccagaggcacugcaggcuuccuugagcugaaccaugugcuacccauugguuuugauacucauuucaugucaacagagcuaauuauuuuaagagcuguauguacuuccuccuccuccuccuccuccuccaccaccuccuccuccuccuccuccuccauuuaugaguacacuguagcugucuucagaaacaccagaagaggucaucagaucccauuacagaugguugugagccaccaugugggugcugggaauugaacuugggaccuuuggaagugcaauagguguucuuaacugcugagccaucucuucagccucauauguccucuucuuaaaaagacauuucaauuuuuauuaauucccaaauaccaaugagaaaaaauaaacaauaaaauauucucuauauucuugaccaccaucuuuaggauacucuggugguacuuuuguaagcuagcuagcuuucuuucuugcuugccuccuuuugccuaaauucuaauugauuuauuuuuaauuaaaaaauuagguuuuguuuuauuucgugugugugugugugugugugcucacaugacauggagaucagaagacaauguguuguaucacuucuucccuuugaccauauggguccugaggacagaauucagguuuucagucuuggcugaacaugauuuuggauaaaagcauuugagcuauuagcugaccccaugugacauuuuuuaagaauuacauuuucauuuaaguguguguguaugugugugugugugugugcgugacagagcacacacauguugucaugaaggcguccauguguguguauacuuguguacuggucacagaguuuacaauuccuuaagagacucacuauugacuaacccuauauuuccuuuggauguggcccugcccuacuuggugauugccugucauucaucuuacgacucaguaugccuguagacaagacuuacuugccuggugugauggucuagaaaauuaccagugcugcacaggccaauucagauuuucaacuugucuuuuaaacaggaagcccugccaaacagcgagucuugauuucugcauggucaugcugugcuggcacagagcagggagcaccugcugacuguccaugugugacggaugcccaucagacaugcuucccuucaucaugucaucacaugugugaagccugcucccuacagcugccucuaccucuccuuuugcuuagcaaugauugguagcaucuuugcccagaugcuuuuaaaugcagucgcacucauguuccaggaaauaguacugauguugcaguucucuugucaaaauggugggcccagggcugguacugagauuguccaaagauggacuaguagaaaaggaugagagugggggccaguccuaauuaggcagucuaggacuacagccaucaugcuucuguuuauuaggcuuugaaagaaaaaggagauucuuagagugauggcuuggugguuaagaacacuggcuccuccuacaaaggucuacaguuugguccccagcucacaacaauucugggagauccauugcccaguuuuggccuccaugggaacagcaugcaugugguucacagaccacauaaaggcaagagacccauacacauaaaauaaaguaaaaauaauuuaaaaaguaaaaugggacauaaguguuaucuuccccccaaguucaagauugcuuuucuguaccguuuuguguuuauuaguaaguaaugaaaauggucccauaaggagacuggagagagugacgugaacucagcauuuugccaggacuaaggcacaaaggggauauucaccaaauauuuaugugauuggguuauuaaacuguauuuucucugccaaagaaguugcugcaagucagucuuugcacagauuuaaaugugagguugauguucaagaugaaucaguccuuauuuuuauuaaaagaugacuuuugacauuucuagacuuguucccagagccgauguuuacagcccacaucacaaaaaacaccagagaugcuuuacagugggcugcugggaaauggugccuuaguuuaguacaguguggugauuuaugcuguuguucugagaaguugauaucuaucuauauauucauauaucuauauauucauauaucuauaucuauaaucuauaccuauaucuauaucuacagcuacaucuauaaucuaugucuauauaucuguaucucucuagauuucaaucucuacuaauuuauaucucucuauaucaucuacauuucugucuaucuuuaucccaauccugcaauuaaaaugcuugcuccccuguuuacugcauuguaugccuugguaauauuuauuggcucaaauguugagaagauggacuuggagccagguuuuguaagaucagauccugguucugucucucacuuguuaugccaccuuuaggucucagucucuucaguuguaaaaugggaauguugaagcuguucccuuuagaccacuuaggaggaaagaauauguauaaacaaugaaucuaaauccauacaauucucagaacuuaaccuaugcacacaguaaaugcugacuguuauuguguuagaacauuuuacuaugucacugugugguuuugcauggucuucaaguuaaaaucauuuuuauauuuacagaggagcaacauauuaucuuauaauuuguguuaaugcuaugaaauuuggacuucaguguucaugaaauuagaacaaaguugucuuucaguuggcuuacucauucuuguaugauuaaugacuguuuucccauuacaacagagcugaguaguuucaacagagaccacacagccaacaaagucuaaaauauguacugaccuguccuuacauaagaaguguucugcccuccuguguagaacaaggacccugcuuacacaccagcuacuuguacauauugggcggggacauguccucuuggguacuacuaguccuuucuguauuuauguggaacauuuggaaguugcaugugucagggauauuuaguguuuuguaaugacagucuaagugugcgcugaguguacacacuuggauaugugugucugugugugggugcaugcauguguuaauuuucuuuucuuguagugcuggggguuguauccugggcauuguaauugcuaggcaaaccuaucaguggacuacaucucuggcuccugcucaggcugaguuuggacuuucuguguagaccaaaaauuguaguucuccucuugcaugcugggauaugugccgugguuguggguuccauguauguuuuucccccagcacauuuucaguccguguccuauugcuaaaaauauauacacacagguguguagaguuucuuacucucacagacaguuccuucuucaaggagucaaaaguauuuaaaacucccaaagacggugugacuaagaagcugccgagucuacagagugagaucuaggauagccaaggugcaaagggagaccuuuucucagaaugaaacaaaacugaaaucaaaaaccaaaaacucggcggauaaacuaccaagaaaagaaccugccuuuucuaguguuuugaugcugaggcagcucguuaacauuuuccugggagacagugcucuggacagagcagagaagaaccagggaacggccaugccugugcuuaaaggacaggaacgaacuagucucaaguagaguauuuuaauauuuuucaccauuuuaauuguaggaauggguggaaacuaguacugugguuuaaagauugauggcuugcugacagaauacuugccuguccuugggggaaugguuuuggugcuggguaacuggauccaggggccugagaguuugacagagcacagaagcuugcuuguugauugagacagcauuuuucuguguagcccuggcuguccuggaacuugcucuguagaccaggguggcuuugaacuuacagagauccaccugccucccgaguauuaguuaaggccaucacucacacauaaguuuuacagcacagauuuugaugaguuccuugugagagucuaggcaccaucucuuacucucuccagcggagccccaucaccuuccuugucugccauucugcagggauuugggguucuuucuuagagaauugacugccaguguaccacacccaugugugggaacauggagggaagggcacacauucacagcacauucuguauagcuugucgucagugaucgucugagauugagaaacagaaggaagaaacugagcugucguuaccaugagccuucuguuuaagggaaagggguacucuggucauccuugcguuuauauuugacuuuuacagggacagaacugcaucuucaugguuuuuuuucccaucagaauauucuagaggagccuuucuuaaacuuguugccuguuaaacaauuggacuauuuggacgugagggaaaaagagugugccauuaauggcaacuuuuagaagucuucguuugcaauggagccuuucuggcaucuguguuauuccuacauaggugucugugugaauuguuuuugaauaggaaagguucccacaagugaccauuucugugaauuugggacugggaagauacucauuccauaaauccccucagauauuaucgaaaauguaugguucuuucagagaagauuauuuuaugugucugaauguuuugcgugcaugaauguauauacaccauguguauuccugcugcuugaacaguucauaagagggcuuuggguccccuggaucuagaauuguggauggcugugagucaccacauggguacugggaaccgcaccuggauccucugcaagagcaacaagugauuucaauugccaagccaucucuucugcuucaauaguacuuuuuauaauaauagaaagcaugaagguuuugcuugugguauaacugauaauaauacuggguuaaccauuugaaguuuuuguuuuguuuuguuuuguuuuuucgagacgguuucucuguauagcccuggcuguccuggaacucacuuuguagaccaggcugaccucgaacucagaaauccgccugucugugccucccgagugcugggauuaaaggcgugcacuaucaugcccagcuuccauuugaguuuuuaacaaacaagugaguguguaaagaccagguaacaugacuaaaguuuguggcuaguguacagcacaaccugcuugugucaaaggacacugauagauaucaacaauuaucugauauggggaaauaauggaauuugcuucacuuuauaauaggcuuuuacauauuauuuuguuguacguuggaaagugaaugcuaguagguggcgguccccuagauaacucauucuguucuauggacuugaccucuuaucuuucucuuugcugcguaagacaugagagaggauugagcucugugugagcucaggagaggagccucgaagacaggcuguuaacaagggcuuguccacccuuugcuuuguugauaguucagaagucuccagugucucucgaaaguggcaucugagcucaucuagucugcuuguugcuguaguugguagagauaaucuaugugucuacaacacgguggcaaaccgaagagauagcuguauuucagagacaggguccagcuuauuccccacuguuucuguggugggccacauguucccuccuagagccuaugaacuuuuaagauacaugcuaagaauucuuaacagauugcacacuauaguuauucaaaaccgaguaagaauucaguaggaggaucagggaacccuucuuuucuugucucaaauuuaaagucuugcuucauauaguuuuuuuuuuuuuuuaagugaucacaaaaagauaguucuugauuauguaauaucuaggacuggcagggaaggacuuuuagcucuaucuuucauaugaagaagugacaacauccaagaccauuauagauuuauuacaucaugguuuaugauuuuuaguacauucucacaucacauuauacuuuuugguauuuaacauagccggugccuuaagggagcuuagguaacugauuaagucucguuggguaguucuuggucagacuguguuugaaacugaggcucuuguuuuuuucugugcaggaauuuccuuguguuuguggacuguggccaaacacggccaaaaguauuuuaaauguuuucauuuuucuuacauuucuauauuuauuagcaugcacauacacgcucucacucauggcguggugccccugagacagauggugggauuucuucucucuuuccacugggugcauucuggggauugagcuugggucaucacggucaccagagagcguauuugcaccuugaaccaucucaccagccccgauguggaacuucugguccugaagucgaccuuaguuuucuucuucuucauugcagagugggaaaccacccaucagugauauguucucagaccucaaagaugggagaaagcucuuggaucuucucgaaggccucacaggaacaucauuggugagaggacaucucugaucauuuuccucagacagggucuuguuucccucaggcuaguuacaaccuaacuguguagcugaccuugaacuucugauccuucugccucuccauccucccaaguacugagguguccaccacaccacauuugggcagugcugagguuggaacacagggcuccaugcaugauagggaaacacuaccacuugagcuaugucucuagccuauaggagaggauggccaucucugagaauguggcugauggagugccucuggcacuguugagauugggagauucucucuggguacuaaauugugaagccugaguacugcauccucugucugccuuccuggccgaggcugggcagcuucaggcuaaaccgauaucucucaugagauucccuggcccgugagguagaaggaagaugacuagcuugucaugcccuagguggcacacucuucucaugugacuuggaguuugggacaaugucucuuugcucuguuguuccuacaugggcaggagaaagcaggcagacuauucugcuguuuuuuucugccucuggagaaguuuaaauaaaaaagcuuugucugacagaauugauucucaaaugugucuaccugccugugaagaguaacuagagcaauuuugaaaaugcugaauccaugucacagccuaaguccuuuaaaucacugucucaugugggggcaggaaacugccaggccuguuugaaugucuccuagaugauuuuaguaggcaugcugguaaaugagcccauguuucaggauguucuuagugaauuuccauccugugguacccaggcuggugacauggaugcugaccugcuauucugcuuccguuucugugucagaguuugucaacacaugaagggauagggacucuuacuugguuuuuguuuguuuguuuuauuuuguuuuguuuugcuuuguuuuccagccaaaggaacgugguuccacaagggugcaugccuuaaacaaugucaaccgagugcuacagguuuuacaucagaacaauguaaguaacauuuagggaucucagcugcugcaggcauuguuguuugcugggaagccugcugguugcuguauaugucaguugaugcuuggcaguguuuccucuuggugggaguuuugaauuuguucugugagugacggauaagucacaugccuuuuccgaugcucucauugaucuguaggauaaauaauacgcuuuugaguuuugcauugauccaauuccuaaaaugaaaauuuuauccuuguuuauauugcuguauaaauauacuuaaucaaaagguuuggaguucgauggugacgcugucccacgaauuuaauuguuguguuauuauuuugcucugacagguggacuuggugaauauuggaggcacggacauuguggauggaaaucccaagcugacuuuaggguuacucuggagcaucauucugcacuggcagguggggaccuucccagucaccuugagauaggccucguauuauuuucucuguucauuuucuacagcugucaaaucgaaguuccacaaacggcuuggcuggaauaggagguguuuauugccucaaacuccucgugucugcaagucugcaacccaagugccagcagagcuggaucuucucagcagcuccuugucuuucuccuaacuucgaguuugcuguaaacugcggugugcuggcuuaggcaagcuuagucuucaugacacacucucuguguugguguccagauuucccuuuguucuuugggaaggucaucagucaugcuguguuugaaggccacccuccucuacugugcuugcaccuuaaauaguucugugugcagcggcccuacuucacacagggcucaauuuuaaggugcugauguucuggcguuagcauauggaucuccagagaacacgucuaauuuacagauucccaauggacaguguuggcagccugauauagauuuuuggcagaggagaaaaaaagguguuucauauuucauugagaaaacugcuuugcuuucagccucauaggagguuguaggaguagccuaagggauuuccaaaugccguucauucagauuccccaaauguuaacacuuacccgcauuuccugagcuuacucuggcguucucugucugaguacuuuggaugcucuuuccuuuuauaaaacaccaaauacacuucccaagcuucggucuaaaaacauggcuuaaaaaaauaaaaaggaacuccacuguauagccacaauaccauuaacauacaaauauaaaauguguacuauuaccaucuguuacuguguuaucacaaucauuaaguaccaaaaugauagauaguugucaaagucaggaagaugauuuugggauaguggaguuaucuauaggucucauggagguuugacucaccucgucaguaauauaccccugggagcguagcucagugguucagugauugacaguaggcaugagguucuaggcucaguucccaguagcaguggaguggagggagggaggcaggaugauaagccaggaaaacaguagguccagaucaugagcgaugcucauuggguuucucuuugguaucucuucaaccugggacacuuucggagccuuucuuuucaccgugcugauguuuuugaagaacacugaacuucauacaauguccgugggauugacucugcccaccagcacguuggaucgagcuuguuccuuguauagacuuguuacaggagaaguguugaauuuucucagucaccgugucagggucaugugcugccaacuaucucucucucucucuggccauauuuacuuagguuaaagugguauuucccaaguuuuucuccauuguaaggugacugucccuuguuauuaaguguaucuuguuggggcguacuuagugacaguauaaaugucuaguuaguuucccaacuugaaccauuaguuuuagcagccauucauuauuauuacccaaaucauuaagauccuugccaaauaguaaguuucugaugccauuguuccuucuacaauuauuagcuagcucuguuuauaaaaaaaaucgguuuuuaucagugugucaaccauccacccauccaugcauccacccauccauccaucaaccacccaccuguucaucaacguauuaugggcuuuuauauaaguuuauuaacuuuuacuaauauuauucaucuugauauggcgauugucuuagauucaacuccuucugauccuuuacauuggcuaaagguccuuuugauagaucucugucauucucugaggccuuucuuaugcauauggauacauauugcuuuaggauaaugacaaacugucaguucuuaagaguauaauuauugcuaucaggaaaauuacuuaauucuuugcguuauaagcaggugugggucuuucugcacaggugaaggaugucaugaaagauaucaugucagaccugcagcagacaaacagcgagaagauccugcugagcugggugcggcagaccaccaggcccuacagucaagucaacguccucaacuucaccaccagcuggaccgauggacucgcguucaacgccgugcuccaccggcacaagugagaugucuuccggucugcaaaucuuaccuccucugugucuuuuuucuacuucucuuccccauagucccuucggcuaccucugcugcccacauugcucauguugaaaagcaucaaggaaagcaauaccaugcagaucaaccaccggguaucucuuucggacuucagggcuggagugcaaagcccauggugucuccuacacauuuauaaacuaagaaguguaagauaauugacauaguucacucccacucaucuggccuaaccaguaacacacacaaagaguuguguguagcuuuucuucugauagcagaaggacaacucuguuuauuguguuacccacauuuacgaagagcuauacaauuuucuuaugaaaucucauaaacuagauucuaacuuguauguaagaauuuaauacaaaagucgccauuauaccccagaagaauaaacagccugaaauaacuuucuaguaaaaaaucaugacacuguaugaauacagagcuauaaaauggaguagaaucauuauaguugcauguaaaggugccagcauuggacugugcuagauauacaagaacaagcucuuagagcuuccauccuggagguacuaagagcugaggaagagcucuccuguauagaccggucugauaaccaguugagcugacauugcaacugaacaugcgguauggggcaguugguuaaccauguaaauaugugccuugacacaccagacaaguaauucugcaucccucagagauuaagugccaaaagcaggaaaaguggauuguguuuuguugcuguuaugaauuauuaauuuucucauuuaauccccugaauguucuugccugcuauauacaaaugaaguacaagcuucuguauuuauguucuacauuucacuaaguuuaucucuguauaauauagguuuggcuuucuuuguuucuuacuuuucuuucuuuuuuuaaucuuugcugguagauuguuagguggggaaguagccauggcugaauuuaggauaaccuuaaaauguguuauccuuuuccccuucuccuccuuuucuuuauaggauucuguucuucauguaguauuguuucaaauuagugacagugagaagaauguuugauaccaaagcaaugcuuuuaauauuuuucacauaggaucgaugugugcuauagauuuaaguuuugguauuuugauuuguuaugggguuaaagacccuuucccucuccuguucucccgcucuuuuucugucaucuugaagauccuguccuguacuguuaagaaacuguugcauuuauccauuauccuuugccuuuuuaggcucuuugauucaacaaauggauauaaagugucuugcacuagacacaaggauagagcaggagcaaaacagacaaacaucucaguuccuucuaacuggagacagagauuuauuuagaaaauguaaauuauagcugggcaugguggugcacauaugaucucagaacuugggaaguagaaagaucagggguucugggugauccucggccaccuguguaacuauuuugaggucaucaugggcuacauguggaagacucugucucacaaaauguguguauggggaugugaagauauagaaaugguagacaggcuaaagaaaaagacgauagaugagagggaagaggcaucugauaugggggaggcugguggcugugguggcuaagggacagaggaagagguagaaaggagaacgggggugggggaaggggagaccagucucagggugcauguaagauacaagagugaagugcaaagaaagggaccaacuuuuaggucugucaagccagugauacuguccacgaugugaggcuggaagaaagacaagauguaaaggaaaacuaguuuucauggagaaagaugaacggaagggaaccagcccccuuugcaccucugcuuuuaggauaacuaaguccaguugcacuagaguaucugugugcucaucuuagucucuucugguguguagaggcaucaagucagggucucccucugcagcccaagcuggacugaaacuggcuauguggaugaggccagcuuuuaauuggugaccuucuugucuuagaacccuuagaacuguaauaucaggaguguaccuuuguccuaauuguggaauuuagucuauuaaaaucauuaaauuugugaagcaauaaaaucauagaauccauuaauuuguagaauuuaguccauuaaaauaauugauuugguaacucauauauuuagguucguuuuuaccacuguguuggagcuuauuucaccuccuguuucuguaucauuuucuuccccggucuucucuguauccauacgucuccuuuacucauaauauacugucugggaaacacuguacacucaacugugccaagaaccugagauuuucuuacuuauuguuaucguugucacacaugucacuuuuagauuuuacaaacuugagaugcaaaagauacaauuuaaaauagcacucacaaauuaaaaaaaaaaauugaagugcaaugaauuacggugcuaucuacauuguuuccauuauauuuuucugucacugauuucagaccagaucucuucagcugggacagaguggucaaaauguccccaauugagagacuugaacaugcuuuuagcaaggcccacacuuauuugggaauugaaaagcuucuagauccugaagguaagguugagaucuugauucugcuauguauaaguuuguuacauaaaaaccugcugaacuugauucugcuuucuaauuuugaacaccuuuagcagugaugauguuuuucuuuuuuacaaaacacuaugacaauuaagggauccucauuuuaccauauuggccauaauuauaucuuuguguugguuuuccuacuuuucuguguguaguauguguggcuguugugcaugaguggagugggugugugcacauaugugaaugcaugugugggccagaggagggaaucaggugucuuuaccacuucccaccuugucuuuuaagacaugggcgcugucagcugggcugacuggcaaugagccugugggguccaccucccgucucccacaaagcacuuuauugcaguaaaucuuuuguccuguuuguagucuuuagacagcagguuaaugauuucaccagauaagaguuaacuuguaucaaguaggauuggaaaagucuaggaauaccuacuugcuagagaaauaauucagaauuaguuugguuucuuggaaugcauguacgugugagcauuuguguaugguuugaagacuuuaauugcaacuuuagguuugaauucugcccacucuauugugugagugaagccugugccauauuuuaaauggcuacaugaguagcucuuagagcauuuugagacaguuuuuuguuuguuguuuuaaaauuuguucuugaaggcagggucuuaguuaguauggagccuaggcagucuucaaacucaugaaccuccugccucagccugucaggagcugaauugcaguaugcauuaucaugcccaccuuauggaaaacuuaagaaccggaggcugaauaagucuucaccucuguccauauuuugugaucugcagcagcaauuuccugagaggcagcauuauggagaucacaaaugaggcauuguuucuggguacaagaacagucacuuuuuacuugguaucgagcaguccacacguuucugagucaucuuuucuucugcuuuuagauguugcugugcaucucccugacaagaaauccauaauuauguauuuaacgucucuguuugaggugcuuccucagcaagucacgauagaugccauccgagagguggagacucucccaaggaaguauaagaaagaaugugaagaggaagaaauucauauccaggugcuggcucauuuuucucgaaacuuuugccgugccuguuugauuucccccaggucaaacuugugcaggguguuuucugaacauguguguguguguguguuuuuuuuuucugaguuccguuuuuuaugaaacagggaaguguuuuguuucucaaggugaguagcgucuggggcuguugaucguggugcugugugguacgcuaaaagcucuacuauggagucaacuggaugcugagugguggauucuguuuaugcugagaggccaaggcguugaccugguguggggaacguuuucucucauguuguccuggguaauuuuuguuaaguaguaauuuucuuucuguuugggguccauuaauagagaacuuuugcccccaauaucuucucauaaggauucucaaaauaccagccuuacuuucccuuuccccuggaagaggcacuguacuauaaaucauucaucagauuuuuccagaaaugggcuaacagaugauuucaccagcaaauaaaugagauuuuccuaaggagauaugaauaauggauuuuuuucuuucuccauuacccuggcuugacucaacccauauuuugucucuuugugauuuuugucuaaaaucccauucuucuucauucauaaaaggaagaccguucagauuuucgaagucaugcauuuuagcaacuaaguccagauguucacacaggcgcuggggagauggcucagucaguagagugcucuauguccaugccugaggagcugaguuaggaugcccugcauguacauagacaucggguuugguggucucccuguauccugaugcugggagacagggaugggcggguuagcggaacucaugggucagccagcauaagugagucacugagcuccaccuucagugagagacacugucucagugaaggaaggaagguggugagugauuggaaaauacacuagauaucaaccucuggcuaccacauucgugugaacacacaugcuuacacaccacauagauauacacauaugaggaaaaagagggggugaggauugcaaauuugugagaagugcauuuuggaugagugugugcccugcagcuuacaugucacccucugguacuuggauggggucagugacuuggccucuugaccacugugguuaauguuaccuccuuggcaaaggcaacacaaagaauacucacuugcuaagcccguuucucugucauuacuauagauuucucuccagauuugcuuugacauucucauuuagcaaauuugcuuucauuuuuuuaaaaaaguuacucaauuuuccaauuauaauaaucuugaacauaucaucuuuuuccccuauuuuuaugagauucaaagaguuuacuuacucuuuuagauuuuggguggcauguaguaaucauuuuauuuuuauccauuuagaaaaaggagaaaaacaccuuauugaauaggaaaagggagagauggagccugauugugaauccugguuucuuuuuaguuuugaucaucaaauaaugcagaaggaaaacccuuaacuacugcaaauuguuuaccuuggcuccuggacacugcuuugguucaaugauguacuuucacugggugacuaagaugguguucugggcuguccuguaggucuugccucuuguauuuacagucauuucuucauuggacugauuuauuuuuguuaaaaagagaagauauuucaauucuuaguguuaaggcuguccucucaaaaaggaagggccauuaagaugguucaguugguaaaagugauuguuuguucugaagcuugaugguuuagguuagauccguagaacucacauaaugguaggagagugcacuauauaauuguucaccagccuccguauguauguauauacucauacagaaacauagcaaaucauaggaaaaagaaguggauuuuacuuauuuuaugguauuuagcuaaaacaaucacuucuuuagcaugcaagguugguaugguaagaauuucagaaaccacuuucuauuuguuaaugacugagugguuuaaugcucacgcuguuuauuguaugcuuuuauugguaacuuagaggcuaaguuccauuaagugagggaaugauguggucaagucuugauugucuccucguuggcuugucuugcuguccacuguucucuaaggaaugcugacugccagccagccuucucucugaauccucuuucucccaccaugcugaguagcauugggaggucaguaggcaaucccugaguuucccuuuagaaacacgccaguugaaaagcuccugcguauuuacauggagaggcuuugcugcuuuccaccccucggggggaugcuggugccuacacagaugaccuuuggcugaugacuagcaguccuaguuuugcauguucuucccauugucuagacuuuugcuuaccucaccuucugaauuaucuuagcacugugacuucaggccuuuaaguugagagaauguagcuuauuuuccuuccuaugcccuggcauuguuugcgucuuaauuugccaguguuuuuacuuaugaugacugguuucuuuaacuccuauaacucaguugaaaacauuccuuugaucucuccuauaaaacaacauuuucugggcuucaaccccaaguuuucaugaggauuuaauaccucuuaugcuuuaaauugcagucagaguaggcuuuucuucauuccugauucuuauguguguugaauuccaucuaugaaggaucuucuaccuauauggucucugagcaugccuuccccuuuuccuacacuuaaacagaaccuuugaguuucucccuaaccaauuaagauccgucucuaugugcccacagucuuucuugcccugucaguauuuuugugaacuaugucaagaauuuuaaauagugacuuaagaccguggaaaggauagugagggauuucaggccgggcgaccugugggugugaacacaugagagagaccauucucucugcugccugagaaguggcuuggcagauaggacugugggugccaaggguuagcaagccauugugggccagaggagagacggguggugcagaaguggagaggucugcauggauuugaguugaacuuugaagguaggacuaguuugcagauuaaacacgggagagggaagaaagagggguguguccaaguauaucacccagguuuuuggcuguggugccuaggugcauggagccugggguagguguuggcaaguuuuggggugggugaaacaaaugaguguuuaaaugugggucugguuugauauaucuuuaaagaugcugcagauguuauugcugcugaaaguuagaagagaguuuuacuagaaauaaaauaucuaucgaaucuagauuauuuuuuaaaaaucaaauaggaauagaugauaucacuuaguuaagguauaucgaaagaagggagaaagaaguucaggaggguuacugcuugcagaugggcagggccacuggauugggaaggagagcuuuggaagucaggauggaucggcuccaggcacagccacugggaggcuucuggaagaaccacgugagaccuggcuucucuuguuuccaguuggugccuguuauuccggcauagcuguuaucagaaacauuuuaauugauuggcuaauuguaugauuacucuaaaaaguaagucugggaaaauggcuuugucagcuuuucagucauuugggggcaaauguugagacuguugaagcagacuguuaagacuuuggugguaacauguguaggcaugacuuuuaccauucuccucauuuauguacaugugggauaguuuacacacgucuugaagaaguuuuguuugaauggaaacaaaggaacagcagagccaguaggcuugauuacaagaucauuaagugcauaaagagaaacuaguaaguuagagaaagaucggcagacauuuauuuuacaaguccuaacccucaaaccacaucccccaaacagaacagcucacacacuagagggcuguugccucaaaacaaugaaacaugaaaucccauccguuccacagguuguaugugcgcccuuguucacuguuuaauacauggcaccagaaugcagggucccuaaagaauucuaagcaggggucaaagcagagugucaggcucucuauucuguaaacugcaaccguuguucaagggccagcauguucuuaguucuccaucaaaauucucuaugucuugaagucaaauacuggcauuuggaguuuuauuuuuguccagugacucaugugggauauuuuucucuccaugccucuuccaauguggcgcuuguguguguacucuauuuuguauuucuuggcugucaguguccucugauuaauucauggcuucauucacucagcuccugaaaacuggggguugucuccugagauccuagucccuaccuugguuucuccagacauugcucauguggugagcgucuguauguucaugguugcuguggcuuuguuuccacagagugcagugcuggcagaggaaggccagaguccccgagcugagaccccuagcaccgucacugaaguggacauggauuuggacagcuaccagauagcgcuagaggaagugcugacguggcugcuguccgcggaggacacguuccaggagcaagaugacauuucugaugaugucgaagaagucaaagagcaguuugcuacccaugaaguaaauaucuguggccgagagccauauuuuuccagggccgggccugauuuuuagggguggugguagguggagugacuucaccauuggcuugguauuuaccaaaugaugcucuguaaaaagaucaugauguagugccugcauuauuuacgugggcuuuguuagaaaacuggagugaucgacaguucaugagaaucagauuucaggcagucuugugacauuuuguguauuuuuuuagaacugaggauuaaaucagugugaacauuguuccuuuuugaaauauugagcuguaguugcaaaucaacauagccaacuaguaucccaaauaaucagguuucucaugcuacccuaaaagccaguauuuuuauuuguugucugauuaagccaguguuauauccaguguuccugcacgauuuuaugcaagggcagcuaccugcuauuuagagauagaaucaugauuuuucacucuaugggaaauucuuuacgguuaaguggguucuuguguguguguguguguguaagcagcuccucuucuccuucuucuucuucuucuucuucuucuucuucuucuucuucuucuucuucuucuucuucuucuucuucuucuucuucuucuucucuauuuuuacauuaacaacauaaucaucauuuacuuaagagauagcuuagcuguuaaaggugcuugcugcaaaacugaugauccaaggucggucccugcaacucacuugguggaaugacagauccaccucuuaugagcuguccugugauucccuauauguguguugaaaugcugaacaugguguguguacauggacacauucacgggugaauggggauacacacccaugaauaguuguaaaacuuuuaaaaucuacuauuaucauccauaacauuguuuucuuugaucuagcuuucucuugaguuaugguuaauaccaaaucucucauuucagagcuuuccaccuuuggugaaagccuccuccgucuuugcuuugcacagguuccuuucucuggggcguugcuguugggcuuaugcacuaccaguuuguuguuucaugucuucgcagcaagugacucacuaacuaccacaaucuccuuugcuagacuuuuaugauggagcugacagcacaccagagcagcguggggagcguccugcaggcuggcaaccagcugaugacacaagggacucugucagaggaggaggaguuugagauccaggaacagaugaccuugcugaaugcaaggugggaggcgcuccggguggagagcauggagaggcagucccggugaguggagcucaaggaccgagagccugacuccccagaccacagugcacagugacacucaaguacaggccugcggggcugugacuaaaaucaguacagggcaagccuuccacuguccucacaccgcucugugagucucaucucugucaagaucauagaggacaguuggaaugcagaggguaguaagaggggaaguuauauuuugcaugggugauauuguaauuuuauauuuguuacagugauaaaacacccuggccaaaaaggcaacuuaagggaggaaaggauuuauuuuagcuaacaauuccagguuuuggucucauuuuggggacccccgaggagugggagcuugaauucaguagucaugucacugcacagugaggagcagagaagaaugacugugcccaugcuagugcccaacuggcuuucuuuacuuucauacaguccagggccccaaccagggaguggugcugcucgguuucagacuagccuuccuauaucaauuagguuaauaaucaaugcagcuccccacagacaaggccucagguuaaccucauuuagacagcccccucauugaggcugucaccacaggacagugugccacgggccuacuuacuguucaguggucuguaacaguuuaaagagcaggcuuauaccauggucuguuucacuuuccacguugugauucgcguuccggugccguuuccaccaauuuaauacgccaggaauuccugaguguagaaacaaugauucuguuuugaauacagggagcuguuauuuauauuccugacugcccuuaaugaacuccaguuaugaaucaaaucagagcuuucccccuuaguuucuauacugauggacucucugcuacuuggaugguuaggguacacaaggcuguguuuuccugcccccgcuucccuggugcucagagugggugcccgugccaggggacaagcccgagggaaugacacucuguccuccuggccaggcugcacgacgcucugauggagcugcagaagaaacagcugcagcagcucucaagcuggcuggcccucacagaagagcgcauucagaagauggagagccucccgcugggugaugaccugcccucccugcagaagcugcuucaagaacauaaaguaaauuugcugcuuguuccuuuucuacuuccuuguguaggaagagugcugagcugacccggggccugauggcuucucucgguguggaguugggcuacuucuucccuguugcuuuuuauucagaagguguucguugggaggugacauuuuggaaagagacagcuuugcacacauguccaugucuuucuucugaaagugugugacauuugucacauuuggcaagggugauuuguuuguuuuuuguuuuuuuuuguuuuguuuuauuuuuuuuauaaaucuuuuuaauaaagauuaauuuauuuauuauuauaaguacacuguagcugucuucagaugcaccagaagagagcaucagaucucauuacggaugguugugagccaccaugugguugcugggauuugaacucaggaccuucggaagaguaguugguucucuuaaccacugagccaucucuccagccaggcaagggugguuuuggacucacaagugcaugagaaccugaacauaugggcaggaauacacaguguggguggagaaagaaacagggauauauacuuauacuuaauuaggauuaggauauauacccaauccugucagggagacuguuaccucuuuuuuuuuucuuuuuaaaaaagauuuacuuuauuuauuauauguaaguacacuagcuaucuucagacaccagaagacggaaucagaugguuuugagccaccaugugguugcugggauuugaauucaggaccuccggaagagcagucagugcucuuaaccgcugagccaucucucuagccccccguuaccucuuuucagaagagcaugaagugcugagugaggaaccagcacaugguggacagugugguuugguucugagaugagugguucgguuuuuauagcagaagaaagguagaauuuuguugaucagugaaacaucuagauagcugauacuaaggcuuuagggucacaugaaacacuacccaagaggcauuucaccauacucuugcuacuguuuaaaccaauuacucucuacagaugucuaaugacuguucucuuccuguggaagagggaagugaagguguccauaugcuuguucuugguugcucucuuggggagcuaaucagaauagcuucuaugagucauacagccuuuuccucauuuugcacauuauggaacuacagaaaaugaccucugauucuauuugcuuaaacucuggguuuuuagaguagucaggucuacauuuuugucuuuuuuauuuuccagugucucauuguguaccacuagcugacuuggaacuuucuauguagaccacgauggccuugcacucacugcgauccuccugucccugccucuuuagugcugggauaccugcauauggauauauuuuuauuuuaauuccuagaauagacacagauuuucuucuuuuccuccuuuccuucuuccuucucaucuucuucuaccucgacuuguuuuuuugggaagaauuaggacugaaaauggcacacauugucacacauuuacaauugguuuugaaguugcacucgcagacucuggcuccuaaugaaauguaaggguguguucagguuucuuucuuuaguaugguacuuaggguaaugguugggaauggcaauaccaugccucauuagguuccuuaauuacuaucgugaagaagcggauuuuuaaauagguaaaugaggaagagcagauaucauaguuuaucuuuucuuuuuuccucuagaguuugcaaaaugaccuugaagcugaacaggugaagguaaauuccuuaacucacaugguggugauuguggaugaaaacaguggggagagugccacagcucuucuggaagaucaguuacagguaagaccuugagaaguaggaugcccuucagauccacucucuggucaagguccauguauuguuccuccugggcauccuuguuuguacagaaggguauaaaaaaguagacuccuuuaaucaucuuuucguuacuguaaugaagguccugaggcaggcuacuugauagagaacaaaguuuacuuagcucacaguuuuggaggcuggcaguucagacagccugacaaauguucucccuuggcuaugucuaauagaacagaaacauguguauguguguguugugucucugccuuaauuuuuuaauccauuagaauuuaucaugaucggccaccuuugugcccugauuuagaaccccccuaaaaccaaaccaaacaaaacaaaacaaaacaucagauuuccccacccuaaccagaaacaaagcccauccucaaucugaauuuccaccuucuugauacuauuuaugcaaaucuuuuuuaguuaaauucuuguuugaauucauggugggguggggugggguggggugggacacaaagcauggcaccuguuuuugguuguaucucccaguuaggccuccucauugugugguuucaggcuuagcuaggcauuccuuguuucauucgaguccuugcagugaaggcaugagauuguuauucugcucccuuguguauaauggugacaacauuuaaaagcaccagaacucauucaagugacucccaggcuucccccagaacagucacuugaagaauuggugaaggcaaccauagccuggaagguuugaagcauagaaaguaaacauguagauugugguuguagcagugguugaaaaaaaaaaauacaacaacccucagacacauauacccaauuuucaaauacaugugaaauguugcauucccauacaaaccuuacagugaaguaggaacaggaauucuaguuuuuuuuuuuuccucaucucugaguaauuuaaguaagucuacccuaugaaaguuaguuuuuuucucauauauguacuuaaaaguauuuuuuguagauugguguuuuggaaaacuguaguaauugugucuccuggcugggcugacagagacugcuucucccuucccuagaaacugggugagcgcuggacagcuguaugccgcuggacugaagaacguuggaacagguugcaagaaaucaguauucuguggcaggaauuauuggaagagcagguaugaaacucaaccacuguccacugaggacaaaacagugacaaggagcccaucguuucaguauggcuguggaauguggcugcccucuucucuagugagaauucuggaacuuuggcuucuuuaaaaaacacagaaauauuauaagaauauguuuuuuuuuuaucuuagguuguucccccucccccaguagcugauuaugauuugccucgugcucugguggggaugugauuuugccagcugcagauauuuucugugauuguguggccuuuguaauccuguggacucuucagaggguauaugucauagucaggguuucuauuccugcacagacaucaugaccaagaagcaaguuggggaggaaaggguuuauucagcuuacaauuccauacugcuguuuaucaccaaggaagucuggacuggaacucaaacaggucaggaagcaggagcugaugcagaggccauggagggauguucuuuacuggcuugcuucuccuggcuuguucagccugcucucuuauagaacccaagacuacaagcccagagaugguuccacccacaagugguggugacacuguggacaaaaguuguuaauaucauaguggauaagaaggagagggggguagagagagagaaugagaggggagagggagagauccuuaauagggaauagcauauaaacaaagaaaugugucuugcaauuuagaagguaaugaguccaauuuggugagggcuucuuucuggcucacaaaggauccuuuguuacauucuuaucaauuuguagaaggaaaaaguaguucuugaucacuaauugaggaaaugccuuacaguugguucucauggaggcauuuccucaacugaagcuccuuucucugugauaacuccagcugugucgaguugacacaaaacuagccagaacaguauauaaauccuggggcccugaggguuguuggguuguucuuuguugguggucaagguuaguccugcacaaagaagaaacaacaagaagaaauuagauauccugacaucgaaggacuuggcacccguaaucagcaggaaauagucuaaggauaacguugaccccuuucuggucccugacuuuguucauggaucucuuugcucucuccccucuauucuuuucucccuccuaucuaguguuauggaaucgaacgaguugaaggcguagguagaagaggguggaaggaagaagaacccacaaaguagccaaagaccagcuagcuacacucuucccuuuuuuugaaaggccuuauuuugaaaauaauuuaugaaauuuggaaauaaugguuugcuaaucacuuuaaaaauuaaaaaaaaaaaaaaccaagggaaaacaaguaaucugaccauuucuaucaguuuaaguuuuauacaaauguguaugcauuauugacugcugcugcauucauuaauucaucuuuuugcuugcuuacauauuuuuuggcuuacuuuauuuauucuguccucauacucacuguguaacuaaggauggcacugagcucccaaucgauccuucugccuccagcaguaaagguggcaucguccccgauuccugugggggcuguggggagaagccagggccuuccuuuacaugguagccaugcagccuaccggcugagcaacauuuccaguccccuauuuauuauuuugaaagucaaauuucuauuaauguuauauccauuucugcagcuuacucauuaagaucaugguaugaggcuccaugguaauaguaauuugauuucuguucauuauuuacaauguuagugcuuaggucuguuccugucuugacuuacuuuucaugguuuaauuacucaugggcuuuuguugagggaucuguuugaauguguaccagcacaauucccagcauacaguuugugcucaguaaauaaaagguacaggaauauucuccauaugcugugaauauuaaauuauaaucuuccucuuaacuuuuaaccagcauacaggaugaaacuagugagaaaauauuuccuagcauugcuuuuggauaagcauucaguggcuccgugugcaaagccgucugcacagcuuuucucuugguuuggugucucuucgaucaccuuuuagcuuuacacaaagguuguuaucaaaacagaguacaaagaaguaaaaaauuucuccccagugccaagcagcuguagccuagaaaagaagcagacacaagguucccacagcguccaucuuggcucuguugcauuuccauccagaaaaagcagcucuguucucugcauggggucaggaaccagaugggugagauccuggggcuucgcugaggcagaggcagauaguucauuuuaaauacuguuacaaaugauuaauccgcaugguggucaaugaucuuccuccuccuccucuuccucuuccuccucuuuaaaucagggacuacauaauggggcugugacucagugcuuguuuaauguguaugaagccuuggguuaaauccucaguaacucauaaaguggguguugugguguauaccacaacuuaccuugcaugccgagacauaagcaggaggaucagaauuucaagguuauacuuagcuggcuagcaaguuugaggcuaaucuggguuaaaagaaccugucucaagacagacacccaccaaaacaauuguauaauuuauucugcuucaugacauauggauggugcauuuugguaauguguauaucaccccagaucuuuauguucaaaucaaagcaucccauacaguaguuuauuuuucuaaaguaauaaugacggacaucagucauuaucagaacaagauugguuugccuuuucugccuuuccaguuugcuuauugcuucuuuguuucuugucagcuugacacacuguaguguguuauuagagaagaggaaccacaauugagacaaugucuucaucagguuagccuguaggcaagucugugcgggcauuuucuuuaaugauugaugugggagggccucccccacuuugggguugcugccccuggggcaggugguccugcguuguagcaggaagcaggcagcaugagccuggaugacugaggcagcuggcggcauuccuuccucucugcuguaauuccugcccugugucccuuagagacggagccuuuccuccuaagcuccuuuuggccaugguguuuuaucacagcaauagaaacucuauuaaaguuuggaaauaacuuuaggauuaaaaaaauguuuagaaaacaagggauuuuugaccaacuguaucacuugaaguuuuauuuauuucauguaugugacuuuacuguugcugucgucagacacacaagaagagugcaucggaucccauuacagaugguugugagccaccaugugguugaugggaauugaacucaggaccucuagaagagcagucagugcucuuaaccacugagccaucucucuagccugucacuuguaguuuuaaauaggccgucuauucauuauugucuauugcuaggacauuuuaucucucucccacucucucucucucucucucccucucucucucucucucucucucucuugagagagaaggguaugucugcaccuucuguuuugcucccuggucauuuauacgcauaucuuaacuuuacuaggcgaggagauaggaucugcauuugucuuuuauuuuucuaauuuucacuuuuuuuggggugguggugguggugguagacuauagagguaaggaguagcuugaaaauacguugauuaaugagacaacugagaaagaauucuucccauugcaaguccagaacuaacccuuugccccuuagcuauacagaaaaaaaaauuaaaaaaagaaaaaaaaaggagaguguaauacacucuacuuuugggaauagggcugucuuaagagcaucucacuccaucacuuaacaucuuccaaagaacacacacuuuuggcugugaguuuuaaauaauuuuguuguuggcuuugggacaucuucauccuucuuccuuuaauguaauugcauuugaacuuugaccauuugcauacuuuucccuccuggugcuguggacagacaguugauuuaggggugggaguuuaugacccagcucagccauuuaguagcuuacucaccucaaacauguaacuugacgucuguuuccuucucuaaaaugagcagcaggaacaagaaaaucuaugagcuuccuuugaauuaaaaccuagaguucuaauaugauuuuuuuaaagcucagcauaauuggauuuaguauccuuugucuacucaccuucuugagaucuaggguuaguugcuauaugggauuauuuucuccuacuguaauaaauucccuagccagguuuggcgucacaugcuuguggugcucaggagauggagauaggaggauugcaaguucaagaucagcuugauauacuagcaagaccccacucccaugccccccaggggcuagugauaugaggcuuauucguauuguuucaugacuauauucuacuaaugauucgagcugguagcuccaccacugaguugcacccauaguccugaaggcuugcuugauucaguguuuuagaguugugaacauccaaaaguacggugcuagcucuggcgaggaaucccugccugucacaucacaguacuuagcacugcagugggagugugcaccaaagggggaggugguguggagacacaggaagccagaggucaggaggcgccagccuuacucuuuuguaacagugauucucaggaacuuauggaggccccagaagaacagcauaucucucuucugcgggcagcaccaucugagacuuccuccuagcuucuauaucuuacagauucuagccucucuccugccacacuggagaccaugcucuuccuacacaggagcccuuuaaggacaugcuaaacucuauucacaccuuacgaguuaucacuaucgauuagaccuaaugacagguuaaucuguuguaaguuauagaggcuaugcuuuugccaguccuugaacucggguauuugagguucuuauuaucccgaucuacaugugagucacagaauugucaggugauugaccaugucucuuuccaacuuuuguuguuacuccuagugucuguuggaggcuuggcucaccgaaaaggaagaggcuuugaauaaaguucaaaccagcaacuuuaaagaccagaaggaacuaagugucaguguccggcgucuggcuguaagugugucccugucggcaucuguuguaagccugugauguguaguguuuuauaacuaagaguuaauauacuugaaugaauacagauuauagcuuauuucccauuacuacaucgcuuccagccaugguacuguaccaggagccuuuuauuauugcauagagaauggcagaacacacuguuggcgggauuacaaaucuacuugauuauacuucccgaggaagauaaacuuucuugagagaaagaaaauuauuuguggaaguugguccugacucuuccucccagccccaugcucccagaaauaagacucaggcaaaauauauuuagauaucuuggccauauagcuagacucuucucugaguagacuguaacuuagaaaaacuccuuuuuuuuuuuuuuuuuuuuuuuuagacaugguuucucuguguagcucuggcuguccuggaacucacuuuguagaccaggcuggccuugaacucagaaaucugccugccucugccucccaagugcugggauuaaaggugugugccaccacgcccggcuaacucauuuauuuuaauccacauucugccauauggcugguuacuugugcucagguaccagacuucugucuucucacaucuuccucuggcaaaucucccaccuggcucuaucccagaauccuuucuccucccgaaugcccuaccuccuauuuccugccuaagccuuaggccaucagauuuauuauugacaggugucauguccauauagaccuaagauauucucuauaguuguugugugauaaauauuugacauucuagauauugaaggaagacauggaaaugaagaggcagacucuggaucaacugagugagauuggccaggaugugggccaauuacucaguaaucccaaggcaucuaagaagaugaacagugacucugaggagcuaacacagagaugggauucucugguucagagacucgaagacucuucuaaccagguacguuuuugauuuggguaguauauuauaccaugaaaaaauuguguguacaggaacagaaaaaugcagucugagauccaaagugugcuuuauuaauugacaauacgaaagauugagccaucaguacaauguggcugaacugugaaaacaucaugauagaggaagccagucaugcaugauaguuaugaacuaugaauugugcaggacaggcagaaccuggcaggugcucaguggccucgagcgguggugauuagggagugggaugcugugaacagauaucaagguucuauuugggcugauuaaguugucuuggagugaaugagaagacaagacagacacggguaugggcuauucaaagauaguacaagcuuuuauucagaagaaaagcccucaggguuucuagucugggaaugagagcacacugucuacuuauaggcuaggguaguuagcuacaggauagaaagggauugaucugggcaaggauacuagaauguuuucuuuuguccugugcuaaaaaagguuaaauggugacauagaaaaugucaaccagcaucuugcuugggcagccaucagugcaggcccauggcauggccagggcaagaaucuagaaaaacaagugacuauaauuuagaaacagagaugacuuugguucgggcaguugucauuauucaagcagaauggaggaguauuacaagcuggcauagccauggcugauguugaccuaaagucuguagccaauacccacaccaauacccacugcaguggacuuuucccuuugcuucugugcaguucuggcuagucucgaaccucuaaccucugccucuccuaccaaguccuaggauuacaggaggguguuaaguuuuauaaagcaguauaaucaucggcggggauauauuggcaggcccaugcugaggugucuuccugaggagacaccaugcaacagaccuaguauaaagaagacuuacugugggggaagggagcagggaccuggagaagcggcaacagaggugugagggcaaagaacuguggggcuggggggagagaagggcagagagaaagagaagagagaggauacguggguacagggaaagaagauggagagagcugcuaggguagcagccagucccuccuuauaugccuggcuugcucccuucucucucaccugguggacuuugacacaggcuguugcuagguagcuguugggcgaggccuaaaggaauugucaauaagccaacagaguguggcaccaugcguggcuugaacuguuuauuuuuauagggagcguuuuaugugaauaacucucagcagcggcuuucauuuaaagccaacgcugggcgugacuugccuuucaggugacucaggcgguagcgaagcucggcaugucccagauuccacagaaggaccuauuggagaccguucaugugagagaacaagggauggugaagaagcccaagcaggaacugccuccuccucccccaccaaagaagagacagauucacguggacguggaggccaagaaaaagugagagaugucccagccucaggccugccuguaacucgcacuaaucacuaaucaaaugagaguuuagacaugcucauuauuauguaaauucagucaugagcucaguuacuggcuuugagucucuggaagauucugccucccaggagcuaagcagcuaaauugcccugagggacuuuacucauccucugcuaaauuuagagacugguguggaguaacccuucuguuaucaauccccaucuguuucucagaggacgauuguuuugggguccggcuccugcuuucuucuuucuuucauaccuuuaagaccugacaguuuggcuuuggauaaauuccuuauucuuugugaaucucuuuccucugcucaucacugcaauagcaguucaggaagacaaugcauuuuugugaccucacgaucucugucugucugucugucucuccuccucuucuuccucuucuuccuuuccuuuuuaucccccccccccccaccaaacccauccauguauuuagguuuucuuugauaauuccuuuuaucagguuucuuaauagaugcuuucuguuuugcugaaagagcucuuuuggguuaaaaugucccuuuuaucuaacugauucgaaagaaaacuggagauuguuagaagaaugagauuucagcugcauucacugggccuuugcugugucagagccuuuaaaaaaauucucuaccuguaggucucgacuccuuugggggugugugugugucauaucaaaaacccuucauaucagauauuuacacuaccauccauaacaguugcaaauuuauaacuaugaaguagcaaagaaauaauuuuauugauggaggugacggccacaugaggaacuguauuaaaggauggcagcauuaggaagguugagaacugcugcuuuaaaauguaguguguucuaggcacuggaucugguacgccuggucacagugagccuucggcucggccucaagcuugcucucaugcucccucuugcagugcgaucccaggguucagggacauuggcaguuauuaggggccugaauaaaaagauaagcuuuccuuccauaggauagcuuuauuagaggaaucaggauguggggcguaucugaugauucuccuuuugacccucagccuguuuucugccuccuaacggugccucaugcaugacuggcgcaccugccguugugagcagcagccuuuacuuuggccagagcagcaggcagagaaggagaugcugucgaugucaacauuagcagcaaucuuccauuuccugaacucuuguuagcugcugggcgcaucuggcacugugugucuccagggcuggcuuuggaauagacaggguguauccugaugggaggcucauuuaaacuugccuguagugaauaaugagccuucugcugcaagagacaaaaugcugugaccaaggugacuucaacaacucauuaucgugucguaugacaagaaacaguccagaaguggcccagcuguggcgagaggaugcacuuaagcagacuucccacugccgucccugcuauuguuggcuugguugcuuuuccucacagugcuuugucuucucagcaaacugggucuccgaugucaccagccaggauuuugucccuugcuuguucaaguuuauaagcugacggcaaugguacuggagguccagaugaaccgggucauguguccuucccuuauccccagucuaugcaguuuguacaaaguauagagagggguugugagucaugaguccugaccuucgaggguggauugaggcagacauucauuacugaauuaauuccucggcagaggccugagugcaugcuguccacgguagcagaaaucucauuuguaaauuuuuuuuaugccccauguuugccucagaacguccugugugcugucuuuguagagcccaggcaugcuuuuguaggcaguagcaggguccgauggcugcccacugggaguuccaguuuccuagaacauggaaguagacagggaugcuuagguguugcagaagcugacaguuuccuaagauacggugugcacaucccaggagaaggcauggaccagagcagagcacaaggcuggaagcccaagcuccgagccccaggcuuucuugugaccugcuguggguccugggcauccgaggagauucuccgugugugugcagugcuggcucuucugcauccaugcaguguccuuucccuguuaaccuuggcuaugaagguuuccagucuuccucucugccagcugguuuuucugcugugugaaccucucagucuuuucuuuuuuuucccccugagacaggguuucucuguauagccuuggcuguccuggaacucacucuguagaccaggcuggccuugaaccucucagucuuaaugcaguucacuucccccuuauucuccccaaccuccucuccucaaaauggucccucacgaauguuugagguuagcucucacagucacuuccauuguccuaaagacgaggcucuccuuagcuauuccuuguaugacauaauuuucagacccuuuuguguauucaguuagcuguaaaaacggucaugaacuuguguuggacuccacagacaauugagagcccuaaauuaccuaauuacuuauucuugguagucaauuuuauuuuguucucuuuuuuuuuuuuuuuuuuuuucguuucuuuuaaaaucugcucaggucaggcauuuccagcuaucugguuaucuuguacuggggucaaugugucuugcucauuucucuuaucucagagagaaacuguggacaucuggauucugguuacuuagcuagagcaucacacacucuuauguugaaguaaaauuuaucgacccucagaugucugaaauaaaagggguuuaaugaguggcucagggacaaauucugaagccuacaaaagcaaaaggguucaguagauggaaaugggcacuugggaacuaauagcccaaaaccucugugugugugugugugugugugugugugugugucugucugucugucugucugucugugcaugguugguuauauggauguuugugaguauaggcauaugugugugaaugcagguuuaugugugagugugauuauguggauguuugugagugagagcagguauguguguaugguuauguggaugcuuugugugaguacagguauaugugugugugugugugaauacagguuugugugagugugguuauguagguguggguguggaugugugggguuauguggaugcuugugugugaguacaggugugugugugugugugugugugugugugugugucugucugucugucugguuauguggauguuuaugugugaguauagagugugcauauaugguuauguagauguuugugugugagcacagaugugauauguauacgugaguacagguuugugugugagugugguuauguggauguuugugucugugaguacagggaucucucucucucucucucucucucucucucucucucucucucucucucucucucucucucuggauuccaaagguuuccuuccucaggcauggucccccuggcuuauuugucagugagccucaggaauuuggcugacucugccugccuccacagcucugggauuaaaagcaugccacccagccagacuuuuaaaaugcaggaaugacuuagaagucagaucuugcagggcaaaugcuuuaccuacagagccaucccucucugcaguccucagagcgcuuuguccuagggaagacuagcgaaggaagagucaguugaguacauuguguuuaccuggccauauuuagaggugagacugcaaggugcugaagggcuuggucugaguggcugggugcagagucccuaagaagcauugcugcuucuugcucacuagucugggacauuuauauauuaacagguuguggugccugggguacagccaccacagaugccaggucaguuuuaacuugcuuucaggaauguggaacuaucauguuaguucuggcugguagcuauuaauuaauucccuuaacucuugccuccucugauuuagauuugagauauuguagaaaaugccuuuuaaaaucacauauuacacagaaaacuuacucagaaucuacuagaaacacauuaagagcugcuuuccagaggaaccuucaaauaccucuucucagcuuaugaugcugagucacgccaggguaagggggcagcugcauggacugccucuguuugaauagcucuugcuucguuuauuaguaugggguccauuauucaaaacccguaugagcucaguugcuucgacucuaacaggauauucaaaaguauuuucagagagaguggugaggauucuuugcguuaacgauagacauggaagguuuaaccaagggccuggucucuggucaccuuucagaaaacugugguuuucaccugcuuugggaucccauguccagccugcccacucuucccccucccauuaccgcucgcugaguuccucuuguguucuaucugugguggucuuuucugugcagucuuggguucuggccccacagugagugacuggacacuaugaacagacucuuaucaguucugugcuuaacacagcugaugacugcucuuuguuuaaauccaucaucuaucacccagggcuuuauuggccccuuugacucuuggccacaucauuauuucgccuucccucgcaucacucucuauaccagacacaccuauuuguagcuggcaaaauauggccucuauuuccguugcuuucucuuugcaagggaagcugucaaacacagccacacuuaugcccugagaccaugcuuuccacggauggguuaggagucaguccuuggcaguccugggauuuaccuagcauauacuuuucuuauuacuugucaauuucaguugcuuccugaugacuugaggcccccgaaaggcugagauaggucugguuaacuauguauugagcagcagaggauaguuuuauaaauguuuguacuuguccuuuuucuguuaucaucuaacuaaaucuguuuuuuguugucuacaauagcuuauaaaaauacaaaugauucccaauuaaguaaaaaaaaaauaauuauuuuauuagcccuauaauguuuucacuuuuaauuguaaaaguauuaugggugguugcucuauuuuggggcagaguuugaauauccuugccuggugggcauucagguuggucuuuauugggccaaggcaacacuggaagcugaccagugacagaggcaaaugucuccaucuugaccagguuugaugcuauaaguacagagcugcugaacuggauuuugaaaucaaagacugccauucagaacacagagaugaaagaauauaagaagucgcaggagaccucaggaaugaaaaagaaauugaagguaaaauauacaaugaauaugccaggaaguaaaauaauucaucaggcuaauuuuacuauuggcacagagaugugccaggguccagaagcuauugcaaaauacauguagccacagauggcuuuuagagcuucaccguaaacaucagaucaccacauguaggagaaauuaaaaauguuuuccccuuuuccuccuuaaucguugaguuguauauacagucaucauuauugcccucuauguagauuuaaauuuacauggucugguacauaguaacuuaggacuuuguauuguuucagagauauucugcccuuguaucuaacaaagcauuuggcguauuaaaauuuccucaaaauauuuccuuuaaacaauacagcuuuuuuuaaaaagucgaucuuagaccaaaaauguuaauuuuaauuauuuccccuugauaaugaacucauaauuacagaacauauaaucuucccuucuaaaagaaucuaaaguugauauucacugucaucauuuuggaauuuucuuuuucagacguacugauucuccgagugcuagagaguggccaggaauugcguaguuuuuucauuacaguacuuuguagauaaacuuugaaauaccuaaagaaaaguuaagagggcacaaaauaugagguuuuaaaauaacaucagcguugcaucgagaagggaugcuuucaguguuuuauauuuggucuuuguuuccagggauuagagaaagaacagaaggaaaaucugccccgacuggacgaacugaaucaaaccggacaaacccuccgggagcaaaugggaaaaggugaggcccugcagggcuuuuuuuucccucucagauuauuuuagaaggucacacuuaauauuugcagcuuaacacacaaaacauuuaauacacaaagauagaaaaaagaucugguuuucaauuuuuuuuugaggcagcagaaucuuucaaaaacugaaaucuuauauugaagcuuuuuauuaaaaacagauaaaaucaaagucguucugcucccacuugggggucagaaaacuagaaaccuugaaaaccucagcagagcaauuaaaauccaacagugcacaagauuguaaaaccucaccuuugggguuacauacucugaauuuuucuuauacaugagggcacugagagaaauguuuaugcuggcaaugucuuagauaugaagucgccuuaagguaaacuuauucuaguuucauucugcugcugugacaaucaccaugacucagagcagcucgggaagaaccaguucguuucagcuuacaggucccaguccaucacugagggaagucagggugggaacucaagcaucugaaagcagaaaccauggaggaugcugcuuguuggcugccugguccuuacagccuaggaccuccugccuaaggaaugguguugcccacagugggcuggacucgucuacauuucuuuuucuuuucuuuuuuuuuuuuuuucuuuuuuuuuuuuuuuugagacagaguaucucuguguagcccuggcuguccuggcacucacuuuguagaccaggcuggccucgaacucaggaauuugucugccucugccucccgagugcugggauuaaaggcuugugccgccaccaccgccagccuguucuauauuucuuaaugaucaagacaauggcuacugugugauccucagucuaggaugucagaugaugcuaggcugugucagauggacaauuacagcuaucuaggacacuuauuaauguuugauauuuggucacguucggaggaucacauuaauauacucuagaaacauuuuucuacuuaaauuugauguuacuuguauucaaaaaauuuucaagcagcaaagacccuugcuccucacuaaagccuugcauagacacagagaaaccuaaaauuaguauuuucucuucuguggcuguuuaguuuggcauaugguuuuuuucuuuggugguacuggaccuuucuuccuucccucuuaagaaaagauguggcaggcugagaugucaaaggcuggggcauggguugcagucgggugagauucgcaugcugcuuuaggcccggguugaagggcagaaacuguagcgggcacacgccaguaggugcacauaggcaggagcagguaggacuggccaggcugacugcagaaacucccuccuugagaacucuagagggaggacaccacgaagcacacuuccugugcaccuguuccuucuucuaaaaauacuuagguugccugucagaugguugggucuuagcuccgccugcauggaaaucauggaucggcaagggaagggcuagucuucuguaggcagcuuuagcaucuguucacagcaguguauggccucagcaggcaggagcgacaucaggcagugcucucugauauuagccuucccacagugggacucuucuauaagcaucagaguuauugcuuaggccuaggaaguggggagccuucaucccaagagaguggcuggcuuuguuucuuguaaguggacauagcuguagggauuccucaaccuugggcaauggccaauauuauagcuucuguaccucuggugccuaacacucuuggcucuaaaggcuugacagcuuucugggucuauucugaggacugaugcuuguaguuucuucuuaaucucucucucucucucucucucucucucucucucucucucucucucucucucucucucucucuccauucccuccuccccucucucuuuccccuucccuucuucccucccucccucuuccucccucuccuccucccucuacccucucuugccuccaauuuauuuccaccuucucuccuacccugucuauuaucucacauccacugcauugcagcugugucuguggcuacauccccauugcugcugcucaggaccuggcuaccucagccuuugugccacugucaguagaggcucugccccuucugcagcuuggccugcuaauugcucuggucugucuuguugucagaugucuauuucgaaguuuagccuacuaguacugcucaguucuguauucccucucucuaucaucucuuuuucuaaaccccguuccucccuuucugccaacaccuccccugaacucacgucuguacuagggauauauugcauucaagacuuugcacacauaaguggucuccccugucuuuccugaagcugucaggcauccaguccccaucccuuggccacugcuggucugguucagggcugcuggcuuuacucuccagcugucacuucuugcugucucuguugcuccugucuuucuggcaugugcucagcucauccaccugacaguagacaauaaaagaccauacaggaaaagccuuuucuggaccuaauguuacauccugggaggguguaagaguauguuuuccagcuaguuccccaagugagccaaaccguccuaucauguagccagagaaaggguauuuguaucaauugcagcaaaccucaaaaauaaauaaagguugugccuauaccaaguguucuauuuguaccaaucacauuguuccauuuguaacaaucacauuaguguuuugaggccaaggaggaaaggccaaugugcguggaaaugugugcagugucaucuacuguuugcugaagcuagcaaaauguguaguucaaacucucaugguuggugcugcaccuucaggaguugggccuguguugcagccuugacugucaugugcguccccuaaggcaccuguggggccaucauuccgcguggcugaggccagcugaagggcagccugccuggccauuuuauugauaguccccuggcuugcagcagucaggagauucugggaguaucauuuggggaguuaggucaccccuucugucacauuuuuauuuaugggaaaaccaacaacagaaggaaugcuuaugauaggaacuuacuaacacucaugucagcuuuaaugguauuuaagagcucuucacauauuuauucaacuccugcccagggagaggugggacccacucgccugccuuugaaaguguucugugccuggcucugcccuugaucagagcuauaaacaaccaaggcacaauguggcagauuaguuauaccaaaucuuuaaaccaguaguuuuuuuuuacaucuuuaacuuugugugugugugaaucauuuugcaauuacugcuuuuggaaugaaauuuucuuuaugauuuauuucuauuguaugugcuuaaguauugccagcauguaaguaaguauuugaccacgccaaagcaccaucauaugcauguccauuguucacacaguugcuaagaaaauggugcuuuuucuuguccaugacuccguuagcagugauacuugcacauggacuguggugugaaugccuugcuuagguuuaauguccucuuagcagcuugcugguggaagugcccuugaacagcugaugugggugguaccuuucuaccauggugugcauguuuguaucucugauucuuaggagauguggugugacacaaaaccuuccaaauuuguauugcuggugagacagggguggcuucucaguuuccaugacauuuuccuuucauguuggguuuccaugacuguggauguugaucauauauguucacagagaagacucugcacuccuacucauauccugaagguguugagucucuccuuucagcaugugugucugccaaauagaguugguugcuguaguacaaucaauuuaaucuuauccccaacuagcuuacaaaugaaugagacucagagucugguuauuuuauuuagcuuugacaauucuuggggggggggcaccuauaaucugaucuucugacugcuggccuggcuaccuccccagagguguaccccagauaccuacucuuacuccuggaucugggcucacggccccccuagucucgucucucauggccccuucucugcucucccuccucuuuccaguucucccaugcucaaccagguaacuuaaaaaccugccuaccucugaucucuccagucaguggcuguagccccuuauauucaaccaguaguuuuaaguuaaggaacaaggucuacacaagaaaagcugguaguucacgggugggccuaggcuuucugguaaagaaucuagcauuacagugcauagcaacagaccaaaccuccacggauugccacuuuucuauaccaccucucacucacuuaacaaaagauuuaaugauaguuuauagcacuacaaaggguauggaaaguguuauuguuauagauaauuuuuuuaaaucaauucuaaggacauugcauagcuuucuaaaauuugagaaaaaaaauuuaagcuugucaguggcuggaaagauagcucuguggguaacgcuuuuugccaccaaaccuaaugacuuagauccuucccugggagccacacaguagaaagagagacauaauuccagcgcuuugucaucugaccuccaugugcaugccuuggcauguggcagcccccccaauacaaaauaaguaaauaaaucugggagcuuguaagaguaacauaauagaauaacauuuuuugagcugugucuccagaguagcuaccauuaucauuacuuuggcauuguuuguauuuacucauauauaauauuuauauaauauaauaauaauauguuuauauuuacucauauguguucagagugcuucguaggcuucuugaugcuuccugaaccuggcaucuaguuuaauguucuuacauguacccauuugcuugcaggcaaagggacuccugucaucuuuugucauccuagacuucagccagcucugaguucugcuagucuucugcuucauuuuccuauggcagaaggcguauauucugaugucugagcucugcacaaauucaggcauuugaguugauuugccugcaucagauuauaaguuagcagaguguuacagugucggggauggagacauggucuacagaagaggaacuaguggaugcuuuauagauauaccuuaugagauagccauaucaccucugaacucuuagcauuccuaacuccccuuaggucaaggaguuaaagcauauccaguuauuaguacaucauaaugguguaaaauagucauaucuaaggguaugaccuaaggguaugaccuaaggguaugacugaaagguaugaccucaggguaugaccuaaggguaugaccucaggguauggccuaaggguaugaccuaaggauauggccuaaggguaugacugaaagguaugaccuaaggguaugacugaaagguaugaccucaggguaugaccuaaggguauggccuaaggguaugaucuaaggauauggccuaaggguaugacugaaagguauggccuaaggguaugaccauuuuacguaacauugccuaaucuuucacuguguuagaugucuaggaccaauucuaagccacuuugguauuacuggaugaagugcuuugaugcaccuggaccuuuuuguuuccguagaaggccuuuccacugaagaaguaaacgauguucuggaaaggguuucguuggaguggaagaugauaucucagcagcuagaagaucugggaaggaagauccagcugcaggaagauauaaaugcuuauuuuaagcagcuugaugccauugaggagaccaucaaggagaaggaagaguggcugaggggcacacccauuucugaaucgccccggcagcccuugccaggcuuaaaggauucuugccagguagggugagaaauggcugcacuauaggacuguagagccuuucugggcugagucucuuauauaaaaagagaagauaucauucagugugucuggugagugggcuguguguguguguguguguguguguguguguguguguguguguggggugugcaucucuacucauggagaccuuucuggguugaaucucauauaugaagaggaaauaucauucaguauauguggugaaugaugcaugugugugugugagcacacauaucucuacucauggaugccagaagaggucagaggaggacauuaggugcccugcccuaccacacucuaccuuauuccuugagauacggucuuucacugaaccuggagccuggugucuaguaagucccagcugcccuccugucacugcccucccuuaauuccagggucgcagcagguggugauacccacauuuucacauggguucuggguauccagacucaggucuacaugauugcuuagcaagcgcucucacccacugagccguaucuguagcccgagaggcuguaucuccuaaaaggcaaaaggucucgaaaucugaagagaaagcagagagcgggggagcauggaucugguaucaugagcuuugucuuugcuucuuucauaacuguuuaugggaacgcucguauucauggagugaagugaccguauuuucucuuccucagagggaacugacagaucuccuuggccuucaccccagaauugagacgcugugugcaagcuguucagcccugaagucucagcccugugucccagguuuuguccagcaggguuuugacgaccuucgacaucauuaccaggcugugcggaaggcuuuagaggaauaccaacaacaacuagaaaaugguaaauauuggcucuccucugcugugugugugugucugucugucugucugucugucuuucugucucuguuucucugucucuguuccucugguucuccucuuaguuuuccuuaaaucuaaaauuacucccaauauuuccaccuuuagugugucuugaguuucauucuggcuucaugcuuucuucccugcaucccuguggcuugaaguauuauaauacauucagaccuggccagguggugguggcacaaaccuuuaauugcagcacuugggaggcaggggcaggggaagcagcagaggcagagggauaggcaaucugaguucgaggccagccuggucuauagagugaguuccgggagagccagggcuacacagagaaacccugucucaacaacaucccucccccaaacaaacaaacaaacaaacaaacaaccacccaacaaaccaagccagcuuggcaugcuguaaaacugcaugaguaggauauagugacuucugggagacuuugcuuucuuuugguggugauggguugaaccccagugccccaugcuugcuaggcacaugauuugcacuccagcccuuaaggagaauuuaaugggagaaaccacuuuguucucaucaaacaaaaacaucaucgauuucuguuugcucccagugguuaaggucuuaguagccccacucgauccuugaaagggaucauguugcuuuuccagaauuugaacaaaauugagcaagguagaauuggagacaguggaaugaagcugguucggguagcuggauuuggaaagcuuguaugucgcuuucugugucucgucagcugcugcccuggguugucaugugccaugugcucucugugcucugacugugaccuccaccauguuagcucccguacagcauguacaggcauuaggaaggcaugcauguuagacaaaggcaccauguuacuuuucucuugacugugcauuuggacuucaugcauuucacucauggaaaucuguuaacuuagugugacauuaaaaaccagagaagaugucuuucccggcugacccccgcaaaccaagcuuucccuuaugacgaggaucaggagugggcaguugaacucaugcugcuaauugguuucaccucuuggugcuucacauuucagcucacuuccucuuugguacaaaugcugauugucugggauuuguacagaggcacagagggauacucuguguuagcuggcuguugccagucaccccuguuucuuacggucuuaggguucccauguaguuuguguacacucaugggauuucaggaaggcugguggcagggucuucgcuucuguuuauucuuuggguaucauuugggggaggggagguugugugagacaaaaacgaauguuguccuucaagcuucauagagacauuucagcaugaucaaauggagaaaaaugcuagcgaguuaauaguucaaacaccagccucgagaggaaugaagccacggucugucugucugaaaugccagagggauggcuggucuuguuaagcaacagagagccuuuucaguuguaaucaggggaucuaauuuauuaucuacuggagucuccuuauuauauacagaagauuaauggugcagucgauaacaguagugaaguccuagcgcuguuuucccuaagcaagcauguucaauugucagagcugaagagccagccuggacccgcguauuuggacacacugaauacccugaaaaaaaugcuaagcgagucagaaaaggcggcccaggccucucugaaugcccugaacgaucccauagcgguggagcaggcccugcaggagaaaaagguaagcuguccuugggagcuuggccauuucugagaguuccuguuauguauuugaagugguuuuucagugauuaaaaaaaaugaccauuuuugaugaagucuuuuaagauuguuaaaaauuuguuacaaaaauugcagaguaaauguaauuuauuuuauuuuuuguuuauuauuuauuauuaguauuauuguagaggugggugugugcugagucagaggugggugugugcugaguccugaggacgacuuuggcaacuugguuuucucuuccacugugaauuccagggggagcguucauucaaucuuaagucuuguguggcugccaucuucaucuguggagucaaucugcaggccuaagaauuuauaauuuuaaacuuaauuaccuuaaauaauuuauuugagguccagaaagauauuaaguguuacugggaaacauuuacuuuuuuaaaucauuuaaauaaaauucuaaaccuguuccuaaucugcuagauauaucuccuaaaauaaugugagguguauuaggugaccugauuucuuucuuucuuuuuccucuuucucuuucuuuuuuuccucucucucuuuuuuucuuuucuuuucuuuucuuuucuuuucuuuucuuuucuuuucuuuuuuuucuuuuuuuuuuuuuuuugagacaagaguuuuacucuguaauacacacuggcugagaauugagugcagucuuccugccucagccucccacauucugggagccacuuaaauuauauugacuaaaccacucuccugcguccaguggccugaaggcucaaugccaauguuucuccacugugacccuguaacacaguuccucaugauguggugaccuccaaccaucguauuauuuucaaugcuaccucauaacuccaauuuugcuacuggaaugaaucauaauguaaaucuucgauaugcaaaauauaugauaugcaggcccugugaaaggguuguuagaccccuccaaaggagucucgccccucagauugagaaacacuguucuauacuacgguaccugauagaaaagaccaacugccgaccuugggcucuuguucuacacugugugugcuguuacaggguuuaauguacagaauccaugaugccacaccuacuuaugagaaaagaaagauuuuuauuuuuaaguaagauacccucuucuccauauauauguauauauauguuacuacaucugugcuaauacauauguacauuguuguggaugguuuuaaucucuugacacuuucguaggcccuugaugaaacccuugagaaucagaaacauacguuacauaagcuuucagaagaaacgaagacuuuggagaaaaauaugcuuccugauguggggaaaauguauaaacaagaauuugaugauguccaaggcagauggaauaaaguaaagaccaagguuuccagagacuuacacuugcucgaggaaaucacccccagacuccgagauuuugagguaaaucgagaggccaaucgauaggaguuuaggcuuguuucagggcacacagcgauaaucaugcaagacugggauaucugcuuucugaguucuuugcuuucuuccuugucccacguuuguuauaugcuuaaguugggauucauaauuugcuuaucagagauauuuuaaugugcuggcaagcacauguauuucuuuugccuuauagagagaaggcuucuugguagagguguacaagaccuuguugaggauguagcuuaguagcgguuaagauagacuuucaucuggggaucugcauggcccuaugaaccagugcucaaaguacagcggugacuaguuagaguggagcagguuaaccuaguuggaggcagagaauggagucggggacacaggggcaggcucucacauguccuaggcuggccuuaaaccaugcuaucuagucaaggauagccuugaacuucugacccuucagucaccucaagugcugagagugcaggugugugugccacugugccugccuuuuuuuuuuuuuuuuuuuuuuuugagacaggguuuuucugugcagcccuggcuguccuggaacucacuuuguagaccaggcuggccucgaacucaggaaucugccugccucugccucccaaguacugggaucaaaggugugcaccaccaccgccugugccugccuuuuaaaccuguggcagagguuaacuucagggucuuaucaugcuaaguaggcacucugccacacagcuucgaguguuccaacuacaagugagaggcuuuuacaaccuucugcugcauucacagaacauacauauuacaaugguaugaaugagaguuauacuugucugugauuguaacauuuuuugaugauggucacauugaccuaucagugauucucaaccagcaguguuuuugauuuuccccucacccuaagauauguguuagucuagagacaucuuugguugucacugacauggcaauaggggugagguagagcagugacaaacagaggcuuaguagccagggauguagcuagcuguuuuauggcacccagguuggcccucauagaggcagaacuguuuagucccaaaugucagaguucaagguugacccaugcugugugaacugauuuuauauuuucaaauuuaaauuuaguuaggggaauucaugagugacuccugaaaaguuuauuuucggguggguuagauguauguguuuuagcugcuuuccugaugcugggauaaacuauucugacuaaagaaucucggggugggagguguuuacacuucaugaucacggccuguugcuauggggagucagggaaggaacugaaguaggagccguggaggaacuugcugcuugcuggcuugcucucagaccuaugcuugccuaucuuuuuuauacaguccuagaucaucugccucgagaauggugccauccacaugucuggguccucucacgucuaagucaauuaguuaacaagcaagaguguuccccacagacaggcccauaggucaauuugaucugggcagucccucaguugagacucauugacucuuggcugagacaaguugacauuuuaaaauuaaaugggauggugugccaguauuugaauauggcaccuuuaguggccaguuugauacacacacacacacacacacacacacacaaacacacacacauacacacacaccauacacacacauacacacacaaacacacacauauccaucaaacacguggaucucuauucaacuauuugguauuacaguagcagacuuuaacaucuuguuauuuucuguuuuucuuuggugggucaucagcaagguuggugauaguauuuguauuuauuuuuuaauuguguaacuucaugcauguaacacauguaaguuuuuguuuuuguuuuucgagacaggguuucucuguguagcucuggcuguccuggaacucacuuuguagaccaggcuagagucgaacucagaaauccgacugccucugccucccaagugcugggauuaaaggcaugcaccaccaacacccggcguaacacauguaugacuucaaugcuaaaggccacgcuugcucucuuguuucaaacgaauugcuuguuaauucacuacucagaauucaugugggaaaacuucaaaguuucuucauaaaguuacaagauaauuguaguaaacacucacucacaggauaacuuuuuucuuuuuccaguguccugaugcauguuuuaguuuuuaagcucuauucuuuaaagccgugagcacaguggguauuagauucacugccaauuuauggaguuucuuugggauaagguaguggaauuguuugcuuaauuuaauuaaaucaauuaguugauuacuugagacugggcgucauuauguagaugaacuccccuugaggaucucgcuggucucuagcaaacagagauccaccuacuucugcuuccaaagugcugggauuaaaggugcacaggcaccuacugagccugguggaaaucagaagcugcugauuuuaaaaugcguuuuuaauccuauaugugaugcaugaagacugcuauugugcagauacugaauaauauaggaauacucauugccaacaguauucuuagucccaguucuaugucccguccuggcaggcuuguauucacagugaauguuugcagaauuuccauguacauacaguccgcacauacuacuaauuccaaucugggguguuuuguuuguuuguuuguuuguuuguuuguuuguuuguuuguuuuuucuguacuauagaauacacuacuguagauccugaugagggauuguuaagauaaaaggaaaguccauuuccccagguuccaaaaggcagaauggacagguggcuaucuguggcgucuguuagcauaccuaagcacaggcaggccuuugggcucccucagcaucagaaguaccagcuacacauuucaaaguccaugcuagcaucuuggugucucccacuuccuuucuuacugugacucccucuagcuaagaggcuuccuuuccaccagcuacacauucuguuuguuuguuuguuuauuuauuuaaauuaauuauuuuaucuauuuacaucccaaauguucccccucccccucccagaguucuuacucccauuccccuuccccuucuugucuaagagguugccucccaccccugcagacccccuucccaggggcaucaagucucugcaggaucaggugcaccuucucccacugaggccagacaaggcaguccucugcuacauacaugccgcaggccuggaccagccugugcuugcucuuugguugguggcucagucucuaggagcucccugggauucagguugacacauucucuuuauaacccaaccauuucagcuacacuuauucuuuugcccacucccuaucuucuguguuaaccuacccgccccacccccacccccuugugcuucuguuucucucauggccauguucagucugcuggccauguuuagucaacuacugucucucuccucucucugcucuggacucuuccagauacuucuggcuguguguucucucucucucucucccucucccccucccucccucucccucucccccucccucccucccucccucccucccucccucucccccucccucccucccuuccucuuccccucccucucucucucccucuuaucucauaaacaccauucccuuaugcauacuaagaagcagucauguugucaguuuauauguguggugcugaaaucugggaggagcacaguuggaccucuuuccaaaccacacuguugauuuaacucugguaagauauggaucauuuauuucugcuggcuucugccucccaccauauucaacucugaauuccagguucuaccuccugggcugcugcuuuucuccagcugcuucacuccccaggugcccucggcucccuccuaaagauuauuggaauccucccucugacagaguuccuguuugugacacuuuccccuccuuuucuaaucuuucccuccucagccucagagacauuccauucugucuugcugcaaauggucucaguccaacucaguuaauggccaaagauggcgcauuagauuuccaaauucucacagaccguagcaaguucucucacuucacgaacaaaugcuccccaaaucucuuaacucuaaacucucugugcucuauauaaaccuucccuuaaccauccauggaguggucauaccaucaguuuauacggacauuucaauaccuaauagagugcaaagcuuagaaagugacuccuccugcucagaaugaagucuuucaagagucuauagcacuuuuagaagcugaguuaaucgugguggugcuuagcuuccauccuccagcccugggauauuugcaagaagaguccccagguuugugucuguggucauaguugccucuuaguuucuuggcauuuguugacauuuccguugucuuuacagcuaauuccuuuuguacaggcuaagguuagacuagcccgcuauugucucccacagugcuaggcacaaacauggacuuaaagucuguucugugcuuugcuucacaauccaucaccucccuuccugguagcaagacauuugaaaaacaugaaacaggcauuuuuuucuuauugcuuucgguuaugaaucaugaguacaaaauaaaauccaaagaggccccuucuucucugauucuuucucucacacaggcaguaauaucuucgguuauuauggacugugauauguuuuauauuauuuccuuuccccuacucaagauccuacagugugggaauaccuggaacauuaccagcaugucugcaagugcccacuaaaccuaguuuugccucuuggcucugcccuccacuuuauaacaguuccaacucccgauucccagcaguuaccuuggaaauucaucuucccacugaagcaagggauggucugguuaucgucaucagaguaaaauguucacacuuuaucacacagucccugcccuuucuucuucuagcuugccuauuguccccacugugaguggcaucaaguugggagagaaucaugggucccaaaggacuacccuggacuguauugccuuccuguggacaugacacaccuacuuguuggaauauuauguuucccuggcugauuuauuuuuuaauguguacaguaguuuuuuuuuaaagcuuuauuauuuuauuuauuguauaugagugcucaaaugccauuacaaauggcaaccaccaugugguugcugggagagcaacuaugcuccuaaccacugagcuaccucuucagccccacccacuacccccacccaggcugagucucuaagaacaaacuucauggccagucaccagucuugcucagcaccaaaguacagccugaaccuuccucaccuuuucaugcucccauccacacccuguggaguuuuaucaacuuagagcucuguguuucuccuccccucccaggguaugagcucuuugaagauagaacucugcggggugcccagcaaguaagagggggugaauggcagugaucagaaugacucacucaguaggugugacucuaucagguagccuucccccucucuagugagcagucucagacccacuuauccucaaagaucacacagcccucugcuuguucucuuccuucaguugcucaaagucaaggacacucaccaaaccaagguguucugccccaggaugcugaaaagacauguggggacggggccauugaagacacaggauuugaaauuauuuuggaaguauuucagggucaagauaaggaagacgaacaucccguauuuagcuacuuuagucuuucuagagaauacaagccugauauaguaauuaaaauacuguccccuccccccaucauuuuuacucauuacaggaaacaaugggccauuccacaccuuggauuuagugacacagguuuagauguguugaugugguggcaauguuauucuuggccuuccucucugugacagaacaccguuuuuauaacagucuuuugaguaggguuaugguauccuugaaaccccagguagugucuguuacaggcuccagaaugucaccaaacugagcaaauuaggaagcucuuuacauuaaauuccuaugccaacucuauuuucaaagcugguuugucccugucccaggcagaaauuagcagcuugaggauccacauacauuccagcugaugggggagcaggaaagcaaaaaugccagcuauguggcuguaguccagaaugaggggcugcagugcacccucgagucucaggcucuccuguccagagcuuccaagcuuucaaaugcuucuaucuccagcucaggaggcgggcaggguaaggugcaaagggauuguuucauugacccuacauuucuccucugugaccugccccuggguguugcccgcucaagaaguuuucuggagggauggauggucaagguuuuuaaacauuuuccacauuccaaaggagaaucuuugguauuuuaagguccucuaaauaaccauguuauuagcaauuucaucguacuugaauauuuaugaguaaaaaugagaaugagaaaugauuacugucuuagaugaggaccgauuaauuuuuuuugcagacauuuuuauuagaaauuuacuggcaaugguguguguguaugugucagagagacagagacggguagacagggacagacacauacagacacagacacagaaagacagauagacagagaagaugugugugcuuaugagaauauguguggaggccagaggccagaugacuguauuugcacuguuuuuuaaaacaaggucucugggaccuggggcucccagguuaggcuacauugacuggccagugaaccccgggaaucuccuagcuucccaggaauuguaccuuuuaccagcaugucgguucugcaugucagucucagguccccaugcaugccaggaaagcaguuuacugacugagccaccucccgagcuucuccugggaacuuuaaaccaguuuauuuagcagaagagaaguuccuuaaagaacuuugugcgcguacauguguguguauucuuguguuuguucagcaaguuggauagaggcaaagaaaccauugcuguuguagacuguagacuccuaagcgcuuuaaagauuuauuuauuuuauguauaugaguacgcuguagcuauuuucagaugcaccagaagaggacaucagaucccauuacagaugguugugagccaucaugugguugcugggauuugaacucaggaccucuagaagagcagucagggcucuaaauggcugagccagcucuccaguccccccuaagcucuuuaguggugugguuuuuaaauggcuagagagauucucuuguuuuugugaauucuuucauguucuuugggacuuagcugaggaacuaaugugagagccagaguuuguaaguuuuagugacuguacauaagagauccaugaagccccuuguccagggacagauggagaaaugcuggagacugauuuuucuauaagauaacaagccacauguucugacuucccuuaacaaauuuguuccaccugacugcaccagauguguuugaucacucagaggcaggcaggagggacccuggcaggaagugcaccagcguguaugcuuaccucugauuggaucuggugagaaauaugcagccuuguagguuugcuuggaaaguuguaguggaaugugacuccauguccgaugaucccuggaauggaccugaccagaguccuucauccuggccaguauuucuuuaacgcuugcuucgaauuugguugaaaacuguucuaguggucuuagucuuguaccgugcauuaccacugacuacagaugagcuggcucgugguaucgaccggcaguuucugcuacaggaacaugagacgauuuuccuuccagggaaaaauagauagucuggggagugugaaagaggagcguggagcugggucucugcacccucugcaggcuggugguggcuggucuucaguagugaccccuugcuucauaguguggcuacagggcggugugucuacuaaaucugccccugcaaggcauuuucaaaguuuggacugguucccguuuccuugacuuuuuuucugcugagcucuuuaacuaugcccaucagauauagcacgauugagcuuucagcuggccauuuuccagggacuuuaaaauaguuauaggacugaacaaauguuaaugcugacagcaauaaaaaaggacaacaacaacaaaacaacaaccaacuaccugauuuuuagcaaacacaacuucacuguggcauuccugggcaucucugacaagaucuaaguucuaggauuuggaagcauuggcucucuaacgagguccucauuguuaauagugaggcagaugcuuucgugggugcuaaguguauguugcaugcauucguguggcgaucucugucccaacacugucugugauuuuucagaacaauuaaacacaguuguuauuguuguuauucugguuuuacaggugagcaacugaggugccaaaacagaauuaguuucuuacagccaugcuguuagcuggugagcucggcgucuccccaucauaggguacagggauuauaugucagauuuucuguagugagaagcagaaugccuguuuguugcuccgucucugauauuucuguggcuugugugugugugugucugcuacauucuccuuucuuuuuuuuuuccucagugaaacugagagcaagaaggaacggguguuccugggcugugugcccucaccggugucugggguugucugaggcgaggaagaggugacugagccccuaaaacuuccucucauuccccagugauggguuaaagcugucuauuuuagucagaggugacugugacuauuagcccucuugggguaugaggcaccucuauguguuacugaaaaaucuuagcugugaaacuguuuuccucuuucaaaauuagcuuugauggauuuccuaguuccucagaaauacuauguuauuuaggaguucagaauggagauuaacaaugcaaugggguaagcaggcaauuuuaaaaggcuuguuucauggaacaagauuuuauuuuuagugauuuauuuuuaaaucuuaugugccuaucugugaacuuguacaucuguacuuguaacaugggcaugcgguaccuauggggaccagaagagggcgcuagaucuucuggaguuggaauucaagacaguuaugcauugucuugggggugcugagaacagaacccugcuucucuguaagaguagugacuguuccugucugcugggguaucccuccagccccacuucuauuuuuauuagcauuuauuaauuauaaacaaugggcgccaugauuucacuuacaaauccuaacacucaaaagcaagaaacccaauugaaaccaaccaaccaaccaagcggacccaaaccauguacccaauagaaaauuguguuucuauguccacuuuccaaguagaggaaaguuaggaagagaaguugguaggaaaguggaaagguuaaaaguucuaauuauucuguuggcuuguugcugaucuauuuuuuaaacuucuguugucagcauaauaaaacaaaauuugguauuuauaaugaucaaguucuauagcuauucuauccauguuaagcaauguuugguaggggaagcuuauuuugagguaaauacugagaacacugggguuuuagucuucauguugcuccugauauauuuaagaacaaacaaguuuaacccaaaagaaucauuggacaaauucacgauaagaaaaaccuaaaaugguuuuaggugguauuuuauagguauaaccuauuuuauagauguaacuugccauaguuguaugucuuuacgauucauuccagcuucauaagaauauuaauaguugguuuuguuugguauauuauaggaauauaaaauauuuuuuguugucuccagaguacauggaucagaaugguuugugcauuacccggcuauauugcccuguaaaugucacaaaagaaggaauauuuagccuucccaggacuagggagacacaugguggucacuuucgaauuaaccauucagguuuauuucuauuucuaggcgugaucaagaguagaacugaaggggacucggagaaacauuaggggaauuagcaaggcagacuaaccaaugaagggacaggaggcuuuggggaaaauagccaaugcuuuaguacugaaguuuaaguguggcugcaguugacuucucuacagcuauuccuuugcgaucuccucucucaagccuacuuucuagaaaacguuugccuucucuuuguacuuauuaacuuugagugguuagaagaacugaaauaaaccagacaguggcuaguucuguuuucagagaaggagguaucccauggaagauuggagaguccugugucauguuccuucaugaugcugugugcuuacuccuaguuccaguaacuuccgagaaaaaauugcucuaaguuaguugaaagcaaaagauuuuuguuuaugcuuugacuaugacuagaguagcauuuuuuuuccuguaauuugaaucuuaguccuaaauauugcuugcauuuagauacaauaguuuauuccagaguggcuugagacugguggaugaccaccgcagugucauuuuuggaaacauuuccuugaggauaaacuaaagacuuuauuuuccaaguugggagacuucaaagaggaaaugaaacaaaugaaaacgauguuauugaguuuugagaaguugucucuuucuuuggucccaguagaucuugagauguccugggguuguaugucacugaguaauaugccccucuguuauuguguucaauuuaggcugauucagaagucauugagaagugggugaguggcaucaaagacuuccucaugaaagaacaggcugcucaaggagacgcugcugcgcugcagagccagcuugaccaaugugcugugagugccuccgcucuggcaauccuacuggaauaaauaacauucucuucucgcucuuugucacuugccauuauuaaaauuguaagaauagggcuuaugaagucuagauaaagagucuuuuauuguaaagcuuuuauuuuuacuucguagcuaauaaaggacagacagauugcucauauuauacugccgucugugguuauaggauucgugaugagaacaagagcaaauuuauuucuuuggaagcuguuuucuucuguuaagauugugaucuuaauguaaugauuaucacaagcaugcugcugccauuguagcacaugacgaaccuuucugagcagcauaucuagcaaaugaaaugugcuagcaacacaauuuauacuugagacucaccaggucucucuagagcagugguucucagccuuccgaaugcuguggccuuuaauacagucccucagaguguggcaaacaccaaccauaaaguuauuuucauugcuacuucaugacuguaauucugcuacuguuaugaaucauaauguaaauaucugguaugcaggcugucugauaugugacccuccccccacccccaaaggccuacagguugagaaccgcuacucuaaguuaauuaaaagucauacuucccacugagauucaaguaauucuaauuuaauuuuuagcgggcgacuguauuaaaugcuaggcaaaaugaguuucuugaagugagucaucucuuaaguagcugagaauccugaauaccagucacuauguccuugaaauauuugcaggauccagguagauaggugugauacugauguccacuuacaugggaguacacuuaacauggacuuaucuccuguauucagacguuugcuaaugaaaucgaaaccaucgagucaucucugaagaacaugagggaaguagagacuagccuucagagguguccagucacuggagucaagacauggguacaggcaagacuaguggauuaccaaucccaacuggagaaauucagcaaagaggugagcuuggcaccuucuuuaggaaggggacacacugucacuggcuucucuugaccacaaaaucaaaaccaaaaaauagugcucuacaauuuuuacaggacagcauaaaacacacuuaaagcacacaugcacagacacaugcauauauauauauauauauauauauauauauauauauguauauauauauauauauauauauauauauauauauaugugucuguguguauauauauacauguauauacauauacauacauauaucugugugugauguacacacauacaaacaauauucuuucauaguuuuaagauagauauuaaauauauauuaaagacauauauaaagauacauauaucuuauauauaauauauuuacuuauuuuauuuauuuauauacuacauauacauauaauauauaaagauauauaaagauauauuagguauauaaaauauguauauuaauauuaaguauauaagauauauuaaauaucuuaaauuaaaauauauuguaugaauuauauauauuuauuauauuaguauauuguauaaauuauauauguguguauauauacaaagacauauauauauauguauauauauguguguguguauauauauauaaaaauuaaggaagacuacugcuugcuuagugagacucaggacuguccuauucuuucuguuuucaacugaguuccacacauucauuuaugacacuugccuugccuugaggacauuucagugugguaucuacugauuauagcuauuaauccuuuaagcagcacauauuuauuaauuaggcauaauuaauaaauauaguguaguauuuucuuaauuagugucuguugcuaggcuucuuuguaugcucugggacacagaaaugaccagaggaaaaguuuuugcauuccuaugaggcaggugagcugucagggaggggcagccaagaauuaagagaagguagaguucuuggcaaucguuuagucagggaguugcucacauugggacauugcagaggucugagaguuggugacucuuggcuggagagaccauguuuguggucaggauagcacgugugagcuguaucccuugggaacagagacaggccuuggguggaggacaaugucagauggaaaacugaugcucuggguggcuccagagauuggcaaacggugugugcguucgugcguguguucuguguggauuguggugcucucugagugauaagaacccaggagcagaagcuuccuagcagcagguaacuggaugagaccuguucuggaaggauggagguggagguaacucugugcaugcaaaggcugcuucuuauuuuuccucuuuuuaaaauuuuagcuuuuaaaauucuuagugcccuuggggcaugggaagcagaagauaguaagagaggugaauaaagcuagaggcaugagucagguuaucugaguuaaaaaucaagcuuuaacuuuaacucaggagcgacuucggaugaccccaagaaaagugcauccccuggcgagguggggaaggaagugacaauggacagugggggagggaaugggaaggaacccuaugguggcaugauugaauguuuuguucuuguuuuagcccaacaucuucauuuugaacauauuuuaugaggagaaaaaucauacuaauccuacagagaaacacccauggaccuauuccaagauuuaucaguagcuaguuuuguauuauauuuucuauguaucucugaaaauaugcuucauacaggaacuugaaauuauugucauauauuauaauauaggcauuugucaagaugccaugauccaacucaagaaaauaaucuuuuuuuguaauaucacugaauacacuauccaaguuuguauuucuguaucugcuuuauaaucugacaguguaagcagcuggggauuuuaucuaaggaaauaaaggacaagcuuccuaagugacauugaggaauaagcaaccauguagcauccauucgucuacuuauccccugucuccuguauccaugcauuuauccaucuguccuucauccuccaucaucuucauccauccauugucuaccauuaccaucuccuaucugucacauccauccauccauccauccauccauccauccauccauccauccaucuacucaaguucaucuguucacccacuugcucauaacaauauaaaaucuacgguacagaaaguauuuagaucaguucuagacgguuuaucucacucacuaguaaaauuuaaaaaguuguauaguguguguguauguauacacacacacacacacacauauauauauacacacaaauguacuuaggaaacauaggucuaucuggggcuggagagauggguuagcaguuuagagcccuucagcucuugcugaagacccagguuccauuuccagcacccacauuggcaacauacaacagucuggaacuccauuuccaggugaccuugauuugcccgcuucuggccuuugugguuaggugaggagcucugaaaauauucccagacuccucugaaguacuucacaaaguuacacagucuguacacagacuguguacaggcaaaauaucccuacacacaaaauaaaaauaaguaaacacaggccaugucaaacuaaaauguacagaaaugugucucauguaugcuaccaugacagaauuuaacacuguccuaaaauaccaagucuauaguuaugaucuuguggauuuuauuuucaacuuuucuauggauccacuaaaaugauaauauuuauuguuguucaggaaauguaaaccaagagucuacauuuaugugacuacauugcauuuuacccccccccacacacacacacacuaugccauaguuuuaucaagagcugcuuaaaguguugagcaagggagaggagcacugugugcuauuguggcuucuccuagaagagucacacccuagcuugcggggugggcauggaaagaaaaguuccuugucuauuuuuaggccugugcuccuguuuggagggagggaacaggaaagccacuaaccauuccuuaacccacauuccugugagcccauccuguuccuggccuggccuccgguuucugucagcucuggccuccacucagacauguaauuugagcaggcuacuggacgugucaggggaagguuggacgauuccugugugacacgaucaucucuuucagccgaagugcauuugugguuaggugaggagcucugaaaauauucccagacuccucugaaguacuucauaaaguuacugagccagauucagacagauagcuauuuucaaauauauguucuacuuccuccuccuccuccuccuccuccuccuccuccuccuccuucuucuucuucucuccuucucuccuucuccucccccuccuuuuucuuuuacaaaacacuuuacuuaugugccuugguguuuugucugucuguaugucuguguauguagaguguuggauuuucuugaacuugaacuggaguuacaguuacagaggaguugugagccaucauguggggacugggaauugaaccugcauccucgggaagagcagcaagugcucuuaaccacugagccaucucuccaacgucuaucuucuacuuucuguuuuuuuuuuuuuaagauuuauguaugugaguacacuguaacuguacagaugguugugagccaccaugugguuguugggauuugaacucagguccuucggaagagcagucagugcucuuaaccacugagccaucucuccaguccuaccuucuacuuucuaaccaacauuuuauaggguaaugccuuguggacaucuuuuguaauaguucuuuucauccucaguuuuuuccccuuauuuuuaagaacauuuuuuugagaacaggucuucuucuguagagcaggcuagcccuggauuuacagagacacaccugcuucugccuuccaagggcugauauuacaagaaugugugacugugcccaacuccaggcucaguuuagaaugugaggccacaccaugggaauucugcuuccuguuuuauuuuuuauauaauagacaguguuacaauuaaauuacuugauguucauaccuuuaucgcuauaggugaagcuccuuaauguggaauuaaaaggucagaaaccuaguuaguuucugcugcuuaccuuucacaguguugggaguacagugcaggcugccagggagaaaaaacaccagcugugaacccuauuuucagaguuauauuagauaucuucuaguuagguucaugucuaaaauguuguauagaagucauuauauuuucauccuuucuuacauuacacagcaccagcacaggaugcuuuaaaaguuuuauuuaaauguuaaaaaauaagacuggaaaucuauugcagugccuuuaaauauuaaaggguagaacuuggcauuuaacguauuaaaauuuauuuauugaguggaauuggcguuuccuuccuagauugcuauucaaaaaagcaggcugucagauagucaagaaaaagcccugaacuugaaaaaggauuuggcugagaugcaggaguggauggcacaggcugaagaggacuaccuggagagggacuucgaguacaaaucuccagaagaacucgagagugcgguggaggaaaugaagguaaggccuuccucccgacugcccucuucacacuaguuagucuguuggucuuucaccuaucacacugcacagaacccuauggacaagucugcucucaguaggagugagugaugagcagcugugguaaucuuaguugggaaagaggcugaugccaguccacugguucaaguccaccccagaguagaucgauucugggaagucccuguggauagucauggagguuucugucucgaagaaggguugugaggagaaacucauuuuucuuuuauuauugcaauaaacacauauaauauaaauuuuuuuuuuacccuuuuagcaguuucuugguguauauuuuaugguguuaauucuagucaugguaccgugugacuucuaucacuguuuccaggaaguguaaguuuugguaaggagcaaaggagacuuggagguuauucuaguucuaauggguuucauucuagucauucgugggggcccagggaaccccagaaugucuuuggagcaggaggcaaaggcuacauucaagucaguauugggaguacaugggaaccccagaacaucccaggagcaggagguaggagauauagagucaguaaugagggcacauaggaaccccacaauguccuugagcagaaaucuuggcguauacagagaagauaaggugaagauaaguuggaguuacaagcugugguuccagaaacaucuauuccugugucaguaguuguccuuguauaaggaaagaacugggccucagacccacauuugccuccacuauccuucuagcaugagggcgugauucugucuuuaagagucauccuucuugucagguggugguggugguggggauacagcuuuaaccccaguacuucagaggcaggggcagaggggcagaggggcagaggggcagaggggcagaggggcagaggggcagaggggcagaggggcagagguagguggaucucuguguuugaggcuagucagucuacagagcaaguuucagagcagccagggcuacacggagaaauccuguccuuaaaaaaaaaauuaaaaaaaaaaaguacacuucucuuuguaaaagaucaaguaacaugguauauuguuaacuaguaguuauacuaccaauuaaguugguuaacucaacuaguaguauaacuaaggcaaacuuuucugugcagguaguuuuuaaaaagauucuaugugacauucaugcaugcuaucuugagucaguagauaugaaaagagacuuauuuaaucugugucggggaucaauauauauauaauuuucuuuuuucuaaaauuuuuuuuauuagguauuuuccucauuuacauuuccaaugcuaucccaaaagucccccauacccuccucccucacuccccuacccacccacucccaccucccggcccuggcgguccccugcacugagguacauaaaguuugcacgaccaaugggccucucuuuccacugauggccggcuaggccaucuucugcuauauaugcagcuagagacacuagcuucggggguacuggucauguagcucuuuuugaaaaguuuuaaaacuauuuuuaguacugaaaauauuuaaaaguagauuacuauguaaagaauggcuaacucauuuaucacucacacuuuuggagcugcaguuugcugcugauuuuaaaagucauuguaguugacagugaagaaaaaugagauuacaaucccugauugggcaacacucuauuuauuuuuauucuuuaaaacagccauuaggaauuuaaaagccacuacacuuaauuacuuuuucccucacccugggagagcugaaauccauuaagcaauaaagcaagcuaaaggggggagugaaagacggcugcagguagguuuuccugcaugugagacugagcaccuugggcaccgagagaaagccaggaagcagcuauuucuggaucagguuguccagaggagcuucuucaucuucauuauuggaaggauggauggacccauggucaaggaggaaaauguuuuuacaaggauuugugggccauuuuaauagaugccucugccacaguguccugccauuuugggggguguuuauuuauuucaauuuaauguguucagaccuccaguggucauuuaaaaugaguucauuuagauuccuacccugaguccagaauuuaaaaauauaucuugccaguagacacuauuuaggauaacuugccucuaaacucuggugguauuaaaaagaaacuguugugggcucggggaauuggaaacuagaagaguaagugagauuuuauuuuuagcauucuucuuucaaaaaacucagguuacagaauuuuuuaaauaguguucuacugaggcauauagaaucauuuaguuguuuugauauuggauuaaucauuauuauuauuuuuuaaagaaagauauuagucacagagagccauguuucaaauugcuccuuucuugggacagagggcaaaagaggaggugcugcagaaggaggugagggugaaaauucugaaggacagcaucaagcugguggcugccaaggugcccucugguggccaggaguugacgucggaauucaacgaggugcuggagagcuaccagcuucugugcaauagaauucgagggaagugccacacacuggagguaagagcuuguuugccccagggcuaccauccugagaucccagcucugcuguguggauuucccugucuuauuuaaaaaaaagaagaagaagaagaaagaaagcgccauuacuuugucaaacauuggauuauaaaaguaauuuuuauggaccaaguagauaaaaaaauagagagauuuuuguuuguuuuguguuaaaaggagaccaagaucugccugcauuucucaggagguucaauggugauaauugauccccgcagguuugugugcucacuaguguucucagguuaccauaagaauccagacagcucucuuuuaccuggcugacuguuauuuuauuuuuauuuugagucgugucuaauauuuacuggaggggaaaaagaauuucaguauguagagauuucauugcauuuuuagguggagaaucucacugccuaucagacugaagaccuagauuauucugugggauuauuuuaauaaagugcuuucucaucuucaugguuaaaaaaaaacuggucaaaagucuuaagaagcguuuugaguuauucaaauuuaaaugaaacacacccuacaauaagcaauuacauucuggugaguucugauaaugccgagggaagauuuaaacugaguuuacucauuguacuucuuguaagaucugagcagauuuuucggccugcuucuuguaagauuaaugggagaaggggacuagaaaucucuuucuucuuuugcucugaaccaagagucaacaaauuaugguagaggccucagguauaaauuguguaguuugagcuaggcaaugguguucuaugccuuuaaucccagcacccugaagggagaagcaucucugagcccaaggccagccuggccuacaccugaggucuggaacagccagggccacauagagaaacccugcccugaaaaaaaaaguugguuuuuuuugggggggggguagguuugguuaagagugguauuucuaaaggauugaacaugguguaaacaccuauacaccaaagaugaagcugugacaaacuauggaugucaccccuaaagucugaaauaccuucucugugccucucgagaaauaccggcugagcccuguucuggcgagcagagcugauguggggaauggaugggacugugcccuaccuugguagagaagacagaugcaggggauuuugugcagagcucuaaucuuagcagucagauaagauccucucuuguucuggagcaaggggauagaaggcucuaaaugcaugccuuccucggcuucucuccuacuucggaacucugaguagggagaacacaggacuaccuggcuccuguuuugguaaaaugggcccauccucuuaugugucuaucuuuacucacuuggaaagaaguccagauggcuacagagacaucugcucccaucagucaucuaggaacuggaauuggauauguccuaggagauuuaaguuucuauaaaaaaauauccugaaugguuuuuaccuuuugcucuuucuggggguguugcuguuguuguuguuguuggugguguuguuguuguuguuguuguuguuguuguugguguugguguugguguuguugguguuguuguuguuguuguugguguugguagugguggugguggugguguuguugguguugguguuguuguuguuguuggugguggugguguugguguuguuguuguuguuguuguuguuggugguggugguguugguagugguggugguguuggugguggugguggugguguuggugguguugguagugguggugguggugguggugguguuguuguugguguugguguugguguugguguugguguugguguugguguuggugguguugguggugguggugguggugguacuggggauuggacuuagggccuuugucaggcaaguacagguuguagccacugagcuaaaucuccggcucuaacauuuucuuuaaaacaaacaaacaaacaaacaaacaaacagaaaauguauuucucugcuguuuuuuuccccuauuaauuauucagguuuguuuuuuuuuuuaacauuuagccagguccuuggaacucauuuuacugaaaaccgaggcagcuucuuuuccauuuuuccuucuccuuccaucuuaauugcuccuauuuuauugaagauuuaguuuugccucauuuauuugauauucuagcuucgcugguuucuggauuccuguauauuacucacugaaauggaguucuuauugaucgaagggaugacguaugguuauggcuucucuuccguguuaauuuucccuucacauuuguuaggaggucuggucuugcuggguggagcugcuucacuaucuggaccuggagaccacgugguugaacaccuuggaggagcgcgugaggagcacggaggcccugccugagagggcagaagcuguucaugaagcucuggagguuggcaccugaugucugagccacaguuauuuucacugugaaugggaaagaugucugucugucugucugucugucugucugucugucuauccauccauccgugcauacaauaggauguguguugaggucagagcacaauuuguaaaaguuauuuucccccuugcaacauagaucccagggaucaaauccaggucguuaggguuuguggcaagcuccuuuugacccacugagccaucucaccggccccugggaacucuuuauaaucaguuuuguaaggcaggagcuacaugagugcauguuagacacagcgauagucacuaguaggguccaguucuuuucaccauucucugaacaaacccuguuuuguuucuuugcacuuaugacuauggcaugaaccaugcuucagguggcuucuucaucauucucagauguaaaaaguuaaagcaggcugcuaugugcauucgugaaggcaggggcucccacaguggggcuggaugacaaggcugggcuucaggcuccuggggccaagaaauaucccgaaggcuuccucguucuguaguuucgagcccaggaguacacacgauacugugguaauuacuucagaaacgaauuacaguguaaccaaagagguuucacuuguacaggaguaguagggaaauuuggggauccgaugaacagcagaaugggaagucagagagcuauucccagggggugggggugaauggggcuccauuccugaagauggaugccgugcagggagagaauugucacuucucaaacacagcagaguagaggaugcauagacagcauggaaaccacuacaugcccauugaacaaacagcaagcaugcuuuucucauagggcauaaauauacauucuagaaauccagacaauggagaaaaggaaaagaaggcuccaugauaaacacuuuaauacauucuguguucucuucucuucucucuucucucucccucacucccuuucuuucuuucagguuuauuuauauauauaugaguacacuguugcuuucuucagacacaccagaagaaagcaucagaucccacuacaggugguugugagccgccaugugguugcugggauuugaacucaggaccuuuggaagagcagucagugcucuuacccgcugagccaucucuccagcccccuguauuuuuucuuuauuaucagcauuccuuuugugcauguauacugcagggcaguaaaugcagucaaagggcuccuaguccuaagagcuucggaaagaguuuggagccuuaggauuuuuguuuguuuguuuguguuuuguuuuuguuuuuuuuuaauugacucucuuuugucaaauugaacuuuauggcuuucagauuucccaucuguagaaugggaguaguauuucaugcauaagguuaguuggacuugugucuauaaaacuguauacauagaaauacuuaguguauuucuguaucauaagguagaaaaauggaucucuaauuuuaccaauguaguuaauaacaugagauaauuuuauuuguagaguacaguuuuguaugucacacugagaguuucucauaaaauuaauaauuauucaaauuauuuuaugcauauguucuugaaguuuuuuuuuaaaguuuugugauuuuguuaaucuauaguggauaauuuugugaauuaguuauuuccuuaauauuugucauuacuuguuucuuaaauagauuucuagaaaguggaauuaauauuaaugcuuaaaauggcauuuugcagaucuugauccauuuagacccauugaauguauuuuuuccccugcccaacugcagucucuugagucuguuuugcgccauccggcggauaaucgcacccagauucgggaacuugggcagacucugauugaugguggaauccuggaugacauaaucagcgagaagcuggaggcuuuuaacagccgcuacgaagagcugagucacuuggugagaaccagacaugugcagugugauuagguaguuacugccacaagcuaacucugagagcucucucucuuacucggagcuuccgugcugguuacacuugguaauguauaaauugguccccauuagauaaugcuuugguguggugggaguuaaaguaggcaggcaauguuaaugggagcauaagggcuuugaaguaaguauagaagaauagaucuaauauuuguaggucagaugcagcuugaucaaacaaacaaacaaaagacaaacaaacauccaaauugccaggacaaggcauggugguauaugccuuuaauccaaaaacuuaagaggcagaggcaagaauaucucugagcuugaggcuagaauacucugcauagggagucuuaagccaggugaagcuacauaguaagguauuguuucaacaacccaaucccaagccaagccaaaccaagccaagccaaaaaugaaaccaaaccaaacuuugucagauacuggauguagcccagugguaaagcacuuuuguuguacacacaaggcuauguguuaaguucccaguuaccuucuaucuccaacaccucuuugagauuuauuucuauuugugaauuaugcaguuuucuguaagaauaguauuacagcuaugucuaagaauaauaacgucuauauguauguccuaauaacgauuagggccuuccgaauuugacauuaacuguuaugaaagcuacaucacucggcugaugcucagauuauaucucaacaugcauauccauaucagugauaagagaagggaccuuguucuuuuguaagaagguugaguugaucauuagauaacuauaccagauuaccaaguaacaacugcugagauuagacuaaaaauaucauugagcuuaauccaaagauguguggcaauuagugguuugacucacaugugcacuguuagaacuuguucucaauuuuagaaaaaaaaauuagguauuuauucacuugauagacauucuuacuaugucuuauuuuuuuuguuaggcauuggagauucuuaaaauugcuuuauauuucuaguaaaauaaaaaaauuagaaauuacaaauuuuacuaaguuuaagacauuuuguauaugugagugucugcauagauguuuaugucccauauaugcgucucauggucauguuguccagaagcggguaucugacccccuauagcuggagcacagauagucgugagccacccucacuaucuacuagggcaacaaguacccuuagccacugagccagucgccugaaauacacauuuuuuuucuauuuuauauguccuaugggggaaucuuuuuguacuuguauuuugucauaguauagguuaauagaaguaagaaugagagauucaggggcuggagagauggcucagcagauaaaagcacuggaugcucuccuugauucaauucccagcacccacaugguggcucucaacugucuuuagcuccugucccaggggauccgacacccucacauagacauacagguagucaaauuaccaauguauuuaaaaugaaaauaaauaaauaauucuuuuaaaaaugagagguucagcugcuguguccaugagauacuagaagaacauuugcacucuuauuaugaucguuauuaauuauuuauaagaagagcuacagucuugaaccaguacuuuauuauaaucugcauggccagaaggcacauucagcuauuuauauuugugcugagcaguuacaaaggaaaugucuccucugugcaggcggagagcaaacagauuucuuuggagaagcaacuccagguccuccgcgaaacugaccacaugcuucaggugcugaaggagagccugggggagcuggacaaacagcuuaccacauaccugacggacaggaucgaugccuuccaacugccacaggaagcucagguauugcugcaaagccgagagccuuugcgucuugagaaagggcagcuguagccugguccucacugccagagucaggaggacucuguauggaacagccuuugggugggggcuguucuuguuccuugugugagaacuugacacauuuucucccuaccauuuuaugcauaugggugucuggcuuacaugugcaucugugcacugugcucgugccuacugccuguggaugccagaagacagcagugaggccccuggaacuggaguuagacuguuguaaaccacccuguggggacugggaaaggaaccuagauccuuuggaagagcagcuggugcucuuaacagcugagccaucucuccagcuccuuucacacaguugauauguuagaaaauagauuucuuccuuucucucuuucucucuuucucucuuucucucuuucucucuuucucucuuuuucucuuucucuuucucucuuucucucuuucucucuuucucucuuucucucucucucucucucucucucucucucucucucuuuccuuccuuccuuccuuccuuccuuccuuccuuccuuccuuuguagcuauacaguucaggcaguuuauucuguauacaucagaugugaacauuaauaaugacaagcaaagaccuuagcaugugcauagcacacggugguguacugugcaacaguuuguuauuaucauguaucccacaagcuuauuaguguguauuagauauaggaucauauacuauacaacuaccuugaacuucuguauuauauuucuuccuguacuugguuguuguauaaagacauacugcuguauuccaacuguuguuauauaaaagcucacauguuguguaaaggcauacuguaacucgugcuugucugggacuuacuaugcagccaaggguggccuuaaacucagccauccuccagcugcagacuccagaaugcuaaggauuacaagcaugggccauuacccagggcuucuuuguguacuuuaaaaacacaccuucucccguuuuuuaucuucuugguagaagauccaagccgaaaucucagcccaugagcucacccuggaggagcugaggaagaaugugcgcucccagcccccgacguccccugagggcagggccaccagaggaggaagucagauggacaugcuacagguaaggacuggcuucccuuugcuuuuuauauaugguggguauagaaaagaaaagcagaaaggcuuaaggacuucgguaccuucgcucugugcuaugauucaaacaugggaugggagcggaguauuaaaggcucauggcaacaggaacagguuguuagcuggguaaggaaacuaugagcuuuaagaguuggcugagaagaggggaugaguucaggccagcaguugacuuuguguagaccauucucugaucucagaggcugaugucugggcacucagggccucaguagguagagggaaaugagcuuccacucuuaaugugguagaaggcaucugaggucuauguucaugaaaaagugaguaaaugaauggacuuucucauccagagacaccaucugucuccagauguaguuuggagacugaaauucugaguacugcucacucaugacaucgagcagugguucugaaccugugggaugugacccuuuugggggucgcauaucagaucuccucuguaucagauaauauauuaugauucauagcagucacugaauuaguuaugaaguagcagugaaauaguuuuaugguugggggcggggucaccacaacgugggaacuguguuaaagggaacauuagaaaggcuaagaacuacugcuuuauaugaccguccuaauuccucugggguuuccuggguuggccuguuuuuuuuuuuuuuugaaaagucuuucggcauuauguauuauaguaauaucuaguuagagcgaaagugaguggcuuacucuuauuucugcaaacagaggaaacuucgagaggucuccaccaaauuccagcuuuuccagaagcccgcaaauuucgagcagcggaugcuggacugcaagcguguguuggagggagugaaggccgagcuucauguccucgaugugagggauguggacccugacgucauucaggcccacuuggacaagugcauggugagccugaggcccagcaggcagcucacauggccagagcugcucugaugguuuaguauagagcaucccuucuuauucuuuaguucaggguauggagaugauggagacugugucagaacaaaaagaacuguggcucucccagaaaaaaaaauagacaguauaagaguaauaggggaguaugaaagcaacagguaugaucugugcagauaaaggaagcagauugcacauaaauaacauggauuuaaaaagaaagaaauguauaaacuacaacaugaagugggaaagaccucucugaaggaugcaacugauaaaugaaacuuuccacaauaaauuugaaguaccucuaauauuuggaauauuauagaguaaaaaaaauauuuugcuaggaaaaugacauucaagucaaaguuuaaacuucagaugggcagaaaugaaugacaaauaagaccuuacuauuccauuguuuguaguuaguuuaauagagguuuauaaauuuuauuuguuuuuuauuuuuuaaacaagugcucuaucugcauguaugccugcaugccagaagaucccauuacagaugguuaugagccaccaugugguugcugggaauugaacucagagccucuggaagagcagacagugcucuuaaccacugagccaucucgccagcccuaauagagaguuuuaaaugauguuguggggaggaccugaacuuagccuuauugugcccggugcucuucuaucuccugggaggagauauugguaggacugucuuuuccaugguuuguuucuuauguggguggaauagugcacagguaggagacguuugaaucacaugaaaguguuguaagcaucuguuugcucauugggacagaguagcagaugucacuguauuugacaucacagauacuggcuuuguauccuugaaguguuuugaguuggaugcucauguauggauaagcugccuagacagaguuuggggguucacggugacaaguacgaaggcaauuuggaauuugaccuguugaacuccaacuucauacucauauccauuuugacacuuuaaaguauuaaguguauuucagaauauaaauuauacucauuaugguacauuugucuucucugaggaauagaaacaaauaaauguuagggauuccacauucuuucgggcacagauugccagaggcaacugucuuccagucaccgguguuaggauuaaagaauucauucagugccgugaguugaaccaaggaccuugugcauaguaaacccaugcuuucucaguaaggagucugccaucccuacagugugguuccacacagagacauuccaguuugcauccuguaacuuuccaaaguuuuugaaggaaacaugguuacagugagcccuuauccaggauuucuacugacauuuaauacgcacgucuuguuuuauauuuaaacacacgcaaacucuauuaguuuauuaucugauuugaagaagcauuacaauccugacuucacuuaauucaaccuucaaaccauauucaagacagacagugugcccuuucauauccgggaugagguauuaucuguccagccacagaagcugugcucugaaaugaugccagucgggaauuuucuguuaacaauggaaauuuuuuuuccucuuuuuuaaagaaacuauauaaaacguugagugaagucaaacuugaaguugagacugucaucaaaacagggaggcacauuguccagaagcagcagacggacaacccgaaaagcauggacgaacagcuuacaucucugaaaguccucuacaaugaccugggcgcacagguggggggcgcuucucucucucuccucucucuauuuaucugucacccccucucccaacauuuaucaaauuuaaucuuuacuuguacaucaguaguauaaucguuauuaguuauauaaauauuuuuagauuacuuaauacaggaugauauuuauauuuuccauggccauuggcauaaguuauucuaaggaaacucaacaagguaauaguuucuguauaaacuuugguuuuggauaucuaaauucaguagguauguuaucaugucaggaucuaguaaauacuuggugguagguagucuaccgagacuaaaagcguccauuguauacuucaaugagugaguguuaagaguugguaggcaggccauuuucuguugcuaaaucccauagaaaaacuguccucugacuuugaggguuugcccugaaauuuagaguccaaagaauacgugaaauuagcuagggagaggauaugaugagggaaaaugaggcuacugagcaaguguuacggauuagcaaaacaaacuuuaaaauaagaagauaacaggugugauagguguauggcagggaugagcucugggaaaccaggaggguaguauuucaaagaugaguucagucauggcucugugaauauuguguucacuuaaaaaugcccuuugcaucuguugccuugggguuguuauugaauuuagcaagggaugugugagaagucaggcauagcaccacacucuaagaagcagcuuugaucauaugguaaaaguagacaguggauauuuagggaaguugguguguguguguaugugugugacaugagaguguuuaaaauguuuacccagaaggaaugguccuauaacuaagagggaagggagaauauccagguaaguuggggugugugugugagugagugagagagagagagagagagagagagagagagaagagaggagaugagaguguuuaaaauguuuaccaagaaggaaugguucuauagcuaaaagggaagggaugagcagucagguaaagccuuacaucuuccuauggucccuugcagaugcccuuagcccacauugaugagguugagaaaaagugugcauccuuauaaguugagcuuggaugcuuuucuuccugauacagaaaucuuugugagcacuaaguuuggugguacuuguggagcugcucgggcaugucagucagagaagcauucuguaauucaaguguuuacuauuuauuuuuuuaaagauuuauuuauuuacuuuaugcauaugaguacaccauugcucucuucaggcacaccagaagagggcaucagauccuauuacagaugguuuugagccaccaugugguugcugggaauugaacacaggaccucuggaagagcagucggugcucuuaaccacuaagccaucucuccagccccaaguguauacuauuuaaagucuguguucuggugcuauuuuuuuuuuguuuguuuguuuuguuuuguugguuuuuuuuguuuuuguuuuuguuuuucgagacaggguuucucuguauagugguggcuguccuggaacuuacucuguagaccaggcuggguucuggugcuauuaauugaguguuauggauucaguugaaccacacugugucuuucucauuguguccuugaccuccuuguuuacucugucucacaguguccuugguccccuuguuuaucuuugacucgcucaccaugucuuugacccccuuuuuaggugacagaagggaagcaagaccuggaaagagccucacagcuguccaggaagaugaagaaggaggcugccguccucucugaauggcucucugccacagaggcagaacuagugcagaaauccacaucagaaggcgugauuggugaccuggacacagaaaucuccugggcuaaagugaguuuuaguuggguuggacaugucccaucaguggcauuugcuuuggacaaucuggcuggacacugccucuauuucguauuaauuguaaccucugcucuucucccucccuuucuuucccucuucugugaucugggaagaacauuuugaauacaccuuguuucagagguuucucucuguaaccugggcugccaugcauucauugaauaucacacgcuggccguaaaucugcagaguuucucuucauuagcuucuccagugcuagggucaccaucaugugcaacuaugcucaguuaaaaccaggcauuuuaacaguacuuuuguguguguauguguguguguccguguaugcacaagugugucagugugaguauaaaugugugcauguguguuugugagugaguguguaugaaugagugugaguguucacauguguauuugugagugugugggagauucggugugaguguaugugaauuuguguguguguguguguguguguguguguguguguguguaggccugugguugaugucauauguccuucucaguugcuuucucugggucaaacucucauucugaacaugaaacuuacuguuuuggcuagacuugccagcaaacuccugucucuguuuuccccagugcuagaauucugcucucguuucugacuuuuuacagcagugugcaggaucagaacucagcucuucauuauucagcaagcacuuuaccaacugagcugccuccacagccccgauaaaacacuucauuucccuuccaaaagcgcugaaguccuaggagucaucaggcccuuuuuuuacauuaugcuuagguaguaucugaagauguuauauuaacaguuagccuccuuagcugggugugguggugcacaccuuuaauuccagaacuucgaaggcagaggcaaguagaccucagaguguucaagaguuccaggauagccagggcaauguagagagacccugucucaaaaaagaaaggaaaagaaacaacagaaaaaaauuaaucaccuguccaugacauuuucucccaguauucauucuauauucauauuauuuauauuuauaucucucuuucucucucucuuuuaucuaucucuagcuacauagcuaucacuaccuuuaucccuauaucuaucuaucuaucuaucuaucuaucuaucuaucuaucuaucuacuuauugcaaaauaacugaugcagaaaucauaaucacauaauguaaagcaaaacucacacaguuuccuuuagccuucuagcuauuuggaauaauuccuacuuaggaauuaacauguagcgucuuguuucugagcuggacacgggauuggauggaggccuucucuuuuccugaguuccuuuuguaugaaagacacaggcaugcuugagaaccuucgcaggauacacuggcugcagaaacauggacgacccaaagucucuccagugaacucuguaggguuuccugcgaccucugugagaagggacucgggcuuaaugacguaacucccacucgccugaacgcucaguggcagggacacuugggagaaagucaagcuguugcucugggaagaauauuccaguuucuaagacaguacauggaaaggagcucaugcucugugugugggggacaaggagcagagagagggauguggaaggaaaaggaacuugaaggucacugguguauucugacuggcugaaaaagaaaagaagccaaauugauuuuguuaacugugaucuuuguuuaguaugcugaaagcaauucuucucuucccuuggacagcuccaggcuccucccccugcucucgccccucccugugccaccauuccucuucuuuugagacuggguuucaccaugcaguucugaguggucuugaacucuugaugccucggcauccugauggugaggauuucaggccagugccaucagggccuggacacacugucuucuuuccuuauuaucucuacgacuuucacuguuucccagagaucacaaacucuccuuggcuuucugaguugcuaaagucacaguuuauguguaggaccuaaaauaaagucaaacacaagcuaacugugagcuuggcaguuugucuuucccucugcuuuucuaguguauguuagacaagccuacuccuaugguugguuguuuuuauugcccaauucuuccacucacagcuguuuaccacccuccauuuucauuauuaugcauaguucuaugaacaacauuccuauggcugauuuucagcauacauuuauaauuguuuccugaauguguuuuaguagcuggaaaaucuaaggccaaagaauacacccauuuuaaaucucaugugugcuucaagucugugccauagacagugcauuacaagcaccacauaugcaucaauuccucccuggauuuugaaaauacauucgaccgugguguacaaacacggucucugacuauccaguuagaaccuuuuccauggcuuauagaccaucgguagccccuauuugaaaaauauuuuuccuguaguuuugaccauuuuuaaauaaccagauuaaacugcuaauuuugauuucuucaucagacuuauuaaugcucgcuguguuguguaguauuuaagaaauuccuuucuuugucauugcgguucacuuccuguccuuauuauuuuuuuuaacacacacuuaagugugauuuuaaagaacagaauacucaguuccuuguuauuggugccuuccguuucagaagggcugccgugacccugagcuucuguggaauuucuucaugaucuuguguagucucaucccuucaacuuuaauguuuaauccuuagaggcuaauuugcucuauauuaggagagaggcucugaacuucuccccgaagaacaaacguaugcucccagguuugucggucugaguucugaguucuucucuagucuaacacaguaguuaauauaucauuguuguuuucuguuguacaauucuggucuucuacccucccccaguucccaaacugcugagugagucauuccguuagcuauuuuaauucucaguagaggguccuucucuuuaugauucucuucguggcuuauguacuuuuauagaaauaguccccauauuuguaaaauaacuuuuguguggauuuacuuuaaagcucuagacuuguuagaugagaacuuauguauuuugccuuuuguuucugugggggcuggagauuaaucccagguccuggcccaugccaugcgagugcccugccagccuugcuaaaucauuuauaaauaaauaaaacaaauauugguuguuauuguuguguauauacaugucugugugcgugcacauguaugugagagaauguaugagugaggcucacuugugccagggcauagaugugaaggucacagaauaacuuuuagaacuuggucuucucuuuccauauuuaugugcuuuccagggauggaacuuggauuuucagacuugaacagcaaaugccuuugucugcugagccauuaugcuggccucuagguguagcccaggcuggccucuaggugcagcccaggcuggccucuaggugcagcccaggcuggccucacccuggugauucucuugcuucagccucuuuagcacauccuacuagcacguaccaccacgacaggcuucaguccuuauuaaaaugcuaugucucacuuuccugaccuuucaguucuuuuacuuucccucauaauaucuuaauuuuuuccuguauaaacauuguguguauaugcguggguauauauauauguguguguguguauaugaauaaugcaucuauuuuauauuauuuuguuuuauuaccauauaaaugugcauuuuccuuuuuuuacugauugcuuuuauaugugugcauauauaauauauaggugagauugaguuguauauacuaauauuugaugauccuuuuuuucuggucucauaaguuccauuuuuuuguuaacuaucauuuuugaagacagacuauaaauagugguaagcuugugaaauauauaauuuugaauucccaacuaauuguuuuacagaucugacauaguuaggguggcaucuaggaagcacccagcacuuuccucucaguggggugggaggaacguugauguggagcauagccacccacuuuucuuuuucuaucaguuuauuuauuuauuuauuuauuuauuuacauccugauugcagcacccccccccccccccacucaaccccuucucuuauucuccuacccuuuuccucugagaaggaggaggccccucuggguacuaaccuacuguggcacaucaagucacugcaggacuaggcacauccucucccacugaggccagacaaggcagcucaguuaggggaacaggauccauaggaggcaacagagucagggacagccccgccucccguuguuaugagacccacgugaagaucaagcuguacaucugcuacauacaugcagguacccaggucuaggccauguaugcucuuuggugauugcccaccuuuucaaugauaugucuuaagauuuaaaaccauuaaagauuuagaagauauuuuaguuucauaaauuaaauauuaugugcaauauuuaaaugcagaauuuaagugguguuuuuauuuguggauguaagugggaaauuuauuccauacauucaauauuauuuuaaacacuuuuuaccauaaaacccaccagacuuguguauguauuauuuaaacuuaauuacuugucuguaguuauuuuuuaugguucuuccagccaauuuuagucaguuacuacagaaccacugaaggagcgcagaaagucugaacuacacagaguacauuuguaauagacuuuuucucucauuuaggggaagaguaggagcaggaaauacccgacugccuuucaaaugcgucucuaagugucaugaccaaggcaguguuucagccuugacucccuuguggguuugugauuuguauccauucagaaaugugauuuucagcaguguucacauaagaacuugaauuccuugaagugauuucuuuaaauguugauuuaagaacccguaccacagggagguggcucaguggccaagagcacuugcugcucuugcagaagaccaguguuucauuuugaggacccaauaucagcguguaacuuuaggucuggaacaucuggugguccucaagggcacacgcacaccucuguccucaagggcauacacauacacacaugaacacuuaaauaaacucacacacguacacuuaaauaaacagaaauaugaaaaguacuuuuugaaaaaggaacaacaguugaggaguaagggggccacggguguuuccauaugucauuucaggauaguuugcauuuucagcaugauuugaauuucugugaaugugcacuuuccuggugagccuucacgugugugugagucccggggccauuuucccuccuggaguguucccacugcaaggcaugaagcugauguucaaagcuucuauuuuccugguucuccuuugauuuacuuaagcuguauuucccaucugaauuucuuucuuuuuuuuuucucuccauuuuuaauauuuagcauuaguaucaucacucacgucucaggacauguguaauauuucuuuuuuuuaauuaaauauuuucuucauuuacauuucaaaugcuguuccuaaagucccuuauacccucccccacccugcuccccaacccacccacuccugcuuccugacccuggcauuccccuguacuggagaauaugaucuucacaagaccaagggccucuccucccauugauggcugacuaggccaucuuuugauacauaugcagcuagagacaagagcuccgggguacugguuaguucauauuguuguuccaccuauaggguugcagacccuuuagcuccuuggguaauuucucuagcuccuccauugaggguccuguguuccauucaauagaugacugugagcauccacuucuauauuugccaggcacuagcauagccucacaagagacagcuauaucaggguccugucagcaaaaucuugcugggauaugcaguagugucuugguuugguggcuguuuaugugauggauccccaggugggguaguguccuuacgucucagcucaaaacuuugucucuguaacugccuucauggguauuuuguuccccguucuaaggaggaaugaaguauccacacuuuggucuucucaucuauuaaaaacaauaaauuuaugaaauuauuaggcaaauggauggaucuggaggauaucauccugagugagauaacccaaucacaaaaaaacucacaugauaugcacucacugauaaguggauauuagcccagaaacuuagaauacccaagauacaauuugaaaaacacaugaaacucaagaagaaggaaggccuaucugaauuucuuaugucuuuucagauucaccuacuuaaccauuucaguuuuuuuuauggcuugagaguugcaaugugucagagaguugaguuuuauaaaccuuuaagguauugcaaguuaucuagaaaccauugacucguuauugcuggaaaaaaaaaagcuaaagaacaaaccacaauacauaagguuagguaaauguuaguguguucugaaagucaaguggguuuuuuuuuuuuucuuuuuccuuuuucuucuagaguauucucaaggaucuggaaaagaggaaaguugacuuaaauggcauuacagagagcagugccgcccuucagcacuuggucuugggcagugagucuguucuggaagagaaccucugugugcucaaugcuggauggagccgagugcggacguggaccgaagacuggugcaacaccuugcugguaagaugccagaacaugccugccacuggggaugucuucucuaaguagcugcauuggaaagcaugcggcccucguuagggcucugugugugucugcuuugcuucgcuugugcguuagguuuauuauuuuauuuuucuacugaaaagauaccaaaaagaagaauuuacagcaccucugauaaaagucaaauauucaugccaaacacaggggccauguuacuuaauauuuuaguaaacauaguuuuguuuuaaugauaagaguauuugcuaguauaaucauaauauauaauuuauacauacauaugcacauguauguagaaauguauauuuauauacacacagucuucacagugucuuaguuauauacuagcacagauaaaggguuaucccagacauugcugccuguaaaauucuugacuacuaccucagugaaguuacuuacaaacucuauucuuucuuuuucucaucuacaaaaugggcguuauuaucauuucuaccuuguaugauuuuauaauaauuaaaugacuuaaaauguguagugguauuauauaacaauauguuaaacacccuauuauuuucuuuuaauuauaacuauuccacuuucauaguguuuccuggcuacuucuaccaaugauuaacauauggcagccccuaucucugaagugagaguuacaauuuauaaguuauuacuuuauucuagcacaucagauaggacuuuaacucaguuauuuccccaguaauggauuggcauagauauaagaauaagugaucuguuugggauuuuuuuuuuuuucaaaucaguuaggauauacagggcagaggagcucaugugcuuaggucuugauugaucagagguuuauauucuaguccaugacucauuacuguuauaacuuuaugcaaauucuguaauauaauacaucaccacauaccaauguagagagaaaaguaaagcuaaagcuggccauggugauacauaccuguaaucccagaauuuaagagaccaaaacaagagucucuaaugauaaaggucaauuuacauagcaaggcucugucucaaaaacgccaaaaaaacaaaacccccaaaacccaauaccccuucuccccucagaauagucacaccugguagcacaggcuuguaagccugcugcuuggaugacugaggcaggaggaucacaacuugaaggucuucuugggcuauauaguaaauucaaggauagccuaaauaauuuaaaauaaaaaguaagaagaggccugaggucauauucaguugcgcaguguaugaggcccuaugcucagucugcagaacuuuaaagcagucgccccucccuccaaaauaaccccaaaccaaaacaaaccaagugaaaguauguagcaaacuucguucuuuguugacacgauugugugacaugcagcaugcucuuugauggccucuucaaucucuacuaagauugccaucuuaauauuucauuuaaagcucaucagcaccaucuuauuccuuugcagaaccaucaaaaccagcuggagcuauuugauggacacgucgcucacaucaguaccuggcucuaucaagccgaagcucugcuggaugagaucgaaaagaaaccagcgaguaaacaggaagaaauugugaagguagucagccucaugagucccgcaggcuaauuugcuguucucuugugccgugugcugucagcagugugugugguguucucaagcaguuugcuuuuuggugggagaaaccaagaucaccauggguuucuaugaccaccacauccucuggugcugagagucuuccuagcaaucucagauguuuauuucaaauaccuuuaauucauaguaagcaucuugugugcuuggaauaauauucuucucucucucucccucccuccuucccucccccccucccucccuccuuuuacuaucagcguuuacugucugaauuggaugaugccagccuccagguugagaauguucgggaacaagccaucaucuuggugaaugcucguggaagcgccagcagggaacucguggaaccaaaauuagccgagcugagcaggaacuuugaaaaggugucccagcacauaaagagcgcccgagugagugcuugcauuuguauaggaugccauuucuccccaugguuuauguauaaugguacauaauuuuguucaagccuauuaauuuguaaaugaauuuuaauaacuguuuggcaaagcaacugcuguuacuuaugugugauuguugauauaagaaaauauuguuuaguaaauaacucacccaggacaggcuucagagccaguugacagucgggauagaaagagaauagaaauaagucauuucccaacugacacaugauuaucaauuccugauccuaaaugcauccuuuuaauguauguguuuauagaaaauacauguguguguauguguuuauauguugacagauuuaaauguuauaaguuauagacucacaguuuguaguucacagggaaauuuucugaauucgcuaauuugaaaacgcuuuaucaauuaaaagaagggucauaaauaacagcugucauuacaaaauggugucuguacuacucuauuauuuuuucagccccccuguaucuuucccaucccccccucuguuauucuuuauuuucagaggggggcaggagacaagcuuuacuguagaguucucaaggccgagcacagauggagcuugaguaaaugugagguggaaacgaugcaagcauuuucucagcuuagagggagagcgguggaccugagaugcccaugcugagggaucacaggaugcugagcguuuuauauaaucucaucugugcacaucugguggcacuuuaaagaaguagucaauugaaccucuuggcaguuaucuauugaaauaacaaagagaaaagaucguuuguuuuauaugugugcaggaaguaaguuuuaccuaacuuuguuuuaacuuaaaauaucugguauagugagccacacuuuuuucuaugccccagcauauaauuauucacgacuuaaaacaauacagucagaccuuccuugagcauuugucuucuuuaaucuuggcuuugccuccuuauuguaugacuuaauuccauuuuauuuguuuaaauagauucaugggaggguuuuuuuuuuuuuuugacauuaaaaacuaagcaaaggacggugcuaagagaaauaauaaagaaaauuagcauugccccucaaaugaccuuugcaaaccacucuguugcuuaacaauuuuuacucacugaugcaugauuccaaaauauaaaaaaaaaaaaaauuauagcauucuguacaugcucccuugaaauggauuuuaacaguaauguucuaugggcuguuauaauuugcuagguuaacuuugugaauauugggcccuugggaauguugucuuuguuaaaaucaucuuacucguaucugcuggcucaucucuuacuauucugcugguaucggauuuuagaauccauugaguuguugcagaggguguagagggccguuccaaacacuuucagcaggggcuaguggaaaaucugugcagguuaagaagugagacugcuaccuucuucauagacgcuggauguuuuauucauuuauuuuuauuaaaauggccauuuuuacuuuuauuuucccaaaugugauguuuuucucuauagaugugaaaauguggcauuuggaaauacaaaucuuuuugagguucugucauuaaaacacccaagggguguucuucuuggugggcauguaugggaggcguucucuagggucuccuugcacccuggagugaggacuggccauuguuucuuucauggcuuguggcagggaugguucacaucacggcccuguaggauguucaccuuggcagcugcccuacugugcucgaagcagccacagggaacggaaugcacuuuacauuccuggcuccagauugaaaaaugagcaguucgaguacacccagguugcccuaagucauugcucugugaugaaugaccuugaagucauuucagauaaaugcugguuucugcugugacccugccucucgggaugauuuuagaaaaucaacucucagaagccucuuuuccuucccuagaugcugauuggucaggacccuucauccuaccaaggcuuggacccugcuggaacuguucaagcugcugagucuuucucugacuuggaaaacuuagaacaagacauagaaaacauguugaaaguuguggaaaagcacuuggaccccaauaacgaugagaagguagguggucugcaaacccuacccucguuuuuuuuuuuuuuuucucuccuuaacaauauggauucauuugcuugacccaccacauguaacugaaguaauccagaugugauuuaugagagucacugccgaagcugucagguaacucaugcaaugcuugaaguucacauacaacgcucaucuaaccccaacauugggaggcagaugcaggaggaaucccaguuccugaucuucucuagcgauagagcaaguaugaggauagccugggcuacaagaaacaaacaaacaaacaaacaaacaaacaaacaaacaaacaagcaaacacuaauggugguggugaugaugaugaugaugaagagcaacaggagaaagaggaagggcaggaggagaagaaggagaggaaacagugguaguagcagcuccacccccuccuuccugacuagcuguaaucauuagcuacguuuugauaaauuagcuuugggauauuugauuuuccaauauaaaguauuugaagaaaaucaagagcaguugugucauucaggccgauguggcuugacccacacugcccugucugucucagcauaguucuuaacacugaacaauggagaguacgaaguuugucuguguauuuuuguuuucaguaauuuucuuucuuuaaauauuuagauggaugaggagcaagcccagauugaggaaguucuacaaagaggggagcauuuguuacaugaaccuauggaggacaguaagaaagaaaagauccgcuugcaguuguuacuuuugcauacucguuacaacaaaauuaagguagguugcuguggucuccgcagcaaagaaauaacuuacccaguuguaccauccaggcuggggauguaauauuuaaagacacaagcaauauucaagcaaaucaccuagggaaauuauauauuucccccucacugucuuuuuaaguuuaaguaauuacugcuuauuuuuuggaguuaggauuggauccuauuccugguguauauuauagguuauuugggaauuucccaucaugcacucugaucacacgcacuucccaguccucccaugucugcucccuuaaauguaaaaaaaaaaaacaaaccaaaaaccaaaacaaagacaaggggaggaaguggggggggggagagaggaagagaggaagagaggggagggaaggggaggaaaaagacccucagaccauuuuguguuaaacuuacuugugcauggucuagucccaaugagaaagggaaacugaguccuuccccacccuugccagaagccaucaguuguggagagcuacauuucagcauccuuaucacagcuuucaaaacuucucuuugauggcuaccuucuuaggcuauuaauuuuuuagggguaggguggagguagggguugucccagaagccucgguguuccucuuuuucaacugugcaucugcagacauugaaaauacggcaagaguaauauccuugugguguuuuaagugaugcuguuccccagagcucuauuuuuugguaguucuuccugaaaugaguuuuauuugaucacuucggaaucugaguggaguccugugccuuggcuugcugucuaccagcugucucugacugcacgugccuuguuguacgauccaauggaaguugccauuggugucguccacuuuccccauuucccuucuuagucuauccucuuaaaaaaauagcccgucuguguagauggaggaaacuucauuaccauccucaccuauuuuccuguucauuacaggaagcaggacuuacaacgauuaggcuuuggacugaggauaguggucugggaagugugugucucacacguaugaggaccugagcugucuuaguucagucuccagucucaguuuauguaaaaauguuaagcaugguggcacagugcugugaucccagugcuggaguggcagacaggaggaucccagggcucuguagaccaagcagucucaccuaauuggugagcucuagccaugagaccaaugaaagacccuuccucaguggguggguggugguccugagguugccuuuuggcaugaaaguggcagacugcugaugaaagcugaggcagcuuguggaguuucuguagcaaugaagguuaaaagaagaaaacuuauauugaauguuauuuuuauuagcauuuauuaauugugugauaaugguuucauugugacauuuugugcauguacauaguguguuuugaucauaaucaccugacuuguguuucuuacaacuuugguugacauucugggauucuucaacccccccacccccaauuuguuguuacuuucauggggggggguuaacauaccugcauuaauauuuuuuuugaaucuuuuaauagacaaucccuauccagcagagaaaaacaauuccaguuucuucuggaauuacaucaucagcccucccugcagauuauuugguugaaauuaauaaaauuuuacucacucuggaugacauugaauuaucacuuaauaugccggagcuaaacaccacugucuacaaagacuucucuuuccaggaagacucucugaagguaaaaauccaagugcggaauguccguugccauuguuaauagaaaaaguacagaaacaaggccaaucuccggcucuuccuguuuugccuuuucccucccccucucucccuccuccccucccucccucucuucuuuccuccuacccucucuccuucccucccucuuucucucuuuccuccuccguuuuaaccuuuucccuccuucccucccuucuuuucuuuuuuccuuuccccucaucuuuuuaaagacagggcuuccuuagauaguccaggcuaauuggaugcucacccuccuuuucuugccuguggagagcugagauuacaggcaugauugccgugcucagauggaaguugcucuuguacuuauuuagauaauccaaaucuuugauuacuccaaauuagcaacaacaguguauaaauagugagauuuuacuguauucccugguaggaugcagcauuuuuuuuuuucaauuuaaaaagcaucuaggucuggacucuuaugaaugcacauuuauuugcaacagcagagaucuaauuuuaaucugauguaaacucgauugucauuugugucaaaugaugucaggucauccauauugauucgagauuggcuaguugccccguuguggaauugcguauugauugcaaguuaacauuuugaguucuuugaaaguuuuuucccauguauuugauuguacuucuauauaaagaugucguauuauuucugauagauucaauaauuuauuuucucauuuaagcuacagugauuaggcauuuaaaacuauaauucuagaagugucuccuuuuuuuuuuuuucaccuacauaguauguuaguaaagcuaccuuuccuguauccugccuugaagccggucaggacaucuaggagggugccuucccauucgccauugugaugguauuccucacauuuuggugacucugagauuuuuauauagaaaaguccauaagaaaaccaacagcggcaacuaaccuggacccuugggggcucccagagaccgaaccaucaaacaaagagcaagcacaggcuggaccuaccccccacccccaaauguuacagaugugcagcuugguuugacaauugucugaccucagugggagaagaugcaccuaguccugcagugacuugauguaccaggguggggggauacccagguggggcaucccccuucucagaaaagaaugggagugggauugaggaaaguagccaugcaagggucaccaggaggaggggugaaugcaauuaggauguaaagugaagaaauaaauugaaaaaaauagaauccccucauuugcacacagaacaguaauuagccccacuauuacuuuaaaugagugucauacauguaacucuuuaucugugguucugguguuuuguacaaugaugcguuugcagaguaucaaaggucaacuggacagacuuggagagcagauugcaguuguucacgagaagcagccggaugucaucguggaagccucuggcccugaggccauucagaucagggacaugcucgcucagcugaaugcaaaaugggaccgagugaauagaguguacagugaucggagaggguaggugugaacuaagugaauaguuaucucuaagucacacgaguaccaggccaugcagcguugacagaguccaagugugcauuaggaucauggaaaccauuuuucauguauuucuaauaugacaugauuaauaaauagagaugagcuucauuccuuaaagagaaauguguccacaggcacacagccauuaagcacauaauaccuuaaugauaugggggcaccuuuaguuuuuagcuuaaaaauaauucucccuuuuaauuagaaaggauuuuauuaauguuccuuucucccacacggcaugauuaaugugaaugaggaacagaagcagcuucagguaauuggaauucauauauaaccacaggcccguucuucccgguuuuucugcucuauaaccuucugcuucauaggauguuucggaguuuuuuuuuuuuuuuuuccuguuguuuuuagacuucgaacagggaccugugaauaggaguaaagaaaaaugagugugaucccccccccccccccaguagcugugaauguaguuaaaugcaaauacaacaugaaauagcccaacaacaacaacaacaaaaauaacauguaauggagaauuuacuauagagcaauacauugcaaguauucagauacgaaagcaaggaaucauaugguuaaaauuuuuuuaauucaugugacuguuuaaucagugaagaaguaugccuuaaugaucuuuguugcuauguaaauuuauaauauggucucuuuguguaguuagugaacauucuuuuguacauuuauauauauguguguguauauguguguguguguguauuuuuguuguuguuguuuguuuguuuguuagaacugguauaguaguuacuuucuucauuggugacacaaauguugaucaaagcaccuuaaaaaggaaggguuguuuugguuuaugguuucaggacacacacuucgcauaacaggcaagacaugaucacaggagaaggagguuggcuggucacauuucaucagcaaucaggaaguguagagagaacagaaaguaggauaaaauaaaaccugaaagccuccaccaagcuaugugcuucuuccagugaggcucugucuucuaaagauucuccaaacagcgccaccugcuggugacuauguguucuaacacacgagccuaugggugacauuucacauucaaaucacagcacuugguuauuacaugaagacaauuaaaaaagcaagauguugaaacucgauuuguauuauaacaugaacuuggcuacuguacccugccagggauauuuauaaacucacccuuccuuuagaagccuggcuauuauuggcaggaauauuucuccaauauuacagugauagcuucauuguugucuuucuuuacugugcucucaaugggacuugaaguuucuuugugcccaguaauggcucaucuuugaaaccaagggaguaauacuuacuguuuaaaauuguuuuucuaacuggaagauauuauuuauguauauuuuuguuuauuugugaguauuuacagccuuuuguaugucacucaaaauggccuguacccuuugacguagagccaacuuaguuuuaugaaauuauaucuuauaguuguuuccuuuaugauuguauacaguuaacaaaacuuacauauccauuccuuacauuugcugugucugaggaaauaauaauguaugguuuggaaacaaucuuaguugcuugguuuugauuuugguaugaccucuguucagggcccagcucaggagccuuuguaccacagcuucaguaccaugagucugugcaugcaccucuacuuuccaaaaacccuuaagcaacuuuuugugcaucucuagauaaauauuuaccagcucuaauuugccucauuguucuuaaagaaaugaccaaugucuccccauaaguuuucauuguccuuauaguuagcaaaaaaugucauaauuuaaaguuauguuauuguguauuaauuuaguggugcuaauuaugcuuugaugcaccauucauuuuaacuaaaugcuauauuuuuauuuguaauuuguaaaauuucccuucaauguuccagaacaguuacucuuuuuuggccuucguuuuaacuuguuuuuacuuuguuucaacuugaauugaagccuucuaucacugaaaccacauacuuucgaagagaauagagguaguuaaucauguguuucuguuucacuauacuuaaacgguaaggguauaaauuuggauggauuaacaugccuacaauuaaucaaaaguggcuguguaagucagagaaagcaaaaaccuuuuugacauaacacauuccauuuaaacucuucgguuuaaaucagauuugauugacuuauuacuaggauggguuugaaagagagguuacuucuggauugcucugugaagcuugaagcuccacugagucugucucucgugcuccagguccuuugccagggcuguggaggaauggaggcaguuccaccaugaccuugaugaccuuacacaguggcuaucugaagcugaagaccugcugguagacacuugugcuccagaugguagccuggaccuggagaaagccagggcacagcagcuggugagugugucccauccugggggcagaguguguguguguguguguguguguguguguguguguguguguguguguguguguuugggggguggggugggaagggggaggcagggcaugcaggggcagggcgggaaggucagaugcuucauagauuguuguaauuuuuaccacuguacauuuuuuccuacaucuaguucccaguuuuaaaauucuaagaaacacuggucauuauacaauuuauuuauuuauuuauuauuuuauuuuauuuuuaauuuauuuuuuacauuccauauuccauucccugcccuucauccacccuccgacugcuccacaucccacaucuccuccccaccccacaccguguccaccuggaugucccuacccucccaccccaccugaccucuaaacuccuuggggccuccagucucuugagggguaggugcaucaucucugaaugaaggaaucccugcaguccucuacuguauguguguugggggccucauaucagcugauauaugcuucuguuuggugguccaguguuugagagaucuuggguccacguuaauugagacugauggucuuccuacagggucacccuuuuccucagcuucucucagccuucccuaguucaacaacaggggucagcugcuucuguccauugguugggugcaaauaucugcaucugacucuuucagcugcuuguugggucuuuuggagggcagucaugauagaucccuuuuugugagcauuccagagacucaguaauagugucaggccuuggggccuccccuugaccugaaucacaccuugggccugucacuggaccuucuuuuccucaggcuccucuccauuuccaucccuguaauucuuucagacaggaacaauuaugggucagagaugugacuguggguuggcaacccucucccucauuugaugcccugucuuccuuuuggagguggacucuauaaguucccucucucuacuguuggccgauucaucuaaggucccucccuuugagugcugggaguuucucaccucucaggucucuggugcauuauugggggggggggggagugucuucccaaccuccuauuuccugagguugccuguuuccauucuuucugcugguccucaaucuuuuucccucacccaauaccagaucagguuccccucuucccuuccccuccccuaaccuguccacuuuccuggcccccaucauacaauuuauaauccagauuuuaaagaaguuuuuaaaaggauaaggcacucuuagguuguuaaugugagagauaguuauuuuuaaaaauauuuuaagauauauuucuccucaggagauuuuauauucauacuaacacaaaaaauuauaucuaagacuauaugaaagacagaaaaguauguguauauucaaugucaccucugcuuuguaccccuaacaccuaggcaucccgguuauuucuuuuuccuuuuuuaaaaaaucauugauuauugucaugagaggaugcuguucuuuauggacaaagccagccucuuguaggacucagccucgagacuauguagcacccagcagucagccugccagcacaauaggucacuaaagggagaaauggagcaagcagaagcucagauguccauugucaaauguauuucuuguuuuaguacauuuucaaaauguauuuucucuagacaguucauggggcgucgaaaacaaugccucccccucacuugcagacauggugcugcgguuuuuuuugggugugugugugaaaguuugaguuacagguaaguauuuagacuugacuuugaaguagaccuuaaucugugacuuuaaaauuuuuacagacagaggcagcaucucaguaaaaugcacauugaggauuuuuuauuauaaauggcuggacauaaaaauuuuauugaccaaauauuuguguguaugugguauccacaugucccuggaaaugcaauuuuaaauucuuugaaaagacauuauagcccuaccccgaauuuguuucuguagguguuagauugaugcuuaaaaacuuggguacacugaagguaucugaacagcuugauugagugguagaaauucauaaugugucaucugucauaggaacuggaagagggccucagcagccaccagcccagccugaucaagguuaaccgaaagggggaggaccuuguucagagacuccgccccucggaggcaagcuuccugaaggagaagcuggcagguuucaaccagcgcuggagcacucuuguagcugagguggaggcuuugcagcccaggugaugacucagcucugaauguuuugagcagaggggcgaagauuucauguaaacuacauagaagcugaucuaauaccaugauaaaaauauuaguggcauuugaggcuucacuguucauguuacuuaggacaguuuuuaggcugucuuguaaaucuuacuguucuguucagauuuccuauguauaaaacuuucuuuggggccagggugauggcucagucaauaaagugcuugccacgcaagcacagagagccuugcuuagaccuccagcacccgugugaaauggucccuguugcaaagagagguuucuuugaugagggaucagaauuauacuuaucuggguuggaagaaguuaaauauuuagauuguacuuaugaauuauguugauuuaggcaaguggcgguuguaagagcacauccaaguuccauggcuucacuaaccuuggauagcuggauagguuuccaguaucaggcauaguuuccauuuuuucugaaugggcuuuaugcccaguuagagagcuauuaguugcauaaagguauuguugcacucuuguacccuuaggguuaaugcauugugcuggucacccaccacagcacuuauggucacuguuuccuuucuacaaaagaaagcuauaaugucagacaguugcuugaggguuaaaugagacuguauuugaaaaauguguaugucuuaacuuuuuauggcgaacauuuaaaauauccauuucuuauaauccuuucucgaacauauucucccagcguguuguugcuguguauugcuaauagucaauuaauguaaucagcuuuaucaauauucucucgcacugagcauucagauguuacuaugaacucagacugaaaagaugaaguagaaaggaaaaaagcgugaucaagggaaacauccacaugaagauguugacacagaggcaggaaagaugagcuauggaauuggguacugaugaagagggaugcugaagcugaguuucgaggcauuuauagcaauuuucuguacauucuuucuagggugagccuuuguggcagcuagcuuucugcagcaauaaugcauaaucaagaugauuagcuuauaaagagagaauguuuauuuugguucucaguuguacgggugccagucugugaguguuuagccccacagcuuuggcccuucucugggacauugugguuggggugccugcuagagcagacagcuugcuucauggccaggaagcaggagagggaaaaggcgacugagguuccugugucagcuucuccuucaaggucacaggccccaugugcugaagacugccaucagguuuuauaaaauugccaccacugcccaguagccucaggggccucuaggagauuucagacgaaacuggaaaccuucuugagagaagauguagaacugggcuuugugaguaccacacccagggcugugugagagagaugggcagaugaggagacaagauaggaggacucgauaucacaagggaaggaauucauggaucauccuuuccuacaacaauuaaucagauuauuguuauaguaaugcauuaauauuaauaguaauuuuaccacuacuacuauugucaaucaauucauauaucauauaauaaacaguacauacuuaauaauaaaauagcaaccaauuaauaauuauaucaauaauaaaauuauuaacuuauauaauaacauaaugauaaguggcuauuuaugucuucuuaaaaaagaaaaaauaaacaaaccugcugcuggcaagauauuaacagcugcagaaauaccccucaauuuucaaguggguuucuguggaguguggaagccauucuuccccaaccuacaggaugaccucgacccacacuuuacucaagcuuuuggaagugaaugcaguaaugaguuucuucuuagcuucuuguauauucacuaaaacaauauugguuuucagaaauucguagugaacuucacuguuucucuaaccuguguguauuggggucacuuuggaagccccagagguucagggucauugacaguuaccacacugcuucauuucucuguguauucaguaccugcagguaaauauuugcacauuuacaguuuauggugucauuccuuaauaagcaauucuuauccuagaauuguuucuacucuuaagaauagcaaaguguacauuauauuuagcugguuuacagaugaaaauuacuugguaauauuaguuucuuuuauaguucuaguuuuagagcaugaaaguagucaugauuaugaaacacuggcaauuuaauuuucaauauaucugaaagaaaagaacuauacaaguauuauggaguguuucuaaaguuguuagauuauuuuuaaauuacauuuuauuauaauuucuacuaccgccaucauugcuucauuuuuuuuuuaauuucaaagugcaucuucuuuuuuuucuucuuuuacuuuuuaaaaaauaaguuacauuuuaagcaauuuuuauuagguuuaaauaguuaaauauuauaccuuuccauuaugacuguuaguacuauguaacauuaacauauaauaucacauauuagcauauugacguaauacauauuacaugcauauuuuguuguauguauuauauuguauuaugcuuuuuaugguuaaaauauaggagguggcaugagaccauuaauuuccauuagggauggcacaguguaauuuauuaaagugucacacucaguuuucaaucagcgucuaguugcaguagcuuaaaagucaugaucccacuaagaucuuaacagcuuucaaacucucucucucucucucugucucucucucucugucucucucucuuaaaucugcaaucuuauuugucaucuggguucugaucacacuucauugucuggcagauggcugguaucccuagguguucuucuuauacuguuaggaaguucuaacugggggauucugaugucauagucauccuguggccuacauuuaucuuuuggaccuuggcuggauuuuuuucccuucaucuccuuuaugcaauaugacauccuaugcauauguuauccuuauuuuaaugaacuaaucaagcauauauguuuguagaagauuucgauucucaguacucauauuuuugcuguuauauggguagaauggacaaauacugcuaucuuguuguaucugcguugguggcgcacgccuuuaauccuagcacuugggaggcaguggcaggcagauuucugaguucaaggccagccuggucaacagagugaguuccaggacugccaaggcuacacaaugaugucuuucugucuccauggagaacucagauaauuauuccuuuuuccuuauuuuacacaaggacauguucacuguucguuaacuguauuauacagcaauagcuaacuuaaacauuuucauauuaacuugccauuuaauuuuuaugaugagaagauaagacuucucagugugucugaauuuaauuaaggggaaaaaaucccuuuaguccuauauguaauuuuuaguaugguacucuguaugcaugauuauuaauguuaauuuaaaaacuacauauuuaauaucauuauuagaaauuauuucuacuggggcuauggggagcaaguuuucuaaaacaaauauauuguuuugcuuacucaguaauuucugucaauauuuucccuacuguguucuuuuaggcuaaaaggagaaagucagcagguguugggguauaagagacggcuagaugaggucaccugcugguuaacgaaaguggagagugcugugcagaagagaucaaccccugacccggaagaaagcccacaggaauuaacaguaaggaguuuguagcuuuccagagccuucgaaugcaggaucuaaugaacuugggaaauaagaucguuuugacugaaauugagagggaaguacaacuuuguucuuuaugauaaguaugguaaauuugaaagaguugggauuuuuuuucccauuauuuuauacuauuuuggucaugcagagaucaaacaaaagauuaguaacccugaccuugauguuuuauuaaaagauguagacuaucuuaaagugacuuagaacacaaugcagccaugaagaauaguuucugccuuuguauugaaaagguaacuguguggugacuuacaagaaaauccuggguguugugcaguuagcgccuugcagcuugaagcaggcuuagaguuacaguucagcaaucagaguuucuuguugauuuguagccaacagggauuuuuaaugguugugcaucugugcacaugcaugcacauguguacacagacacacaaucuauaaaaauauauaaagauauauagauaucuaaaugccaaaucuccauaaauauucagguccaugagcaucuguagucucuauuaagaauugagacauuaauaguacaacguuggacaggauccauuuucugaaagcgucacagacauggcaagauggcucaucagauaaaacacucacuguggucaucugguaacuugguucaaucacccaaccagugguaaaaaaauuuagauaugacggugugccucuggagugccagccuuuuugcagacaggugcuagguagagacaggagaauuacuuagauacaugagggccagcuagucuggguacucgguacgagagaaaucccacuuaaguaaggcgaaaggagggaacugacuccccaaauuuguccuuugaccuccacaugugugugugcgcgcgcacacacacacacacacacacacacucacauuuaaaauaauaacauaaaaauuguacuugaauguguuaauauauauacauauacauacacacacucacauuuaaaauaauaacauaaaaauuguauuugaauguaauuacacauacacacucaaauuuaaaauaacauaaaaauuguauuugaaugugauuacacacauacacacacauucacauguaaaacuauguucaaaaaaguauucaacuuauuugagaagugguuuugucauagagauguaugguuaaaguaucuugagaaagaaacuuuuagugaugaugggaaacgugggaauuguucauuaaauuuuuuuuuugaaguaugaggauauuccuucuuuauguaaagagucaagaauuuucuucaaauauccuguuuauaaaguauuuggaaaauuuacaaaggguaggacagcauguuaagaugaagaaauuuaguggugaucaugauguaucuuaacaauguaaacauagugugcgccuggugaaguggugcugguccuagagcgauggcccagcaggccagagcacuaacugcucuuucagaggccccaugucaggcaggcagcuuggaacugccuguaacuagagcuucaaguaaucugaugcccucucaagacugugaacucaaguguagagcccuuccaccaauauauacacuugguuaagaauaauaaaaaagaguauguguuugugcauguauauucagacacauacacaggaauguacauucaugcucuaucagugagaguguguuaacaauuucgguaagcugacuuuccauuuaagaugccugaguccugaauguauaaggauauuuucccaagagaauauauuguguauaguaacucucccucagaacaaccuucuaaccauggcuguuuuuuguuucaggauuuagcccaagagacggaaguucaagcugaaaacauuaaguggcugaacagagcagaacuggaaaugcuuucagacaaaaaucugaguuugcgugaaagagagaaacuuucggaaaguuuaaggaauguaaacacaacauggaccaaggugugcaugugggaauccuguaacguguuccucuugucuauugacuuuuagaauuauacuugcuuuggaguguguguauuuguguguguguguguuugugcgcgcacacaugcacaugcaaaggggggggggcaaacagacagagacauagagaaaguaccacacauaagggaacaacuuuugggaauugaucucuucucucauguggguuccagggauugagcuaaggcuguaaggcuuagugcaagcaaucuuaccagaugagccaucuuguugaccccuauuuacugaguccuugguuaaauuguucucuugcuauugcucuaaguguacagauacaggucugacauauguguguuuuuucagcacuuuacaauuauacacacacacacacacacacacacacacacauacacacacacacacacacacacacacacaauauaucuauauauauucauccacuaucacauguauucucaaagaauaucuuuuauuucacauggacuucuuuguucuaggggauguguauauuuucaaacauaccacauaugauugucuauuggaauuuagcaguaaaaugccaguaauuauagucugaaaaugaagaccuuaaaauagccucuugauguugaacaagacuuucccacaucuguuuauuuuuggugauuuuuuuuauuccuuuaguauguuuuuauuguuaggauccuguggaauuuaauaacaucugacaaaaauuaaacuaagaugggaguuauuuuccuuauaugauuacuuuguuucacagaggaaaugguuaaagguagaugaaaucauaggauucuucucauuuugucuuaguacccacugggucgauguauggugucuauuugaacauggaauggaugugucccacccgggacugccagucacuugacucucuuuucaauucuaucaaacuggaaguccuggcgaauguguuggcaugcaucaguagcucugacauuugacauuuacuaggcuaagguaggaggagaguuucuucaaagccaaccugggcuacauagugagaucuuaucucaagaaggaaagaguaagaggaaagaggaggaagacgagcuaugagaaugaagugguauuaugcuguaucuaacaaccuaugugugcuuucuagacccagccucugugacuaugaguuacuguccaagugaucacucguuaucuguaucucuggccuagaccuuucucuguauucggcacuugaauguucaaugucucugcuuugggagcuaauagaugucucaacaguuacaaaauugaacuccugauuucuaccuuaucuuugggccuuaguguauaucacauuccucaauuaauggcauguaugucucuauuguugccuaaaucagaaauccugaaucauuaaaauggcacauaaauuauauaugugaauuauaacucaauaaagagacauuucuuccuuuucuuacacacccagacacccacauccagacacacacacacacccagacagacagauucacccgccaccccccaauucuuugaugucccugucauuggcuuuuuccauggacuugauggauaguuugauaguaggcagcuauaugugauaaggcagaugagggcaaauuuuugauguguagaauauugguugugcacgaauguuucugcacaguuauuucaguuuucuuuauguuagaaaaauaauggcauaaauuggacuucaccgcuccuuuguauugcuuaucccaagccaccgucaucucugggaaagcccuccuuccuggucucuucugccacccuuucucauugucagagcacagcagccaaagcuuuguuaagauguaagugagauccaguaacucucugaacaauguccacuaacgacuuuccgucuuacugagaguaaaagccaauuguccuccgugugauuuauaaggccucucacccugccuagcugcucucucugaguuuaucugaugcucucucuucugcucuccacucuggacauauuggcucccaugucacuugccaaauccauuugcacguauucauccagagcauacauuuuuauggaacacagaggguuuugcuugguauuauagauuaaaggguauuguggccaguuggggaacaccaugauaggcagcauugaagcuucuauuacugcuggaauuaaauuaacauagguuuuaguauugcccacuuuggguaauuaugacaucuaaggcaaaaaaaaaaugcuucuuguguggggaaucauguuaggaacugcuacucuggaauauuuuauuccuucaauucuuuuauauacuuagcagauuucacuacaccccugguucaugcaaggccccauuuuaaggacuauaggaaauuuuuuaucacccaguugguuugacauggauaagacaaagagaucaauaauuaaaaauuggaagcaaggaacauucaggggacacuuauauacuuucgagugaucaaggaaggccugugggagaagaucuuaucuagccuaaguuauaaaagcuucacugcuuaggugagggaugaaguaacaggcuuugacggggaaguacagcaaguggaaggcucuagaggacacaccgugagggaagugcaucuguggucuacaauagacuuauacauaaaacagucacccgagagaugcccagucacuccagagaccagauccugguuuauugagcaaaugugccacucuacagaauucgggcucuaucuugagaagaauucacuacuuugagggaaauggacagcuauuauuuauuuauaaacagauuucuguuagaaagaccccauagcuauacuguagggaaggugggcucaguguauggaacaaucagguagaguuucaagagaagcuuaccaaaggcaguuuccuggaagacagaaaucgugaacugagguuuggaugugucuaaagaucuauuagacagaaagcugaguggaagauauauuacugggggaguucuuuagccucugaagcauccauauaggaaaugaagaguaagaaaggucaaagguuuaaccugcacagcaauggcacuugauggacagugaaggaaacuuaagagaggcaggaagaaggucagacucacugggucuuuacaggauuugaguugugaggggaaugggcagcuccaguggugcaagugucacacaugaggacugguuggcauccuugcgcuuacugucaggggagguaaccugccacgaccacacaugcuuaguguguauaauuugauccugaucauaggauuuugaucccuuccaaaccccugaucguggaguuuugaaggcugcauuucccaggaaaccauguccuaguaacaucacaguggauagugaagguggagaugcaagcuagggugggaacugaaagaaaauugauugagcugucguauggaagaguggcuguguuucgaagauacaaucaucguuuguuucucuuguguguuuggcuugaugcuacagguaugcagagaagugccuagccuccugaagacacgcacccaagaccccugcucugccccacagaugaggauggcugguaagaaagcauuugcucuuuaggagucauuuuuaucaacacagacaaacuuauagugggaacauccuauuagaagaacuuacugaaaaacaucacgugauugcuguucauaaucugaauccagacuggaugcuuagcauggggaaagauuuguuguucuccgagucaaagauauaucuggauggccauggguccuggugaaggaaggaaagaggggcuagguggaaaauacugaguuaauuuaauggagagaugcacuuuuucaaguuaucuuguguaaccugccaugacaacacauguuuaguguguacaauuugauccugaucauagaauuuugaucccuuccaaaccccugacugugggguuucgaaggcugcauuucccgggaaaccauguccuagcaaauauuauucccuuaguuauggggaacauuguauauuuucucaugauuccuguuuauuuccuucuguuucugucccaaguagaccauauagccacugggacuauggccuugcucacucuccuacccaccacauucugcuugcugucuguaguccuuagcuguacuaaccccagccacccacgucucuuugccagcugaggcuggagguugggacuuucucacuguuuuucagugccccccucaucucuccuccucuccucaacucugccucccaccugccgccuccuaccugggcucaccuuguccauuuccaccucuucuucucuucuuuauaucuucuucuuuuccuuuaaaaacaauguguauuuccuuccugauauugcagcauugcuuaugacccaguguguguucugcauuacuuauuuuccucaguaccuugucuuggaaaucccuguggccugauugguuuucuugauuauauuuagaacaauugaauugagauuuguauauauguaucucucuuccucucucucaucuauguauguauguauguauguauguauguauguguguguaucugucguauguaugcauguaucuauguaugcaugcaugcauguauguauauaucuguaucugucguauguaugcauaugagucuguaugcauguauguauguauguaucaucuauauguaucugucuuguaugugucuauguaugcauguauguauauaugugucuauguaugcaugcauguauguaucuaucaucuauaucuauguaucuauuuauguauauauguaugugucuuuguaucuguuguauguauguaugugucuaugugugcauguauguauguaucuaucaucuauauguaucugucaauguaucugugcauguacauauguauguauguauguauguaugugccuaugcaugcauguauguaucuaucaucuauaucuauguaucuguguauguacauauguauuuauguauguauauauguaugugucugucuuuuugucuaucuugcuucaauucuaugaccauaaagaaacagcuugcuuuauuaaguacagcugcagagguuuaccuuuuuuagaacauugacaaaggaguagaaaaaguuuauguacauccuuagauuauaaaagaccaacagcaaaaccacuuuacaguagguuugcaguuuguuuuccuuaaggcaacccuccauaaaacaggugugagaccugaagccaauuucaguaugacuuuccuucuacaguguucuuguuuuuuuuuuuuaagucuaaacacaaaauguaaaaaucuaaaugaauaauuuuaaauucuaaguaaaaaauuuuaaauguagaaaaugaugaaauuauguguuuaucuguguuuguacaugaguguaggugccuggagaggccagauccacuggagcugggguggaauggccauugugaaauaucccacauaaauguugggaacugaauuuaggucccuaacaagaauaauaugugcuuuuaacuucugagccaucucuccagcccuuacacaacuuuuuaguuuaauauuuuucuucuuuuaaaaucauauuaaaaguaaaaugaucuauuuuuaaaauaaauaauucaaggacauuuaguucauugacaguguuguacaagcuucaccucuauguagcuccaaaauauuucuauucucaaguuagaguucuugugcuugaguagcuucucucugcuccucccuccgacccccagauucucagcgucugguauccaacagugugcaugccagccaugucagcagauugguccaucuugacuaucucguauaaauggugucacacaauguuucuuucauuuagccuagggaacuucacaaaauuuuuguuuaucuguauguuuaaaaauggcacaggcugggcaugguggcgcacgccuuuaaucccagcacucgggaggcagaggcaggcggauuucugaguucgaggcccgccugguguacaaaaugaguuccaggacagccagggcuauacagagaaacccuaucucgaaaccccccuccccaaauuggcaauaaccaaucuauuaugcuuuuaaaauauauauuuuuauaauauuaaaaucuacuauguuucaagagaaagugaaaaugaaggaagugacauuguuuugccuuuuuacaaccuaaguaucuggcuuugaagaugauaucuaccuucucauuuaugcuucuggguuucaucuguaaagauggugcaggugaugugucauuauauaccugggggagauuuaaagcaaauaaguaugguggugguggugcuauuaccagcauccagauaucuuggaagaggcacagggaggccagugcuugucagcugucacuuugccaaccugagaccugcacacuuugcugaccugugauugcaaaacauuuugcuuuaauuagugcuuucucuuucauguuucauguugaacugcugucccuguuaucuguguaguagguuaucugucgccucguccagagcucuaaagaauaaaagcauuuugcucacuaauuaaauucacgugccuagcaaucaccuccuuucuuagucuuucagagauguuugaacggaucggucucuggugcuuuccuuagacguuuagagcuuuaauggugcauuaacaaguuugccugucuuuguguugugcucucgacucauaaagauauucuucuacgucuuaaucugauagucauaguuuuuccccuucaugccuucaucuccaggugucuauuuuccuuuaugcacaugaggucagauuccguggcaucaucuugccauacuagcugccagacagcagugcuuacgggguagugaagucuuuagcauccuuccacaaugccacuucugugucaggucuuucugucccugugccuuaugguucuccucuccuggucaucuauuuauuauuuugggauacaguuaucauuggucaaaaguguaacucaauaauuguagggcauaucuccuuacacaaauauuuuuauaaauuuuuuugggggggaagaggagggucccuuucuuucuuauugaacaacuagaaauuaguaucugugauuuugccaagcugccugcauaccuguugggguuuuuauuagaauuguacugaauuuaugcuaggugccagguagauuuaguauucgucuuaacuacaucuuauauugaaaccaacuguuaacuucucuuagaaacaaaagaaaaacaaaaacaaaacuaagaacaaagacagaaacaaaaccaagaacaaagacagaaacaaaaccaaaggguuggagagguggcuuagugucugauaucauuggcugcuuuuccagaagacccagaauucauccccaacauacacaugaccgcucacaucuaucuuucuggggauuggguggccucuucuggccccugugggcaucaggcaugcgcauguugugaauaucuauaucuguaucuguaucuaucuaaucuccagacaaaacacucauacguguaacagaaauaaaaccaagcacaaaacaaagagaaagaaaauauuuaucaguucuuuggagaagacaagaauugauuuuaauaccuuugggaggacauguaagauccuucugcucacugugaaggacaaggguggauuccucugacagaaaggaguaaauaaaauuaaauaaaucaaauaaauaaauaaauaaaaaugaaacaauaauucaaaaaauaaaccaaauaauaaguaagaacaauaauaaaauaauaaacaauaauaaauaaaauaaauauaauaaauaaagcaaaacccuaggaggacagccccucucagaaagaguaaugaaauugacuuccucaaguuuguuaagauauaaguaauuacaaaguagaaggacuuagggaggaggagaaagaggaagggaggacauaacacauugcaaaaaugaaacaggagaaaacaaacaggccagacaguagcauagcuuucaucucaaaggcauccaaauugauaaagaaguagauuccaaagaaacaaaaaccagacuaauacagauacuaacuauaccacucggugcagaagcaugaaaacaccuuuauuaguaauuaauccauuacaguaauggaggcagguguguacugagauggaguccuguugauguagauacaggguguuuagcuaguuguuggagaagugaauucccuuuggcaaggagauuaaauacaugaauuuaaaaauguugucugacccagugauuucucuuugggaaaucucuacuaaauuggaaacuggaaauguggaaaauacuauacucaaaaagaguuucccuuuaagcucuuugguaaagaauggauuucaggagauuuguacauguacagcucaauguguagcugaaggaaagggugcuguaaaagucagugacuauuuguguaaauucuuauacagaucuucacauuauaguuagcuaagaaugagauaugcaguccaggugugguagugugggcuuucaaucucugaacucaggaggcagagaagguuggaucgcuaugaguuugaggccagcccagucuacauagaaaguuccaggucagcuagggcuacacuuugagacucugugucucagagagugugugaaacagacagaggcaaagaaacaggagauaaaaauaaaaggugaauaugcuguaaaguuaaaugaaaagaacagaaaaauuagaaauaaauuugcuuuauauuuacaguagccugacucaaugaaauaaugcuuuuaauuuuaucaguguguguguguuuguguuugugugugugugugugugugugucuguguguguguguguuuguguuuguguguguguguauuugcuuuguuuacugcuuuauuuuuuguguuaauguugauugcaugugcauuauugauugcauggaauuuugagagggcuguguuauauuggaucuauggcuauuaaauacacgugguuauuucaaucuaugccauuucaacauaaaaauaccuuccuagaaaaauggaaauuuacuuaguacacaaaugcacaugcccucacuacauaucuuaaccauugccuccuguugauuauuuucaacuugcuacaucucuuguuucagcucaucccaacguccaaaagguggugcuaguaucaucugcaucagaugcuccucugcguggcggccuggaaaucucgguuccugcugauuuggauaaaaccaucacagaacuggcugacuggcugguauugaucgaccaaaugcugaaguccaacauugucacugugggggacgugaaagagaucaauaagacaguuucccggaugaaaguaggugcagaaugugaaguuuugccagggcacuacgcucuccuugggucucugugguuuauccuaaauuuagagaaaacaagcuuaccgauauuccuuaucugcuggguagcccuucaggguuaacuccaaagagucaagcuuuucuucaguuagcgcagguugaucaaauagaacugaaggcucaguguaaaacucuaguauugauacugugaagcuggacaccacauaacuguaagcuaccuuuccauuuaaugcgcaaugcaauauagaauaauuucuaagccuauguuucaucuuagauuucauaaugaguacauuucauuucugaucuuagaaaugaauguguucugaugauauguuuuuuuuuucucuuauagaauagagaccaccaaguagcaaccuggaaaauucuuuuuccauacuuaguauaugcuaggcuauagcuuaucuguuauauagaguaaggcugaaaagaauguuuuagauagauaugcauaacaaaauaauagcuauugcuagcaucuaagugcuuaauguguguugaacauuuucuuacuuucacauguauugucuugucuauaucauaacaaucugguaugguaggugccaauucauucccauaucaccaagaacuuugaacuucuaaaccagugguucucauccuguacgucugacccuuuugggguugccuaauaccacuggaaaacaauacauuccaauucaaauuaugauagcuaaauuacagcuuugaaguagcaacaaaaauaauuucauggcugggguguguguguauguguguguguguguguaugugugugugaccacaacccgaggaacuguauuaaagggucgcaguguuaggaagguugagaacuguuguuuuaagaggucgggaagaugggcauaucaagcagaugguuuucucugacaaaauaguuucuaauaaaugucccaggggagugucagccacauguuagaggagacaggccaaggaggggcuguuucaguagcccugggaucaggagguggguuuaugagauauuuaccguucuaucauaggggacaggaggcaggggcuugggguugaucaaauacuuagagccggcauuugugcaagaaguguuuuuguuuuuguuuuccccuuauggaaaaguuaacuuaguucuuugagaagaggcaugcgaagcuguucacagccucguggacguaagagucugcaaucaguagacaagcgugcucggccguuucuuucugguuccugauucguggcuggggacuguugauaauaaugcuuugcuuuaguagaagaugaggauggcucggaggcaggagaugcuuaagucagggaaaggagcccuuccugaggggcugagacgaugcuguuuccaguagaggaaguagaggaaguagagggaggaggaggaggagaagcggagcuccagugacccucugagugauuuagcuuugagucuguugugcagagggaagaaagucagcagcauaaacggaagcucugggaucuagagcuggaguaggagucguucauuuggaaauacuuacuccuguaggagugauugaggucuagagaaguaguuuacccgcagggagccggcuggaccaaucuuuuggcacacuguuuguaccaacugugaauuguguuuucuaauucuuuuugguauuuauugguucuagaauuagaauagacuuuuccuggaauucuuagcccucacuguauuuaucagcuaagacacauaguccaugaaaaaagggugguuuaugaaggugauucauuugcaguuauuguaauuauugcuuuucuaacaugccguuuucaucuuucuacaccagugguucucaaacuucaucaugcuggaccccuuuaauacaguuccauccauaacaucguuuuucauaacuguaauuuugcuacuguuauaaauugccauguaaauauguugggagauggaggcuuaccaaaggauugcagccuacagguugggaaccauuacuguagggcauccacaugugcauucauaucugauguccaacagguacacaaggagucaguagcgaagauugcugauguuuugagagcauuuauagugagaguuccuugauuuaauuuccuuagauuugauggaacugagcugggggagccaauggagagggcagaugccauuucugguuauggaagaccugagauuugaaccuaaggccucugacuccaaaucacauauucuuccucuguuacaucgaugauguuucauugccucuuagaggaagaagacacacccaauacacagcuaggggcuuaucucaggaugcauuaaucccuuugaacuugucuccuugcagaucacaaaggcugauuuagaacaacgccauccucagcuugauuguguauuuaccuuggcccaaaauuugaaaaacaaagcuuccaguucagaugugaggacagcaaucacagaaaaauguaaguuaaaaaaaaaauguccugccuggcgugguggcgcagaccuuuaaucccagcacucaggagguagaggcagguagauuucugaguucgaggccagccuggucuauaaagugaguuccaggacagucagggcuacacagagaaauccugucuugaaccccuucccccccuccaaaaaaaaaaaauguccuuuauaguaucagcuacuucccuuaacacucgcaaaaaugucuucagagauuauccuacuagaaauaaauguuauuuuuagaagaaaauacuuuuuucucucuuuuuaucuucaaguuuuugaaagucuuuucauaccuauuccucccuucugaacucuuauacauuuaauaauuuuuucuuuuauuuuaagaauuuuuucuauuuuuuuuuuuuuuuucuuuugagacaggguuucucuguguaacagagccauggcuguucuugaacuugcuuuguggaucagguuggccuggaagucacaaaugcccaccugccucugucuccugagugcggggauuaauggcauacaccaccaugccuggccaacauugggauauugguuuaaggcaucuaauggaauaagcuagcuaaacucauagucacauaaauccauucugccauugugccuuacucacggaaacuggcugucaccaucucuuaaacuuccgugagaauucacuucguacuugcuuucugaucggcuuucauguggggaugccucaguuaaaaagaaaauuaaacagccaauaaaaagaauggguggaacacuaacaaaccagagucucuguuuggaguuaguguuggagcugaggaucugugucgcaugcggaacuggauucuuaacgauggugucugguggcuaucauagucuuucuccucagccccuguccccugcagaccuggccugcuccggaucccuguucaaagucccugauauuuccagccauuaacuuuuauccauauucuccccgcccaaccucaauuuuguucuucuccuggggugagauuacucagcagcuaaagugucccucccucugugaguccuucccacccacacaugcuccccuguggacugcauuuucuaucuuuaguucuugccacagccuccuuccccaucaguuuccucuggaucccauagcugcuuuaaucuucuuucccauucccaggcuaugcagacucaccuuccuggucucugguccucccacuuggcagaccaugagggacucaguuaaauacacgugagaauguaaacuaggcgaauaaaguugaauuuuucuuaagggagagcauucggcuauaggcuuaauagauggguuuggcuuucaaaauaaguggaacaaagugguuccugauggagacaguuagccuggggacuuugagugacagauggcguugauuuauuuucacuuaaacagccacuauccuuuagucuuccugauuuugauaauugaucaaauauggaucuuuuaugauggagcacuccgauaugagggagcacucuggagucaucuuuccucccucucuugguaggacaucuucucuguucacagcaccagaccauuucuagccacauuucauuuuucuuucugaucaucuuaucaggacuuuauuuuuuuuuccugagcagguggacugcuggcugagaucacuauaucaagcccagacaguguugcugacugagccuaggaucuugggcacgcuaggaaaccacucuugccugagcugcaacccuagcacacacuugugcucucucucucucucucucucucucucucucucucucucugucucucucucugucugucuuugucuaccugucugucuuucugucucucucucucccucccuccuuuccucccucucccucucccucucccucucccucucccucucccucucccucucccucucccucucccucucccucucccucucucucugacaacaggguuucuaucuccugaauaucuucccuuaucacuuauuucugucucuggucuuugucuucuccuccucuucuuccuccccucguccuccccacuccccaacuaauuaaucuucaucauuauuguaugcaaagagcccuuaccagcuccuguggcacuaauaguaacagguuuaucauuuauaaugaauaggauaaucaguuuauuuuuuaugauaggccaaugauauuugcugucacucgauacuucagcuuguauuugugcaaaccaaugaacuguagcaguaguuaaauuggccauaaguauuuagcugagaauuagacuaucaugauaguuuggucuuuucuucccuugaguuaaaacuuucaguaauuuucuuacauuauuaaaacaauauacagcagaggaucucaauggauacuuuuuauaaauuauaacucacugaacaauuuaauggaauuuaugacauguaagucucucagacuucuaaaaaacuccaagucgauagccucaugauuuacaaugaccauauguaaucuuaggaauuuuaccagaauguuacauuguaacuaaacccaaucuuuucaguuuucaaaaacuguacgugugugaguguuucgccugcuucuaagucuguauggcauugaaauaugugaaccacaugcaugcaggugcccauggagaacagaucagggcauucgaucuccuagaacuggaguaacggaucgcugugaaccuccgugauagugucggggccccaacuugggcuuucugcaggagcagcaacuccagauuccuggcuggaguuugucuuguaguuaaguucuucuugggcucguucuucuguaccuuugagguuguucagccuccagaugucacugagccuuguguuugccauucaugggcugauauggagaacuauuauuuccugguauuucagcccacagcugugaacuuuccuugugauaaugaaccaaaguguaaauuucgaaaggucucucucucucucuccuuuuagaucuaugauuuaaaaauaaggauaaaagacaggagaggagagaguguuggagagggaaaagagagaagggaaggacaaaagacagagacagagacagagaaagcaggacugagaaaaggagaaaugguacaggaguggggggggggggagccagcaugaaauuuuaugacugugaacuuauagguacagagaacuugcaauuucuucauucucaguauuucuguugaacuugaacauguaaaauauugccagucagaaaggccucacgcuagacuagagcaaauguaaaaaguguucuuugccugagggauugucauuguuaggcagaaggagacggugucuuuuuguuaacguccuauccuagacugccauuaggugucauugucaaaccagguucugugaaauacaggaacuagggaauuguuuucuaucuaucuaucuaucuaucuaucuaucuauggaauuguuuucuaucuaucuaucuauccauccauccaguagauauuuuuguuauuacaugacuaguguauuuaacauaagccguauucaaguuuuugcuguucaggaacaauuuuagaaauauguguggugagguagcccaguccuggaugucagccaagcuacuugggauaccacaucaggggagcugcaaguuccaggcuagucuggggaacagaggaaggacuaacuuacauaaauaaagcaauuuagaagagcaauguauguaguucagggguaaagugguuacuugauaugugaaauguccuggauuugagcccagcacugaaggaagaaaaauuggugagcugagcacuguagaauaaucucagcacucaggaagcugagccaauagaauuggcuacauauaccuauaauggugugauguguaauguauuuuuuuacacaguguacauauuugcgagccaucucuccaaccccuguacauauuauauagcauuacuuacuauaauaauacauuauacuauguacauaauguuguggcaggugagcauagaguuccuuuaagauauguuuaucgucuuccacucuuucuguuucuagaucuauuuauagcauauuuggaaccaggucuuuuccuucugugguggucacuuuaacagguuucuuuuuacucccacuccccaguggaaaagcugaagacccagugggagaguacucagcaugguguggagcugcggcggcagcagcuggaggacaugguuguggacagccugcagugggacgaccacagggaagagacugaagagcucaugagaaaauacgaggcucgcuucuacaugcugcagcaggcccgccgggacccacuuagcaaacaaguuucugauaaucaaguaaggcaaauuggcuaguuuuuugaugcagucauuugauagauuuacuuguuuuauauugauaacuauaauuaggggcucucacguuuucccaaguucuuagacauacauguugagauuuaugggaauuuaaucacaggguucuuguuauuuugggaagaugucuaaagacacaaugagcaggaacgugcacuugugugaguagagccauaguuagcgucuacaaggcaauccucauuuguugacccuuuuucugucuagggagauucuuuucuuuuuuuuuuuuuuuuuugguguuuuugagacaggguuucucuguguaguccuggcuguccuggaacucacuuugucgaccagguuggccucgaacucagaaauccgccugccucugccucccgagugcugggauuaaaggcgugcgccaccacgcccggcugagauuauuuuaauguauaaaauuuuucuagacuuccauuugaguacuucuguagugugcaagcuaagucguaccucagugucauucucuauucuauguuuaucaguagcaacagcuuucaugaccaauuucauaauaguggugagaauauugaacacucaguguuuaaaguguguuauuuaaaaauuacuucuguagucacagaaauuuucuugugcuggacaugugguuacauacuuuguauuugcccuugugauugccugagaugaaaauguacuuuuaggaagaauguaguaaucuagaacaaugugggaagaaaacugagaaccugcaaauaaugccuuaaaucucugcacacgagggcuucucguggcuaucaucucauggguaucauuuaaaauccaccuggccacgucuguuaguuccugaauugucccauguguuuaugacgcuugucgauggccccgaaguaagagugaagcuuuuguacacaugacuagaaaaaccugaucagcaauguucaccagugcuuccaucuucauacccagaaugcacuuggccuucccaucuguagcauccaugucuacagauuuuaaaaugaacacauggauuuucuguuagcuugccauuaucccgugaccacacaguaggacaacuaauuaugaguauugaugucauuuuaagccaguucuucccagccuuccucgugcugugauccuuuagcccagcuccuuauguuauggugacccccaacaauuuaauuauuguucuugcuacuucauaacugaaacuuugcuacuguuaugaacaguaauguaaauacccgauauacaggauauuugauaugugacccuggugagaagauaguuugacuucugaggggucgcgacccacagguugagaaccacuguuuuaagcacugcaaguaacccacaggagacuuaaagugcacuggagggcgugcacgucuuauugugcaaacacuaugccauuuucucuaggggaugugugugaauuugguaucuguggaauggaaagguuugggagcagucuuucacaaguacuagacacagauucucugcugcucuaaugaacaguguguauguucuuucugaagccuuaagguggauuuuucuuucacaauugcuacaaaaacauuacagauacaagugacacaaguguccuucuugauugacacacacacacacacacacacacacacacacacacacaccccgcuuaaccucccuggguugagaaccugugaaggggauugugccugugauacacugagcaucuguguagauagaaugcugaacaaaucuucauuggcugccugauccauuccagcuguuaucuuugcaaacacucagacugauucggaguuaaagggcagaggguuuccaccaggguaaucuuccgacgugucucuaaauguauacacaagaacucaguuuauguugauaugauucauguucugugagaauuagcuacacagcaaaaagaaugacaagggcauuccaggaauacgaggguuugaggaggccagaaaucucaauggguaauauuuuacucucaccuacuaggcaccugauuccucaggcauguucucuuuuaaacaaguauuuuuauuauauuuuaaagcauguguauaugugugucaugcaagagugcagguggcuauagaggucagaagaggguguccaccucccgaaacugccugggacuucagacuaccaugguggaaaagcucucuuuuugcuauuucuagaauuacucugguuugauuguucugauuuaaacuugagaguuuguccucuugcuuccuucuuaugauuucugugucuaaaaugugcuaaaucuuuucaggacuaugagaguuggguaguccuaguuacugaguagccauggguagguaguuuuaguuauugaguggccauggguagguaguaguaguuauugagugaccauggguggguaguacuaguuauugaguaaccaggggugguaguaauaguuacugagugaccaguucuaacuguguuucaauuuacaccuuagcuauugcuucaagagcuggggucuggcgauggugucaucauggcguuugauaauguccugcagaaacuucuggaagaauacaguggcgaugacacaaggaauguggaagaaaccacggaguacuugaaaacaucaugggucaaucucaaacaaagguaagccuggguggggacaugugcaucuccuucccgagcauccaauuuccuucgcuuucccauggaaacaagcuaaauaggcaaauauuagaaguguaucuuauuauuuuucucuacuuuuaaauucugaugaaaaaauucaugucaguauauuuugugcagaguguguauuuuuauaucuucuugaaguuuuaacacuguauuuuuaaaaauaaaccuugcuaguauuauuuuaaguuuucuuauuuuuuucccuaugccucuuuguauuauuuagaauacauuuuguaguucucugagagcacagauaguuguaacuacaucaggcuaauauuaguacuaauuguuacugugauagcguaugauauuugggugggauacucucaaaugaggaccagacacuguggaucuaccaccugaccucagaaaucaucuaugugccgaguuuuggcuaauucauuaucuuuucuuuccaucauugucuuaucauuauguauggaaaaaccuggaacaacauauguguuucagagaggguuucacucacuuaaucuugcagggaucgagaaagcaugggcagcaguuagcauuuuuccagauuccauguauguccaucaucaguuaaaauauuuauauagcuuacuguuagugcccauauguaagugaaauuauggcuucuuuuuuaugcuaagugcaauuucuugaaaauuauuuuaauaccaaaacauauuuauuuuguaauggauaaaauugcuaccagaacauuuuauguuaaaauaacuccaaaaauuuaaugguaacuuaacacagaggaauuuuugcguauagauguguuuuaaauugugugugugccugugugugugugggugugugugcaugugaacauguguacguguauacaucugcacaugaacaugcgugugcucaugcaugaguguauccaugggugcuauugcacucauauagagaccaaagaaucucuugucgaagggaguugguucuuuuugucuacagggugcgaggcuugugagaaugcaccuuuaugcagcacaccacuagguuggaccucuggagagccuugugaguuagauucuuuaacaagguucuggaacuccuugaaggaugagaauguuuacguguuagaugcuuacucagguucuccauagacccuaacaaauacacagcuuugccaaaaguuaaagguaaauagcugcaaucuuggcaguuucagcagaauagcguucuuguaucaugccauguuguuuguguagaucucauaacuaagauagggagggaaaugcauuaaaaaccacagagauauaucuuaaaacugcuucauccauuuccagaaauuacauguguaagaaacauggcuuugguuuuuuuuuuuuguaagcaauuccaaaaaguugagcacucgcuggaaugaacagucugcuuuuucuuagcaacauugaggcuuuucuuuguaaauacucuaagacaguccauggcugcaguuaaguuagacggacgaggcaauuaaagacaaauuauaucccaaggagaucucucauuuaucagcguugagguagccacagagccccaguuuugucguagugaaaacacgugcuucacuuuauucuguuucugaguuguuuuaguaaugagaauuccuauuaauauucagacaugauuuaggucauauuguucuuuaugcgguuaggaaaauacaacaaaaccuuggcucacagaauccuuccugagugacagccacagcuucuauauugaaacugugugucuuucaaaucuuuaacuauccuaaauagacaucucuugggaauauauaaaccauuccuuccuuucuuaagcaaggugugagauuauauuaaccuucuuuuguguuuuugacauuguucuuauaaagacagacuuuagaccaauacuucuccacuuuuuaaauuaucuuccacaggaagcuuuuaaaacuccuuccacugaaauuuuaauuaauuaguaaaugaauuauucugggggcacagcagagucuuacuaauguagcugaacuugcaaaguagcucagagugggauuaaacuugggaucuuccuguauaaucuuugaagcuuuauuaauaauggaguauucugugagucuguuuccauucuaugcacuuaagcuuuuuaguuagacagaaaaaggagugaguuuuucuaccaccacucuggggguagaucuacuaagcaacuccuuugagaccacuugggcuagccuaacacugucaagcuuagugacauagaaagcaaacgacaauuucuuaagaccaaaagccgguaacacuauccaugcucugaauucugaaacauggaagacaaacuuaaucagcugcugucuccugugagugucugcugugguuuuccaguguggaucugagugacuucucacuguuucuaacugugguaggcacuugacacagcucuccuguaguucgcccacagccuuaagagacaggacgcaucuuccucagcauugcauugguuguaaauggaagcucagaggcagcagagaguuccccagagucacacagcucaucaagcauagcuggaauuuggauuuuugccuuuuugccuacacagccaggcucuuacuuccuuuaccaagaguuuaauuuuucuucuuuguuaucagaaugucagcuauugcuggugaaugcucgcugugugcucuugcuucucagaucugcgguucuauuuacuggugcuucucuguacuguguauggagaacagaucagauuaaagauacgggagcuuccgugaauaauagaauagagcaagcucuagcacauggccacugugccaacucugauggcccccgccaggccuuuaucaucacuuccucuuacuucacaucaucucugaauauacucugaauauacaucauugucagcagaauugugcacaggugaagggguaucacacuugcauacacaguaauguuguuaguggcugugauucauaaaguuuaauaugagcuuucaggggagauguuugguaugaauugaaauugaccauucauaguuaaagguccucauucccuuaucuacaguguauaagccccaagcagcccugauaacagacagcugcccuuuaaugugagugccuuaauuauagucuuuaugcagugggaaugacuuccuccuagcagcacgaguauuagucugcuugauugcuucccuaaaccuucuggaagaugaucuguaauauagagaaauguauagaaauucuuagaucuuugcuuuccuuuuuuaaugccaguuagauaauuacuuacugcaaauuuugauagucaagauaugugugcacaaguugaauauucuuuaucugaaaugcuugggacaagaagugguuuggacuugcagauauuuacaggcacaugaugaaagauauagaagaugaugcucaaaucuaaacaugaaauuuauucuguuuucaacauacuguguaaguugggaaauuguagcaugugugaagccuuguaccaugccagcacuguaauuaauuaacuaauaaaaagucauguauauuuuaaacauauaaccagaaggcaauuuauauaacauguuuaguaaaugaaacagaaauuuccaccgcagcaucaugucaguacugaaaucaauuuuagauuucagagcauuucaggugucaggguuaguaauacucaauuuauagcaaguuuuggagcguggaugccugauuuggaugugaaugguuguuuaguccuuuauuuuugcucuauauagauaaaauaacacuauauauauauauguauauauauacacauacacauauacauauacauacauauauaaauaauguaugccugucuaugaguauggauguauauauguauguguauguauagaaauagaaugaucuguucugaaggauuauaaaggaaaucagaucccaugacuauaugcuaugguuucucacaagucacuaauuaacuauggacuuucucuuguccuaucaccacacaugccuauuauaaggaaggcacuuccaggaugguagagguagagcaaguccagugugaaccuugagcaaguuauuucaucucgcugggucucagcuuuuccuuuaaagcggagggcauggcugauggguaggccuacugugagaucaaaagucauauauaaacguucuugguuccuggucugugcuccacaaaagugcacccaaauuaacaucaucgcugucaugucuuccacgggacugauaugcagacuuguuugucauucugaaugguuucuacugauccugaugguaaaguguuggauuaucugcuuuaaugaaugcauuagaguugcacucagucuuuauuaguagaugaaacuucuuuuaaaaaaauccaauuaucuuacuuagugaaaucaccacacuugcuuaauccauguuguauucaagugucuugugcuaaagcacagaucuagccauccuggcaagaaaagaauauaaaacuuaaaggacuaugguuugauugagugccaugcaaacgauucaaacugaugagugaaauaacuuuauuuucuuuuuauauaagacugucuuuauucauugguacucauggacuggguauauuuacauggacugacagaaguuuuguguccacugaugacugagccugaggacugggcguauagcuccauuguagauggcuugucuugagguucaauucucaaauccugcauaaacaggguauaguaacaauugccuguaaucucagcacucaagagaugugggcagugggaucaggaguucaaggacauccuccguggcaccaggaguuuggggcagccugggaccuaggagacucugaaauaaauggacugaauuugguaguuccuggaccguaguaguuuucacagugaauuuugucgcgugucuccaagcuuccguuuuguuuuccuuucucugucguguuugcuuauugucucuguagauuaagcaaaaagcguauauucuucagcaugggccccuuuucaauaccuuuucaauacaaaaagguauuggcucaaaaccuuuuaagaguggccaaugaaagacaucauaucaggauuaccgcuuuugccuacccuuuggccaggcucaaccacugagcucauaaaauuagcgacugucaugcucagucaauggacuuugaugggaagugcaguuagcuuuuuccuucuugcugauuuacuauuaugagagccagagguuugcaucagucagcuggacuuuccucuuggaaggcaauuucuuuccucaauagucaccuuugguuuucagucuguuucuuuuguuuacgcuguucacauugagagaaguauaaaaguuauacucuucuacauuguucuguucugcuauuuaauaguccauguauuguuuuucugcccuuaauaaagcacagccaucaugacauacuauuuguaugguguauggagagaagauuccuguguucaguuugugccaggccccuacaugcagacauuuuucucaguuuugcaucaaauaauauagaggguuagugggcacagucuuugucuuuucuuucauuuguuuuguuuuuauuccaucagugaauuaaucauuuaauuaaugaacuauucacuagucuccaucuguccaggccccaagagaguacagaagaaccaaccauaaacauacguguuccuuccaccagaaagcucacauucuauuaagagaaauaguagaaugcaaacaugguauggaagaaguugggauaaagauuaacauaauuguaggcgguuguuuggaacuuguaaaugaaguuggcaguguaauguaagaacgggacuuuaaaaugguagaaagcaaaacccaguggucagaugugaacuuuaugaagcacaggcgucucggcaugagcgcgaugggaggcuagugcgugauaagucugggagcgacacugcguugguuccaacuuaaucucuguacaucaugcuuugagaguuguucacugggcuaaaaagaacaguugggaagagcagaaaggacacaauugcuuuugaaaugaagacauuguuggcuauugugaugcagccauggauacuguagucuucggaucugccuuggauguuggcaugcuuuggugguuuagcuguauggugugauaggguggaaauauuaaaagauagaaucuuaugaaagacacugaacugagagacacuguagcuuuguggggaaaaacaaucuagaggcgagaaagugcagacgauuuauagaaauaauuucagagaacuuugcugugaggaggggacagccagauuagacaggaaugggggugggguggggguggaaauugaaaacauaguacuuuugggcuuaagaauuccaguuucagugaagcccagaugaggccuuggccugaggagacuaagguccaagucuggcugauuguauagcaggagcucugggacuugguugaagaugccuuuggaacguggaccggugcaugucgggaaggguauggaaugauaaaauauugauugauaaagugaagagcaaaugugaguagugaucuaguuuaaauaaauaauuaaaaaagaucuagcgagaacgcagccucuuauggaaaugucuggguggucuguuguuguuuuuuuaacuggcaauggcagccccacagggaaguaggugcucugcuguguucuacacaaccuugcaucaugagcuggggccagagcucuccucuuuaacuuuuaagugcucuggcaucagugccuuagcacacagaccccuuaagaccuguggggugaauuuuuaaguggcuugggaaaggcgcaaucucuauguagcaaggacugcuacaguuccccaggccucucugugcacacugaaaggcuuuccccacaguauguguugguaucuauuucagaugaacaaaaucuuaggaaauuacuucccuguaaguuuccuaccuucuacuuagacugauucugccauuuuccaugcugaaagagauaaauacauuuaaaucuucugcagagaucaccguuaaagacgucaaaauuagcaacacacaacuguggcuuuccuaagaacucguuuugcaucuuguaaaaaaauuuggggacaauguucucuuugaccaauuauaagcauacacauacuucauagaacaguauauuacauucuguagccuaaaauaccaaauauugccuaacaucuuuaaaauugcguuuucaaaagccugcuuuguagguggcuauauuuuauguuacaaaauggcuaucgguuuguuuuauagacuaucacagugaguuuuauuacagacaucaugugaaagcuaagacuucauauuuuagaaaauccugguucccuuuaauauaaacgaucacaaaucugucacccguggauggccuuacauuuccuaugugaagcuauuucuauuuucuuuguguccuauaguugguuauuucuuuuguuugaggcauaaaaauauuuuagcuaaaguacccuguguagacuucaaauguuauaucuuacauguuuucagccuauucuugcuuuuuuugauuuuauagguuuaaagauuuagauuuuuaaaaagucccugcuuuugucuucugaacucagauuuccuaaaguuaaaacuuuuauucccauuauaauaggauccuuuccauacauacggucaucuuuguccuuuugcuucuucuacuccauccuggucuuauuugagacccagcaaaucaagcauugggugaagaccugagcuggaccuacagaaccauguuuguaauaaaugaaaagcuccaaacaugauagugugcucugguagucccagggcuguggggacagagauagguagauccuuggggcucagucaccagccaauguagccuauguggccugccagacuguguuaguaaaagcagaagguaucucaggaguuacaucaguuugcccuuggcuguuacacacaaaugcgcaugugcacacacauaugcacccugagacucuagaugaauguggguucaguacuaggcauggccacaggagcccuaggaucagugccucucaaccucuuugcuccaguaacauuucauguacaaguagagacacuuagugaagugggauuucaagcuaggaugggaacaacaguggaagaacucuuccagcugugccuaugauaucagcaauggcuuacacaguuugaaaaggaccccuagagagucugaaauggcucuuccacugaucugcuccaagcucuucauucuaaggcgagaacugauauaucaaagacuuuuacaugguucacucgaagccauguuccugggaaauugcagaagaggcaaaaauagguucuuuucuucugaagguagcauacagggcuauuaaaaauaauuuauuaaccugcuugauugaauauuuguauauguguguguguauauauauauauacauauuaucuaucuaucuaucuaucuaucuaucuaucuaucuaucuaucuaucuaucuaucuauccacacacacacgugugugugugugugugugugugugugugugugugaauaaaauucaguauaccacacuagauuuggaucuaauuuuagaaacaaaaaaucagcugagcugcacucuguuagaaacuucauauaaauuauauuaacgucagaaaucagaacacaaagugacauauaugugugggcuaugauaacucuuuguguguguguguguguguguguguguguaguucuagaaauuagguuugugcaugugguaggcaagcauucuacuacugagucauauacagacauacauauguccuccacuauaauucauuaugacauauguaucauuuagacuucuauaaacagagucuaaacuucaauauuccuuuuuauaauuagaagguguauuguguauguaugguauaugccuuuguguguauccuugcacguucaugugcaggccagaggagaguaccagaagucucccuguauugcucucugucuuguuuccucgagacagggacuuucacugauccuuugauucuuuuacuuuaucggaaguuaguauuuaccucugugguuuuuuuuuuuuuaaugcauaaguuucuucguuccuauugcuaauuccucucacaucuuuucaguagccuggcaguguaauuuuucacaaagucugccacguuagggaagcugucacuucugcuaucuuuaucuugaaggcaucucuccuggugccaugcauucuguguguaccuucacucaccauacugaguaugucuauucuucuucucucaaugugucaucucuucuuggaucuuaugguuuuguucucccuuuuggagacauuucauuugaguauaucuuuuguaaguuuugucgaguuaauacagagaccacagagcagucaaagugacaacacacucuucucucuuugauccccuuugucaccaccaaauagccuccugaugguuccuguugucaggagucuuguuucuuugguucuggaauuuuaccccuucaugguguauauaguuugauguagucuaucuccagguucuuuagggaaaaauggcauuuaggaacaaaucucaaaggccagauauccaucuggugaacaucauaguucugcaguauggacucugaggaauguggaaauauggaaaacaauugcugccuguagguuguagaauaaguggacagauuaaaaagucuauauauuauaaaguguagaguggaagcagaucagaaucuaaggaccuuucuagaauacacaugauuauuuuuuauauagagcagcucacuguccuuuuauaaacccagagugaggaaacuugagaaagaauagucucaaagagauggguucuaaacuuuaaaagauaaguuugaucuuguuaaguagagauaguaggaaggacacuauaauguagguauaaaguuuuuacacagucauacuaucaauaacauucuagaaaaucugaaacauuacuuggacaugaagagaauaugagagaaaaguagagguuaaaguuggggagagaaauuggcaaaaaguuuuagaggacggaacauuccgaguagggcagugucucuguuaggguucuauuguugggaagagacaccaugaccaugccaacucuuuuaaaggaaagcaguuaauuggagcuaguuuccagauaauggaguuuaguucauuauccuggcaggaagcaugguggcuugcagacagacauggugcuggaaauggagcuaagaguucuacaucuuuuuuuuuuuucuuuauuagguauuuucuuaauuuacauuuuccaaugcuaucucaaaaguugcccauaaccucccccgucacuucccuacccucccacucccacuucuuggcccuggcauuccccuguacugaggcauauaaaguuugcaagaccaaggggccucucuucccaaugauggccaacuaggucaucuucugcuacacaugcagcuagagacaugagcucuggggguacugguuaguucauauuguuguuccuccuauaggguugcauaucccuuuagcuccuuggauacuuucucuagcuccuccauuggggucccuguaauccauccaauagcugacugugagcauccacuucuguguuugcuaggcccuggcuuagccucacaagagacagcuauaucaggguccuuucagcaaaaucuugcuaguguaugcaaugguguugaucugugggcaacaagagaaagaccaugucacccugaccauacuugagcuuagaagaccgcaaagccuacuuccauauuggcacacuuccuccaacagggccacaccuuuuaauagugccacucgcugugggccaagcauucccacacauuagucuuuggaagccauuccuauucaaacuacuacaggcaguucggguuuauuuucuagacaaaugggacuagaggaauuuuauagaguagcugcugcuaugauuaugucaucucggaaggucacauuaauugauucacuguuguccuuuguaucuggcuucuuucacuuagaagcaugaauuugagagcccgaucauaucauugaguguaguuugucucaguuucugaguccuaucccauugcuugcauggagugcgcuuuacucuccaccuccuguuuggguuguuuaugguccuggaggauaagucaucugcuuucccugucuugaguuuaguugcuuuagagauuucccccaaauggaaucucacaguauguguccuuuggaacuuggacuccuucucuuagccuauuuuuguggugugggcauguuaaguuagaguguuuaucaggaugguuuuauucauucugugguugaguaauuguucauguauuagcauauaaugguccauugguuagugcuuccuucagauaauguacagugguguuucaguauucugaaucaugaagcucuaaacauuuguguaugacacuuugaaugggcgggcaguuccaguguucuugggucuagauagauaggacuaaaaauaugugagugccuuuuuuucaaauuaagauuuauuuauuugguaucugugaguguauaugugugugcaugccccuuccugccuuuauagaagccagaauaggaauuguaucauugugcccuuuggagcuggaauuacaagagucuuuggaccacugagcuuguuacuuucugagacccaaacuucauccuggugaugguacaucacacacucugggucacagguccauccaucuaucuagccuaguauccauuuaauaaaaauaguuugucuauuuucucacugugaaacuuggagguauauacagcuauaaauguuggauuuacagguauauaccuugccuaauucagauaacucucggugcucuaguuuugauguagaacuuaugaaacauucauaaaagcuuguuuguucagugucuuucagauacuauuaaauauuaaguugauauuacuaaauauuaauuauuaagucaaguauuauuaaaucacauuauauuuacuuagauuauuagcaaaagccaaaaguuauuauuuccuuugugguguuggggguugggcccagggccuuguaaauacuaggcaagugcuucaacacugagcucuccauguuagccuguguauuguuuguuuuuaagucuuaaauauuuauuuugaauuugcucuuuuaaauucagugagugaaguaugacuauguauuaauaucaccuuugauugacaucccuuuuauggcaguucauagauuuuuggcauaaaucuauaagagaucauguuaaugcacaaaucugauauguaaaauacaggcaugauuuauuuuauguuguggguguggcuuuguuaauauuucucugucucuguacugguaucucacaagucacuagacauccucuuuaaggauuauuuuagacacacagaugaaaaaaaucacacauuuccguuugauggcuuaaaggauggagguuccucugaggcuguguguuaauuuugucuugggugcguaugauguaugacaucacccugaaagucacagagcugugucuucuauguuguuucuuuuagcaucgcugauagacagagugccuuggaggcugagcuacagacagugcagacuucucguagagaccuggagaacuuugucaaguggcuucaggaagcagaaaccacagcaaaugugcuggccgaugccucucagcgggagaaugcucuucaggacaguguccuggcccggcagcuccgacagcagaugcugguaagugugugggaagccacaggcagcagucucuccugagccccugggccaccagggaacugauuacuguuucaaagugaggaggcugucugcacuuugaguuauggaauccgugcugucccaugaauaacuaguuuuuuuuuggauaugaucuacagaauacuuaauauacuuaacauuaggcugaagaccaccuuguuuuauagaaauaauuguguauuuagagcuagagacucagggcugcuugguuuucugccauuuuaagcccuugugccauuagugcuauugaauauuaaauuauaaggucauuucaccuucauaugaaugggaaauuauaauuuguauuauuauauuuauuauaauauauauuuauuauuuauaacaauaacuuguauuuauacuacacuuaauauaaauacuugcuguagaaauuucaaaucuuugugauucaguuauagccagaucuaugaggcucaaagacauuauuuauguauuuacuuuauaaucaugacuacauaugcagucugagguucaaaucucauucuugagaaaugugguaauauuaaagcuuuucuuuaaauaacuuugugugaaauuauaugaagcaugccagaaucucucuuuccauuccaagucauagcccuucugugcuccugcgucuuuuucucuuaucguggguaaaugcagugaucauuucuugucaauuuuagauaagccuucucaauuacaacuuuuaaaaaguugcuucaucaggggcaucuccugugugccacagcgacacaucacauuuugucuguaugcugugacuuauuuacaaacaugugaauucaucacuuugacuacugucuucugccauuguggugaacaugcguuuuguuaucauugaguguauguauuuuaccuaccuuaguugcucacauaguucuuuaagcauagggaugcuauucuuguuguuuacaugauguuucaggaucaagucccaaguaaaugcacuugauucuaacuucugcaguugaaauuuaguacuguuaaccaauuuuuaauccauucuuaagaaugcuuuucucuugaaauaucuaaaagaccauauuauaaaauaucagcaaauuggauuaaaggucuagaggcuuuuuuggaacuauuacucuuaaauuuucuaaguuaaaaauaauuauuauuaauguguuaaaaggaguguuguugcuguaccuucuacaagagaacacacacacacacacgugcaugugcacaaacacaugcauacacacuuguacacacaugugcacacacuggcacacaugcaugcaaacaugcccacacacuuauacauguguaugcacaugugcacacucacagaaaauuuaaaaaacuuuuaaaacaaguuuguuuaauuuggaauaggcuuauuuauaauccauccuuaugugugaagacucuuacagucucauagugaaauuaaggagaguuagggccugggaagaguggcuuaguaggcaauguuuuugccacagaagcauaaagaccugaguuugaauucuuuguacugucaaagguuuaguguggggguugccugaugauuuugcugugggucuucuaucucaagcuguggguaggaggguggagacaggcaauuucagggucucaauggccaggcagucuucccuaaacugugugugagcuccagguugacugagaaaucaggucuaaaacaauggagaggagagugauugaggaagacaucugaggucagccuucacaguccaagggcacccacauauacacacgugcacauauggaccccagccaacacaaagaaaugguagaaaagaaagaaaaacaaauaccagagaaaaugucuguuggcuugcucauuucuuaugcauugcacacuguucuugugacuuggugaugaguguguccaggcaaguaucaaaguuaaaggugcucuuucccgucacucucucgacccucagaaugacuguuaaugugaauugcuaaaauauuucgagaaaguccucauuucaggaggcugcagugggcauucaguguguguaaacgcuaaaccauauuaguuuugugauuuaaacaacuauaaauuugaucuacacaugcuugcagauauuuaauuuauagugguguuaauuucaaugcuguuuagacugugccccccaguaagcaguaacuugugggaaggaaggaagguuccacaugaacccugcuaauaucuggccugagcagcacacaggcccauuggagagucuagugguguuuucucacacauuuucucuuaggauauauucuuaccagagcuccagcuccucuccauuuuuaaugaauauucaagcuaugggaaaaauaaauuuaaauagaaauggugggaaucuuuuaaauaaaaauaacuaagcuggggauuacuugucuuauggcaaacauugacagcccaaggaggcuguuggcuaauggauggagagaaaauguguacgguaauugcuucucaaaaauaaucugauguugcuaacauagucuguuugggcucauacgaaggcaggccuuugcuaacagcugagucagauaucuguuuaucugaagacaaacguggaauguguccaggaugccucacaguauggugaucucuguggcuuccaccuucugcucuucuagauuggauacucuuaguuuauagcccucccauuguuugacuaaaacaaaaaaauuaauccaaugacuuuguuucuggcacuguauagauagaugguuguuagauauguaguggcacuggcugagcauuucugagauaaaggaauuuaaauuuucccauggguuuguaguuuauuucucguuugugugcaugauuucaaauggaaacguguucagaaauggaaagguaugugaggaaaucagaaaagaccugaaaucaugaaauaaauuuacugguguugagcugcugcuggugguggugagccagccaucugagauuucuguguaaggugugguguuuacuucauuguacucuuguugcaugaucaggagauggauggaucuauucugauagccauuaucuaucuauuuaucuaucuauuuauccaucugucaucuaucuaucuauucauccaucugucaucuaucuaucuaugcauccaucuauuaucuaucuauccaucuaucaccuaucuaucuauacauccaucuaucaucuaucuaucuauccauccaucauccaucaaugcauccaucuauucauucaucaaugcauccauucaucuaucaucuaucuaucuaucuaucuauccguccaucuguaucuauuuguccugagaugacauguucacuguuuguauuugauuagcauuuugugccaaccagauauaaagccccacagagguauuucauggagauacaguuuauaccguguucaguuuaaagaugauucugaauauauuuuaauaaagaagggcuuggaagcacaauggugguugaagccuuucuggaccauuucuuuuauggacauuuggucauuuggacucuuguauuuauguuuugguuuuucuucuaggcagaggacuuucaguaagagaaaauuugauuuugaugacuugcuggagagagaugcuccuugagagcugaacuguacauggcagggugguggugguggugguggugguguguaccuggcaguauaauguauauuuaaucugcugcuggugggagaugucauaaaggggauuaggccagagagugagguauuauagccuccaaguuacaggaaucuagcugacgacucugugaggaauggauuuguccucagugacagagacaguaaggguaccugcuagguucauuugugcuagaugugauaguagcuagaaguacagcccugcaggaguugaaggccuugggaggaggugaacaugagaugugugugguaauccaauguaguugguaucauaggagaagaagguaacaggagagacuuguuuggacuugaagggauggcacguucuucuauuuugauuaaagcagaauaaaguguuaagaguagccucccguagaaggugccaaauuuggcucuuuuauuuuaagaagaaacuguuguugauuuaaaaacucaauuuauuaauugacgcauuugucuuaauuuucauugccacagucuagggcauucauuauuuuaauuacauuuaguuguaagcucuauuuauugcaguaucaacuacugagaaguguuaguucuuuuccggauaagcuucggagucccuauggccuuugcggaguggaugugagaaugugcuggauuugauccgaaagucuuugucuuucacagucuuccgcuuguccugcccugugcuugcugcuagcuacguguucuacuucuauuguaggagacagaagaucguucaguucuaccacugcacccaacuuguggggugaacccccguuucacuugcuggcucuggaacaggaauuauacaaguuaagcauccccaacuuaaaaaaaaaaaaagcaaaaaccaaaaaaccaaaaagcugaaaccaagauacucuaaacucuguaaguuguuaaaugcuaacaugauguccuacauguucuauaccgugacaguuucuuccaugcauagaaucacuaauaaugcuauaaaaaccauccucaggguugugcuuaaggucugugugaaacacaauugacuuaucuguaggcuugggucccaccccuggaauaccucaguguauuuaugcaacuauuuuauuccaugauggggaaaaaaacaaaaacuaaaaaaccaaaaaaccaaaaaaaaccaaaaccaaaacaaaaccaaaaaaaaaccccaaaaaacaaaaaacaaacaacaaacaaaaacaaccaaauccugaagcuucaagcacuccugggcucaagccuuucaugugaacgaugcucaacuuguaaguucauauuuuuuauaucuagucaucuaucuguuauuuacauacugcccugucuauguacauucuauaauucaguuuuuuguacacucaaagauguacagccauagcugcggucgacauagaacaaacacgcaccccccagaaguccacuucccuuuaggaucaguucccguucucaacccuucagacccugaccuuguuuuaucacuaacuaaucuguauuccuaucuaacuaagaacaagcacuuuccauuauguuaauggaaugucucuggcuuuggcagccucaccaggaggaggcaguauagguucucaauaaggagcugauggcaaauuauacauacacaggcugaaguuugaugaaccagcucuauuugacccaaucuaagaccuuaaaucacacgagugugaaggacugaggagacagaggaagcaaaaagaaguuccugaaaaugucauuuuccugaccauagcaucacagagaggugaaugagcaguguucccugggcaauuaggauaggccggaccuugauaaugagaaacauaugggcuuaguuucaggcugugcccuuuugcccagccacuuaaucauccugggauacucugguccucuaagauauugugcccaaauugguuaucauagugcaaaacgucucucagacauguauguauacaugcacauaauacacacacacacacacacacacacacacacacacacacacacacacacacccuucauaugauguacaauuguucucuuggauuuccuauaugugaaauuaaaacagcuucaggacaaacagaaagauuacgaagaugcugucuaagagggagauggagggugaugcucuacagucauuugcaggcuucuuguuauuaacuuggcuguuuacuuaagggguccuauuugauuucuggccugauuugcuccugugcagggaccuggaagccuaucuuuuggcucugccuuuggagccgagguaaaccuucaucccuccguaaauauguucaguuuuguuuuggaugaugcaaugcccagacuggcuuaaggugauuuauuagcacagagugggcuucagucuguccuuccagacaaaucccuuagugcuccucaguguuucuacucauuccacaagcacagcgggagccgcguuccacugggagugcucgcaucucucuguaaagccucauguucccugccacccggucuccucauguaaacucagcuaccaggcaugcaccguggccgugaugggguucacucucuguccccaggggaagucgccuuuguaucuuuagcuuuagugcuucacuuaauauccucucgucuccggagcgcucuccuucccugcagccagcagugcuuggccacgcugcaacuugcuucauuucuggccacgccaggcugagcagguccuggcugugagcaucugcugggggcugucuggguggcguucuucaguguuuuugucaaaucaagaaguugauggacucccagccuccuuuucucuagaaccuuaaaccccccuuuaucuuucaaaugcaugucuggaaacgagcaugcucagagaacuggcaaaucauuguccagugaccgggaggaaaugaucgcugcucuucauuuauaaugcaaauucugaggacucuucagaagugugguaaacuuaaaaugauggcgguggugagaacgucucugcagaaaguugugguuuuguuacaucguuuacaaaggauggcaguuuccucuccgcgguaccagaagcucugcaagguaacugauuggaaauagggagugggugucugaagaauccacuguugccuggcuaggaaauacucaucuuucaggcuccucugaaggaaaggaaaaacucccuuuccaggcaacugauugcaaaagcuguuaaaagaaaucgcuccauuaaaauuuauuuaagccuaugagacaaguacuauuuuaguacauauuuuauuuuaccaucuauaaccuagucuucugagauggguuguuuggagaaaauaugacaaacuauuuucauuaagaccuguuaccucugggguacuuuacaauaucuuaauauuuaaugacacauuaauacaauguuaagcuccagcaaaaucaagcagagagcucagaaugcucuuucaacagauugcuuaccgugcucuucuuuuuauagcugauauuuuccaauuaagaaaaguaaugcccauuuuaaaaacaagcuuagccccauuguaaacauuucuuauauucuuguguguccacauguccuaguuaaaguugaagaacacaauuuucuguggccagguggguuaaguaguguuuuaggauauaacuuguuugacaguuauacauuuugaaugcaaugucaguuauucuaaacacaagccgucccacguccuccuguguuguuuuggguuaguauuuguuauugcccauggucuuaucuuauuuaguguucguacugucuccuuauuuuuauaaaaacaagaugauaugaugcaaaaggaagauuauagcagcagcaaaucaaauuuuauguuauuacaauuuucucccuguacaauucuuaguaugcuucuaaagaaggaaucuuacuguucuuuaaaagaucaacugaucaguaauugggaaaacugccucuuaucucauuauuuuucugaagauguuaaauuugauguguugaagcaccuaggcucugccuauaaagcaaugggucuaggcugggaagcuggauucuguuaauuugauuuuuuuuuuuaaucacaguguugugcuuuacaguuugucuaauuuaauauaugucuguccagaaacuuacuuuuuaaaauauaaucuuaggaaaucgauugauauagugagacgugcuuuaaagagaugcuauauuuucauuuguguuaaguuaauuaaagcuugauccaacuuauuaauccagucggaaaaguacagaacuaacuguuggauauguugagauuucaucugcuuaaagaauccguguguuuuuguaagauguuuacauuuucacaaaaagccaauuuugauaauggagaagaaaaaugcauucacuaaauaaguauuaguauuuuacuuuuuaaguauugguauagauacaugaaucauuaauauauguuacuuuuuuaaagcuaaggauauaaauguaugaagcauuaaaaaaaagcuggguuauuauuuuucucaucuauucccauaagcacuuucacaaaagcagagggguuuugagcuguaaggccauugggugcguugacuuccacacauaaagcaaaguuaaggugcuggagaaagcuacuaaguagucuuaugauaagacccugaauaagcacacaucauguuacuggagucauggggaaguucacuuccaacaggaguauucuuugggaagauuuauugagauuuguaauuucucaaagaugccuuagaauuuaaaucuucggcacgggcauuacuuuuugggaaccugagguugucuuauuugcaauugaaauuuacccuuuauauauucucuacccuaugugaaauuagcuacugcucagacagggagggggggggcacacacuuccaguacuuuccaguaggugucagugucaggcagugauauaugagguuuggggacuccagacagggaaguggcgugaugcuguuguugacuaugaauaaaugaacugguagcagguaucuuuuauuuaucuuauuguaugugggaaauggauccuaaugcauaucauuguggauaaaauuauagguacagacuuaaaugucaguuguccuucucuguuaauggcaugguaucuauaucuacugagccuacuuguuaccagugcugucacugugcugcaaguuugaccagcuguacuguuuaucugcuuagcgagacacugaauucucuuuauuuaaauugcaaauguuguuacagcuauuucccccuauaucccuuacauucucuaaauuuagucuuuuagaaaggaaauguuaaauacuucaguguuuugccauaaaaaauacagaaagucuauauuucaaguacauuuaaagacgagagagagagagagagaaagagagagagagagagagagagagagagagagagagaagagaagagucuauuuugcguucaucuuggcauuuugaaaacuggugucugaauauuuguacccucuucaucuuucacaucuuucuuuugucuguuguauggguaucagucauuuauaaguaagugaaaaacgacuggaaaauugugcacaguauucuuauuuugaguuuuauuuauuuguauguauuucccccugccuauuucucauagggaaagggacagggaugggcagaacuuggggaaacuguggcucugaguaaccccccuccaacuguacaugguguuguauuuuuugcuuuuaaagguguuucuuucugguuauacaaucccuaaaauuugggcaggaaacagaaacacauuggcugcugacuugagaagcagcagcauugaaauugcccugaugaccucgagccaccccacgcuagaugcuaauuucuccugauuuggcuuagaucacuuagcuucuuuaaaauauuaaugacucuagaggauaauuuuuccucuauuagagcacaguggacacaaagcuggauguaagugacuuuuaagauugcuacugacuuuaacuuguuugcauuuugugauuaucuuggccuguuuucagucuuugaauugaaaccugauugagguuauguugaguuagagaggaauuuuauaaucccacccccacccccacccccucagggacauuuuuaauggcauauuuaauaauugacgugguaaaaaguagauucuuacaagguagauuagugggugagucauagaacauugaaaaauaauuaguauuauaaauugaguccuucaugacuucagcauuuuuauugauuuagcuaauuauuuugauuuaguuuuaugauuuuuuugugcugccagcauauguauguaaaacaguuucgcugaaauaauuuugugcccaaacauuuugucauguguccuaugaguuaaaauauuuuaagcauccugguguauauuauuaauucaagguugugcacaggugccaugaagaaggaaacagcuguucaagaaucauagaguguugauuuguucguguggucaauauugucuucuuacugcccagacugauucgccccuucauucugugcauuuuucucccaccauuggcuuauuaguaggggacaaugacggcuuggaaagccagggaugacaagugauguuuaaacaaaaucaguuucuccucccugacgucuguauauauguuugugugugagaaccacauagacccuguguggguacuuuuauaaaggguaacucuauaacugaacauaucccaaucacucaguguuugacaugacuuuuaaguucacaugcugccuggcaucuguauguuaauaugagguucauauaaggucaagcauaugugcuggacagugguggcacaugccuuuaauccuagcacuuggaaggcagagacaggcugauuucugaguucgaggccagcuuggucuacagagugaguuccaggacagccaggacuacaugaagaaacccugucucgaaaaaacaaaaaaauaaaccaaaacaaaacaaaaaagguugaacauauguguuuugggggaaaaaaauagaacacgugaguggugcauuuuaaaauaagccuuacagguuuuacuuucaggugggguguguugcucuccuuggauaacuaaacccugaaguguuucagagcaugaaacaagcuugacuuggccacagucugaauguuaagacagagguauuuuaagaccaucugucaggcucccuugguuucucucaguaaccaaaccguacacauauuucuugagccacaguaaauggacguccuagccugagguccccuugaucaugagucaguucuugcuuucaugagaagccaguggguuggguaguucagaagguguauggagguggagaugccguggagcaaaauggcggaugcggagggauucacauuuauucuccccuuuccuuggugcuguuuguggugucucaucagagaugugugaacucccagaacgaguacuuucuuaaugcucugucuucugcaguuccugcugagguccagauuacugacucaaaacaggagaccuuccucccugccugugacugucacaggaguuuuguuuuguggcuucccaaaggggcagcagcuuagcugaucugugaccucccuuuuuaccauaauuccucauaucaacgcgaaugucaaaauuaucuuuuauuacuuaaguaguaacauaucguuaaucagaaaacccauguuaccaaugacuucacuuaugauuuaaugcagugcuuuuuacaugauuaaaaaauagccgggcguggugguggcggacgccuuuaaucccagcacuugggaggcagaggcaggcggauuucugaguucgaggccagccuggucuacagagugaguuccaggacagccaggaaaauacagagaaauccugucucgaaaaacacccccacccccaaaugccggucacaaaguuaagugguucuuuaagaacaaaaaacguuaguuggaacucugcgugacugacgcggauacaguagggaguaaacagaaaguucuuucugagaagagagcuggcauagcacucuagauucagaaaaugcuauuuugucaucgugacuaaaagcuugaugacuuguguuuccucuggggugcaguuuauuaaguaucaaauggaaauuuccagccuguauguauggaucugaaagcuauaggcacgaaccgcuuucucuugguucucggcagagcccugcuggccuuucaaagggaaguuaguuguuuauauuuagcucuggaaauuaagcaauuagcagggauaggagaauauagacaaugucacaccauugucguuuucucacuugcucgaaguuuguucaucucaggcaagguaaaugaguccaaguaauugaaguuggaaaggauguggagugugggagaggauugcuuuucauuuuucuuuuucuaguuuguucaggucugugaaguucugaaagacugauuuguaacaaagcucagucacagaagcggacagugcuuuuuaaugcuuaauaaauaauuggccgcugugacagcauggccugauaaagccggaacggaaucccucuagaauggaaagugaaguaguugggucaggccuggugguacagguucuguacucucagcuaacugggaagcugaggcuggaagauuguuccaggccugggugguuuguagagugaacugaaggucagguuguauaacuuagugacucucugucuuguauugaaauguuaaaguaucaaagcuuuguguauugugccaggugaacauuugccuaacauauguaaggcccuaagggcaauucccugcaguugcuggaagguguugguuuucagggugggugccuccuucucccugcucuuccuccuucucuucucccucuucuuccuccuucucuuccuccuccuccuaauacauauuugugcauguuuauuauagaauugguagacaguuucuguguauagacaccaugaccuugacaacucuuauuaaaaaaacaaaacaagacaaaacauuuaauugcgcuggcuuacaguauagagguucagucccuuaccaucauggugggaagcauggcagagugcaggcagacauggagcugaggguucuauaucuggauccucaaacagcaguuggagacugugucacaccagccacauuugaccuuaugcuaccucaaagccugcccucacagugacacacuuucuccaacaaggccacaccuccuccaaggaggccacagcuccuaauacugucacuuccuaugggccaagcacuuauauacauuuguguaugggcuccauaccuguucaacaccacauucacaaaagugaccaucucuuuugagacaggaucuuuuauuggccugaccucaccaagcuguccagacugggguggauucucccuguuuagacuucccuagcucugggauuacaaagacagugcacacacaccaccauacccaacaaacauuuuucugugguuucugagaaucaagcucaagucaagcacuuuauccagugagccaccuucucaggccauauuuauggugucuguauuuuuuccuacuguaaaaggacuaggaaaacaaaaacuguugacauagaaaaccacagcacaauaaaaauuaacaggaaagcaacaacccuagacuccaugggaaagcgucuaaugaaacacggacagagacgccuaaugaauaggauuguaaacguucuauguguuuuuaagauaguguuaauauauauuuuuauauguuuuaucuaucaucuauccauuuauauaucuucuauuuaucuaucuaucuaauuuauauaucaucuaucuacauaucuuucaucuaucuaucuaucuaucuaucuaucuaucuaucuaucuaucuaucuuccuaccuaucaucugucugggaaagaaaauugucaccaguucuauguaacaucuggagaaacaagcucuuuuaacuccacagugaaggcacagaguaggcgaugcuuggccaguacaugauuuaacuggcacuguugacagguuuucugauuccagauucagugucucucugcauuucauuucagguggucacagugguuauccugagcuacaaagaaccaugcgguugagggguaaagaaagagaaaguagcuuaagucauugcuauacuuucuuuuaguuaucauucguuguauuuucacuguacuaggaaggaaauccccuguguagauguuucaucacccguagucuugggcaugccuagguacuuguucucaucuugaaguugaaaaaacaaugagcaacugggcugugguggcgcacgccuuuaaucccaguacucgggaggcagaggcagguggauuucugaguuugaggccagccuggucuacaaagugaguuccaggacagccagggcuacacagagaaacccugucucgaaaaaccaaaaaaaaaaaaaaaagaaaaaaaaaaaaagaaaaacaaugagcuacauuauuuuugaaacuauuuuggcuauaugaacguuuuuguuuccaguuucuauaggcuuuuuuuuuccccccuaauggauucauuucucagcuuuguacaaaggauggauuggcucauuuuaaugcaaauugauauaguugguucuggguuuugauucauaauuuagcuugguuugagucucaauaccacaaguauugaauuauguauuccccaagccuaauucuccauacccaaauguaguuuuuuaucaucauauuuaagacacauaauagcgccuuuagaagauaagugggaaggagccagcuguggagcaccuuguuuuagugaagcaucuucucuguuuugaaagucauguauucagugguucucaugcaccacauauauguucagcgugcagggaugugccagcuuugucagucccagaaguucauuuaaguuguucuaaagacauuuaaaauauuuucuucuuauguuuuuuauuuguuuguuuuaaaacuuuaaagcuuuguuuuuauuauuuuugaaguguguaucucucucucucucucucucucucucucucucucucucucugucucuguguguguguguguguccguguguguguguguguguguccgugucugugucuguagugauguguacaugaguauagccagagaggcuuggauccucuggagcuggaguuacaggcaguugugaguugcuuaacauaggugcuggcauccagcuguacuacucggaaaggcaauuaggugacccuaauccucugagcuagcuaucuuuccagcccuguuuguuuuuugaggcugucucugcauauguagcccaugaugaccucaaacuaagcauccaccugccucagcuuccaggguacuaggauuacagucucauaccaccacagccauuuauuuuaauaauuaauaauaguaguaaugguaugaacuuuugaagaauuguugugagucaaaguguucauacuagucuagaauaagacuauguguauucacauaauuuuggccuggucauuuacuacguugacaucaccuugacaaaccauugacaggaucuauagcucagcugucuuuccagaaaaugagaguccaguuaaucucucugaauuucacuaacaucuugaaucuuuacacaggcuguauggguauucauugaucaagggagaugaccuagggagugugcccauaacuucacgugccugugugugguauuguuacuuuccugguauucucuaacauuaaagggaccaccaaauccuaauaaggaaguccacagcauaauggcccggggagugccucucaaagauucaaaccuuguagacucuggcuuccugagaugaagucugggccauccucagcagggcuaccuuacaccacuguucucuauagagaauaaggaaagagugcuaagagugcuacagaggggugugugugugugugugugugugugugugugugugugugugugugugugugucuugguuucuguuugcagcucugcuugggaaaguccaggcaauccuuucccuugaccuugagguaagauucccauaggauaugcauuccccaguucuguucacuccucuggauuuccaggcuccuccuuauugccuauaaucuuugaagccuacaauacaacuaucaugcacugauuuagacauuauuaagagacucuguucuuuuuaaacaaagccaggaaagacaucacuuguccugggaccacuguaggagaauacaacacauuuacuuagagauagagaaaagcaaaaacuucuuaaauacauuuuucaguaucuugaagaaugaucacuguuuuguuuuguuucuguuuuuugagacaggguuucucugcguaacagcucuggcuguccuggaacucauucuuuagaccacggugccccaaacucacagaggccugcuucugcuuccugagugcuagguuuaaaggcauguaccaccacacauagcagaaugaauacauuuugauaucauaaguuuugaccaaacaccugaguuuuuuuguuuguuuguuuuguuuuuuguuuuguuuuguuuuucgguguaugccuaccauuaauuagcuaaguaggcauaauuuuuuuuuccaaauaguuaauuaguuaacuaauuuugaggcaggaucucaucucauaugucauccagccucggcaugccuggagcucauggugaccugagugagacucacugcauagcccaggcuugucugggacucacuguauagcccaggcugacccaggacuaacugcuuagccuggacuugccucagacauggaguaauccugccagcuuugccuaccaagagcugaguuuacaggcaugugccaccaugucuggcuuacuauguguaggccuuuaacaaaugcucuugcuaauuguucaauguauuuuauaaaauaauaaaucuuacuuuuaaaaggguaaacuuuacagaacuuagaggaagagaagaaggggggaauuugauuagauugagaacauuuccuguaugucuuuugguucagaaucuacaaggaucacagugccuaugccccugaccuauacaagcugaggggacaggcuucucuaagacuugcuuuuauaugcaagcuaaguaggcauaauuucuuugcuagugaguuuucuccuugcauguauaacuucccuuuacaucuucauauguuaugaaugcuuuccccugggucaaaaaguauuucuuacauugugauuuuuuucccucaaugguguaaauaaaauucaauugaauggcuucaauuugccauaauuuauccaagcuuucaaauguggugagaugcaugcuuguugccaguguucuccugauaaauuacuguguggcgaacauacuccugcauuccugacugcauccugaugacuuucagaauaccuucauagaauacaacaacugcacuaaaacgcagaaccuccaaaagcucuuacacgcaaggucaaauuccaccuugugaggugccacuugcuugcacgcucucucccagcugagaggaugaauuucuagcaugaucacaggcaguagcaggugucgguuaaaugauuuuaggaaguuauuagaucaaacccccccauuuggcaaaguagagaaccacauauucugucccugaauggacugcugagaacccgaacacuacagggccuacaugggcaugacagagggugugugguaaaaccgaaccuaggacauucuaacugaaaugaccgaaguguuuagggaaaaggcaguacccaacauggaucuggagggauagguagaauuguagagaagcugaggcuucugggaauagauaagagaacaagcagauagcuagagcauugaagcaugcugguugcaucuaggggaccgaggcauuuauuugccagaguucauucauuaaaauauuguaaugacauugaacaagucuuuugguuuccagguguguggcccugacuccuccaaauuacugaaguuuaauccaugagaugcuccagcaugaaaaacaucucuggaaaggaauuauaaaguuuggaggagugggugugugagcgugaacauucaucugucuguguguguauguguguguucauguggauuuauauaucuaggggcauguacauagguguacuuguaguuguggcagauugauaucaaaugucuucuauuucuuacuguaaucuucuaucuaugaggaaaaaauauuuuuuucacaacuucaugcaugcacaugauguauucugcucaccccgcuuuucccgucugucccuauaagcuccuauuccuagcuauuucccccgauuuacuaguuuggcuuuuguuuuauacccuguugaguuaaagaagggucaucagugugacucugaguuuggaacuaagcaugagagccuacugggcucaccagagcauggaccuggacacugucucccuccaagagucugcugcuugcuaauagaucagcagaauugacuguguccugccuguuccuccucccuccauagcuaacagaggcccugacuucuguggacacagucaaccuuguuuuugggauaggaucucucacugaacuuuuacacucaccaauuuggcaagaaagguuaucuagagagccucagggauccccucucucugcuuucccacuaagauuauagaccuguaucaccaugccuggccauuuacacaaguucuggggagccucaucaagugcucagacuugccuagcuaacaguuuauuaacugagccaucucuucaguccugaaaaggaauucugaaaacuaaauugcuuaaugucuguauauuuaaggcaagaacauaguuacuuaugaugucuucuuuccaagggacaacuuuccucugaaugcaggacugcaauuggagugacaaaaagcuggaaggcaauugaugaggaaaugucaugguauuucaagcagaaaucuaaaaagaaaaggagucacgggaaaugugucuauuauuaacuuagauucuagacuuauagaaccuuaggguuuauagaaugguugaaauuauuuaaaguuuuguaucugaagaggcaauuccuuagcauacacauagaacuucucaagugagugugaauauggacuuugaagguagccaagguugaacagccaagugguccuuugcagcucagcuuucagggauuucucugauauguauauuuauauguguguauauauguuuaugugcauguguauguauguguacauacauauggauaugaucaauauguguacauguauguauguauccauauguauguauguauauauauauacauauacauauauauacacacauuugcauguuaugaugauauauaugcauauuuuucucacuuuucguaguacuacauuuaucuguuugucuguuuuaccuuuucaauuaugaacuuuuuaaaauuuggggccaugucuuauuaucaguaucuuuugauccuuagaauacugaacaauauauaaauaauccgauguucagaauguuacuauaauaaagcagaaaugcaauauguaauggcuccgguuucuuuuuuauaacagcuuuauugaugugcaggagagauggcuuggcaguuaagagcacuuuucuauucucucaguggaccaggguucaguuccaagcaccugcaugaggccucagaacugucuguaacugcaguaccagggaagaagcugacagccuuugcuggccuugccgagcacaacacauguguaugguacacauacacaaugcaggcaaacauucauauauauaaaauguaaaaauagaucuuagaaacaaagagcuuuauugaaauaaaauugauaucuagaacaauuuauucuauucaguaaaauaaaaauaaaaauuuauauauuuaggguucugcaaccaccacuacgaguuuguuugugaacauuuuaugaccuucuaaaacagauagauacccuuccuuauguuccgugucugucaaccugagacagccacugccuuuccuuagcuuuucuuccauuaaucuauauggaacacacacacacucacacguauuuuaaauguuuauguaugccugcaacugugaaaugcacacgugcuggcuucucacagaagcaaaaagaggcugucagguuuuacuuaggguuauagaugauugcaggccaauggauuugggugcugaggaccaaacuccuguuuugacucucuuaaccacugagucaucucuccagcucccccuuuuuuuuaguaugugauucaguuugucaacauugcaaaauagaaagucauggaaaaccccuuauaauuuucugugguaaacuuacuacuuuagcuuagagaauucuauauuuugauuuuguuuguggggcagucuuagcuuggcuuguaauucacuuuguagaccaggcuggucucgaucuuacggaaaucugccugcuucugcuucccaaugagaauucaguacaguuuaauuagaaauaacaaauaagacaccuaaguucaaucuuuauaaacccuauagagcuauauauaacugacuuuccauaauaauuauauaaguucauuaagcauaagaauaaagggggaaaugcugaauuugaaaucagaaggccuaugugacgcaaccucauuugccacuucauuuuauaaaaggcacauaugaccuaugaauucuugagauuucucauuuaaacauuccauaacuucaggaaggucucauuggccugguaucuuaaugcuuuugaacuugcccugaagagcuaaaguauuauugaaacugccuuuucuaugauucccuuuucuacaagcagcaacacugauaauauuuaucuccuuguuuaaucacaguucauuuggaauauaacacacaacccaaagagucuguguccguccucgcucacuuagccuacugagaacuccagguccuuuuguaguucacggccauuucagcuuucuucuucccgaagcuuauuuccaacuuccuuauuaggauacauuuucugccaguaaaaaccauagugguuuuuccaaacacauccaucacuaauuagaacuucacacauuguaucaugucuuaagagucuaagaccaguggcuaauggccucuggggcaacaugcuuugaaaucaucaacacaaaauuaggggcagcugugauugcucuuuucucuuccuucucugguuuccuuccuuccuuccuuccuuccuuccuuccuuccuuccuuccuuccuuccuuccuuccuuccuuccuuccuuccuuccuuccuuccuucccucccucccucccucccucccucccucccucccucccucccucccucccucccucccucccucccucucucucucucucucucucucuuucuuucuuucuuucuuucuuucuuucuuucuuucuuucuuuuuugagauagguucacacuguaagcauggugguccaggaacuacuaugcuggaucuggcugcccuugaauucacagagcugaguauugguuuugaagguauguacuaccauaccgggccacuuugguuucuuaaguccauacaucaauaaccucagaugcucacgagcacuagggaaggcugcaagaagauuuuccuugaguuuuaaugauaauuaaacauucuauacuucucauauuuuuucuguaacuucucuauugagaauaaggucuugauaguugaugaagaacuugaauuaaugaccacagggauagucuugguuugccuuaguucuugaagccaaguccucauuacuucuuugcaugcccuuccaguguagaaaaaucucaugugguguggaguggagguaaaguaggaguaaacauggccucuuuuuuuuuuucccaguaauugcuucuaauggaagccuaaugaccuauuaugcuuauuucgaagagcggaacagcuuaauaggaagccggugaaggauuugagaaauuauauaauagaaaccaaaauuucaggaacucacacaugugguugagaaucaauacuucauuagagaauuuaaugauucagugguuugcuggugccaaaugucacccuuacuuuaaaagccguaggaacuuguagaugaauauucucaggagugaggaccaaaggagacggcugugcuuuuguucuuguagguguuuauuuauuuaaauucuacauguagacaauaaaaggugaggagaguagaauuuucuuacagcauugaaauauuauuaaaauuuaauaacuagaagugaacuugacauuuuuaaauuuagcuuccucuuugguuucuuuguucugcuuuuauguuugagacaggaacuuguuagagcucagguuggcuucacaaucuccuggcucagccuccccagugcuuagaguauacacuuggccuuagcuuuugcauuuuguguaaaauccauggaccaggugcgucaaaagguuaagugaucuguccuaacuuucaucaauagugucagcagcuaacuucucucauggcgauauacucugguuguggguuuuaugauacguuacaucuaaagugggcuuuguaggucucugagaugaaugguuaaccucaaaugauauaccugaugguuguaaacauagcuuuuggauaaaauguucaugcuaacaguuuaacuguugccaacuccagauguuauugugguuauuuuacuaggcuuucaacuguuuuguauacuugaguguuuuuaugaugaaaugcuggaaaaguagcagccauucaaucauaagaugggucaguuuccuguaaggugcuuaugggccgcuaucucucauagccaaguuaagacagugauacguugaaaaugcuugaaaaauucuccauuuaccuggugauaaguauuugcagaacaaauccauagcucucaugcuuugaacucaaacucaaaugaaauauauuuuacaucacuaucuguucuuuuuacaaaaccugcauauaccuccuaucaacauuuauaacuuugcaaaaacaugagauacgauaugccauaggucacaaauuccuguagagauuaaaaagaaaauaaucuuauuucuuuagcauccagcugaauuccuauuuaggcacaguuuccagcccuuucuggaaauguugacauuucuuugggacuugcauaagggguaugcauccucucacacauauugaugcacaugcugauuuuaugguucucuauucauaaagauucaauuugcaguccucaucuuuauuuaaggcacaucaguuuugucaaagaaucauuuauuuggauuaaaugacuguauagcucauuuguguuacauuguuuuauuuugcuuuuaucaauucucugauaucauuuacgcuaucuauuucauaaguugacuuaaucacaucuagagugguucuuucagaacauauguuaguauauuuuuggggguauauguguguacaugugugauguauguaaguagauaugcauguguguauuugggcgugcuuaccuuugccaguacauguagauguuaguauuugauacuggaaucucuucaaucaagcagaaauaauaauaacuauuauuauuacuugguuuuugacaagaaauguuauuggaccuggagcucaccaauucagcgaacacuugggauauuuuuuuucucugucauuuagcccuagauucaacagaccugugacucugaaaucacaucuucaagucuuucagcaagaauuuaccuagugaguaaauuuaaaugagcaucuucucaggcuucgccucauuccuguuugagauagauagggucucaggucuguaacucaggugagauagauagggucucaggucuguaacucaagcugggucggaacucagguugguuuugcucucccagcaauccuccugccucaggguccagaguucuuguuacucuuaaaauuuucaaguaauuaaaaaaaaucuuauuauuucuagcguguucuacuucacuguauaaacugacauucuguaauauugcaaacauuaaguuauagaguaugguauagcauaggauauuuugauuuccacacaugaauuggaugucaugaugugaccuagaaauagcugaguuguuggaagauuuuacauucuauuuauuuauuucucacaucuaguuuguguguugauuaauugcucuugauuaacuuccaacuccuuaaaguaaaucaaaauuaacaaauauuuauugcagcuugcugaaaaucuuguuuacgccacauagcguaguugaagucucacuuuuaauaaaggucagaaaucaaacacuaacauuuaaccaccgcguguauuuccugauacagccguuacacggggaagugagugggugcuucaguuuggaaucagagagaggaggacacucauuuaaauaauucugcaugauuuuuuuguuuuuuguuuuuuuaaucuugcuggagauugaguccaggcuguugagcgcacuugacaaguguguuaccacagggccaccccuggugcgacaugcuguuuuccuuuucaugauaucagauccuuugagaaauaacuaaagaauuguaaaacagcuaaaugaaugaagggaacccuaggcaaggaaggguaaaggggauuucuggacauaccuugaacagaggagugaaaugggugagaccuuaacuguuacaaguaaguuauuauuuuuguuguuguuguucauacuugcacuuaagcugguuucucuaaaguaugaaauauuguuuuauggcuuuguggggguagggcuuaauggcuaacucagcaaagugcuugcuuugcaaggacaagugacucaguucuauauccaggauccaugaaaaagggcugugccuguugguauguacuugugagcucacugauggguaggcaaggacugcagcauccuugugggucacugaacugcccacgaccaguuaugacacuaucucagaggagggggaggaggaggaggaggaggaggagauuucuugagggcugccuuccuugcacaggcccauaucauauacaguuccauguacaugaacaugccgccaucccccuuucaaagaagguugcugacaguguuauugagaauugucuucugucuuccccacuacauaugccuccauauccgugaacacacacacacacacacacacacacacacacacacacacacacauacaccauauuaaaaugcuuuuagugaccuggauuuuaguagcaaugaagcauuuugacaauuuuuggcuaugcauauucaucauauagauuucauuagcucuaaaaguggaauuuauaguguaacuccuggauauaugaaagagaaagcaccuguuuuauaaauaucuaggagggaagaagaaaagaaagcugaccagcucaguuugcucaucagagagcaacacuaguaacaucguauuuccuuucuuuuuacucaguuaugcacauugaacacacugagauaguauuucacacaaugucuucugcuuucuuaaguaaggauuguguuggcagcggugauuuguuucuaacggauuuuauaagcauuuuagcguuucuuuauuugaaaaguugucauuguagcaauggcuccagucccacagugcucuguauuuuagaaaaugcuuuuucaaucugaguuuggucuuauaauguggaaaugacucccacaaguuauucuuagacauauacgugugugcgugcuucccauaaaaaaaaaaaauaaguguauguuuaaaaaaauguaagacaagcuacuagaucucuagaaaaauccaauuauuuauuuuuaucuguguaucuaugagugacucauuauuccauaguaaauacauucuugauaccaugaaaacuuucuuuuucuguuaugauuccuccuaugagugcaguauguggaauauuuggugguuguuuuucagcuuugaauauuacaguuuguggcaugucuaauggcuuuuaaaagacaaagcaaagucauuaauguccacaaguguuuuaucugaguacagaguccuguaaugcuuucagaagagggucgucaucacagccagccuuugggucccccguggcucccuauuguuauugugcaaagcuguacugcucugaaaaauccugguucucugugaauaaagcauucucuuuggcccuggcuugauagagucucuuagugucugagccuggugguuuguuucagcucacagcccccaccaacaccaucauuauugucugauaguuguauguagaacaccaugguaugccauuugugacaaaaauuaauuuuacauauagugaaauuuuauugugcaucugcuaaagguuugccuugcccgugaggaugccagcccuggcgucuggcaguagcacaugauaguaaggagcgucuccugaggugauucaggguagaacguugcuaucacuugaccaguuaggucacagaguucaauagaucuuccuuuucaaugugaccauaagaccucaacucuaagccuauuucuguucuucuuucauuaugacucaguaacuuuuccuuaucagcuuuggcaagagagcaccugucaauuacuuggagaaacuggcuuuagaaaugaaucgauauucuauuuguaugucaccucugcuuugaaaggcgccauacaauccugcauucuugcaaccagucagcguuaguuccucagcuucggguauggauccacuugauguucugcagguuucuuucaaacaaccaaacuaagcaagaagucucuccuuaggcugcugagcuccuguaacugcagacugaguuuccugauauuuagguuauuuaggaguugagaggaaaucaucuugaggauuccaaacagcauuugagucucauuuggaaucuuccuguccucuuugcaaaugcucuuucuuugugaguuaagaagaauaauauuuaaguugugaacaaggugaauggucgugaaguucauguuguggcaucucuuuauggacauucucaugagauagauuuuguguuucuuauuuuguucuuuuaauuugugggcauuuucuuauuugcucaugggaauaaauucucauuguacacuauugacuuaaaacguaauaaucacacaucauauaugagcucaauguuuuauucaaggauagcccaaaagcacuguuagacaccggaaaauaacauaacuugucuuuguuaguuuuguguggugacaucguccuacacaaaacacaacuuuagauuguggcauauacaugugcagagggagcuguuaauucaaaccaaugagagcugguaaaaggggaaagggugcuggguggugugucuaggaucuacaguaaucaccaugcucagcaacaacaucuguugcuggcaauauuggcaggaucauaggagaaagcaaucauuaaaauuagcuggugcuugcuuuaagcaccacacagcgcacugacauuuucaauauuuucucuaguuuuauguuuucucauuccacaaguauccaccugguuuugccugaacggcuucuauuaugucuuuuuaaagaacuauccucuaccuuucuuucugaaucgauuagaggcuauagcuugugucuccagugggccagaguggccuuuaccccucauauugcaacuggguaccacagccaccugguuugcauuuggucucacugaguuuuaagaauuguagugugaaggagacucauuaauuugucuuauuuuaguugaaggggauccauggacuagauagaguauauuggggaaaauucugggggggaggggaacaacuuaaugucguggccuucuuggggacaaggggacaaugcugucuuuucugagccucucaaccucuccuuccuuucccucaccuguucaaggagaggaauggcauuguguuuuuagaaguuagaauuuguauuucuccuuucuuggucagacagaugacagggacacacaaaggcaugcacgcacacaugcacuugugucuacauuuucucugucucuuguuuuuauuuuauuuuauuuuuagggacagauaugauuuuugagacuaaauauuuuguaccaaaaaugucuuucgagcugccucuguggaugacuuucuguacacucccuucuuucacaaggcaggacaaggcugcauuauuugccaagaagugaaaugaguauagaguuggaaagcugacaacuccuaaccuuuuaggguguuaaugcaucaaugcacuguucaaugguugauggagucuuaucauucauucaucuauacccagauucauuuccaaagcccagggacaggacacaacaauagacaaauuugaucaaaaggucuagcuuucuccaaauccccauuucagcugggaaggaagcccagcaguccuuggcugagggcuggcuggggauggagccugguugcugagugcugagaagagaccuucacuguggacucaucuuccagcugucugcuuugcuuaaauaauaacaaauaacccaacugcucucuggagagaucucuguucuaccugugagcccaggaaacaucagcuucucauggauuaugaaugcugauaugguuuugugaaggaguuucagcaaaguaucccaagaucuucguauaaaauuuauaagaugagaguucauuucguagccaaaaugguguggggcuggcuucucucugguaucucuagccuuuugucaagcagacaagccaagucagagaacucuuuuuauuucuggaagacacuagauuuaaaugaaaaaacaaaacaagacaacagaaacccagcuuguaaauacaguuuaaugacauuuuaggaagguuuaauauacuaacggggauaauaaauuguaucuuucacagcccacucuguguggauuuuuucauguaaauuucauuaaguuuuaauucacauuaaacugagaauaauaauaauacccuuggaccaugggugggcuuuggggucucagacggaguuaagaagaagaaaacugagaaaggaacuuaaaauuaugguuaagcuuugccccauaccauaugauacaaaguaaaugcaugcuuaaaauuauauucuuuugcccaauagaaugucuguuccacuaguuuauuucuucugacuacugagacuaaaauacuggucagacugucaguaauuuucuccucuuucccucuaccugguugcagcacaaacaaagaaggcagagauuuugauuccugcauguuagauuuucaguguagucuuagcgcugcaagucugcucagccaccugauucuccucuuguuauuauuuuuaaccuguuaaaaccucgguauuuuuauauauguguaaauauaauuagcauauagacuugcacaaaauacuaaggucccagcuugauuucugucucuaugauaaaaacauucugaccacaagcaggucaggggaggaaaggguuuacuucaucuuacacuuccaggucaaaggccauccuuggcggaagucaaucaggaacucaagcagaacguugaaaccgaaacuguggaggauuuuucugcuugccugcuuacuccggcucauccuacuuucuuacacagcacagggcacuaggccauugugcuucaacuaauaaaucaggacaccccucacagacaugcuccagucuaacccagggaagacaacuacucaacugaaacuguuuuuuuuuuuggggggggggucgggguggggaguaggaaguguuuuuuuagguuguucucugcuguguccaguugauagcuaaaauaacccaggacaaauagauuuuuauuguaucgcugucauaccuguccgagggcacuuugguucuaucacauuaccuaucauuaguuuuuugauggcuaugggggaauagccugaaagaauauguaaaguguuaguaauuaaaggcucuucugccuguuuucugaaaaugccaugaaaaguguuuaauuauacucuuagugaucgacaaauauuuucuuaaaacagaagugauaaaguguguauggcagaggaggucugguugauucucagacgagcagaugcagaagaaauaucaacaaaacacagccaccagcauagacuaaagaugcaaaacaagggcaaucauagauuccuugagaguuuacagugaacguuugugugugucugguguaugugcaugcauguguguauguguguucauauguguguagauacauggggguguaguugcauauccauguguguauguguauggagucuagaggacaaccccaguuauuauuccucuggagaccucuaccuuauuguuugagacaguggcucucguuggccuggaacucacugauuaagcuaggcaaaaaggccagcaagcccugaaccugccucugucuuccugcccaaccuagcaaugacaaucaugccaccacaccuggauuuauacuguguuucuguugcucaaucucagauccauguguucacaaggcaagugcuauauggauugagccauccucugucccuuggauaauuuuuuuaauguaagcauuaagucucagcuagcuagaucauuauuuuggucucagugagucuuccaaaguaaaaagugaugaaaugauuauagguguuuuagauguauaauuaugugucauuugcucauucuugagaaaaacaagugaaugaaccagugggugaguucacgaaaggagccuaguggagucugacuguugucagggccuuuuggccugugcuuuccauuuucaccaguauacuacucaagaugaucucucucagcaggaagugacagcacacccugugggauugcuuagugguuuuaaauauggggacaaguaugaguuuggaaauaaauuuuuccuaaguuauucuucuucugagaaguuauuuauguuauaauggcuuagaaguaagucuuuauaucaaacaaggaaaagaucuggcaauuuaauaucugaauucuuaagaacccccaaauuccaaaagcacaaauuagaacacuuuguuucuucuuaucaaaggucucaccugggguaguauaaguaacagagccacuuguccagcuuuuguuuccucauauccacuuauuaggguaccagauaauguaacagaaaaguugagaugcauaauaaaaauugaaggauuaugaaaugucauuacaagucagccacuauugguaguuucugaaagaugguuuuuagucauccaaaaauucuucuguugaaggcauauugagaaacuaccagauauuuggcuccugaggagucaguaaacauaugcauuuuauaagcauguacauuugucacuagugcagcuucuuagaaacgacuuccuguauugcuuugccaugaugaguguuaccaauaauuauggaugcaguuuuuagauguauggaugugcccuuguaguucugagccuuuguaagcauguuuucaucaaucucuauagaauguuuucccaggagucuuguacuccuuauucuucuuuuggaagcccuugcugacugcuucucuuucucugugcucuuaugguacccauugcugcccugacaguucauccugaucaauuucugaaugccuagcucaaacccauugcccugugauucaugcuugccugggucacuuacuuucugcccuuucuuuuucugaacauguaagccauuguuauuuucauuccuuccucaugcugggauaauaccugcccagcuuuuauguggcuuuggggauccaaauucaggucaucuccuuugugcgguaaguacuuuaucuccugagccaccuccucaaccucucaacuguaucuuaaacagccauucacaucucucuucucugaugaucgcucaaaaccauguccuuguaacuggaccaaaguaauaguccccaaaguucucuuugcuucugcuugugauugcucuccugcaucagucuucucagggcaccagaggucuuagagaagcaugcacuggguccucuuagugcacuaucuaguugaaucacaccgaaagccucacaaucauacuauacccuauugccuuuguccacuauguguaauucugggugaucaaguuucugucuguugauguguuuuuguugcugcuauuuugauuuuaagucaccccugucccuuugauucacuacaugugagccauacuggccucuuuucucuuuguaguccacucuuaacauaccuaccacaguaggcaugcaguccuuuaucacaguaggcaugcaauuacugaacauaccuggaggcaguucccacucaucucccuguaacaauucuugcuuaguuaagcaguuggccaggaugguaugucauauuuuauccugguuuaauucuguuucuauauacuagauagaguaucuguugguaaacuugaccaaugaagaaguaucaacucaacuauuauuuuaauaacuccuguuguuaacuguaugcuaccuauauguugaccuaugaaguaucaauucugagcaauuauuuaauaguucuuauugcuaacuauaauuuauaugugugcuuaagaacuacuuaauauuguggggcuuggggcugucauauggagacaauuuaucagauagcuucaaaugauaaaaaaaagucaugcugaugagagaaacaaauauuagcaacucuuaacauuuaauucauaauuuauaacagcaaauauggaaauuuccacucuuggaaauuuauauuuguuucuuuaucaacuguggagcucugguugauuuugaaguuugcauuuucucuuacauauuuuucuuuugauugauuucuuaagaucaauagguggagguaaaauucacauaaaauugaccaaaguaaauguuuuuacuuuuaaccuuaauuuuuaugucaauuagucuaguuauuugauauugccugaggggggaaaauagaauauauguucaauuuuuuuuuccccuuaggaaguucuuucaucuuugcccaccaacucauggggcacgcacucugaauucucuccuuguucugcucuuaagaacugugagccuacauuggcccugcuuggcuguauucuaggcacagguagguuuuggcacugccaguucacagggugccaaaaguucacaguucacugguaaagaaaucuguuaggcaccacaaggaauuuugguugcuuucauucauagguccuuugcuuuugaaucuaccugcaaaaaggaauuuauuaucgaacuaagccccaugaauucuauccagucccugcauuauugauuuucagaccagcucauuccauuauacuguuguacuguuggcuaaguucagugucaauacaugaucgguugggagaucggaggcucauuuucauuguguuuagccaacguguccuguguguuucacugggcccugacuugcaucuuuccacacguggcaaguuaaugauuugaauccacuuuugcuugaaucgauccauuauuguguuacucugugggcagcaagcaaggcacucccuaggagagagaccuguuguguaacacaaguaacaucaggaaaugacauuuuacguuaucuccuugucucccuguucagucaccagucaguuaauaucaguuaacuauugggaagcuccucuaucucaguuuacacgagauguguccuguguuaaagccaguguuacugcauguaugaaacaagaccccucagucugguacacgggaguacauuuggcaacuacuuccucuucauuuucgccaauacccuacacuuauaaauaguauucuuuguggauuuugcuuauucaggccaugggcauuagguuauauuugcuuuaauuaucuuccugcuucuguagacauuauguguguggacuguacgaucgaucaacuugguauuugcaagaggaugagccugcuuuuuguauaccuuuagcugaucucaggagaguuguauagacugaucuuuagggcccaguuuauccuuucuuuguuuuccuucuccucacaaaugucucccaggccugcuuugcaugguuaguaaauggaagcacagccaucuugcauuucauaaguggcuucaagcuucuauucagcagagaaguacaguugcacaggggcacaaucucauucauuaccccccacucaggcccauuccaugcuugcuuuggaguuuagggaggcauuucugaggucuguacuccagccuuuucuccagauaaucaaaacucuguucccgggugcagcaggccucugggaaauggcuugcuuuaacuggaguucauugugucuuuaaaagcuugcaaauuguauguuggugcuuuaaagagagaacacauaugaguguuaauucacauguauuguaauucaaaagauaauuuuuuuuuuuuuugcagaguaaauuaaaagauacagaggccauucagagaugccaucuguuacuauuugagauauaauuagggugauaauuuuuaaugccauugucauaugaugggaaagagaggcuuugggguaccaauuaaagauuuucuccuucugaaugccauguuaauuccaaauuuaaaaauguagugggcucaaagcuuuccuucaauuuuaaaggcaaacucauucuuucuuacugaugcuggugggagcauccucaugaguauacgaucauagguguuucuucagcuacaagccuauuaugccacaagcuagcuuucaacuucuaauuugaguugauaguucuguguauuaauuaguuaugaauaaaacaugggagguuaauagcuguaccccggccagaagacuuuguaguuuuaaaaaggugcucuaaauccauuugugucaaaaauccuucagcaaucaugaaauuucagaccagucaugguaguccacaccuuuaauucagcacuaaggaagcagaugcagaaggaucaugaguucaaggccaggcuaaguugcaucugcagcucucauuucaaaaaguaaaaauaaggcuggugagaugguuuaguggguaaaagugcuugccauguaagucuggugaucagaauuugaucuguggcacccaugauguaaggacaaacucgacucuugaaaauuguccuugggccuaugugccauggcagacacaugccacgcaacacacugcuacuaauacuaauuuuaaguaauaaaugaauuguauaaaguaaacaccauuucaauuucaucuguuaguaucuuguugcuuuguuuuaugaauauuuuaguuuuauguucacuauauauuggaugguaugcuaacuguggugguuugaauaugcuuggccccuggaaauggcacucuuaggagguguggccuuacagugggcguggccuuguuggaggaagugugucacugugggggugggcuuucaggucucuaugcucaagccccacccaguuuagaaugcuggucucuuccuguuugccuucugaucaugucugccuacaagaugcuauucuucuugccaggaugauaauggauugaaccucugaaauuguaagucagcucaauuaaauguuuugugucauaagagauaccuuagucauggcaucgcuuuucagcaguggaaauccuaacuaaggcaguaacuuggcucguuguuuuuucucugucauaaucguuuaauacauggaaguuaacauacauugugcucauauucugaaucagcuaaagccaaacauuggugcuguacuaccaaaauauaaucgcuaaagaauagauuugaccaaauacauuucauuuauacucaaaccucuaacaugauccauuuaggcauaauauuuaauaaguuuuguuguucuaucguaauuuaggcuuuuugaagcagugcuuuuauaaaaaugauaaugaaaucggccauguacaauucuugcugugauuaaacuguucagucuauuaaaacacacugauugauuuuguugacaguuagcaaauagcccauuauauuaaauacaauugccuagugaucacagcaacuauauggucuuaaaggucucccucaaggucuuagugguggugcauuacaaauuugcugucagugagauuaaauaaaucuuauuuauuaauaaaggaaaauaguuucuuaaggcaauagaauugcuuggcaucuauguucuauuuaaauggugccauuauuauuugagaaugucacuugucaacaugaucaguuuacaaauguuaacaccuaaugaagcagacuauuggugagucagaacauaguuucacagccccgugcaccagaaugugggagaggucugguuugccuuugaaucuguugagugccuguguggagaaacgcguuaaagugucaaugaugaguaaaucccucagugcuuuccuucaucugugggaaguugcucuagaauuucacuguuuuuggaccaaauguaucaaugcuauaaaguaucacagcuuugcacauccuagcacauauguacagacaugauugaagaagaaaucuuaaauauugccucuaaacaucccucuagcccugacugugauugugugcgcgucguguugauauuauaauugaaugagaaauaaggaaacauuuuuaaaccacacgggugagugucucaauaugagaucaccgagaaagagaauucugucuuuaaacuuggaguaugucacuacaggaauucguuguggauaugccuugauccagaacuuucuaacagagcuccagugagccuaaugggcccaccugucacuuuucugccuucuguucaucucugucucugucaccccucccucccucccucccucccucccucccucccucccuccuucuccuuugucucucuccauggcccaccccuacuccccucccuuccucacccuucuccgagaauaagcguuaauaugucauucucuuuuuuacaucgcuauacuuuagacaccuucugcucauacugaguggcuucuuugggcuagguugugaauuuaaggagcuccuucauugugauaaccauaguggcuaaggggaaaauaccaguacggaguaccaguuuaaaucauuuuuaaguacccacuuguucuacugagccuuccuucugggguuuauuguuugauauguuuuauuucaaaauggguuccuucaacucugaugcugaugaggugcauuaaucuggguguguaugugguugcccuuuuagcgccugacccuguuuuaauaaaagcaccaucugcuuaauuggugggcuuguguguuuucccuguuuucuuuuucuuuuuuucuuuuuuacauuuuuacaaagccugguucaaaagggcaacacuaaguguacccuuuaaaauguauuauuugggaagaauuuacauuuccacccucagucuggugaauagaugugguaacugagugguaauaucuaaaacagcacuguuuuucuugauccuuuguucuguugguagaucauuguuucuguaguucaugaaacuaagccuucccugagguuugaugggccgggaccaagacagcucugggcauuuaccuaucuuagauuuucuacuuuucuuaauucauuucuuaauuaagcccucuuguuacauuuccaggagaaugaagggagaauaggggauuucuguagaaggcaguauagaggucaacagaagugaauggaaggaaggaaggaaaggaaaagauuggaaggacucaaaggaagugcaaggagggacuuggugguuguuucuguucuucccguccauacuggacauagcuuggagcuugagaccaaguuucuaagugagcguggcuuggugcuguaggacggaguuggugauccagcaccugggagauauucugaagccaagcuauuacauuagccaaauugguuaacuucucuguuuuccccuaugaagugagaugguaacuuuaucauuaccuuuuaugguugugugaugauaaaccaaacaauuguguuacaaaugcuuaccagggauugaagagauuguuuagugguacucuucuuaaagaaaagcucagucacguucccaguacuuuccugguucggucacucccaacugcaguaacuccagcuccaggggaucugauucccccuucuggccacugugcguacugcacugauuaacacauacacacaaucagguacacauggauacacauaauuaaaaguguaauuuaaaaaugcuuagagaaguauauuuaacuguaauguacauauuuuauuauaauuuuuaagaguaggauaucaauauaagugagguaaaaauucauggauuguaaaucauuuuagugagaaacuuuuuuuguuguuaaugugaauagaccauucauauaugaaauuguucauggcucuucaaagaaguccugcacuuuucugugcaucugucuucaugccuggacugcuuuucuucuggaaucuucuauucauuugcuagagcuuuucucuguuaucuucuuugugaauucccuaauaacaacuauaaagagauuuagcucacuuccaaaauugagcuuuuguaguacuuagugguuuuuaaucuagcacuugauccauuauaaugcacucauauucuuaccuuuguacguucccucacuggagccugacggugaguuuuuccaucauuuuagacaugcacauaaaaaaaugaaaugccugucuguggcugaccuuuggugaggaaagaugugaccauuucauaguguucucagcucauacucucagaaggagagaucauggcgucuuucccuggaaaugggugucuuuagcauguguagcaaguauuguuguuucccugcaaauauucaaaggaacuuucauuuaauuugucgaagggauguuggugucauguuuccuuucuguggucucucucuuccuugacuuuguucuuuuuucuauucuuaucccuuccuuccuucugccucuuucugcuaggcugcaguuuucaggguuggggaauauauuuauuugaagcugugcucacuuuuacucauucccacagagauuucucuucucuuaguguaaauaaauuuucauccuguucauuaguuacagcauucuuaugaaaguuuagucaacaaccaguugaauaauuucuguuuuuauuuauacaugcuuauaaaauggccuccuauacuugucacugaaccagugguuuaugcuagcaacagauguuuccuacaauacauaauaugaugacauaaaguuuaagaauaauaacuaaauguaaauuuguggcauugccugauaagaaauauccuccgguguaguguuuuuguuggaauaaugaugguuguuuuccucauaucuuuguggaucuauuagaaagcuucuggauugcagggcuuuaucacccauacccaggggagaugaccucgaacaguuagaggucuuuaucaucaaugaaccuuuuaaauaucuuuucucacaaggacgucaguuauuuuggggaauugggacagaauuguugaaauuuccaucccccuugggaaaugacuuguuauuguggacccaggccugcugaagguaacaucucucagauucuacagugcuucuacuuaaaauaagguuaauguagauaauaggaguguguguguguguguguguguguguguguguguguguguguuuacuacuaggauuaguguaaagcgagcacuggccauuguggucuagagagccauacacauaaaauaacacuucaaagaaacauagugacucuagucccagccaaacagauguauucagaaaacaaacaaacaagcaagcuuguuccaaacaaauucaucauuacuuuguugcuuaguuuauggggcagaacaguggcucuguugagcaacaguagcucuguugagccgaggacaaggcauguguuagacuuggaaucggauuuggcaucuuugcuagcuuuuugcaccugaguuuucugagcuccuuaucuuucaucgugucuguaagaugagaaaggcugagucaauacauauaguaccauuucaacccagcccaacaacagaagcauuggcaauguuaguaaagacuuggcccagcuagucuuuuuuucuuagauuuacagauauacuuccaguuuaccuuugaaaugcuauagaguacuguauugaugacuaucagcacagcaggaguccaugaagcuggguuucuuuuuguucuuuuguaguuuuguuuuuguuauuguuguuaacauuuauuuacuuuuauuuuauggauguagguguuuugucugcauguauguuugggcaucauuuacaugcauugcccaagaaggccugaaguagguggguuucagacucccugcuggaguuugggcagguuguugacuaccacaugggcgcuuggggaauuuauuuagcccugguccuuggagcagcagccagagagcucuuaauugcugagccaccuccuuaucccuccauaaagcuuuuccauaaaggaauugaaaugauuuuaaugacucgguucaguuuuagguugugguugauccccuuuagcagacuggagaagguuguguuucauuuuaucaaugcuccccagaauuagugacaguaaagagccaccuuucagcagauucccaagucagcuguugaacaacuccuggugugagagugugacuugacucccagagccuugacuguggaguggagaagcuucucauggucuaacguuuccaguccacucuuugcuuugucaguguuuuagagacucaaaagucuuuuuucccuucccuucccuucccuucccuucccuucccuucccuucccuucccuucccuucccuucccuucccuucccuucccuucccuucccuccccuaccuuacccuccccuuucccuccucuccccugcccuccccuucucucucucucuccuuccuuccuuccuuccuuccuuucuuccuuccuuccuuccuuccuuccuuccuuccuuccuuccaaauuccuaucacucaauaacagacauuuacagggcucuugaggacauugcagugcuuuuguuaagauguagagaaaagaagggggcuuuuaguaaacugguguuugagagagcagauaaaacuaucuuggaacaggugagauauaacaaguagaagaaagugaauguugagagucacauguccagaauuggcaacuuggugaagguuuacuguuggauucuaagaguaugaagggcaggcaaggagggcaaccacaaugaggaugggaggaaucuuuuugaguagauugagaacgggaaaaaccuaguccuuggccauugagggguuguuaaaggggcgaauuggggauguaauaggaagaguuuggucaaaucacccaagauucugagaucuugccaaagaauucaaaguuuauuauuucaagaccuuuggcuguuauugaagaucuugaaggagggcaccauugugcuuuagcaaaguuaaacuaaccaucguguucaagaaacucagaacaguaguguauggaagggaugaagggaccuggcacuggauugucuauugcuuuucuauugcugaagcacgacacuauaaccaagaugauuuauugaagaaagaguuuauuggggacucucaguuucagaaggcgaguccauggucaucaugaugaggggcacagcagcaggacguagugcuggaucaauagcagagaguguacaucugacccaaaaguacuagucccagagagagggcgacucugcuccagugacauaauccucuaacaaggucacaccuccucacccuuaccaaacugucucacuaacuggagaccaaguguuccaauaugugaaccugguggcucauucuagcuaccacauugcacucccuggggccucauaggcgcauacacacacacacacacacacacacacacacacacacacacaugcgcauauauaugcacaaaguguauucaguccaacuucaaaagucucaauaauguuucacaguuucaacacaguuuaaacacccaaguuccuucugaggcucauggaaguuucuuaauuguaguucuuugugaauucagaaaaccaguuggcuacuuggauuguacaguaguacagaauauacgccaacauuccauaagggaggaauggcugccuagugaggaaauacuggaccaaagcaagacugaaacucagccgggcaaacuccaaagcuccaugucugaagucaagugccuccccuccagcuccgcugacuguaaccuacuucuauuaggcuggcucagcucacccuuuucaggucucuguggcaaaucuuccuugggucuggaauccgaacccaguccaggcuucacacacugguuucuccagguuuugauguaggcauuacccuguugcauguucagcagcuuuccuuaaccucagagcaagauuccagggaccucuuuaguccugcauccuuuccugacucuaaagccaaguucugcuuucugcuugggguggagccuggcgccuugcuugagccuuguuugcauaagcuuuucucuaugguugcucuuaagggggaggaucauuucagccuuguguuucucaaguuucagggcuaaguggguggggucuuguccugaggguaccacucccuuuacuccauuucacauuaggucuuucagccuuggcuccaauguuuccuggugcucucccugccuccccucagugcucuccugccucccaacugauugguuuguuuuuauuugccccacauuugcucuuuuucauuauagaucugaguaagaaugaccacuaauuaacaagcaacagaaucaauaccaggcuguccuaaaaucuguuuugccaaugaaauuagugcaaaaauucuuccauuuagccucaggcagauccuuaauacuccgguaaacaguagucacauguugguuuguuuguuugugugccuuguuuuuguuuuggccaaaaugucacaagaaugacccaacccagcugcuaauacucuuccccucugaaaccucucuagcuggauacauacaguccaaauugcgcucagcauggccuuccaggcuucuacuaggauggccuauuauggucugcuucuacuuuuuaaccacuguguuaggcuaaagucccaaagucuuccauacucuuccaaaaaugcagcauggucaggccugucacaugugcuaagcccacagugcaguaaugcaggguagauuuauuaaaaacaaaacaaaaaaaauccauguuccgccgucaucauaucugcagagaucccugugggccacuuggcauaugaaaagcugucuaauuagcuuacuuugagucauauuuuauauuguaaacuuuccaucgagacauuugauaggauaaucggagugaugcuuauuuguguauuugaguccugugacuuauugacucaaugaucagaauugaaaauguggacuuugcuaagaggcauuuugcuugucuugggcuuaucacugauacaguuuuaaagucauugcaguggaauuuacccggauuccccagaggagacuugugaggagcugcagagcucacagagauagauuagugugucuguggucagugaaaagcuaccaaaucugagcaaaaguaacaauaaaagccaugugaauccaccugccuggacauuucucuccaguccuucagcccuggacauugucucccauccuucagccaucugcuccuugccagaaccaacucccauugcacagaacaaaacuuaugugcacaccuugucuauuugaauaggauuugaauagaauacauuccaucuucucuauacaauaagaguaucaagcaguaucaggugaggcuuaaguauuuuaaaaauauaagcaaaaauggagauuauuuacuuauuuauuuauuuauuuauuuauuuaaaaaaaagccuaguccugaaaguggaaugagguuguuagggaucauuucuggcuaaaaagcauuguguuaaucauggacugagcaaucauuucucuuuagggaauguuuuauaacuauaucacagaaauucaagccuaacuauaacugcuaagugauguuuaaugacuugaaucuucaaagacaagcaaauauggacuuggaaaggucuuaacuaaaagauauguuaaguauugaaaacucauuuaaaaccuuaauaaaacuucagauuuacauaacuaaaccugccuguuacuucucaucuuuccacuuuauuuaccaugacacuaaaaaucaacucaacaaauaccuaaaauccccuuagcauaggguccguaauacauggguuuuguuuguaaagcuuucaggaaccucuguagauuauaggaguucacuguuauaucuauuuauaaaacugggcuaaagacauaaaauuuaggauuuuaaccauuuuaagugcacauuucaguggcauuaaguauauuaacugugguaugugacagcggucagcaucuguuucuagaacauucucaccauccacaccagaaacucucuacccauuuaaacaguauguccucugaugccagccccuggagacccccauucuauaccccauaucuauccugacugcaguaaguccaccacauaaaggaaaacaaaauauuuaucuuugucuuuuguggcugguuuguuuauuauugagcacggugcccuuaacauuuaucuagguugugucagaauuuccuucuucuuucaguauggauuuuguucuauuaugcaugugacagauuuugcuuaucgguucaucuguugguggauacugggcuauuucucccucccggcuguuuugacaauauugcugugaacauugguuaacaaguauuucuagaaucacuacuuucagucuuuuugauauguaaacaagacuuuuaaccugauuuuuuucaucucuuacgucuggucucaguauacaguucuuuuaaaaucuauauuuauguaguauucuuucaugauuuuagcccugggaggggaguggcagguucuaggcccucugugaagauuuaauaccagguguagauucuggaacuauauguauauuaagccccauuucugucacugagccacacaucucuaccuauucuuugacacgugugaccuccaagugcuucaaacgucaaccugaaauuauugguuucuaugccagaagcauuucugcaaagcucagcucuuuagaaguucagugcaugauguugcuuuagaacuuaaacuuucaaugcugcuguugcuguugcugcugcugcugcugcugcuucuccuccucccaacccccaucuuucugcuccuucccacugcauacaugcuuugggaaauuuucuucauuccuguugcucucugcacuggacuaacccaacuuacuaacucauuuuucuaaacuguguggucccccagcauguggaaauauguuguugauuucauuuuaguuggcauguugcgauuaagacuucuugcuguauaaugaacuucaauuuucacugaagauuccuggagucuguggguuauagaucacaugauuggcaguuccuauuauauaccguaagaggagccuggucugcccuacuccccauccugggggggggggguugacaucugaagcuaaggacuggauuaacuaaucagggccuuuauccuguuugggcuccuuacuuuuaaaacagcauaaaccuuuaggcuauggaaauacgguucuacaaguguuaaauugacucaugauuuccagguguauggaaaaauggcauauugaacuuguaacucucuucauauauacgcgcacacucgcgcucacacacacacauugaauaugaacaacagcaggcagcaauuacuucugucuuugaagaucuuguuccuuggccaugagacaccagucucauugcuuaccuucgauuuuaauacucugcauuuguaagcagauacuucaugugucccuacuuauuuucucucauuuugcaaaagauagaaugcauguuuuguuuuaaggcuggggaaucaaaaccccuuccugauuauugauaggagcugcaguuuugaaggauagacaccaauacuaguuucuuuugucuucuuacagacuaaguuacuguauuaggcuuagcgggguguguguguguguguguguguguguguguguguguguguaugcucaugcauguguauaccuguguugugagcacaggugccuuuauaaggguuagaugcaugcaugugcacauguguguagaggccagagauugauuucaugucuuuuuuuuuaauugcuaucuacuuuauauaucaagacugggucucucacaggaacccagaguucuccaauauggcuauuauagcucauucccuugcucuggaaaccuucugucuccaccucuuaggcacagagauuacaagcaggcuggcugacauuaacauggguauuaggcauuuguacucugcuccuuaugcaagaguuuuacugacuaacauauucucuagucuguauuuuaaaagcaagcaaacaaccaagcaaacaaauaacaaacccuacagagguuuuuuucccuuugugucccacccuggucuuaaacuuucgaucccucugccucaggcucccaugugcuuaggugguagaaccaucacaccugacuugcuuuuuauuuuaaaacacaaaaugcagguggaacagcauauaaaacacaggcgcucuaaauaaucacugcaaagaacucauugaagagaauuucuggucucugcaagcuguaugugccuccuccauggaauuccucccugcucuuaaauaguagccacacugaaucgagugcugccagcacugucuccauuaaaggagcagagccugguacccuaaccgcgcuugccacgugcucccuaagcggacaggcuacaggcuaauuacugacucugaugaguucuucaauguucuuccacccagggcagaugcgucuugguaaucacagugcuccucaucugggcugagacuuugcuucuguguuagccguggcggauuuagauguugcuaauaagcucauccugcccgaaagagcacuuucaaugcagugcauucauguuauuugggcuacaccugcuaguguagaaugugcauucagaaaagggaagacgguuuuugaaauuuuggagcaaagcaucacucugauugccagucaugaagguuaugucuuacaggaagacggaacaugcacagacugcgcugggggaggaaagagagcggggaauauagauaguuugggggaugcaaagagauugagcuuguuaauuccaacgauuaucggaguuucugcaacaaaaucagugacugaggaguaguuauggaacccaaaugaaccacucaccugccccgugcuccaaauguuagacagagggagggagguggcaaggaaguuccaguuuggagaacauaugcaauaaucauuuaucacuaaacguuuuacuugggaggauggcaauacggaugugagguguggggugggcucuggggagggugguuucuggaagaguggagcagcaggguggauggugcuuaguucugugaaagccgggggggggggggggggggggggagacaacugggcaugaagaaggaugcgcugguucugaguucaagggaguguggggaugucucuuugaauuuuguguuuucuuucuuucucuuccuuuauuuuuuuccugguuuacuauagagcaucuuucuuugcuuucaauuacaucucuuguugucugugggaguuuacuggcuuucuuuucuuuucuuuuuauuuauuuauuuauuuuuuuguuuugagaaaguuuuuuuguggguuugaaaugacauucuagcugccauuggaaagacaacaguguccuaagcuuuauggugucagagcucugaggagaaaggaaaagcaggcgacugggaggaacggaagcuuccucuucugagcugcagugaggccagccagggcugagucauccuuaaaaagugaagauccgcucagcaaaugaccagaucccaucggaggaggccccaggaaaccccagggagagucauuagaacgguuucucccccagccucugaguucccuauggacugucagcucucagagcaugcaaaacugugcaaaacucucucucucucucucucucucucucucucucucucucucucucucucucucucuuucucccuccccccaccuccuucguccucuucuccccucucccuccccuuccccuccugcgcaagcaagagagagagagaaagagagagagagagcuuaguuuucacccaguuucauccucugugaaaacaagugaagucugugcuuggaaccaugcauagaaccugcuauuuucauuguauauacgcuguguucuguaccauaauuguugaacaaaugugucugaguuuagugaugggaugcuuuccuuccauacacaaggcucuagguucaggcccuggugccaaaaagcaaaaagccucaaacuggcaaauauaaaccuuucuaagaguaaggaaucaccacaaguagagccauuugugaggagaguccugggucagagagggcuaucuccccuuccccauagagcuccuagaaagcaagagaauguccagacaguaagaugauguacaguccuucucguaacuaauuuauccccagaaauuccagaaauacuaggaaugaaacgaaaacuaguuugauuccuguguucugagaccuuuuuaaugauuccuuauaacaugagagaguaauguuuugugaauuauucugccgggcuggguaugcagcucccuccucugugacuuaaacagucuucuuuaucuuuauuccaccuugcuaaagagagcauagcacuuccccuguggcgugcacuccaggcuaccagcagaucuuuugucuuuuccucccauugugauguagaacuccuggaauuugaggcgaggguuagcuuuuuagguuccucaguuggaacucugauccucaggcucuuguggcaaaaaaaugcugucugcugacccauauuguuggcucuaucaugaauuucuuuuuaacuaccauuauagagaauaauuuagugucgugccaauguuucauuguguauuugcaaaugaggcauuuuacaaaauaaagguaaaauguguguuuuauucuuuuacuucuuccaucaaauaguuuauuucuuaaggaguaaagaaaauugauacauuauauacauauaugucauauacacccacacauacaucaucuacaucauauacauauauaaauacaucauauacacauauagccuacacauauacuauauauacacacauacacauuuauaucacacacauauuuagauguauaucaucgcuucuguuuuuguccacaaaauauuuuccucaggagcauagcacuacaucgccauugcuucauaguaaugcauugccaugcugagugucuccuuucucguagucacuggaguugccauccaaagggaaggaaagcagugugucuaccuuuuaaugaguugugcugcauccagauucuucugaguucucuuugaugaauugacuggauauuuuuagugaucuguuaggauacuuuucauucuuuucucccccccuuagccuuaggugugaggaauuauuuaaaacuggcaucauucaaccccaggaaacggagaacacuugaaagcuguguuuuaaugcuugccaggaaugauugaauccguguguugcaauuucaauguuuguuaguguuguguuuguuugugagguggcaagggucuuggguucaguaagcagguagaaguauucugugugucguagauaccacguuguguagcaaaaagagcaccuggauaccuggaugauuggaacgcguugccccaaagagcccccacugucacgcugccuucaaggcaaugccaggauaugaugcagaacuggggcauccgugcagguugcuggaauauagcauggacacauucaggcaugggguuuaugguagucuuggugacggaggacccaggaacugaacacaaugaauaaauaggcacggggacuuugggcuguuauuuauuuuaguuaaaucccaacacuucugccacucagaaauauuauggacuaagaaacuuaguccccaucgaauggaaaaguccuauucuuaguggggccuucucaggugggacgguaagcuguuacuuugugcagguccuuugguggggacuagggaaucauuccuggguagcauaauugucugggugaaaauugaagacucuuccuuucuaccuuuuucugucccccuccuuucuauaucucugucccuccucccaucugucucucccuccauccccccagccuucccacccuuucuccucccauccuucccucucuucccacccucucucccucccuuuccaagaucuuacuccuuagguagccugaccucaaauucuucuucagccucccugaaugcugaguacaggugucagccacuaugcuaaucuccuacagaggcauagcuuagagccccugaaucauagaaacagugaaagcaagucuugcuuuuauuuuuuuaaaauauauuucauauagguuacccauauagaugucauuucaaagcacagucggccaugcauauccacagcuucuuuaucaguggauauaauuaaccagagaugagaaacaauuagaaaaacaaaacacaaaacaaaaccaaucagccagccaccaagaacaacaacaaaaauaacccuaauugcaccauucuguaaacaguacaacgugucugcuauuuacauagcauuuacauuguauucaguaucaugaauaagcuacugaugacuuaacugaauuguagaggaggaugagcacagacuauaugcaagcauugcaucauucuaaguccaggaccugaaccacuuugggauugugguaaccuggaaggaugguguagaccugaccuggccuuucuccccauagaccaugggaucccugucgacucgaaacuguguacugucaccacagucuauucuaggaccuaaucuuuacuuccagagaaacuugaaacccucuguccaucugaucaacauacucccucaggcucaaugacuugaagaucugccuucucuuccuauagcuuuacuauucuggcuguuucgaauggaugggaucacaugguauauggcuuuuuuuggcuguauuuuucauuuaacauuauauuuacaagguuugcccauuuuguaguuuggguugguauuuccuuucuugauagauaauaauucauuuuauguauagauaccauuuuauuugucucuauugacugaugguuguuggaguaauuuucacuuuuuuggcuauuauuaauaaucuugcuguaaacauuugauuauggcuuuuuguauagcuguacuuuuuauuucucauaagcauuuuaucuagacuacaauaacuaaauccaaaaauaucuaaguccaaaaauaucucuuauuugcucuucuuuucaauuccuucucucuagcucuccguauccuccuguuucuuuaccauguuauggaauaccaugccugcguucuucuguggccucucuucaaguuuagagaagauugacaggguuuuacacaguagcucuuuucuggcagauucauuaaaaaucccacauguuuauguuuauuauauuuucauguucagaaucuaauauagcucuuuggugcugagaugauauugucuucuauauugcguuguuuauggaaugauucauuuagggguuauuuuuguuuuuauuugguuuucuaguuauuccucaucucugguuauauccacuaauauagaagucauggguacugaggacuggcugugcuuuggguuggcccacuuuaaauaauaaccuagaggaaauucuucuguguuuuuaaauaacauuucucaaguaaagaguuauaaaucauacauuuuguuagacuuuacguuuuacaauaaugaaaguuacccgaaagaaaaacaugacuaccauagcccaggaacgcuguaauaggaggugccucuugccccagaugaagcuuuacauuccgagccccgaaucccugagcaaccguuaguuccuauauuccucccagaacaugcuaauacauuaaauguauuuauagccauauguguucuaaguguuaucccuagugucguuccauacauuaauaugcuuauagcaucgccugucccucugcuuguaacugacauuacauaaugauuuaacuaguuucugcguuuucuguuugcuguggcagucaggaaucucauuuaaaauuucuaggagcccugagcucauuguaguugccugcugaaugaagccuugacuuucuuaaaauuuucuccccuuuucuuaacuauuucuuuaaaaaaaagaauacuugaaaguuucuuuuccuugugugaacuuuguuuaaacaguuucaguguguaggaggauugaacaugcagcuagaagaggcgcgcuugaccugaugcaguggacaguguucugugccuauauaauuuuagcaucugggacaucacagagcagagcaguacuuaagaaguuaccccuuuaaugaguauuuaggacugaaauacuccaaaggguaaauguaacuuaccaacuugcaaaagauauuuuucagaaaguguuauuagaaaagaauaauuaucuaguuggaacauuuuagauauuucuauaucacggaaacuguacuuacggguagugccuuuuaugucuuuaggauaagugcuuaugaauuugcaguccuugcuuguguaaucacacuggauuguucuuugguaugauauugaaauagaaaauacccccacugccauucuuucagacuacagugcugugcuuugaaugugguaaauaucaauuguaguacuuuaagaauugcuuaucuguagacccuagaugcuuucuuuacaugugaguucccaggugggaaaucacuugacuuuuugcuuacgagugagagaaaccauuucgccgaggccugucuugccagggugggucacuggagcacauacugcaucuuuguuucagagacuucggcucuagcauacaaaguuuacuuaauggcgcuuuggcuaccauucauguuugaaguugacuuuggauguuacaaugcacuuaauuagaaauuuccuuuaaugagggaauggaauguauugaguugguacuguuugauggugguccuucuagaaggcagcuaagugaacuggcugucauggugcuuuugaguggcucuagugauaggcguccaggguuaggagucugaacuaauauuguucuuaaauucuacaacuguuagggucuugugaacccaugaggacacaguguuuguaacauucaugcauguugucuuuuacagucaauccgcucaaacagcuucuuuuuuuuuuaaaguuuuauuuauuuauuguuuauaugaguacacuguuacugucuacaccagaagagagcaucagauuccauuauagaugguuguaaaccaccaugugguugcugggaauugaacucgggaccucuggaagagcagucacugcucuuaagcacugagccaucucuccagccuucaaacagcuucuuuuccuauuaccucgacacugcccuuuugcauuggccauaguacaugguauuccagcgucugcuucaagcauagccuugauauuuuuaggaucugucagaaagcuguuaguuuucucuuguggauuuucaguucacuucucuuuacugugcuagacagaaaucuuccccucgguuuuccuccucugugggccgaucacgugcuuaggauugcauuggcacacuuggccauuucuuuccuuuuuucacugucuucuuucuucccuuuugcuugagacuuuccagauguguuuccuaaaaugucucuucacuuucugcuuucccuggcccauguguaucuaauaagugaugaguuguuucuuuaucucucucccugcucuaagccauuaugucugacugcuuccucgauauagaaguugauaauuccaucugucagaccuguaaaacccccaaguaugccucucacuggauucccuuguuugguuaaucuugccuaguuaacccaagcagacauuuaccuaucacugaacacaauuguuauuguuguucuugcuucuccuucuccuucuccuucuccuucuccuucuccuucuccuucuccuucuucuucuucucuucuucuuccccuucucccuuccuucuuccuucuuucuucuuccuucuccuccuccucuuccuucuccuccuccuccuucaccuucucccuccucuucauuuuccuuuuccuccucuuccuccuucuuccucuaccucuucucccuucuccuuacuccucuuccucuucuucaguauucuugaauucucaagcuaugcaaacacagugauaagugcagcauuagagccaucugccaauauugcuauuagacuuucaauguagaacuuacaagcauuaacugagcuuuaaagaaaucaaagcaaacuguguagggaagaugucuguaggcaauucugaagacuauguuggacacgggaauagagauuacuauguguggggcuugcuaaaagagugagagaggcuucaccauguaccuaaaacaaugcagaaagcguugggauuuggaaaaugugaucuggagcaauagguaaucuggauugugaaaagccaggugucauggagcagccuuguaaucuuagcacauuaaaggcaaggacaagcgggugcuuggagcugcugcuggccugaccucugagcuuagucaucaaaucccaugucucugacucaaaagaccagguucauauuucccaggagcaacacccaaguuugaccuccgucuucuacauauauaagugugaacacaugcacuugcaucugcacgcauauacccauauagaacaugugugugcucacacacacacacacacacacacacucucucucucucucucucucucucacagaaagaggagacuuaaaaauggcuuaugagcaaaguauuuaaauagagaaaaagagaaacuaagcuauuaauaauuucaaauagcagaaggguugucuuuuggaaauguuugucuuguacuagaagaagcuaaaauacaucacagacaagaugaguuucagacccuaaugauaagaagacauuuuuucauuugguguacagagacugagacuugauugcauaucacauugaugauaauauagaagguagaaaguacuucuuaaaaauauuauggguaggauuggauuauaauaaaaaaaucugauuagagcacugcuacauuccaguccagcccugcugugucgagggugucccuuagaaugauacugaagagcuuccuagccuuugcacuuuuaccuauagcuuggaaguauuugugaagcuaugcagcacaggagagauggcucagugguuaagaacacugacugcugcucuuccagagacauggguucgauucuuagcaccaccuggccacucacaacuccagucucagaggauuggaugcugcuuucuggccucagugggcacuaggcacacauaugauacacaaaugcacauacagggaaaacacucuuauacauaaaaugaaaauaaaaacaaagaauauauaaauacucuaauagucaucacaguaaaauaucuccauuucucugcuaagaauauuaaaauaauuuuuaaagaauugcuagaaaaacauauauuugguuuuaguauccuauaaacuaaauccuauaaugcacagauucuagguaggaggcauauagucaguuuuauuuauuuguucaaaggcuagucuucugaaaauugcuauauaaauacuuauuuuaacaacuguuauuauuaaggggauuguaugaaagucugccaacaugauccuaauauuuauguaguagaucaaaauauuuugaaaauuuugcucucaacugugaucuuuguuguuuuaaaaauccaaaauauccuuguuauuuucaguuaacugcagcuggaauaguuuuuaucgccaaucuuugguuucuuuuuugcuuuuaauuaaaaaaaaaaacagaaauuauuaugcaaagaauaacuaucucauguuagugauuuaagugaaaggaagaguugggggauugagauugggggcauuucagucaauaaaacaauaaaacugauacuuaugugcaaauuaacagucaggacaccaacuuguuauaaccagugaccucauuauaauuauuuccuaacucuagaguaauuauagauucaugcuuguauaugaagugauagcaagcgacuuucagagucuguguuugucguacacaaucaggaaauuuaauagucaucuauugaggaaaaaaaacacagaugagcugaauaauaucuccaugaauaaggaaauuaauuugugauugguugaugcugugcuuuuagguuuacagacauuuucuugcugaguggucuugacugaggcaaugcagguguuuacaugaauauaaaauuggcaacuauauuuaacucuaauuuaauguacugugauaggcaaagccuguuugucucugccuuggacuuauuugaaguuaaugacaucucagaggagauuguagauagaauguuccuuuuuagaaacaaaaccccaagugugugugugguaggggcccauggugauauucuuuguuauggucucuguacuuguuaucgaauuugauuuuguuauaaagcucuggcagggauggacauguaguucagcuguaggucaagguuuuaguacccauggcacugacacccugugccucacccaggcuggcuccacauccaacauacuccaggcucaucuuccaaggcacugugaugauugguacggugauuguugucucguccugccaggcuucuuauucugggcaacuuucuuuaaacuuuauguuacucauacaagcacccaggaccgugguccaggaaaucuuacaggaaugaaguuaauguguuccguggauucacagagauacgcugguuguagucaucccugaguugucuugguuaauauuucagcucuuccaacaguuuccuuucagcuuugggcucaccugacaucaucuccaucguccucuuugcugugaaucucuuguucaucuuccccuuauugccaaggcuaaguggguacauugugaggaaguuugaacagcacacauauggcuccuuuccaacuaucuacuguagcugcagucagcuaagagagauugaaugucuagucugcccucgacuccacucuucucucaaaauagccuccauaacuuccaauuuucauauccuauuaauuaggaaaaagagaaaaacugucacagggucccugggaguuuugucuccggcuaaucaguacuuguuuccuucagaguaaagugcaguuauucuuuaucuugagggagaagaugucagucuugguuaccguguauuaucuuuuacuggguguaguuauuaucccuaugacagagccguguaaaugcucuaaaauacuuuauuuuaaucugccuuuguuuuuggucuugaguccuaaucgaauuauuccccauccccuuuggguguucagacagccuuuacauuuuucuauggagucuuacagacccuagaacccguucauuucaccugauuggauuguuucaggaaaaaugauaggagauaguccuggaaaacugcuucauucauagaaguaaauugcaguuaaaaaaaaaaaaaaaaaaccuaaacuaaaaggaaguguggaacaaggcauuucuugagagggugagacaggaggauagcaaguuugaagccaaccugguuccauggugaauccauuucuaaagaaacaucaaaagcaccaacaguuacacugaccgaguccuguguaauuaaccuguucaguuuccaaagggcauggugaauccagucccugaccugugagaaugcugcccauuuagcauuauuagaagacaguggagggccuugggaaaugaaguucugauuuugauuuaccauaaagcaaguagaaagggugcagguugggagaaauaagaacauauuuuugaggagacuacaaauacagaaaaccaaaacaugaaauauugcuuaugacugaaugggaauaaguaucauguucuucacugaggguaggcucaacuggaucauucucaugagaauuuguaacucuccaucucuuuuccuuguaaaugauugaauuauuaaaauuuuguauuaaucuugcuaaauuagcuugagccugggugcuauuacauucuuccaugcaaucuuaaaaaucauagucuggcuauaucaugagucucugucaauuguaacuggguauauuuguagauuaguuggcuauuuuuaucauccugaaaaggauaccauaauauuuugucagaugugucaaaggagcagugacauacaaaugccuaaaggcguguguccacacugguuuaacccagccuaugugugcuaacagcaaaguccuguguaaccauauagaaaaccaagcacucauaaaacuuccuaauucucaccaucucaugccuuuugggaagcaauucuaaaauucauauuggaugcucccuucaacugguuccaauagcugucguuauggucauaugaucagaggugcaaaauagugucaccuguggguucaaaacucaucuaaacgggaguuuuggaauggcaaaacaagugucuggugugcauggucucauuucacugauuaagaauuaagaagccggucugccuggaacagccggcagagacaggagccuagcauagcagcccucugagagguucuacccagcagcugacugagacagacacucacagacaaacauuggauagaggucagggacuccuguaaaacaguaaaaggaaggauggacaagcgucaaggggauggcauuuccacaggaaaaccaacagugacaacuaaccuggaccccugggggcucccagacacugaaccaccaaccaaagagcauacgcaggcuggcccaagccccagacacuuauguaguauagggcugccuugucuggccucagugggagaggaugcaccuaguccugcugugacuugaugcaccaagguggggagaugagaggggagcugccuucucagaguagaaaggggugggggggggaguggagcugggaagaagcagggaggaagggccagagcagggcaaccuuugugaugaaaacaaauaggcaaaugauaacguggccuuacuuagguuugcaaaucauccaucauuuaaucacaacccaaggaaucaugacaacuacgaaauguaaccuauuuuuauuuuugguuauuuauucuuagaugguuaacucauauaauuaaccuggcaguguguuuuuacaguuuuuacuuuuucuaugaagcuguauuuccuaauucuuaacuuaccagggaaguugacuuuauccucauuaaguagugauaaugaauuuaaauccagcugacagaauuuucuaaaacucugggaauauguccaugccagugauucauuuggauuccuguucccaaggaauuuuaauuuuugaagcugcuauaaaauuauuuuugucgguccuaacuacaauccauauuuuuuacauauuuacuaaaauggaaucacauuuaaaaaaauauaguccuagaaauugcauugagucaggcuugguggcgcacgccuuuaaucccagcacuugggaggcagaggcagaggcagguggauuucugaguucgaggccagccuggucuacaaagugaguuccaggacagccagggcuacacaaaggaacccugucucaaaaaaaaaaaaaaaaaaaaaaaccgaaaaacaaaaaacaacccccccaccccccaaaaaaaagaaauugcauugaacuuaguuauaaauuacuuuggauugaauguguuuuuguauuggcuucaaaguccauuucuuugauuuuaaaaauuguuguuaucaucauccucaucgucaccaccaccaucaucaccaucaccaucauugugcauguguggguggguaugaguaccacaguaugcaugucagaguauaaauuguaaaguaggaucuuucauucugccaaucuguguauuccagagauugaacucccccgugggugucaaguaccuuugcccacugagcuuucucacagaccccuauuucuuuguucuccuugggcuuuucuggaagagaauagaaaaaacagaaacauuuagaucaauaguggaaauaugauccacauuaccaaaugcuguuuauaaguguuauuggggggcuggagagauggcucagugguuaagagcacugacugcucuucuggagguccugaguucaaaucccagcaaccacaugguggcucacaaccaucuguaacaaggccugauucucucuucuggugucugaagacagcuaguguacuuaaauauaauaaauaaaaauuuuaaaaaaggguuauugauuagcugguccaguauagauggccaaaguucaacccagcaacacccccuucaaacaaacaaacaaacaaacaaacaaaagcaagggaggaaaagccacguuggugagggauuaggcuugcuccuggcaauggcagacaguaacguuggcuauuagcgaaggcaauagagagaaaaccaacaacucuuuaaagaaauuugugucaaaaugggauucaguggcccaucacauuaaaucaacacaucuguauugagaacguuguuuagcacacacuccagggguucauuuuucucauuuucuguacuugcaaacccuguauuuaucuccagcaugggucacugaacaaauucugguuuuccucauuagguacagaguaaugaggccuuaagucuccuguucuauuucaccuucuacccaacuuugucugacauguaccuccaccgcucaaugagagacuucaaugugagcgccgugcuacuuuguuccuucccagcuuuucugccuuuguugauucccgugcguggugcguggguuccugcccaggcaguccacugugcacugguggucucaggaugcugaggagcuggggaguucaguggugggcagcaggcucccugagagcuguccaggguaugggcagcgcucuaccuucccuuuuuuggcuugagaacccacacaagugacauguucccuccgagugugauggaucugucuuccuugugccuagggccccggauaguuuaauuuaaaauauuuuaaaucaugugaugguuaauuuucuucugguuuugugucucagcucacugagauguuccugauuuucuuuggcuaucugcuauuugaacagggaaguauuuagaauccuaagucagaggaauuacaguuuuucuauucuuuuuuuuuuaaagggauuuuuuuuuaaaggaagcugcucgaaaauacaccauacuaaccagauacaagccuccugcucucccuugagacuccucucgacucucacagugcuccuuuauccccugucauaauaagacuccaaaaguauuauguuuucuuauaaagaaaacuucucacguauaaagauucaaaccagcaaaacaaauguaccagagggugauuuuuaauuugacaaaagaucuucuacaugacaaagaguucccccgaagauuacguuuaaguagacaauuuccuucgagugcugagagucacauuaaacaguugucaacauuuuaaaaacaagcacagaccuguuccuaauaguuauauguaaauggugacuguguguccccauguuaugagucaugauacagucugugaaauacucaccaucgccaguguugaaaaaauaagcaagauggcuauuccaguuugcaucucuguugugagaagacaucaaguugaucaacaggaacuuguggaugagaugggguguggcuaggucaccuuacacuucccugguccaguccuugggaauccuaggugggaaggaauuuuagggcagacaucuggaauuaggaauugaagcaggguucaaggggagagagcuacuugcuggcuugcuuucucagacuuucucagcuucuuuucuucgaugguguaagcccacccacaguguucugagccaccaugcccaauuuaaguagguuuuaaguacauguauuuaacuggauucuuaaagcuuauggaauuuauaguagccauuaccuugacuugugaauauguuuguuauuuaugagaucuuggagugagucguuuuucauauacuuucauaacucagaacauaauaucucccagaaccauacuugggcuauggaagcugccuaaagaagagaugguauauauuguagccauugaauuuccauagaccauacuguuuguuuguggcaauuaguacuuacuacguagcacacucuggccuacugcuucccucugcucuuucacuguagcucagcacagcucuccacaguuugcaguauuauugaauacuaacuucauagguaaaugauuagaacauagacaguuuuucucuucucugaggucauagucacaguguugccuugagauuugccauguugguaucaacucauuuuuguugcccuuguccacuucauuuguacagcuccucaccuccagcccuucccgaaccuuccauuuaugucagggaaaccuaccaacccacucauuauuuuucaauuagagucagcccucaucugguuagaaaguugaccggagacaggauggagagcccccaaugggaaacaugcacgguuuugcgauaaacucuuuuucucuuaauguuaaaauuuaacuuugcaguauuuccucagcugucagcccagugacaaaucuucuaccuccuuucacgaaggggcaccacuuccuucuaaagccugaaguaugacuuuaaaaaaaauacagucaguuauguuucuccaauauaacaucaaguuugaaugguuccuagcaggaagggaaucaaucucucucucucucucucucucucucucucucucucucucucucucguagaauuggggaguaagauuggaaaaaccauaguacacuugaguucccucuugaaaauguaaugcuaaccucuaggauuuucuguuugaggcuugaauuaguuuauuaauuuguaaucuuauaaaugguugagucaaccaaaaccaugacuuccucuucaacuauagaaucguguguguguguguguguguguguguguguguuugugauuuuaauauucuaauuccuuuucuccuggaaaaaaaagcauacuuuguuguuuguuuagcauucaacagcucacuugauggacagauugauauaacuuuuuuuuuucuucuuucaaggaacaugccuuagcuuggguuuagagagaaaguuaaagcaaaaaauaagcuggcaacaaccagacuucaggugaagcaauaugggauacuagcacaguguagaagacagacuccagugaacaacugcagagagaaagucagagggugaggcuuugugcagaguguggguauugaacuugaccucccaacuggauaaacauugaauggauagaaaacauugggaaggugggaugaaagagaagagaauccgccaguggagcaaaaguagaauuaauuccuuccuuccuuccuuccuuccuuccuuccuuccuuccuuccuuccuuccuuccuuccugggaaaguuaugaagacuguacuauugagagcauuguggggaaacaguguccggcuuuacagaaccccaaaaccaagugcuaauucugaccucuuucuuccucuuuugcagcgugcuguacaucccauguacaaacuagacaagggcucuaucacugagcucuauuacugagcucugucacugagcucuaucacugagcucuaucacugaguucugucacugagcucugucacugagcucuaucacugagcucugucacugaguucugucacugagcucugucacugagcucuaucacugagcucuaucacugagcucuaucacugagcucuaucacugaguucugucacugagcucuaucacugagcucuaucacugagcucuaucacuaagcuguagcuucagcccaggcuacauuuccuaguuucagauucacuagccguaugugucuuuccaacauuguaaguuuaaauuaagcaaaugcugaguuccuccaucguagcagccaccuuucaagggauuaguggcucuaguucuugcugugggaaugucaauaauauagacuguuuucuuaucgcagcaagaccuccuggacagcacacugcccaguuucaauaauguuagguuuggauauggagaacugucaaguuggagagcuggcauaauaauaaaaaccauaguugaauuuuaaugcugucaguaaagaucagcuuugcuguucucacccucuuccuccucugccuucuuucuccccuuccucucuauucuucccucuuuuccuuaucuuucuacuuuuaauugcuauuuuguuguucaaggaccaaacacaguuugccagcaaauuguauuuuguauauguuuuuaagaaugucaugcuucauuuauguucaucagucacguacuaguuucauagucaaggaacuagaggauuuugggaaacacuuuuucauuaaaguagauuuuaaggagaauucagcuuaguuuaucaugacagccagggcauggaaaauaauuugagucuagaaaguacaaaaggaaugaugguauaaagugauccuguugggaugugagagagaucugaaucaaaugauguuguaagucauuaggagaggggcugaagagaugacgcagagauuaauguucugagaugcacagagaugagucaugcacaggacccaaguucaugucccagcacuauugccaagugccucagaacugccuguagcuccaguuccacgggagucugcacuccugacccucaggacaccugcacucaugugcacaaauacacacucauauacacacacgcacacacacacacauuuauauaauuaaaucuuuaaaauuuaaagauauuuugauacuuguuugaauggagguguaauucuugaccauuucaaguuguuuuaaaguauuagaauuugccgggcgugguggugcacaccuuuaaucccagcacucgggaggcagaggcaggcggacuucugaguucgaggccagccuggucuacagagugaucuccaggacagccagggcuauacagagaaaccuugucuugaaaaaccaagaaaaaaaaaguauuagaauuuacuuuucgauaccauagcaacaguguguaugaucaguagcuucugcuccguagcagccagucccuugcuuguguuuccuaugugugagagaguguuagaaucuccccaggaaaaacaucaacagagaaacaguguguugcuauauuaggaaucgcuucacugcugugauaaauauuuuauuaguuaauauugcauuuuaauaauuuguaaucaguaauaaauguuuauguagcauguauuuauuuuuaaaauuuuguugcuaauaauagucacuccuaccaaguuguaaacacucugauaaaaaugugcagagauauuaaaaauaccacauacuaggcuucucaaaauaaguuucuauacuaucuuaaaaauucaugaaaauuuacgagagcccuggccccugaaacauucaauguagcuacuccuugugucccaugggauuauaggaacgucuugguuauccuguaacaacuacaucuguucuacuuuaaaugauguuuuuguugccauuaguaagaaguuauauauggccccacugaacagccuucaugauaaaaguguuugcuuaagugucacagggacacucuucacacaaaaaucaagauucaggcaaaggcuccaggcuuguaaaaccagauuagugucugagaugaaauggcugaauauuauacuuuuuuuuauuggucucaugagaaauacuaugucuaagagcugggguaaaauaaacagaugaggaauauaauucaaauaugaauuuaguuuagcaucucauaauuacgaaaguuucugguuacuuuuccaacuguccuaauagaagacugugccccuaugauuuguaauaagaaaguuaucuucuaagccagugguucucaaccugugggucgcaacuccuuucacaugaguugccuaaaauccccaggaacacagauaguuacauuacuauucauaauaguugcaaaauucccguucugaaguagcaaugaaaauaauuuuacgguuggagggucaacacaacaugacaaacuauguuaaagggucucagcauuaggaagguugagagccgcugcccgacacacugauggucuuaaccauccuaaccuguuguccuguguguggagagucuggugcucacaguuagcugagcaagaaagaaucgacaccauggcuagaggaaagcugguggcuuuggggguugggcugaugaguuuggagaggaugacauaccuguugucaauaaauuaauaauucucacagucaccuuuagauugcauguaugucuucuaaauugauuucaugcuuuuugguauuauauaguucuuguagcauccuuaauacuguauagugagucuacugagugcuaguagacuggaucaauuaguccagacuugggguuuguaucucaacaggucauacagauaacucuagugaucaguaggggugaaaguuacgcuauaaaucaaacagugacaucucaaauucauuauaugagucuuaaaagauuuugcgaaguagcuguauuucaggaccuuucagaaauuuguuuuuuguuuuuuguuuuuguuuuuguuuuuaaauugagagugggaugaccacuagauucaggguguugcuuuuaacggauuauuuuacgccaucaucuaauuauaaagcugaaacaugagcucagucagauuccugaugugaacaucgcucucaguaccccuugcccugacaguuucuuacgcagaggcaggaaugacacauguacgacccucucuguacagcagcagguggcugcugacuaugucacgggauauuucuuucaguacuuuugcuuuuuuaauaguaaucuuagcacaucaagacaagcaggguucaugauauuuuccuuuuuuccuaagauaacuuugaucauaaauggguuuucagguaaccugucuggcagggguggugguuguccuaguggcaaaccuugcgucuuccuucuuugcaaacaaggugggacuacugagccccucuggagaggucaagugaugguuuccugggggguaacccccuccccauccccaccacacacacacacacacacacacacacacacaauguauagcauacaguaucauguaucugaugauaacagaaguaaagaucacuuugaagagagagaagcuagaaugauauaguugccuauuuagacacaguuaucauuuaaauaagcagguguugcugguuacagaguaacuuuucagaacaaaagggcuuuguccuuguggccuuuagaaaaguuugccauuuguaaacccuguucugcugaggccaguuuuuauugagggcugauuuguuagaaugguggaccaucuggcacuucaaaacuucugagacuuucagggaggggggggggaaagauugugugcuguguuauuaacugucaaguaaaaugaugcugccauugugguauggagagcgaccuaaaaggaugaacaugguuuacuugggaguguucuaguggacuucauuuugugugaaaaaaaauauuacaugaucagguaaaaaaauguuuuucaauuuaaaucaaggagauuuaagauaaauuuuaucucuccauguccauuucuacauuuuuucugagugauagccauuauuucuaucauuugauuguuccguuuaccauagauuauuacuaaauaaagcuuuuaucauccuccuccccuuugaagauacacauauggcuuauuucucucugugcacuauuuauuugccagccuauccacuuuucuguguuccuuaaugcgugaaucugccaucauuucuuuacauguuuccuguccaaauggagcuuauugugaauuccuguggguagaauuucugugucaaaggucauaagcauuuaaaauuauccucuguccccagacugggcaguuucuaguaaucuucaggaaauggagugguuacccuaguucugccaggcauaggcagaacucuaaacagcccacaauuuucugugucauggucuggguugacugacuguguuugguagaagaagaguguggagaagaaacaaagaaccaguguagagcucaaugcgcagaacacccauagaaaggagucaggcaaagacacagcaugucaaucagagggugggugcaguagagagagauaaacaaagaaaauuacugucucugucuuuaggggcgcuguauuugugcuuccuguggaaaguguacagacuuugauuucuuuaaccugggcauucccacaaagcugccaaaccuuccagagccuucuucuuaaagcuccaugucacguggccacaucuguccuaugcgcuuacacugaggcuuggcuguuaagagcauuuuacccuugucugaugcugcauuguuuucgggaaggauauauuuuggggacaguaacuugucucgguauuauuuucugaauaaccuacuauagugcucucugaauccuuaacuauuuagagggccguggaaagcugaccccugcaccuggcuggcuaauucagaaguggaucagcuggcgggccugccccugaaccccuuccccacucucccagggaagaaaaaaagcucuuugugcuuuuaccauaacuguuaaaaccuucuggccaugaacuauggaaacaucuaaaguaguaacuuuuuuuucuuaugaaugguguuuuuuuuuuuuauuucccaacacccacccuuaucauuaucaaaauagauguggcauuuauuaaaggugaacauuauaaaauaagaccuugugcacagucuuaugccccggcuuccugggaugaaaggagguuucaccccuuucaucagggggcucaggccuccaucuccugguugaacuuucugcccuuuggggcuguauauuaccuuaaauagcuugcagcugacagacugcacugccggcccaugugaacuggaacgcuguaauggaugggguagcgucuccuaauggaaccaccgugguaggcgacaaugagaagaaaucucuccucgggauuaggggcuuggagcgauuuuauuuuauuuuauacuuuauuuuauuuuaguucugaccuccaaguuagcagguuaugaagaggagaaaugaggugauuugcuucacaagaaauaaacaagggucuuuucuugagucagaaugggcuuacagcaggcacaauguucuugcccaugccugaagcuguucauuuugugaaucggccagccgccauuuaucuguggccaccuauugacccccguaugcuuugcuuuacaggcuccuaaaaucucuuucuuuucucaggguucuuuguauuggccacaucaggagaaaucuguuagguuuuaugcagaaaaaaaaaacacuuuauuuuuacaguuuuaagacaugugagcuugguauuuagagggaaggaacgcuuaaguucacuguaggagaaaauaucaguuccccaaagcuacucuuuauguuaacccuagauaaucucuugcugcuuuuauaaaauuacaaguaaguuaucuuuuagcaagcuauacgcaacacaguuuuuaaauguagaauauuacuuuaucagccugcucuuuggaaguucauggggaagccauacaggccuuuucauuuugacacuggaaugugguuuucauuagguaauuuggauuuggauuuuauugguuggauuuuccugugcuucuccaugguuccggggccuuccuuggcuuucucauggaacuguaugcuugaauuugaaacaugucuuacuuagcuaaagauucuggguugcuuagguugaucuaucguagagaccagcagcuuggcaugccuucgcacuccugaggauuagugagccuuuuauuugcacacugguuuaaacggagaaaaugucaacuacuucaaaugccaccauccaauuuguugucucucugguggcuuuuuaauuucacuggaggcuucucuaggacuuauaggauuuacagaagauaauguaucaagaaaagcuugcuguacaaaaaagggggaguacauaucacaauucaugaacugaauuuaaacugaggaaaugucaucaccaauagauagaaggcaguucacuacauuuagauuuucgaagucuuacuuuuaaugccucauuuccaagcucuuaauuuacaugcuggagcugcagcugaaugaccgaucacuuucauaauguagauaaggcccugaguuugaucaucuagaacagauaaaugaauaagaaaacauaacaauacagauuuaguguggugacaguauguaauuaaagugaagacuacggagauugggacuggagagguggccuggcccuuaaguguucauacaguucucccaggccuugggguucaguucccauccaggucagguggcuugcagccucuuguaauuccagucccagcagauccaguguguuucuucucgccuuugcagguaccggcacucucaugcacauacccauacccauacauacauguauaacaaaaaauaaaaaucuuaaaaacaagaguguaaagaugucuucugaggggacuggagagauggcucagcaguuaagagcaccgacugcucuucugaagguccugaguucaaaucccaacaacugcaugguggcucacaaccaucaguaacgagaucuggcacccucuucuagagugucugaagacagcuacagggcacuuacauauaauaaauaaauaaaucuuaaaaaaaaaaagaugucuucugaacgacuccaccaccuuuccagugguuuauuuugaauauagacccccuagucuaugcuggucaccuuuguuuacugcaccaucauagcuaggcugacccccaucuuugacaguuuugacaacggugugaagaaaauucuaucucagugcccucucuucuuugccggcagaggguggcaauucugagaacgggcagcagcuuugguauguucuacugcaaagcugcugguccccuccuucuuuuuccuuauccuguacagaauauggacauuuaccgcacucagaaaugugucuucucuggaggagaucugcccuaaagaaggaugcuguuauuaugccuugaccuuuauucuuagggaaggaaacaggauaucucaggcacuucuaauagcauugugcuccuuagcuugguguaaaaacccucuaaggguaagagccuucuugugcuuccuauugucuguugcuugguagagucuuuucaguucacucuuuagauaugugcggccuguuugcacaugucagcucacaguccuguagcacucugggugguagcuggaaguuugcccagcugagagaguuugcucuuuuucuuccucuuauuuauuuauuuauuuucuggguggugguuggugguggugguagcugugguggugguuucuuuugucuugaauuuauguaaaaaguuuauuuguugcuguuuaaagaucucagcauguggccugagcccuggcagacugggucaccuuggcuaaagcaagggcugagaaagaguccccuggaugugugaaugucaguacuccagucuuguccagucuguuuugagccacauugcagacugcuuuuccucuauauuuucugaauaaugguuggagaaaaaugagaguuucuauuuauccaucaaaauguggugcuuuggaaauccuacauagccauuuuugccccccaggggaauauauagauuucuauaaauaaguaaugaaaauauuuuaaaagcuuguuaaauuuuguauaaauggacauauguaaaacacaugcuauggaaauacugaugugaaaauagguugggaaugaaguggaaagagaacagguuuguagaucagacaccuguaauagugauggauuccugguagauuugaacucuuacaugugaagaucuuuuuguauagguuuaaauggaugcucacaacuuugauacucagguaauuguguagaaaacucuaauuucagcgugcucuuccaccuuugcuguugaccugaugcaaaaaaguagauucaguugcauuaagacccuuugugauguguccccauuaaaacacuguuuaugguaaaaauccuccccgugacuagagaaagaugcuuccuauggacagccccaccguucuuaccuuuuauggcuaugcuaaauagcuauguaaaacaaaacaaaacaagacaaaacacccugugaaaugguaggaugacugaucaguacaaagguguaguuuguucugaacuucccccuccaaagucaucccaccugaaguggaaaauaaguucggugucauugguugucaaaauuggaauauuuucuuucauuuuguccguaucaaauucuccuuaugcaaacagaccgggcgacuuuuuaauaagaucaaagaacuuuaagaacuauuucccucaucauuuugccuuugcagcccguuuuauuuucuuugcacuaauaauggaauuaaugaagcuuguuuccuuuuguggcaugugguguguggcgcacccacuccccuuucuuuuccugggugggcucccaaggggacuauggcuccuggggucuauucaggacugagacaauguaaaggauacuguacugaaguuuggggcagggcggccuccaggaagugggaggaagcuucaguccugcugggugagggguggcgggagagggaggaugcugauuaaaauaauaaacaggggccuaggagagaguccgggugcugucagaucaggucugggagucgcgggagcugcugcaaagcucccucugggcacugcacacccuguccugaggagggcauccugagauuuguugcaagaccuuuccuuccggaccggagcaaagcaacuuuuaaaaguuuuaacuccgcggcacugacagcguaccuuaggcugugcugaagugagcaagcggagugaaacuagcuugguggucaccauagcaacugugcuucugcugucugggagaauggaagcugguggucucgugucucggguuuuuuggggcgucuucagcuaggagcacacuccugcuuacuggaacucuacauaagcccugcuguuuuaaaauuggcucuugacucagacuuuuuuuuuuuuuccugucuuuuccuuuuuucuuuuugaaggcagccugaauggaggaaguugguaaugcuuggcuuuuuuucccucccuucucucuugcaaguuuccaggcuauagcuuuuucccccuuuccuuucugcuguguguaauugagaccaaacucuaagccugggcucugaagagaacagugguggccugcaggucuuuagggaggccggcagaaagagauccugggcuucccagggcaaaaaaggagaccaugccagccucguggaacacagcuacaagaaaacacagaagcaggucucugccugccgagcuccgaaguccgugaggaaacggacccaaggugggguggcuaaaaugucccagcgcaagcugcugaugcucaugggccaccgcucaagggcaaggauugaaaaggauuuuacgaaggaguugaaaguauagcuagugaagauacggguuuuaaaaguuggacguuguugucugaaggaaguuugccaggaagauguaggcuucaagggcucccggacgaugauuggucugaacuucagcuuacgagaauuguugacaaaauuugaaaagguaugcagaaagaaaacuucacggacgcacuucuguuuuaguucuguuucuucuucuguuugugcucuccucuuucuucuucuucuucuucuucuucuucuucuucuucuucuucuucuucuucuucuucuucuucuucuucuucuucuucuucuucuucuucuucuucuccuccuccuccuccuccuccuccuccuccuccuccuucuucuccuucuccuccuccuccauuguuuacuguaacuucuaaagcauuuucauuuuuaauuuuaauguaauagcuucuuugagauuguguuuuagggaacauaguucuuucccuuggucaggaagaguucucaugcuugucagcuuuaacguuccacaucagaaggaauggcuuagagucaagucagcugguaacuuaauugcaauuuauuuggggggagaaaacaaaacaacagccaaauccagcaacaaacacuggguuugggugccaaaggcugacuucaucaagcguguauucuguuuuccaugccccucagguuuguuuaucucucaggcugcugcggcugagccugcccuugcagccccggcugaggauucagcucugagccccagaagcuggcccuugguaacgauggcacaucugcugucuggcauuuccuucagaaucucuuguuuuaaaaguggauaagguuuaaggcuuggauuacuaacuuugcacuuggcacccucucuucccccaaggcucuuggcacaccccaggguggagcauagccuguaaaaaggcuaccuccucacuuuuugaauuaaacaaagcagaaaccuccccgagccaguuaguggcuuccugagugccagucuuguuccaguuucugcuacuuaaaggaguggggagagaaagaaaagaaagaggcaggguccuuuaucccuauaggcacagaugaacuguuuaucaacuguuaaauguguucugguuuuucccaccauuccugaaaguacaaauauaagcaucuugaaucauucaaagaauaauagacuuuuucuuaggaauugcaacugccagaggaaaagauguaaaaagugauacccuuuaaaaaggugguaggcuuuuccugaacaauugcagccauccuggcuucccagugauggaagcagccuaucagaaguauguauaacaacagcaaaaaguuagucccuccucauagagugcuuccuaucucacaucccaacuugaguaguggagaauuugcuuguaacaugggacagaccuguugcuuucauaguugguaagggucugaauucuggagagcaagagccaguucacaguuggcuugcucacuuacaaagggcaugacaaagaaagaauaucgcucuuguggcagcugcgaacagcaggugacaaacuuuauggccguaaagaggucuguuagcuuguuuucugcagauuugucucauucacauaaaaagguauagagcauaugugacaggaauaauaauucaugcuugucauccucaccccccuccaauaaucauggugcaauagcuggacuuuugaauucuaauugcugcuauuugucuucaggcuuaggucagauagcugaggugagcaaccuaguuucuuaggccucugggccaucuuguggguagagucagauguucugacauugguaugcuuucuccuuuaauucccaggccuugguaucugaacaugacuuaaucuuguuuuuacuuuaggaguugacuugacagcaaaagaaaggcuuauauauguaaaaggcuugauuugaaaauuuucuccaaggauagauuuccaagagaccacccugcuuccauugaauaugaacuuuauguaugcucauucuuguggugggcauguuuucaaagccuggaugaagguaacacuuauauguguuucacugguaggaagccaucacccaccaguguguauuuuuccaacucgcaccuuaaaaaaaaucccuuuguauauucuaacaaagcugucucauauauucaguuuaugcuccauuaagucauugccaggaaaaccggaauucuggaaagguuucacuacuucacaccucucaaauucagcuacuucccuuucucuaacccagaaagcaacgcugccauuucuggggacauuugaacuauuuguaauuggaaagccacguggggugcugacugccacuugcaacaguacacucaacucccuuuucccguggcaugcagaagcuaccauguucauuuguggucuugcuuuauuccaaagacuguagaagcugaccugcuaugugcagugguagacucccuuuauuccauggaauacaggagcugaccuacuaugugcacuaggggacucccuuuacuuucaguucucuuaguuuuucuuccuccuucuccuccuccccuccuccuccuccuugccucagacaugccaccauuuucauaacagcaguuuaauuguucaaucagaugguaaguuaucacaaccaaaugucaauuuugcuuuauuuuuaaagccauuucuggcuugaagaaaacuaagaguccaucuugggauaguagaugcagauuugauauguuugguaauugagguccgugcuuggcagguuacccagugcugacugauacugagagauugacuuguuagauaucuaagaucauuggauggggugaaagcaaaccuucugcccgccuuuaaggcaccagacuguggagaugaagagaaagccacauuauuuuaaggaaacuagugaaaacuuugcucuuuucacacauaucugaacaucuaucauaugaaugaauaucuacuccugggcagauugcaacuaggacucgugucucuucaaaccaccauguuaugaguccuuggggguccaagaggcaggaagcuuucagagaugcucauccaagcucagggaaccauucccuccuaagaggaggaccuucuuacuagaggauaaggaccucaccgugugauggauccgccaauaaggaggucucucaguauccuuaagccacaugcagcuaugcccaugaaccugagagugacuucucagcaagcucaaguuuguagacaaagagaugacucaccagggaaccccugucaaagccucuggcuuaguuucaugguuccacucauuuuaauucaccagcguuuuucuugagcaaacuuuccuaacgaaagcauaacagcguuagugcuguacugucuuagcagagccucuuguauuguguacugguuuugugucuguugcuuaguccuacagagacuugaguaaugggcagcucuagcucagugacauuuuaaaugacugucgcuuuuauuaauuuuuuuauagcccugcuacuagaugauuaaugauaauggucaucccaagggguucuguuuuuguuuuuaaucgacagaugauaaucauacaucuuuaugggguaacaugugacaauguuguuacauuuauauauuaugucaugauuaacucaggcucuuuaagccauccaucaucugaaacauuuaucauuccauugcucuuuagacauacaaaaucuccuaucacaguuugaaacauaugauagaauauggucgguuguguucuccuuugagggauccuuaccauguaucuggauggcaguguucacuuggugagucuuuaaagaaagagacucuucauagugacaauauagucacugacuauguaaugcaucucuauggcauuuacccccuuuaucaagcaugagucugauauuuuaaaagcuagaagagaagugagccaugguucauaggugauggucuaucauguuggagaaaauauggcugccauggugguuuuguucccacugguggcaauuaggaugguuugcucauagaugugcagguacaacaggagaaaaacuggauuggagagaaguggggccaggguauaauauucaagccugccugccacuuggcaaccacauccuccagcuagacccucucuccuacagucuucauaacauuucaaaaacaacuccaguaaauuuuaaauacauaagucuaugggggacguuucacauuaaaacuguuauaaccucugagcuauaccuccaacccuccaauuaaauauuuaauucaaauuaaauauuuaauuuaaauguggguagauccuggaagagacaguaaauuccuucauuuacuguuuagggaauauuucugaaguaccaguuaucaagguugaauguagggaugggagacaaccacguggggcccacucuuuccuucauugggcuauuguagugguaggauauagaccuuaagcgagaagauuuacaugauaagugugcaguuuauccuauugucuuaguuggguggguuuuuguuguuguuguuuuuugcuuguuuuaugcgaggagacacaugccauaaccaaggcaaauuuuauaaaggaaaacauuucauuggugcuggcuuacuguuggagguuuaguccauuaucaucaugccuggggaagcacggugucauauaggcagacauggugcuggagaagaagcugagaauucuacauccucaacucacaggcagcagacuugaacaucugagagcucaaagcucauacccuagugaugaaccucuaccaaccaaaccacagcuacucuaacaaggccacaccuccuaauagugacccuccugaugugccucuaggaaccacuuucuuucaaacaggcuuauuuuguccaguuucuuuuagcuuaacugaguuuuguuuuaauucagcuuacuuuugagaugggguauucuagaguuggucauuguguugaucaguuuguaaucaaguucuuggugauccuccugccucaaccucccaagugcugggcaguugcaggaaugagcccucacacucagccaauagcaaguauaguaacaguagaaacugguuuuauaaagucuccucuggagaaauugcauuauaucugugauuucaaaaccuaguuuaagcuuaaggagaaacugagguuguguuccgguuugcgagcuccugcgcagcauggguggauuuggguggagggagaaacucacuaggaucuucauugacagagcacagcagcaacacugauugggauuugaagagaagcuuaccccaggauuguagcuuugaauguuugauuagugugaaggacaacaguccauuggugugaggucagacuuaaguuugaucacaaugcuggauagaggaguugaguuaaaacauuauauuggccacuugaaagguuaagggaguguuccuagaaacuugugaugcagauagucugugcuuauguagugugugcuuugaaaggaaagucacuguagugugauuuaguguggcuuaaaacuauaugguuuagacguucagaguuaaaagcuugaaauaauuuuuuuuuuuuuuuuuuggugguagaagauaguucuguuuacagcaguguuuacauguuggcauuuaaaaagcaguuuauaguuuauuggaaacuggcuuguugaaaucaccuugaaauuguaguaaauggugaucuuaaacuuaguaaauuguaaauuaguaaauagacuugucauagguuuugucucuuugauauaaguguagacagauguuccugcgacucucaguugaggaguuuccuccaucagauuguccugugagcuuaucugugggauaucaucuuucuuaauugcuuauugauguaggagggcacagcccacugugggcagcaccauccuuaugcugaauaagaaaguuagccaagcaaaccaggaggaacaaggcaguaagcagcauuucucaguggucucugcuucaguuccuaccuccaggauucuguccugaccucccuagugauagacugugaccuaggaguuguaacaugaaauaaauccuuuccugccccacuugguuuuacucagugugguaucaaagcaacacaaagcaaaccaagacaaaaguuuuucuacuccauuaucuuacauauauuuacaucacaaacagugggagaagagcauuaauugcucugauuucuuaauuuguaaaaguaaccgucaauacuaucagcuuuacagucagaauggcauucuaauguugaucaaaauaggacucacagcuugacucaaaauuucaagacaaguuauuggaaggaaauacaguauuuagcacaauuaauaggguaacugaaaucaauaaauaauugaguaacuucuuacaaguuucaaaugcugaaaacauacuuuugacuugacauuugauuauauuaacuauuuauuuuuauuuggaaaaauaucuggauuuuuuucaaguuaugaaacuccucuuuaaaauacaaagcuccuugagcaucucuuucaguccaucuucccuaucuccuggauccaacauggcuuuuuaaaggcacaccggauuuauuuuucaucccacggguuacuguguucauuuagccuaaguuugggacaggcuaauggaauaauugcucauuuccccucuccaccuucaggacaggggucaacacuccuccagaggaaacauugcuauagccauauaggguuagagaaauaagccacgcaaaaaauaaaguugagucaauuagucucaaagagaaugcauggaaucuagcagggauuuagcuguugaaguuggcuugaugguauuaugcccuauuagaauguucauacaguucuguuuggguaaaucuaaagaaacauuuuuaccuuccaaguuacauuaguaguguuaguaagacauagggaacagaguauaucagggcacaguggccuauaucuguaaaucuaacacuugaaauaguccaugggaggaucaggcuaggauacauagugaaauacucacucaaaagcaaaaacauaacaacaacacaaacaaauuguguguguauuuguauuucugugauaucuuuauuuauaucuucauuaaaagaaugaccaaaugaggcagaucugcuauuaagauaucaaauauaaaguaaguacaauacagaauuaauguauuccuuucuuugugccauuuauuggaccuacauagugagagcuauucacagaaacacuacugcuaaucagcaaaucagcaaaucuuacuuagcucuggaagcccuguuuuggagagcugugaugggguuugcaucucaugcuacugaugguguuucaguaagaggaaaaguaguggccuucuuuuccagcccuucuucuuucuuaacccuccccauugugcuuacacccccuacaugcauccuuaggacauuuaccagccuuguuuucaagguauuaguucaacuacuugcuccagugugcacaugacugguuuauguuaagagcuuggaagagaauugcuuugugcuucuagauggauuacagucccuugcuaauuaucaguaacuguuuagugcuauuuaaccuucugcagggcuugcugggugacagagguaagcauuaauagaacuacaucuuccuggauggccaacaaaaggaacacuuccuuuauggaacuuugauuuauuuuagcauuuagugcugcuugagggucuugcccucaaagcccuccgugcuggcaucuugauuuuaaaagcuucgcaucauugcacagcuaucuaucaaggagcaugauucauuaacuucauuuaauucugaguuuccagugagagcguugauaggacuuuacagcaccggcuucuaaaugauuucacguuuuucauauccaaacuuuuaagugaggaaauugaacuuaaacauuuaccccauugcuguucaauccaucaccugcuuccuuugucacuacuguggcuuacuugucaaccagucaagauguaugaguauuuguuuaugacauuggucuuuuauguuagacuuauuuuguauaacagaagcugugaaagaugcagaagaaacauaauacaauuuucuuuuuuuuuuuuuuaauuuuauuuuuuuguuuguguguuuguuuucaauucugggugauuuuggaagaauaugucaccaaaaggcaaauaaaacaaaauaauguguggugaucucuuuuucuuuguucauguucugauuguuggcguuucuuccuaacuguugauguugcucucauauggaaggguuucucacaucuugcaggcuuuauuccaacugggacaucacugcaguucucucucagugccuucagggccaaacaucuuuacugucuuugcugaauugggaaacauaucaccugccaugauugugaggagaaauuugcuucacaucugcaguguccaaacguaugaaguuaggcagugcucuuguggaccauagcauuucuauauccuguuguacauccgucuuucuggucucguggaucugaaggguagcaggaaccaggucuaaugugagaauaacuuuaaaagucccacacucuuuacauauucuuaaaauuucaaucucuuuauaauauccaucucuuuuaaauccaaagucuuuuuacaauuaaaagucucuuaacugugggcuccacuaaaauaguuucuuccuucaagagggaaaauaucagggcacagucacaaucaaaagcaaaaaucaaucuccaaccauccaaugucugggauccaacucacgaucuucugggcuccuccaagggcuugggucacuuuuccagccaugcccuuuguagcacaggcgucguccucuaggugccuguacuccacugcugcugcugcucuugguggucaucucaugguacuggcaucuccaaaacacugcaugaccccuuuaguccugggcuugagguuguguugugaauuuuuggcccauuguucuuaagaaucugugcagagaauauaaggccaaguucccuuggcaauggaaagcaaagagaggccuuguugauucuaucauugagucucuugagaaauaugguaaugauauagaucaacagcacugcaaaaguagucuucuaaguuucauauacaaaucuauacguauguagguuauacucaaugaugcuucagauuuugauucaaguagcuauauuuugugguuauaccugcacccuuuaaagcuggggucccaaaaaggaaacucaggcugcauccuguucuuugaauagauacuauaacauguuuuuaggauagauacuguaacaaguucuuaggauagauacuguaacaaguucuuaggauagauacuguaacaaguucuuaggauagauacuauaacauguuuuuaggauagauacuguaacaaguucuuaggauagauaauguaacaaguuuguuuuuccguacauucugcaaguaauuucaguauuaacuuucacauuccuauuuaauagaagaaaaauuauuuuuccuuuauuauuucuuagugaagcuaaacauaugugaauauucuucaaagguuuuagaauaaauuguaugagauuaaaaugacaggcagagggagaguaaguagugacuuacaauaguaauaaaaauuuaaaaaaugcccacucccucuaaaauacuaacaucaaacaggauggugcaugaauguagaauguuauaaauucugcuuuuaggacacugggaauugauguauuagagauuuaaagacuauuauuuucaaugauggaacugugggaauacuugguuuuguuuuacauuacugaugguaaaauaaagucuuuugauuaaaaacaguucuucugcacauccaaaaguaacuguucauguaaagauccugcaacgugccccaagugaccuuuagcauuugcaucaucucuuugcuuuucuauuuaggacauccaggcagaaauugaugcccacaaugacauauuuaaaagcaucgauggaaaccggcagaagauggugaaagcucuggggaauucugaggaagcaacaaugcuucagcaucgacuggaugacaugaaccaaagauggaaugauuugaaggcaaaaucugcuagcaucaggucagaccacucgagauuuaaaaaaaaaagugugugugaaugugugugugugugcgcgcuuauguagauuugggucuaucagaaagagaaaggauuaguacaacucuaucagaauuuguuuaagauugaaauccaaagucuguuuucuuuccaguugguacugaagauauacuuaacaguagaggacuuaacuguggauuaggucuuggguucaauccucagcacuaccaaaagaauaaauauguaguuagaaguuuuugccucguuuauauacccagugugcucuacuauuuguuccaggauauucauagucauguuuuaaaccauacaacaauacggauaauaaugucacugacacuugcuaauugauaaguguuuaucauuauauuguauguuuuauacuguguuaggaucauuagagcccuauugaucugucuaucuaucuaucuaucuaucuaucuaucuaucuaucuaucuaucuaucuaccuaccuaccauccauccaucuauuaauuuauuugagacaagguaguaguacuggguggcuuagaaaucacuacaugaccggacugacuuuaaacucagaguuaucugcucaccuuugccacucaagugcaggaaauaaagacauucauuuuucacagagcaggcgugcuauagcccagguugaccuugaguuuauuguguaggcaagguuggccuuuaaugcuuuguuagaaacaaaaacaaaaacaaaaacaaaacccuucauuuaaauuauguacauguauauaacuuuuguaaauguauguacaccauguguguagcagcccauggaaguggaagaggacaucgaauccccuagaacuggagagcugccauguagauauugggaaccagccuggcuccucugcaagagcacuaggugcuccuaacuugugaacuaucuuucucaggcccuggccuuugacuuuuucauucuucauccagagugugcugacauuacauacaagucccauccugcccauuuagaacaauuacuuuacuuaguagucuugcacuguguacuaacuuauccaucacuuuauguacaguaguuguuucacacaacuacuuaauuuauacuauagagaucugauggcuucucagaacgugccucuguuguuaaguggcacaugauaguucuugaaaaaaaaucccuguaaaguagaaggucaggauuuccauaugagaaguuuaaugaauauaaagauuaagauaauaagauaauagccagaauuugaauguagauuucuuuaaaucuugguauugaaucuauuuugccccaucaaguguuuauguccacuuugaaaauauauuuauuuauugagauuaauugccucuuauaaacacuaaaauguagaagugaugauucaguucugcuuuggaugaaaguaaaauucaguuaaguacggacaauaggaucagggcucugacaaggaaacagcauuaacgaauuacccagaguaacagacugguaccauuauuggacuucaagcacauuuuaaguucauacucaguagcugauagacaguuucuaauuggcagcaaguuaaagggauacuuacagaagaccauaguagcaagaaugauaauuccaaagaggaauguugguuaaagccuuagauuugguuguaucauguguugaauaugcauaaccuuaaaaccaaaugguaccgacuuugauuuuugcacuuugcuauguauuuucugaaguuggacacauuacuuuaccccugugaacuuugccaagguguacuaucuguauccaacacacuugauugucaggaagaccaacuagaaugauuugauuuuuucucaggcucuguagacccugguuaaaguagacucuaggcuauuacucauacacaagguugggugaguggaucggauucagcagguguugggaauccauagagcggcugccagagaauggaaaucauccacuauuuuuuguccuguaugauuuucuuauuaauaaagaaaaguaccaugugcucuacugggucucauaaauuaaaacuuacaaccccucuauuucuuaggaagagugaauuguggcgcuaugcacucuucucccuauagcuccaguuggaaauuaucucugcaucagccaccucuccuguucauuugugcuagagauggaagcccaagcuuugcuuaugcuguguagauacuaucuauguuuauguccauauggacucacuuguguuuucuaugauuagauauguguaacuaaagaggaaagaacuuuucauauuuuaaucuucaaauauguaaaaagaugaaaucacguauccuuuaugaauuuguaugagauagugguuuaucuuucucaguagugggcucuucacauaggaaguucagcuuagaaagaaggggaacaaagcagcuuuggagagcauugcgcuuugcagagacacuauguccaaacacugguguugucaugcagcagucagugggcagguuauugacccaugugugugcuucaguuuccuuguaugugaagcaagaguaauuuccuuaguggggcuuccaugcauguuuuaguuagcccacauacaauacaugcaagaagugggucauguuuauuacugcuaucagccacuacuugugugguaaauuccucuccuccccagccccucccauaucuuagucaugaguguaggaacuguuugagggacucaccaguaagcagugcccucuuuccuggcuggauucugaacaaaugugaaagaaaaguggguuuagccggcuuccucacaaaaucuaaugccaugggaaugacggacagaagccaggugaaaggaggaacuggcuuagagcuuagguugcuaacucaaaccuagacugaugcagaauucccaguagucacuacucaaagguggcuucccaagugagacacccuacaugcaaggucuauuauuuuacagcaaaauucuucccugggccagucucuuucuggcuccgccuccuucauuauacacgcaaaugauguggguggaguugcuguucagaucacuccucccuuucuucucuggcuuuaggaguccagccugguacucacauugccuuuaggaguccagccugguucucacauugccuucuguugguauccgauuaucacucuucccuguaauuaauugaaaauugacuuuucucuuaauugccaaacuuuacuugaaauguucuuuaauagagguuaauuuccuccauuuuccuugccuagaagccagugggaauacucugaauauuaagccuccuguggacaccacgcauuaggauaucagucauaaacuggccguggaaggcaguuugccugcagaaguagcccugucacauagggauagguggccaauuggcagccucuuguggcuccuccugccuugauucccaucucuucacaucuccccccccccuuuuuuuuuuuaaaacaaugcaucuauauuucugccccuuuaucaucuuacuccuaaucuauaggggcauaugguuccuuucucuuugaaguacacacacuacuuccuuuuaucuuccgcccucagcucucagccuugguggaaacauucacacugguaacuuuuucuuccccgacacagacuuucucuguguagucaugacuguucuggaacuugcucucuauaccaggcuggccuugaacucagagaguugccuguaucugccucucuagagcugcgauuaaagguauauacuaucacccagcaauaacauuuuuguauuuuaaucuucaagucucucuuugcacugucugugaacguucucagcucauuucuauucuuaagucccauagaccugcucauccugggcuuccauugauuucaucuucaucuuggccuccuugagaucacccaguccccaggggaccaugggcagggugaucuccagagggauucaggugcauuccacuggacacgugaauuccucagagaugggccuugguuaaaccaaaucaaacuuaggcauuauuaaugaaacccucucauaugaaagugauggaccuucuccagcuagggccccuuuccuccuuagcuggagccaucuguguacuauucuauaacuguguuauuuacuucauacaauuuauuuauaaugaagcuacauuacucuagccaccugcacuauauuuaaaaauguagauccuccaacauuuucuuuuuauucauugauuuaacauuuuucacacaauuuugaucauauuccguccucucccucagguccucucaggccaccccagccuuguuccagccuuuuccaugauggacugcuucauuucugucuuaguuugguuuuccagugcuguaauaaaagcaauuuggggagggaaggcuuuaucucccucacacuucaacgucacagucuuucaggguaggaacugagcagagacugcuagggagccuugcucucuggccucuuccguggcuugugcagcuuuccuauacaacucuggaccacaagggugaccucacccaccgugagcugggccuuucuacaucagucauuaaucaagacaguacuccacagauuugccuacaggccagugugauagaggcauuuucucaaccccuuccauccagcuuggagcucuucauaacacauucuagucagagccaugcccuuguauugucccccaaaccccaguugagcuuucucuucuacuucuauucacauugauauauccuggucaccaccuucucucuauccccuacuauuaaucuuggauuaauugcccccuccuucccucccuccuuccuucccuuucuguguaugugugugcucaugaccaugugucucuuaagaugcuucugcauguagacacacaaacauggagagauuaaagauguguauuuuccuuuccacuuuuaaaaacaauuuuuguuuuuguuguuguuguuguuaauuuugaggcagguucucucauugaaccuggagccaggaagccccagggauuuuuccuguuuccacaucuccaggguuacaagugccaccuuuuauguggaagcugggaaucugaacauagaggcucaugcuuguaucccaagcauuuuaccaacugaaccaucuccccagauguguggugcuuuaggaagggggguggcaggcagaagcuaagguuucuuugauauaauuugauacugccuacuauugcuguuauaauucugaauauuuuucuauuuuauucacugccaugucuaucuucaaaggccuuguuuucucuucaguuuccaagccuuucuuucucuggaugacuuaaucauuuucugaggaugaggccauuugauugauaacacccugccccuucaauuccauaauauuuguggauuguguauuucaaauaguguuuaguucauacuaccaccauggggaaauguuucuuuuaauuuguuuuuaggaaguggauguaugcucuuuauuguuuuguuuugauaaucuacucuuaaauauuuauggacaucaccuacuuuaaccaugcuguggucauuggaacagcuaccugaacuauuacuuuaaagauuuuuggaugaccaugauugagcccuuuaaauauuaaaauucagugugcuaaauaugcuguaucaucuuaaauacaauccauaacauuauaauauauacuuguauauauuauauaauguugcauagcauuauauauaauuauauauaacauugauuuuauacacacacacacacacacacacacacacacacacacacacacacacauacacacgccaguacacaauggaguaucaggucaguauauaacaaauuagcugaagacuuaagauuucauuuauaaaagaggcucuuaggagugcuggcaguacuuuaugaucacuuuuaaaacugauuggaauuauacuaauaaauucaagacugaaugccauggcuuacauuuuuaaauuaaauuuauuuaauguaagauuauguuaauuaaauauccacuuaucggcuuaaugauguuuaauauagauccauccuaacacuggguuucaaaggcugggcaaguugucaaaugugacagaaacagaguuuaaagauaaaaaucuaucuugcauuucuuuuauaagucuuuuuaacauuugggucauuguucuccaagcccuuaugggcgauggcuauucacugucauccuugguguugucacauuuuacagcaccauucuuaaccuuaagggcuuguuuuugcuaacuacauuacaaagcuaaagucuccuucuccuaaauguaacaaaacaagauucuauucuccucuuagaacguucuccagcagggcucucugugguggcaggaaggagcccugucaaucugguuacaccaugcccgguuagcuacaaguggcauuuugaacucuuaaauuauggcuagugugacugaggagcugaguuuaaguccuaguuaucugaagauguguguuuccauagcugcacaucacagguguccgccauauccagucauagcucuggggugcucuuuaguggcugaauuuuaaggacugucuguuuuauuugguuggccuuccaugcucauuuugggagcaggaauaaucucuuuugaauguugucaccuuacauguacauucuuaguuacauuuguuguugguuuuuuuuuuucauuguuacacaauuuaaauuaagugaguuucacaauaucugaaaagagaucacacuuguacuugaaugacagauuucaucuguguaguuuucucugcucugggagguagcaugucucugucuuuguugucuuuucacugagauccuuacaaagcuuaggagacugaguuugcgaaagugcuuuugacuuguguaccauuuaguugagcaguuuauaguuuuccuccuuuugcuguugcuaaccaaagccgugguuggcugaaguccacaucuuccuagugcugccugaggccuuuggcucccucagugucccgauauuuagcagaguggccaucagccuucccaucuugggaguguauuuggugaacuugaaauuuuuccaauuugaccuucaaauauuaacauuuugccuuuuguuuuagaagucuuguuguaccuaagggugcuccuugaacacugguucguacugaugauugagaacuguuuuccuuccugccucucucccucucacucccccuuacccucccacaccuuuucuuccccauuuucuuccuuggacagcgucucaugcaucacaggcuggcuuggaagccgcuguggagaaugaucuugcacuguugauucuccugccucuaccuccugaaugccgagguuacaggagggcaccaccucaccugguuuaugagaugcuggggaaccaaaccaggauaugugcaugcuaaacaaacacucuaccaacugacuucuggcucugguccccaaauggguaucuuuuagcuuacacgauuuucuuuguugauaauuauauucuggagaggagucagauaauuuguuugaugacaguuacuuugaaaaaucacuuuggugauucaaaacagauaugaguguacauuucacucuguaguucuuuucuuaccauagccaauugguaaggaaagcuuuuaauaaauguuuuucuucuaauaagucuauaauuuuugaauaacuagucauguaaaaacuuauaaaacuuagagcuuuauaaaaugauauuucacccagaguugggaaaucuguguaaggcagaauccauuauggauacuaucuaagguuaauacuauaaucaaugagagggucuauugcacugcaaaucuuacauaugguaaguauuaacugaugucaauaagacacugugauaauuauugaaaaacguuucuacagauaaugaacuagguaaagcaguguuuaccuguaaaugcccugaacauguggaugaccugcgaucuguaguauuggcacaguucaagcuauaaaaugucuauagucaauggugagagaccacaacuaagccaagcacaaauauacaguuucuccuuacagagccuuccacccacugaccaggaaaagacuuucaucuugaaagaugaaagaacuaaacugaaucaggaacagcaaaggcuacugcagcaggcugggccuguuugggcauaugguaguaaucugcuaagcacaaaggugcgauguggagaguaagcagagcagguuuucuaggcagagauucugucagaugagcucaguguuuauaaugggaaggcagagcuauggagauguacauggaaucgaugcuuccauuuucauuucaaagcagcuuuagcaucucuuguaaaaguguagccuucauuugugcagaugcuccuucuggggcuggauuccugaacauuguaaugaucaaugaucaaucccaguauuucugucuagucaauagaguccauugcacuaggaagacauuugugugcucuucaggaaacauauaggguuuuauuaucaagggaauugauauguagcuuauuuauugaugaugaaauuacagacacugaugaugccgcaucagaucuggguaagaggucggauaugcacagaagugguuuacucaguagauagucaacacuucuggguugaauggagagcugugauuucuagcugucuuugcauuuaacagugguuuguaagcaauuguaacagcccugucagauauacaucaugcaacaagcauuuugcauuaggguucauaacuguacagggauuuugguuaauaugauuggaaugauuuagacaugcucuauggcaagaaaguuuguuuaucaggaugacuugccccaaauuaauaagaauccagaaaagcuggagcucauguggaagcaggaucuugucagaacacagcuuugacacagaacacugagcucaucggacagaaucuccgccuagaaaacccgcucugcuuccucuccgcaucacaccucugugcuuagcagauuacuaccauaugcccauccuggcauuuauggaacaaauagaaacaauaguaaaagaaagaagagaaaaugaauguguuugugugugucuuguguauauguguccucauggguucaugcucauguguguaaguacaucggaggccagaaguugaaucaugugucucccccucuguuuuucucuacuucauuaguuagucagggucuccagcugaacucagagcucauggauuccagcuaauguagcuagauuucuuugccuuucuauuguugggauuauguguagcuaccaugucugccuucccuuuuuauuugauuuuuugcuugguagugugguuugguuuggcuugguuugaguugguuugguuugguuugguuugaguugguuugguuugguugguuuggguugguuuggguuaguuugguugguuugguuuggguuaguuuggguugguuugguuugguugguuugguuggguugguuuggguugguuugguuugguuuggguuaguuugguuugguuugguuuggguuggguuaguuuggguugguuugguuugguuggguuaguuugguugauuugguuugguuugguuugguuuggguuagcuugguugguuggguuaguuugguugguuuggguugguuugguuugguuuguuuuugauguggguucuggggaucugaauccaguuuucaugcuuguccagcaaacacccuaucuacugaucuguuucucaauucuaaacuaaacugagauuuaagcuauacaguuuugagguaguuacaaaauucuuugaacauguuuaagacuuaaaaauuauguuuuaguauuuuauagcuaaccuuuuggaaugaggcauagaauguucaaguuugaguaguugguuuuauuagccagauggcaacacaucugugaagagaugggaagauaauuggccuuugcaauaacugugugaaugcuggcaugcaguauuuuaaagugcacccagagaaccggcuuuccuuuccaucuagaguauuggacgguagacuccaguuauuguuauaugagcuagagaugaacuagaugaacuuuuagccaaaauuuacgauaauuguugagugaggaucgcuggaaauagcuccuaaaugcgaucagugagguaaugcuugucgugguaccucuagcaaaacuguucacuuugagacagacgugcaaguggaacagaggugcacaggacauuaccuccguggucugagagacagcaguggcugagccugguggauagcuuccauguccuugguaaagaaucagauuuauggaagugaggauccuaaugccaacaucauggugaagguugucuuagaagacauggagucugcugaggucccaaggccugacacuauuacugaggcuguggagcgcucacaaaaagggaccuaucaugacugcucucugaaagacccaacaagcaguugaaagagucagaugcagauauuugcacccaaucaauggacagaagcagcuggcuccuguuguugaguuagggaagggcgauucuguaggaggaccagcagucucaaucuggaccccugagaucucucaaacucuggaccaccaaacagacagcauacaccagcugauuggaggcuuccagcacacauagaguagaggacugcugagucagugugcauucagagaugaugcacccaacccucaagacacuggaggccccagggaguuuagaggucaggugguguggggacauccacguggagacaggggguggggagaagguauagacuguaaaagagucagaggguagauguggggggggggggauaaaauauggaguguaaaaaauaaaaauaaauuaauuaauuagaaaaaauaaagaagacacagagucugaaugugugcucuauguggcugaagcuucuaagauaacacucucucucuuucucucucccucucucucucucuuucucucucucucugucucugucucucugucucugucucugucucucucucucucucucucucacacacacacacacacacacacacaccuguucacauacaugcuaagccuuucccuuuggaagauguugagcagugaggcuaugugaauuuccaguaggcucgacccucugcaccuggcugauugcagaugugcaaggcagcccaucucaccagcucagcacugaguucacauucaugcccaugcacuggguauagcaguccugagggaaauggauuccuugaaugaauggagguucucuaaauaguacauguuuuuaaauccagcccuccuaugggauccaaucuagauggaugggccuuuuccagggucuuagugaaaaccaggaagaauuuguccucugcuuaauacuaagauucucaaaggauucuagucaacuuaaagccaagcaguucuuggcuagauagugacuuacugauuuucaacaguuuggaguaaauauuucuaaugucuuaauucuaacaauuuacuucaguguaagaaagauuggggguuaaugauuuccucuccuuaaaugauuagucugggcgcugcagagauggcucagugguuaagagcaccgacuacucuuccagagguccugaguucaauucccagcaaccacaugguggcucacaacuaucugcaaucagaucugaugcccucuucugaugugucugaggacagcuacaguguacucauauaaauaaaauagagagcugggcgugguagcgcaugccuuuaaucccagcacuugggaggcagaggcagguggauuucuggguucgaggccagccuggucuacagaguguguuccaggacagccagggcuauacagagaaacccugucucggaaaacccuaaauaaauagauaaaauagaaaaauaaaucuuuaaaaaaauaagauuagucuguucauuuagagagaaaaaugaauaaauuuuaaauaaauacuuuuuaaacauaaaaguuaguaacuagugucugugugucuuuuuucuuuccuguguguguguguguguguguguguguguguguguguguguguguauuugcaacaagccucacuguuuaucccuugcucaacuacuuugaucugugucuguagauaaggcuguucuugaacugauagauaucucccugccucugucuccugagggcugggauuaaagguguaagacaccaacuagacuccagauguuucguaugcauucuuuuucuucucccucuaacuauguauuuugauaaaaaugagaaaaauauuugaauuuuuguauuuaauauuugcauaggguaugcgaacaaucagaaccugguuuguaauuuuaagcauuucagacauagccuggauaauauagcuguuuugaaauaacuguuucucacagaguauuuuuugugcaccacaagaaaaauuucuccuccuccuccuccuccuccuccuccuccuccuccuccuccuccucucccucguugauuuggauguguuguuuggugauuaguuguguguauauggugauuaggucaaaggaguauguaucacuuuuuaauuuguugcuagcaccuggaaggucuucaucaccuucauucuuaucugucaccagggcccauuuggaggccagugcugagaaauggaaccgguugcuggcaucgcuggaagagcugaucaaauggcucaauaugaaagaugaggagcuuaagaagcagaugcccauuggaggggacgucccugccuuacagcuccaguaugaccacugcaagguaaguacaacauuugugcccuuuuuuaaaaauuaauuucgauaaacaaacugaaugaaguucucaagaaaugaaaauuuaaacuaauuaccacagcguuccccccucuuuggcaucuaguugguugcuaaaggaucaauauaagguugaaauuagcuuagguaacaugauuaagucugaggccagacuaggcuauaaagcaagacccuaccuuuaaaauccaugcacacaugcaucuauacauccauacuuagauaaaaauaaaagauaacuugugaaguuuuuuccaauaugcugauauccaaagaaaucuucuagaaagccucccagugcuaggauuacaggggcgugucugcuguuauaucuaacuguaaccuaaucaggaguauagaagucauggugucagaaaggguuuuaauguagaacucgggaggcagaagcagguggaucuaugugaguuugaggccagcaaaggugauacacucagacccuguuucaagucaaugaauaaauacauaaauaaaauuccaaaguaguucuaaggauauagcuuuaaagugugagcuuuuccuauuggccccaagcuccucggaugaagacuuuugagacucaaaauauaucugcaaucaccuuggccauaugcuuugguuuggucuccaucuaacuuauaaccuguuuauucuaaucuaaguuuugccaugugacuggcuacgucugcucaggucucaugcaucuguccucuguccucuuccugggugaacacugcucucccugccuuacucuaucccacaauucuuaaucuuuucugccucuggaugucccaccuucuuucuauucuacccuuuccuauagggcagagguuuuuguuuguuuguuuguuuguuuguuuuuacugacaaacaauacauccauacaauacacaagauauucucuguacauauagcccagugguagagcacuugccuagcuugcuggagauuaaacuaagacaaacaaaaccugaaauuaucuuguucauuaaaauuaaaaguagagaaaaucuguagggcagauuucaguccuguaucaaaugaagaucacagugugaaacaaaagaucauuuuauggucuuuuuauguuucauuuucuuucucuaaguucuguuuccuucugcaugacauccaccucuacacacgcuguguuugcauucugacaaugaacaaggaauccugaaaugucaccugacauaucccucagccuuuagauuuuuaaauaucuucuccuauuccaaguuccauuaauuuauuuauauccuuuuauacucuuuucucauauauuaaaugucauuuaguucuguuguauuuuuuccuacccaugugcaguaugaauucuccuucuaagucugcacauuucaaugcaacauuguguccuuguucccaauugaaagaugaaugcaaaugcauguuccugagggaagauagcaucuauuacagaagauguucuaaccgauguugauagggucuugaauucuauuuuauuuugacccugugcuuggugaauaaaauuacuauuucaguagaaagagaacaugauagacagauaacccugagauagaaagacacagagacuaagaaaauacccacuaggugugccuacaugagagccucagggaggcgguuacuucauuuacauucccagguguuaacaaagcaagauuuuccauugcacagagagcuugggucugagguagagcagccccugccacugggcugcaaagcugaaagcuucuagaaccucccuacauagcacuaccagcuagugcccaaguguccacacaucauccuguaaauguaacguuuauucuccugucauugaugucucagaagcuuacuaacugaggccuaguccugaaaguuuuuagcuucuguacagucuuaucuaggccuacaauguuuucugccucugagacuuacacucaccguuucuagaucuuucugaucucuggcuggcuggucuaaucuagcuucucucaguuucuuacugaguugcucugcuuggccucauacuaacuuuagcaauauguucuaauuuucuggcuccuucccauucucuggcuggcuccuucuucaaucugucucuguaaaauucucccaguaaaacuguuucuucccucccucucucugcauugcucucuuaaguagcuucccuucccucucucguuuccugagaguugggcaugugcugugaagucuuucucugauucaucacuuugucugccacucaguuagacaucacauucaaacauggcugcuuccuucugcaaaccaucuuuaccuuuguuugggauuaaaguugugugcuagggacugagccacaccacaacuagaaacaguuuuguuuuguuuuucaguaaagaacacaguaauucacagugugguuaaauauccugcaguguguuccucuggaagauggugcacacugaagcccuaauaccugucugaaguuacguaccuuucuuauggaacaccaccaucauuugaaaaaucucugacaguugaacuacaguagaaucaagcaauucccuuaaaguuagucucuuacaggugugcugccaggcaacauuuuuuuuuaaaguccauuuucuccaaucucacauucuuccuaugaagagaaaucuuuacuuacuauguguacaccugcaacaucuaaccaguugucagaagcucaaggaccugcucacugcauagaggaaaauggaugagugcugcuuagcuugaugaaauccgagcagcugugcccccccuccaccucccgcgucccccuucacuuucacagauacucaucauauuccuguugugggcugguaguuucuaagccacugguacagagagcagacacagcuccuguucugugcaggggacagccugugucuguguaguaagagagcauucagagaaagcuauggcaggacugugacaugcuuauucaugcaguuuccccugguugcugucugucuguccaucccuguuuguucacuccuaucuuccagucuuuguucuugcuuacacugcacacggacucaauugaggucauggacauguuuaucuccaaauuccucucuaaaggacuuagaacucucuuuauuuauagcauuacagugcagaacaugaaaugauuuuuuuuuaaacaauguuuucacagauauguuuuuagcuuugugaaaaauucauugggcuuuuuuuuuucucccucuuuuaguuuuuuuuuuauuauaaagugcaagguuggguuuuugggggguugguuguuuuuuguuauuguugguuuuuauuaucugcuuuagaugcuuaaauuuuccugauaaaguugaaaaaagucuuccuaauuaaaaaaaaaugugauuuaaugauacauuuccaaagcauuucuuugauaauagaauuaccagucuguucaccacccacaccccuuguauacuauucauggaaugccuuauauguuaaaguuggugccuuuguccagaaagcaguauaaccuggccucuguaccgcucugauauguuucaauaguuccuuucccccagagaucuguucuugugguuucuuuggauguauccaaaggaaauccuauccauuuaaaauuuggcucugagauugucaguuagaaagguaauacaggaucaugcuuuaaaucgcuccuugaccaaacaucuugcaauuauaggaaaaacauuaaaaaguagaaaaccacccauagcauaacucugcuccaaaacacaacagcuaccuuuagccuacaagaagcaaaguagcuacugaaguugaugcuccugaagagaugaaaaaaggcuugcaggaagaugagccauacugaagacuugggguggcaucucuccucagagcuugucucuccuugcuggugugagcccucuauggauggaaauuuuuccacuuucuaguacagaugcuagaucaugccuguaguuuucuggaagauguguuguguugauacuaauuucauugggcuuguugaugaccuggccugugacuggauacaagguagaaugcucagcaugaagaagcugguguuuacucuuguaauuguugagacucugugcauuuacuuuguuucuguugcugugaucaaaagcgcugucaaaaaguaacuugggagagaaaggauuuaugugagcucacaacuccagguuacagugcaucauuuuaaggaagggaugucaaguaaccaggaacuggaagcaguaaauccuaucuaacccacacuuaggaguagagagaaaugcuuuaaugcaagaaugcuuauuacuccucucuacuauuaagugauucagaaccuaaaccgagggaaugguguagcccacugcaugcuggguguucccacaucaguuaauguaaucaacgaaaugucccauagacaagcccauaggcugacugaguguagacaauuccucauugaaauguuuuccaagcugauucuagacugugucaaauuggcaguuaaagcuuagcaccauggucuguguuggugguuuugaucacucugucuuaauucugucuaggcuauaugagcucuuucagggagcuacaaugccauuaauaccuaguaaccauccaacacagcccaacagugcuucccccaccuccccacuuccuaugcaguauuaauuuguugaauuauucaagagucacauuccagacuuuacagauuggguagauaacacagucguguuauuuucucauauauguacauauuuaauuccuuuaaauauuaaaauaaauaacuaccauauaacuuuuaguggcuugaaaaaugagugaagauggcugaacguuccucucaaugacuuuaauuauuauuauuuuuugccucuuugagucuugaaaguggaugauuuauaugcaacuucauugucaacaugucguccagucaguuauuucuuauaaagcaccuacagugugcauaguguugauaugcaugccaugaauuaacuucagauacucaaaaguugccuacaguugcauaugcaguuuugaauauucaauuugcacuuuauuuucacaguaauguaaauacugaguuaugcguaggcaauuaucagagcucuaacacgcuuuucccaauaaaaugcauguugguuuuauaaaagcaaaucaccaagaaugauuaaauugcaugauucagguauaauuuccuggugugcaucuuuucccucaggguuacuuugcccuuugccuaacucaauuuaauuucuuauauccaaaccucauuauguaagaaucaggacauuugggccuuaaaccaaacugccaagauacauaagaaaacuuagucauuaaaguaacagauucugaugucguuuuuaaaaccuccaccacguguggacacauacgccuuuaaucucagcacucaagaaccagaaguaggugggccuuuaugaguuugaggucagccuggucuacauagugaguuccaggcuagucaaggcuauguaauaagacccuuucucaaaaaccagcaagcuacaacaaaaaugaaaugucaauaccuccuuguuaaauuuggguucugugcauuugcauguguguaugaugcaguucuauuaaucugagguugccuacaaaccuguaauguugaggucuugcuguauguuaugagauuuuuuucuaugguaguaaauuaguuauuuucugauuggguugaggaguucccaugcagguauauuaugcacaucucuguguguacauccauauggaggcuaggaauaaccuugaguaucaauccuagaguccuuccuccuuucccuccuuuugucuucccuccuucccuccccaccccacuuucuuuguauaucuuuuggagacaaagucuuacacuggcuagggugguuggccagugagccucacggucccaugcagcucucccucccuccuggguucugagaugacaagcauaugccccacugugucuagcuuuuaaaaaguagauucuggagaccaagcucacauccucaguguacaaggccauugcaagcacuuuacaaacuguacuaccucuucaacccaauguucuaaaguuaagcauuucuaagugcucuucugaaauuugcaacuguauugcuuuccuucucagaaacacacugcaccccaucuguugguagagccuauaccuauaggcacccugaaucagcuuucuuaaggagccaucucuacuccaguuaaccauucauauggcuacaggugaucauguccucuaaguuugggagcaauagaugaagacucacucccaagagcuggggcucacacaauguccguguuuagagggacagggggcagcuugagagcugucagacuggugaugaaauaaagaguauggccauucuugggcacgaaauggccucugugaaaccagccacccgcuuccaggugaaccacuucuaugaucuuuguugcuuagugaccauuuccuuuguuuaacagcucauuucuucuuucagcuuccauguuaaaucugauaguugacauccuguauuagguacuauggugguuuggauaugcuugguccagggaguggcgcuauuauuaggagguguggccuuguuggaggaagugugucacuguggggguaggcuuugaggucucugauauaugcucaagucuguccagagucagucauccuaugucaaccuuuggaucaagauguagaacucuuggcaccuucuuuaucacugugucuuccuggaugcugccaugcuuccugccaugaugagaaugcacugaaccaagccagcccuaauuaaguguuguuccuuagauggguugccugggucauggugucucuucugagcaacugaaacccuaacuaagacagauacucagcacacaucacucaauagaggguccuguauuuucacaaaacacacugccuagucgcaggauugaccuucacaagaagauaaacacuaucaaaagcccugcaucagggacaugaacacacagccaggaagcagagaugcuuaugacuguaugcuguggcugauaaagaaaggcuuuaggaaguccuggaguagagaguccguaaaguaaaaaguccuuaaagaauguuauccagguuacuauggugaagaucuugcguguuccugguuguguuucuuagaguaaugggguguacugcauucaugcuuguagcucagggggucucaacuuuccuaaugcuggggccauuugaaacaguuccuuauguuguggugacucucccugccaacuguaaaauuauuuaauugcuacuacauagaugcaauuuugauacuuuaaugaaucauaaauaucuguguguucugauggucuuagguaaccccugucaaagagucauucgaccccacaaaggggucagcucacagauuaaaaauggaugcuuuagccuaacacugagagcaaagcucaaagagaaggaacuugaauguuagcaccuaacaggggcugaugagagaagcuacuaauggauuugcugaauaagagggaugcaggcgcaugucuguguaucuccaugcauguguacgugugugugucuguguucaacaaugcagaggaaagacugguuuguuacugugacacguuggagaguccugucuugcucuuagcauucauacuuaguauuccuauuuugccuuuauuuuuugaugccagugggguggaaccaaaaugaauuuauacauuuaacugaucauuuagggacauuaaccaaaacuuuuacggcacugugcacuaugaaggagaauuaaaagaauuuuuugcuugcauaccaauggaacauaaucccauuuuucucuuuuuuuucuuugaguuuuauuagugcuaucaacuuuaacgacugucuggccuucuuugcuaccguacaaaaugacuuagauccauacaugcugauuuagcucugaaagcaagcugggaggaggaagggaguaaauuauauucuggcagauucuccuuacguuuccaucauuuuuuuucuaucucucuucugcaguaagccaugaaguucuuuugagaaccaaagguuaaagaagccugguguguaccaacacugccuccagccugccccagugcagaugccccucguccaugccagcuacuagggcacccauaugcucucauuagugccagguugugggaagggcucuccgugcuuuguuguaggccuugcuguuauagugaaugcccaaauauucagauaaguggcccugugguuucaucuugcuguggaguuugcuguuuuauaguuagaucuguuggcaucaagaacaguuauguaagcuagguauugguggcacacaccuuuaaucccagcccuugggagggaggagccggugaucuuuguguguucgaggccacccuggucuacagagugaguuccaggacagccagggcuauauagagagacccugucucaaaacaaacaaacaaacaaacaaacaaacaaaacaaaacaaaaaacacaaaaaaaaccccauccagccaaacagacaaauaaaaaguauauuaugcuucaacauauauaaacuauaauguguuaaaaauaacaaaagacucugagaauguauuuccaggagcgucucucuccucaguucaggcaugguccuuacacugagucgugugccucuugucuuaacuuguggauguuagaguuggcuagucuugggcuucggcccacacuugguccucucuacuugacuucuagguacccugcccuccugauuuucucauccucucaaugaagcuccgucucuuucccucucugguccguucuuuaagcuccuuguagaacugggaagcacuaggagccaggccauccugaugucacuauauguagccuuuccuggguuuagaaucuaucugcaggccagacacucccagcuuugugaaugugcugaugugucaccucuacagggauccuaauuuugcacauccuauggccaagcugaaagcacugcagaguugacuuuuaagacauucuacccugaauucuauacccccaucucacuugguagagaugugacuuaaguugcuuaaaauaauaauaauaauaccuugaaccccaucuuucucauucaauguguuagggaguuuuaaguuuucucaucaagauagagaaucuaaauuggccacuugccaccauucaucugacucugggguccccagcacagcagccaguauguuccuguuaauaaaucaaacacccaguaauagacauagucucaggaaggcaugcaagagccccguguggcccccuacgccucccacacaccaagcucaguucagcucuugcucaucuucucccacacuggucucagccaugcuggccucuugcugugauucaaucacagacccuugcuguguccuagaauguucuuucugauagucuacaaaguuaacucuccgcugcuccucaaggugcuggauggcaccuuccaauccuggcaaccucucuuuguuccagcauucucaucuuccuauguagcugcuguacuauuuucuauucuuuguguacccacaguuccauaaacucaauaaagacuuguugaaugcaaaaugacugacacauaccuaaggguauuugauucuuuuuaauuucuuuauaucuauguaauccuuuuaauuucguucauuuaccaaauaucacauuuaaaaaacacuugugugcguaauuuucuaaaacacugucuuauuuauguaugccaggugaauaucaaacuugcaguguagcugagggugaccuugaacuucuaacucuccugcuuccaccuccugaguacuuuuucaggaguguaccacuauacccaggcuauguuaagcugaggauuggaccagggaccucgugcaugcgaggcaagcccucucccaguuuagcuguuaccuuggcguuuuugcuacuuuaaguaacugaauuuuuaggaaaaaugauccucucuuuagacauauaagcaaggaucuuucaucgacagcuuagagauaauuuuuugauauuuuuuugaucugcaagaguuggacuguaagaaacccuaccggcacagcuauaguuuaacauguauuaguuaagagacuucuuuuccuuccgugucaguucacauuggccuugaacuuguggcuuuaccuuucagugucaucccagugcugagagucuaagugggugccaucauuucuggucaagaaauuaucucuucucugucucaauauugccuuaauuguuccacucagggggugggaaaguaauguuuaugggaugagagggaguggacuggcaaaucaagguuauugaggcauccucuaaauaugguucauuuuacuucuggaauaugcuaucagauugucccucugugcauggcuccuauuaucccuuaaauagaugcuuuaaaaauaaauaucagauacucuuuaaaacuaaauauguuaagaucuccaaugaccauaggaauguaaauguacagacucuuugauucaaugauugucguagaucucauuuuauaaaugaaucuaaccuggaagagaucacugaaggaaauccguagaaaaauuuauauacacugccuuagaaaugaagcauuggcuucuaauacacagucucccuuuuauuucauaaauuuauuuuuaguuaugaguuuguuuguguauauaugugugucugcaguuauagauuuauuuguaguuauggguuguccaggaaggccagaagaagcugucugaccccuuggaccuacagguaguuaugggccacccaguucuggugcugggaagcaaacucgggucauuuggaagaacagcaaucccuuuuugccacugagccauugcccuggcccauacauauguaauugcuaauaguguguuauuuaaagguaguaauuuguucacgacuucuguuuugcagccuagagacuauaauuaauaacauguauaacauucuugaaaauuguugaaagacuauauuuuaauauuauuguaagaagcucaaacuauaugagauauuacauauguuagcugcaugauccauucugcaaguuuauuauuuauuucaaaauaaagcauuauaugagguagauguauauauuuuauuucuuaaugaaaaguagaaaaaauaguuuagaacuauugggaaaagaucuuuaccaaugcuacauccaauagagggcuaauauccaauauauacaaagaacucaagaaguuagauuccagagaaccaaauaacccuauuaaaaaaugggaaacggagcuaaacagaauuuuuaauuaaggaaacucgaagggcugagagcaccuaaagaaauauucaacauccuuagccagcagggaaaugcaaaucaaaacaacccugagauuccaccucacaccaaucagaauggcuuagaucaaaaacucaggugacagcagaugcuggcaaggauguggagaaagaggaacacuccuccauugcucgugggauuacaaacugguacaaccauucuggaaaucuuucuggugguuccucagaaaauuggacauaguauuaccugaguaccuagcuauaagacuccugggcauauacucagaagaugcuccaacauguaauaaggacaugcuccacuauguucauaggagccauauuuauaauagccaggagcuggaaaccacccagacaucccucaacagaggaauggauacagaaaauaugguacauuuacacaguugaacacuacucagcuauuaaaaacagugacuucaugaaauucauaggcaaaugaauggaacuuggaaauaucauccagagugagguaacucagucacaaaagaacacacaugguaacaaaaaaaccuaggacagcaaaaacucuucucaaugauaaaaggaccucugguggaaucaccaugccugaccuaaagcuguacuacagagcaauugugauaaaaacugcaugguacugcuauagagccagaagcuggaaagaacccucaacagaggaauggauacagaaaaugugguacauuuacacaauggaggacuacucagcuauuaaaaagaaugaauuuaugaaauuccuaggcaaauggauggaccuggagggcaucauccugagugagguaacccaaucacaaaagaacucacaugauauguacucauucauaaguggauauuagcccagaaacuuagaauacccaagauacaauuugcaaaacacaugaaagucaagaagaaggaagaccaaaguguggacacuuugcccuuucuuagaauugggagcaaaacacccauggaaggaguuacagagacaaaguuuggagcugagacgaaaggauggaccaucuagagacugccacaccugcagauccaucccauaaucagccuccaaacgggcgcugacaccauugcauacacuagcaagauuuuacugaaaggacccagauauagcugucucuugugaggccaugccgggggccuagcaaacacagaaguggaugcucacaguuagcuauuggauggaucacagggccccuaaugaaggaguuagagaaaguaccuaaggagcuaaaggggucugcaacccuauagguggaacagcaaucaauaugaacuacccaguaccucccagagcucaugucucuagcugaauauguaucagaagauggccuagucggccaucauuggaaagagaggcccauuggucuugcaaacuuuauaugccucagcacaggggaacgccagggccaaaaagugggagugaguggguaggggagugggaggggaggguaugggggacuuuugggauagcauuggaaauguaaaugaagaaaauauuaaauaaauaaguaaauaaacaaacaaacaaacaaauaagaaaaaaaaagaguugccauguucacagugucucuuuucaacaauaaaaucccuaaggcaaaacaaaaccacacaugguaggcacucacugauaaguggauauuagcccaaacauuugaaauuuccaagauacaauucacagaccauaugaggccuaagaagaaggaaaaucaaagaguggaugcuucagugauucuuagaagggggaacaaaauacucacaggaggaaguauggagacaacguguagagcauagacugaagaaaaggccuccagagacugccccaccuggggauccaucccauauacagucgccaaacguggauacuauuguggauaccccgaagugcuugcugacaggagccugauauggcugucuccuggggggcucugucagagccugacaaauacagagguggaugcuagcagccaaccaugggacugagcaugggguccccaguggaggaguuggaaagagcugaggggauuugcagccccauguggggagcaacaguauuaaccggccauauucucagagcucccaggaacuggaccacuaacugaagaguacacauggagggacccauggcucuggccacguauguggcagaggaugaucuuguuaaacaucagugggaggaguggccuuugggccugaguguguuugaugcuucagugcaggggaaugccagggugggaaggcagaaauggguggguggggagcauccacauagaggcaaggggggaugggauaggggguuucugaagagaagaucuagauaggggauaacauuugaaauguaaauaaagaaaauauccaauuaaaaaaaacccaaaaccuauuuucaaugauauuuuaaaugauuaaugagcucucuguuaaguguucuuuuagguauaauuuucaaucauaaagauaauauuuacagaugaaauaaugaacagcugggucuugauuauucaagcuuaucucuucagcuucucaagagcugaaguaggggggaccacacauuuaaguccugccuggagugcauuucucagugaauuuaaggccagaccagucugaucuuaacucaacugagugagaucuugccucagaguaaaaagggauagccagcugggguuguaugucaguggucagacucuagcugggcucgcacaagucgcugcuuccaucccucacacugcagagugauagcaaagcaaaauacacacucuucugucuuaccuuccucuagugccauuguucucauccuuccuaaugcuucgaccuuuuaauacuguucuucauguggaagucaccacuccuaccauaaaauugcuuucauuacuagcucauaacugucauuuugcuacuauugcagaucguaaugugaauaucuguguuauccaaaggucuuaggugaccccuguaagaagguaauuugaccucugcaaaggggccaugacccauguucccauggugguaucuccucuuguauacacaccguccuuagcuuuaauuggaggccucguuuucuuacucugcuuucaccuuuagguuucugucaugcucacguucugaccuugcucuuguggccauuaucauaguaaucuuugaagguuguguaaugguuccuaguguggaccugccauuguggaucucaauaauuuccuaguguuggauauuuaagcugcccucaauuucuuaaagacauaaauaauguugcaguggacaccuuuuuauguguagacuuuuuuuuccccuccucugguucauuuucuuagacuccauccucaaaggugaaauucuuguuucauaccaugugaucagcauaaugacuuuauagacugccaaauuggguuucccaaaugaucaaaccauuucccucccucuagaaaauauggacacgucagugcucucuugcuugacucucucacuucugcuccuugucugauggacuugcacugcuagcacccaaacucugcuacuccacaguggguggaaaaaacaguuuucagauucuauacaggucuggcccaugcuucucuucuuuucaaagaauaaagaggaaaauuugggagaucuguuugacuuagccauguguagaguagcagggagaugugguuucuugaacuuucugggggagaaaguuccuauuuauaucacaugggaugugaucuaaucaaccccuaaguccccauagcuuuacuucacuguuauggagaagauuuagauaaaaaaagacuaaauuuuuuucucaucuaagagucuaaauauauugcaaaguuuuauauguaucaaauauuuuagcuuaaucuuggggaaucacaaaguuucacagccuuccuaaccacaucacgugaacauugggauacauauuaaguucaguuuuuccuggaaaggggagauugguguguuagcgaguuuuucuugcuauaacaaaauacuugagguaaccaccuuaaaacaguagaaagguuugcucuuuaguucaugauauaagaagauccaguccaugacucuaauauuuuuaggcauaugguaagggggcagcaucauagugggaauguaugagggaagaaagcugcuugccccucugucagcccagaaagaaaggacgcaugucaaggagagaagggaagagcagagcugcuucaccgcauucugucuccugugagccuguuuucuuagggagagacuugcaggcucuccacguuucugcagaagaacggauaauauuguuuguuuagcagcaacuuuuacaugacaccaagcugaugcugugcccagaaugaaaacgaagagcugugauugacaggugguaguuuuugaccuuugccaagccagucacuucuucaaccaccuuaccccuuaaucccuggccuuuccaguaaguucuagcagguggaguguucccugaccagugagccagaaguguucccugaccagugagccacagugaagaaucucugcaggugcuuauaguuggaucugcagaaauucauugugcugccuggcacucugggaaauagccguggcuacuggagcccuccuugcuguucagaugcucgggacggucagauggaagaagggauggcucaguuaagagggaugcugagcuccuagauauucuggaaggaauaaaauucugauacuaauguucagguuuucguuugaggcacaugagagacuagauggcuuuacucucaauuauucugucuuucuguccauuuauguguuuuuaaaccuguaguucacaugaaaaguucaaugggaaaugccucugcaguuaaaucauuugccuggcaagacuagcauuuggauccccagaucucaaguaaaugccaggugggcaggggugguccuguguaacuugagccuuggaaagaggagcgggaggauucccagggcaggcaggcuagugauacagggguaguguuugacugagagaugauggaagagugauggagugaucaggagugauuccucauuucaaucaggagcucuacauacaugcucacucauauauguucguauccugauacacaugcacuuaacacaugcaaacucacacagauucauacacauacacacacaccacucaaaaggcaaaaugcagagagaaagagagagagagagagaugcauaugccuuuaagagacuccuauguuugagaaguuguucacccuuccucccugcauuguauguuuguacuuaguagggcucuugauagccugcuugugcuuuucaaagucuggugacaauuaucacauucugcccuucuccucccccuuuuagauuguaugacaugaucuguggcuaugucuagccauuuucuguauauucaguaugagaguaguguuuguuuuaacuuuuuuauuaggguggaaaacucuaugguacuuugcuagcuccauaccuugggagacaguagaaugucuccacucgagacagguuuucagguagacuaugcugucccggaacuuguguuguuccugccuuagucucuugagagcugagacuacuguacucagcuaagugaauuuuauuuuuuaauggacacaaaauacuuuuuguauucucccuuuucuauuguugucucuugagcauuugaggucuaguaaacauuuuagaacguuuaggcuuuaaaguccaguuucugcuuucuuuggugaaguuaucuuauuuuugugaguuauuuugaaguuuucuuccuuguuccgguugagucuuguuuacuacauguaagcuaaaauuucccuuuacacuguucuguccuggagauuauuuagggcacuuauuuacugggaagguauauuaguucauuuacuuuugcuauaacagaguccuugagacugaacaauauauaaggaaaaguaguucacauaucucauagcucuagaagcagagcuguaucuagugaggucuucauacucuaugcacacugauagcagaaggcaguggcugccucugacagcaggggacaggacagaugcugugaccugcugugcaguaauuggaccuuaugagaauuuaucaguuccugggagaacuuguccagucucacaagaaagacaucauccccucuuaaauccucacguuccaacccuacgucaaccaauccgucucaacaugaguggugauuguaucagcugaaugugucacaggcagggccaagcugccacacgagugugcuucuagcuuaguggccgagcuuuguuugguuuggcaaagucaccaggugucugcaaagacaggaagugcauguuuaccagguauuucucccugcaaacacaaagacucagauucuaaaacacugucacagaaagaacaucccugauccuuccucgcucggcauaauuucagcugucacuaggcaguacccacuuggaugagccucacagccugugaaaugcuuccuuugaacagcuggacugaauguuaccaaucccaauucauucuugcuugucugcguaugguauuguuagaauaauggauaaugccuuccucuugagcugacaugauuguuccucucauccagugauggaguauaguucuccauucuccuuagccaguugaugcaggggacgggugcauagccacacaggguauccagacagcaagguaggaaguguuccagaaugagugagaggauccauuguaugacuaaauaugcucaaacccugaagaucaacucuuacacacacaugugauauauagugauauauaguaacacauauauguuuguguauaugcauguauguguguuauaaagaaacugaaaaagaaacaugaccugcaguuuuuuuuuuuuuuauguuuuaguuuaagaacaagauauuugcauaucguuaaguuuaccccauuaaguguaugguucagccuuuggucuauuuacagaaucaagugagcaucauugacuccuaaguuuagcauuucauuaucuucgaaagaauggaacaaagcuauagccuuagcuuuggccucacuguugcugaagccuugaugggcugacuagacugcauccucuauccaugucauuugggguagguagauauuuuacaaagccaaacuuggaaacuuggaaaccuggaaaccaugcccuugacaccaauacuggaagcaucuaucccuguagacuuccacaguccuccuucaguugcugaguccugugagcuaccaccaugaggcugcccugggaacuggaaacagccagaugccucaaagcaaacauguagaguuuggccaucaucuaugacuuggggaaggagauuagaaacagguaugcagcaagcaagagcaccguggagaggcuaaaaugaggccucaccucauucacuccagggcugguucuggagugcguggcugaagcagauuacaaugucagauccuggccuuugauaguucagaagguccccacaucuuucuaugagaugggaggguucagcucauuucuccuguugaaagaaaauucauccccccaaccugaaaauaguaacugcacggcuucuuuuugcuuuguuuccccuguccuggcucauuauacucugaaacacucaaaaauuggguaaauauuuuggaguuaguuaagaugagcauuuuaagugguuaggaauggccuaggucuuuuucuucccuccccuuuuuuaaagcuuucauguaaaaggugccuaugaaguucccuuauagcccuccagugucuccccuucaucuuccuauggauguguuuaccauuuguaucacucacauuggcucauuguaacccaaguuccucuucauaacaucccaggacuuaggcccccagugguuaggacucaaugauugacuuagaagcucacugcauggcuguccaguguggcaccugcgagauagaguuucuuugauuaaacaguuguguggcgagugcucucaagucaaucuaaaaugugcaaguuguaaguaaagcaaagagaguguucuaucaggacuugagcacccguggaauuucucuacugacauguuugcacuaagcugauggacuuucccuggaagagaaggacuaaaaccauuugcaccuugguuugcauuuauuacccaguguaaugaaguuuauucucaugaaaaagaaccccuguguaccugaacccccucaggccuccaacacuaggcagcugcugauauacuuuuuuuucucucuguagacaccucugugguaauggaaucucacaccacaggcuucccucugagucauuucgcugagaacauuuguuagguuuuuaucuagugguagucugcauuggucuguaacucauuuuccuugcuaagaucugucgugcagcucgguugcauuuugcuuaucuacugaucaauggcugcauguuugguuggucccucggucuggcuaugauggcgugcuguuaugaacauuugaugccgugcuguuaugaacauucacguguguguguguguguguguguguuuaaucuguacagauguuuuauuucuggguagaccuaguuaugggauaucuaggauacaggguaaaauaaacccuguauuuaacuuuugaggaaccaccaaacugaaaugucuuaugagucuacgauccccaacagugugugagaauucaguuccucacaacuuuaccuaagcuuguuauuguuuggauagagguuguuuucgguaaaaauauaaagucauuaacacagaaaaauuccaauuagguuaucuuauacucauuuaaguggcucccaaaugagacacgagauaccagaaaguggaugcuacuuuguauacaaaacaacucauuggacucuaauuaccuuaucauuaaugcucaggaaaaugaaggcuuucuuuuacgucgaauggagagguaaaagguguggugauuauguguguaauacaguugagagucgaaucccuuugugagugcaauuaaauacaauugaaauagggcaaauugaauaacaaaauuaaaacgucaaaagagcguauguacagguauacugaguguguucucuaggcuacuggggagagagaugguaucagggucagagucccagaaguuuuuacuuagggugcuuuccaccugcccaugccugcuguacuucuucucuggcuuaucaagucagcucaccugauauuccuuaccaagaauucaaggcugggugauccuccccccccccaacacacaccuuuggcagguuguagauuaaugugcuaagaaaugcaaauuaacuauggaagacucucuacuacucugauuucauuuuuauuaucuagacgacccaacaauauuguuaagaagacuauguaaauuuguagucacuuccuaacccauuugccugccuggcucuucaucaguuugccugucauuugguaucagguguacaaaggugcgcacauagacuucugccuucacuucuaccugugucuugagccuuagcuauugccuuguauaggggccaaaggcgugugguucucuccugaucuacacacuggaaucuuccccccaaggcuggcgcaugguuuuucucugggggaagaaacuuucucucuuugcaagacucagaugaagcccccuccccagcccccaccccacaucaugaggaagcacuuuggagccaagcucagugcucaacuuccuguaguauaagauccagaaguccugagaauuuaugguguaucugagaaagguagaaauuaaauaaaacauaaaaaaaggaauacauacuguccuugacuaauagaucugggaaguacaaaaagacauaaacagaguaaugggaacaggaaauguacagaacgggaaaggugagcgcuacuguaaugguagggugacugugcgaaccuccaucuauaaagcauuaaugguuugaagaaccuccaguguggcugucuggggagagagcuuucugagcucagccaacagccagccaacacaauugcucuccugugagagucuccaugcauaauugauaaaguuucagccauguggggaaucgaucaguuugucuccucaguaguuuuucuguagacaaacguuuauuuucuauuugaaugugagagacucuaaacacaauuuuaagaacaacuguccucugucuguccccuucccucccacagcacucuccaaggcacuuugugaacugagacauuuugacuggccaggcacaaauacuccuuuuccagucacuggaucaccucuccuagguuccccaccauagcaucugggauuuacccucugggacaucuccccaucagaauuuucuuccuccugaggcccaacaucugucugcucucccucauuuccucuucagacuuagucuuucuuccauuuuuuaaaaugucuguucugguuucccuuuagcaaugucucuaaaacacucuaaggaauuucaaucucucucucucugucucucugucucugucucugucucugucucucucucucucucucucucucucucccucucucucucucugugucagaugcccccgagggaagguguagucuucuagcaccucugccucuucuucuguaccuugcauuugaacaguuacauuucuggcaaguccucucagggaggagaguugcagcagagcccugguugccauuuuaugaaucuucacugcuuuucuauuaccuaguugcacucagcucuaggagaugaguacucuugacuauuaauuuuuuuuaaguucaaaaauauaaaugaaugugauauucucauaccaccauuuuauauuuauuuauaagugguuuuggaaguuaacuauuaggaaugccucugcaucucuagaucccucucaucuaaagaugugauaaucucuuguuaagaaauguggagcagacccauaaauacauguauuucuucucauucucuucugacuuuuucuuuacauacaugaaaacacuaugugucagaaaacugaucuguuucaucucgugcagcuaugagacccuggaacaccuugagcugcuuuucuugaccaggaaugcugaaggcuguguuuccuaacaugaccauuuaauaacacuccuugacuggggguuuguccccucuccacugacucugcugucaggcuuuggugugauaagugagggaguaugcauaaguguuaucuauggaaauuauuuucagagacaguuuuccuucccaccuagauccuuacauauauuggguuguagauuuuauuuuauaaggggcuggggagguccuacuuucauuuuuuaaaauucuuagcagauaauaauuguccaugaagucaaauaaccuugaauuguccuugcccuggcugucccuuuccucuccaccuguaacagcucccucugacuuuggcccacgccaguuuaucuuugcugucucuaugugaugauuauucuggaacuucuacauuuuuuccauuuuuacugaguacaaaagaugaugauuuggccuccaaguaaccuugcguccuaucaccauugugucaagcacuauccaaacauuuaaugauuccggaaaggcaaaaggaaagacuugauucuacaaucuuaaggggaaauauuuuagggaggaaaaagaccccuugcauguucauagugcauagccacuggcuuguucuaugaucaguuauuagggccugaagacguggcugugucuguacuggccagaaaugacagcagcagcuuucaguuagcuuugcuuuaguauugaaaacagggcacgagacauauuuacauguuggugucuuauccccgagugaguguggcugucaugaaacccuugucaauuagaguccuaaucaccaaacauuuuauaggagcaggggugaaaguucaucucuacuuaaaagaauaaaugugcuagagaccaguuguucugggagucccagaucugcaugcaaaccucaccagggaaaacaguaauugccucagcaugagagacggacggacuguguuuuaagauaauuggagacugucuuuuauguguucucuuugcuuuaguuuugauuucauacacuuuaauuugugccuaucucuuaauuuuuucucaguguauucuaaagaacauaaaacccucugaggccuucauuaccacaugugaacucaccuccuucaguaucauuggaugcgauuguucuugucagucuuaaggaagaagugucuuugagcaggcuauuauguuuuagcaacucuacacaguggggauucucuaaguucacauuugguaaauucaaauacaauagcuaacuccuguagaugaaaaucuuaaaguguccuucccgacauucaucauuuucuucuuuccuucaacacagacaacauuuucaggagcccucucuuuggcuuuuauucacacuuucuguuguuccuaccuguaacacauuuucacuuguaacuuaucugaauguuggcuuaagccacucccucugcagcuucagucagaagugguaaagcuaaacccugcguucauuugcugaaaacaugggaaguuguuuauauacuccauuucuguuucuuuuugcaaaggugcugagacgugagcuaaaggagaaagaguauucugugcugaacgccguagaucaagcucgaguuuuucuggcugaucagccaauagaggcccccgaagaaccaagaagaaacccacaaucaaagacaggugagcgugguucauuucuuuagaaaaaaaaaaaaaaaaaagacaaccaaccaagccuuuuucuugcagcaucaagcauguacaaaugacggccugucacaucgggauauuuagcuuaaaaugaagcaggaacuaacuucuuuauuaggaaacaucaauucuuaauaucauuauuagauuuugcaguguugccaaaagaagcucugugguauauucaaaaacaaacaaacaugcagagccuuggauaugguucagcaguucggcgcccuggcuacucuaccagaagaccuggguuugaaucucugcaaccauugguaaccccagucccagggaaucucaugaccuauucuggcauccaaggauaccggguacacacaugguaugcauacauaacauggguauggguaaaccgcucauacauguuguauaaaaacacauguugcccaaaguauuuucccaucauucacuuuacccaggaaaagcaggcaugcagagugccuuacuguguuuagcagugcagaucacuuccuuaugaggggcggggucagugggagccccuuuccucacugaaggugaacucuauauguauaacuuaccucagcucucauuccaguuuaagcaucaugcuagauccccugcuuccccuuuuaagauauugccuuccugcagcaaccggauaauaaugacaagcaaaugacagcgugagccagcugacuucagugugacuccccaggaaggcuccucguggcuggcucuccucaucaccacccugguuucucaguugcuccucucugcauccucauuucugccuuccuggcugcacugcuauguuuugaacauucaggguugcuccaaucucgaaaccuuugugugucucuucccuguuucuggaacauuccugcuccucucccagauccccaugccuacuccuaccaccacuaccuccccacuucuccucccacccucccuuccucucugcuucuaucccucuuccuacuccucccuucccuucuacuugggucuucauccaaauguugcaucuuuaguucuucccaguguugugcccacaugugugcacaugugcaucaauguguguguccguguguauguggaggacacagucaacauggaguauuuuccucaauccugcuuuaccuuggauuuuuaguuuucuacuauaaacggucccuaugguuuggcuagacugacccaucagcaagcuugggggucaccagucuugacguccacaagcauguacagucuggugaugccugcacagaaccuugcccagcuucuuaacgcagugcugggaucggaacucagguccuccuguuucuguaucacacacucuucccacuauccaucuccuucacugauguauuuuguagugucugggaugugaucccugccucucacauaguuacuaaauggauuaaaguaucaacagaguacggcguggggauagguaagacccccccccccccggacacauuucauaaaaaggauuuaggcuaguugcagaugaagccuaacacaaagagguaagaaagaaagcaauugccacuacccacaauacccuguauuuguccaggggcuugguuguacaccacaaaggacagggaguuugaggaucagaguagagacuacugucuccgugcacacccuuaaaaugggagaagaggugauuaggugagaagacagccacacaggaaacucaagaagaacgaagaccaaaguguggacacuuugccccuucuuagaauugggaacaaaacacccauggaaggaguuacagagacaaaguuuggagcugagacaaaaggauggaccaucuagaaacugccauauccagggauccaucccauaaucagcucccaaacgcugacaccauugcauacaccggcaagauuuugcugaaaggacccagauguagcugucucuugugagacuaugccagggccuagcaaacacagaaguagaugcucacagucagcuauugaauggaucacagggcccccaaugaaggagcuagagaaaguauccaaggagcuaaagggaucugcaacccuauaggugaaacaacaauaugaacuaaccaguacccaccccagagcucgugucucuagcugcguauguaucagaagauggccuagucagccaucaguggaaagagaggcccauuggucaugcaaacuuucuaugccucaguacaggggaacgccagggccaagaagugggagugggugggugggggagcgugugggugacuuuugggauagcauuggaaauguaaaugaaauaaauaccuaauuaaaaaaaaaaacaacuuuaaaggggcagggcgugguggcguacaccuuuaaucccagcacuugggaagcagagucaggcagauuucugaguucgaggccagccuggucuacagagugaguuccaggacagccagggcuauacagagaaacucugucucgaaaaacaaaaaaaaacaaaaaaaucuuuaaaggacacuuuuguagcuucucuccuuuguucuuagacucaggauuuugcucaguucccauuuccaaccaccaauugggggugggggggaacuggcaagagaaaaauguuacaucaauuuaacuuuaugagguuuguccuuuugguuugguuugguuuugcaaggaaccauuuuccaacccucuccuuccuugauauuauuuucuguaaugguagcccauuuuaccugcuguuaaaaguaaauggagggaaauuauccauaauagcuucuauccuuuuuuuguuuacugugacuuaugcacaacugcgaucagaaacagagacuguuugagcauuagucaucccgaguaauagugaagugcucuguguuggaggcauuagugcuagcccaagccguagauggcuuuuaguucuacuuaauaagcaguuuuugaauacgcucugugcauuaugcccuaggguacaaagauagauccaucucuuuuuaauucuagaaaauaguuuucuccauuauuuuucucucaaacgucuuuuucccuugcaagccccauuccacucauuuuguucuucuguuaucaacuuuauuaauaacugguguugcauguauuuucaaauauuugggaagcaguaccacccagcauuaucaugugugagggugcgcauacaugugagugugugcagaagccagagguuaaccucugguaccuuuccuuuuuuuuuuuuuuuuuaaccucuucuuuaccuccuuuugagacacggucucucauuuuuaccuauagcucuccauccagcuaugcugugcugucuggccgucgagccccaggucuacauguugucucugccucccugucaguaggauuacaggcaugugacuuuauagcugacuuuuuacaugggaguucugggcauuggauucaggucauccugcuggcaugguacauauguuacuuacugaaccaucagcccgugacccaagugaucugucuaaagaccagcacuggcauuccuuuagaaugggaccugguguagaagguugagcagacaccugacgucaguguucgaccagucugcuccagugacgacccugucucaugccacccacucugugccccacgcucgauguccacuggacaccagacuucugcuuucugcagccaugcacugccuugucuuacuguucacuuuuccagucaugaucccucuacucugcucuccagcuccuuccucauauacuggcacagcaccuacuugcucgaccaacccccucccaagcucagcccugucucagcgacuucuuaaguacucugcugacagauucuugccugauuuccuagcacuuuaucaucggugaaaccaugccaccaaaggcugacucgggcacuuagcccacccuggggccccacugacuuccuguuuaucaagaaucugaagaagggauuugaacaugaacaguaaauacaauaagugggacauauagacccuguucugaacgcaggugaagccuacagguacuuucucagagacacagacugacauuuuagacagguuguaaguacucgaacuccaugaccugugaauugcgaacaaguaacuagguagaagugacaagacagggacaagguugacaggagugaccacagccagaugacacaaaccaggggaaauuaaaaaauacagauacuagauaagaccuguaaaaucugaagcuaugaguugcaguuuauuucugaaggcagaaggcauaagaggucuuacuguauuuuaauaaguuuccuccccaaagugaaaacaauaaagaaauugaguuaaaugggguaucauguaacuauguggaaaacucaguuaccagaacaacgugcacuguuuagaaaugauucaaguaaauacgauuucuuuuugugcaacuaaaguaggagauuuaaagagcuuuguguucaguguucuuguuugaacggcauggaaguaaucucauuuaaucuaucauaucgacacauuuuuccuuuuaaugcaaauugcuuuuaguugaucauuaucauccaguguauaaugggauauacguuucuuaucauuuguguuguuuuuuuuucccuacuuuuuaaacugcauuuguguucauucuuugaaccaggugaaugugcuagacagauuauaaagguaccauuuauuauuuuuuaaaaaaaauaccaaauacuaaggccaagagcaucuugcuuggccgagcaaggucauugagauaaucaaaggaagaugcagauccagcacuaagcugcugcuuauucaccuucucucaccccugggcuuucacuggcuuuaggcccaucccuguaauuucacccucuccaucucugcucauguggaaugcucuggcugcugaccuccuagcuccuucuugacucccgugucaagaaccucuuagccuugcacacacauuucuuggcucuucuuugugcugccaacuucccuugcuguucucagagcugcaucugaauugugugcuggcucaaggaucuacucacugugggguacacagccagggaccaccucugccuccccacccuccauucucuagaguuaguggggggcagaacauggcauuuucccaacugcccaucaccaucaauagcaauuucuaaugcauuauaacacaauaugauauuuuguucauuaauuuucccacaaauaagcuuuaaaaaugauuucagcuaaagccuuccuguuaccgugacuacaguauccuucucuugugagaauggcucgcuuuauccuaggcuggucaucuuugcuucauuuaaaugauauucacaaauagucauagaaaaauauaguucuuaguguaauguguuuaucuguguauaguuaguuauaugucugguguauguuagugcuauacccgcaauuaguucaaugugacuggaccgggggucaaugggaaauaaucauuuuuuuuagaucaguguuuccucuuugggucuccgauggcuagcuguguguauuaacaacauuuguucuaucucaguguauguuguacucuuugaaauaccaaacacaacaauauaauguuuccaaaggccaauuccuggcaguguuucucucuuauggggcuccuauauuguaggauauugaugcucacugauaauuaacagggcaaggcccagcucacugugggugcuuccaccucugggcuggugggcuugggagcuacuagauaguggguugaacaaaccaugagguccaagcuaguaaacagcauuccuucauggccucuccaucacucuuaccuucagguuccugcccugaauggguuccugaccugacuuccuucaacaaucaagugugauuuuagaauuguacgcugacauaaauccuucugcccaaguuguuuuugugcaugguguuuuaucgugggacuagaaccccucggacagaguuaucuggcagaagaacccagcugggcuuggugugacaggcugaagggugcuuauccuuuuggagaacuacagacauauuucagaaucuaaaucacauugcaauuccaugucagcucauuuuauagcagcaaugacagauuugugcagaaaaaaauuuuaugaucauugaaugaaugacgguagggaauugucauauaguuuaauagaauguccuuuuuguauggcuucuccaaguaacuuaggguuccauuguuuccuuguagccaauaaaaugaggccaaauuacaucuuaccuaacagaaauaauuaagcuauuaaacuggcaggugguuuuccccuccaggcuuuuuguuuguuuguuuugcaaguaacaggcuuaucuuucaaaucccuucauuguaaagguggacccucaugccccuaccagcguccuugcuucccugcuuccccacuccuaggcccuaugggccccacaacccagucacaggaggagcagggauggagcuggcagcagcagcugaaaugccacccaggaaccuggccuuccugguuuccucucugcugguuuucuuuuccuuagcuucuuuuucacaagggaugggaguagacugccucucucgucaucuggagucucuugaggaaagccuuccccucguuuagguuaagugaggaggaaugaggcuuucuaggacuggccaggaucuauccucagaagccccaggcuaaguccaugagaacacucugcauuaagagugcuuucuaccacccauuguacagauagggacauuuagaaugcucaguucauaagucuaugcaaguuagaagccaagauuugagucauuaaacuuggugcuuguaaccucuagagguuuuuaaauuuacuucuauccucauugguauuucuguaggaaacuuagcagcauaauuaaaugcauauaccuucuuuguacccucugcuacacuucccauccuaaagucccacacugcuuaauagagucauacaccaguucaccgauucccuuaccgagggagaagguguuuaagcaacauuagaauuugucuuuucaauuuucacauaaagaguugaaguaugaguaauugcucucagaucuguagagcacagcaauaauuuaauuagcuucccaaguccaaguuagauggguaaaguuguaacacaugaaagggcauagaaaaauauguuacuuucuguuucaguguucuuaacuacagauagauauagugauccaaccuugaacugaagaagcccauggauugggcagacauuuuuuagaaagcaaaacuucuuuuagugguuaugaauaucacugcaagaaaguucuguguaaguaaauaagucagcacucucucuauugagaacagaaguuaguguuauggacagacaugguuuuaauaaauugcuugccagcugcuacuuuccccagccaguguuguggccaucaauaaauaaaacacauuugcuucauaaaaagauauggugacacuuuacagggauauauuuuauggggaucugcauccgggaugucacuuucugauuuuagcauaaaggacaggaaggugcuacagcccuugagcagagugugguguuuuuucugguuguuguuucuugguugggagcuagaaacuucugagaugucaccgugguuuugaagauggaaggccaucaaaggcauauaugucccucuuccgcugaacucaucgauuguuuucacagaacauaaacaugaaacguacuucuucaauaagaauagcuaagcucagguagaaagcuucugaaauuucugacuuaaagaucacuagcuuuuguguguugcggggaaacagcccaagguguggggagaaauggaugcuaaugugucaagaaagagcuuuuaaaucuauggcuccuguccucugauucuuugguguguguuggguuggguggguagggggagaugguugugggucggugucuuagucaggguuucuauuccugcacaaaacaucaugaccacgaagcaaguugggaggaaaggguuuauucagcuuaaacuuccacauugcuguucaucaucaaaggaagucaggacaggaacucaaacagaguaggaacuuggaggcaggagcugaugcagaagccauggagggaugcugcuuacugccuuauuuccccuggcuugcucagcuugcuuucuuauagaacccaugggguauuagaggcccugggaauacaugugagagcauuguggaucccuuguccugcugacaucgaauguucucaguauuuuuaccccauucaguacugucuuccuguccccagugaccugcucauugcuguccagugugacacuguugucagcaggaggacauucagggagucacugcugcagagagucaguccggagggucaggaguuggcucucugggugccacgcaagcugcccugcugcguucagcuucuuccugccccuccugcuccugcccuguguauggcugucauuaggaguuucucccuuagcucagcacacuggcacugcuuacaucugagagcauggugggaauccuugucuguuuuguaggcagaauaaaaucucagugaccaccagugauuuucuuucuuucuuucuuuuauuuaauuuaauuuuuuuuuacuuauucacuugacauccuguucacuucccccuccugguuacucccucuccuacaguguuuccccuaucccccuuccccaacaaaacagugauuuucuaaucagaauugcccucacugagaccccucagcccucagggugguccuccugccucucuccuccuccuuccucaccucaugcucugcagaaaguugccuuuugagauucuggaagauguuuccuaccuuuuuuuucuugaacuuuauauauauauauauauauauauauauauauauauauuuucucucauuccccccucccaugcgcgcgcucucucucucucucuuucucucucucucucucucucucucucucucucucucucucucucucucucucucucucucucauucaccauacuaccuuuagccuauccucauugaaagcuguaguuuucucaucugcugggcaaucagcugaguagccccuacuaacuugucaaccuuauaauuugcuagaugagcauaauuagaagucuuaaccagcugagugcacuugauauucuugugaucuuguccauaaugaacuguuaccaucugccaccucccagacuagaaguggacaggguccccuuagccacugacagaccauuuuaaagagauuaauuugaucuuaauuauuuaaucagaauacuugggaguggaaauaagauauuccccauuauuuuaaucagaaauaccuuuugauuaugaagagaggggaggggcuguaaagagagagaaauaaagauacuggaagugugagcauccauagggaggcacaacccaucacuuuugccagaaucccaaggaaugugaccuuuugcuuacuccacucagauaaaacagaaguauuuagggagacaugagugugcgcuggagucauauugaacuaccuuuaaaagacacgcaugcaugcacaucuuucaauggauguaauuuguaacaagauuuaaaacaaacuuaaaagugaaguuuacaaguaaaauaauagucaauuuacuuguuucucuuaccuuacaggauuuccuuugguaaaggaaauugcaaagugguuuuaggaugcacacugauagguuugggcauuagaucgaacauuagaaacaucccagguuuccccugcauaaccauuguucauuuauugacuuauccuuauuaaacauccuccuuggagaggucucuuguagagccuacauuaucucuguagucaacuuugguuuuaucaguuuuuaaauuccuugagucucaacuaugcaagcaggaaaggccaaucagauuccagagugaaucuucuuuuaugucccauguccccuuaaucuaacccugucccaugugacucagaaacaccaaaagagagugaguaaauuuuucuuuuuuuuuuucuguugaacuccaguggucuaaucagccaggauuaugcggacaaucacuggaggauuccagagcuccagauuagaacuagacgcuucacugaggaccgacugugugauguguguguguguguguguuuuguaguuauaaacucagcuucuaacaaauaagagugagcagcaucuaggauaauauaucguacugcuagaauuucuaaucuuuucuuacggagaguuguauagcagugaaauccuacuuacaaucuuuuucuuugucauuguuaacauuaaccuuucauguauugauaaaguauaaaagacugcaaauaaaugcaaaaaggaccccacauaguacacgucaaauauuuggaaugaccauagguuaaaugacuuuugaagguuuauaauuugaauauguagcuugacaugggguuggcaaggaggggaaaaaugaagugggcauuuaaaaauggaguuuaguauugcuuuuaaaaaguacagcuaaaguauuuacugcaagucagugacagacugggccccugucuggguucucaacccacauggaaaggaaauaaauguucgugacauaaacguuuagaaucaguaguaacgagaaguagaagccgggccaguaccaaaacuaagaaaaaaauaugauaagguuaggaaaucguccuuaccaaccuuaagguuaacguugaccuuaaucauccuuaagaccaggaugacuccaguaaaugacaacaucacuauuuuauauaagaauuauguuuaaaauaaauauuuucacaagcacacacaggggaaaugucuaccucucguaaacacugaagaguagaguguuuuccuagaaugagagaagaggauuccauggaguuuccucuuggaaagacaggggugaaguaaguauucaugcugcgugcccgugcuugagcaaccugcaugcacaugaaggaagugcuucugcuucggaagucugggccuggcuccuagccuccgucugcuuuccucccucuagucuucgcucccacuguacagaagagccugugacagaugcaggacaauccacgagcacacacggagagauauaaagacugcugaguuuucucuccucuucuccgugcagcccagacuggccucaaacuuaaagggcagagguuacaggcaugugacaccaacuuuaccccucucggucuucuaaaaaucugucgcacauuauagacuguacuauuuaaaauaacagaauaaaaauagaaaacacacaagauauccauaaaguaugguaggacguagaauauacugucaaaugaacccaagaauguaaauauaauucuuccuucaaauucugggcaguuggauccccaggccugaacaggggaggguggagaguuugggaugaauauauccauacaggugcacacagacacugggugggaaggccagugacaaggaaagagcucuucuggcaucagaagugcaggcaaauggguuuggcuuuguccuccuauuuccccucucagcuccuguuccuguuuucaaaugcaaauuagagugcucucuuaucacugggcucccaggucuccuagacugaguagcuguguuguacaugggauugauacaucaacgcaguggaaggcaaaugugucuuuagcuucaagaccagcgcaucacuguguuccauuaagcuaggcaugcucuacugacagaugcugggaccacuggggcagugugggcaucucuccaggaaucuccagcuugaugggccaagucacuaugcuggagugugggucucugauagcagcuucuagagaguaucgguuugaaucagcucucagcaggguuucucagacaauaccaugcuauagaaagacuggcuaggaugcgucuccacccggggcuucagaauuuaccauagaagcuuuucauacuugaaaaaaacauucauccuuugguuuucaaaugagaagguuuuguuuuuaaagaaugcauccuuuaagaacuuuauucuuuucccuguaaaucuuuucugccucuucgaguuuacuuucuuuccuuuuucuucuucucuuucuucuuuguccccucaaauugcccuaacuugaacuuuuauguauugcuucauuuuauaugccucacaaacguggacaacuuuggguuuguuuuguuuguuauccucucguuggcuuugaacagcuucuaaggcuugcugcagcgggacacagugguguucugacuacagagugcuuagugggcacagguccucugugguaaacagauggggaguuuagugucgagcuuugcuccucuauuggcgagcugcuugagaggggauuauaugauaaaccaacgaaaggacuguacaaagagaagaacuuccacugggcgaaaauguggcagccaauaugggauguuucaucccaggaugagaaagcucugugugccccucuguggacugauauuuagugguugguuuagaaacaguuuguauuucauccaagggaaaccacugugaguaagcugucuugccucgaacaugaacaggcagucugucugucugucugucugucugucugucugucucucugccucugucucucugucugucucucacugucucucucuuccucccucccuccuccccucccucccacagacauugaaacacaaaugcuuaaaauacauucuucgcaaagcccaguaacuuauuaaccagcacagguguagcccucauaaaagcuacuccacuucuccugaggcugcuaggaaugaaauuuucaucucacacauaacauuuuacauuuguguaaaauauaaaauauagguguuauauuuagcauuuuacagaugucucgaaggcauaaguauuuagaggagcuugccuuuuaaugacacuguuucccccucucuggagucuggcugccuuauguguugguuaaacuuauuggcccuucucucuagacuuccuggcuuaggauccuaaauuggcuuucacuuauuauuaguguguguguguguuagugugugugugcaugugugaguacgugugcaugugguguggguaggugugugcauguaugguuuuagagaugugugugugugugcacgcucguacuggugaggcucagucugguauagucagaguacccacuauuuuggugcuuucccgucucacccuggacucuccuacccaguagucccuugagacuggguucuucguaggccauuuggucacagucugaguaucaguguuuaaaauuuucuggaaaauuaaacaaacauacagucuguguucuuuaaauugucuuuugaaucacacuuagaugaggacagagaggcaggcuuuuuauaaggauggauauuaagguuuaagaacgcuggcuuccguucauuuuaugaugucguuuauacuuaaagaugggauauuauuccagauaaagacuuaggaugagucaucuuaaaacauuuggggggcuccagccaugggagacuacagcccuguggccauuccguuucaagcauuuggaguaguauucugcacauuaugagaccuuuagcauuuuaucaugaaggaagcuuuguguucagugcgcuugucuaacuacaggcuuauaucgggacucuauccauauucaguauaggcugagcugugguguuugcuaggucagaucuaauaaaugugcuuuugauuucugagauuccccucagcuuaggaugggcguauccacaacacuaccuuaagucccgaaacaucuguauacgugucugccuuagacaacccugccuuuugccauaucuguguggguuuggucugccucucuguuucuggggacagucaagaagguacacuuaagccagcuagaauaaagaggggguccucaagugugggggugagagucccagacauuccuauacuuggguugucccgcuuugggagucacucucuguguccaaauguguccuuuugucuuugcuuuguuggauucaguguuucugugccugagcuuuguuccaaccugacuuugguuucucugugcaacuuuucuucauugcugggcugucgcuuuucuugcuagccuuacauuguguguuuccuuuccauuggaaaggcuuaguuuauuucuuaaacucagacuccuggcucuguuacaugucaaggaugguccuuguaaucuugcagacuuccuggugaaguguggauaaacauucaguuuccauaugucuagucuucggaaaauguccuuuguuaaauaugaacaggcaagcaaauuuacagaugaugaagucucuaagaugucauaugccuugaauuuguucuuuaaagaaacaugguaaauuaaucuuuuuuuaaauaacuuacagcuaaucuuugcuaauuaugcuucuaauuucacuugagaacaaugaaauaaaaaacugucuuuggauuuucacagaaguaaauuuaugguaaaggaaaaauguuuucuuucuugaguuauuuugcuacaucucaagccuuacacguguuaaaguauuaaaauucagaaguuuccaugaacguuaaaccacuuacuaaucugcgcaaccauuuucuuuuccuuuugaguauccauuuagauguaacuaugccuuacugguaaacgcauauagauaccauuguaacucagccuuuuuaaucuauacacuaguaacccuuuuaacagugagauucauacuuggauuugaagaauaccuguauaacugaguagacacccagguuagaccuucucguuuuuaucaacagaguugacuccugaggagagagcccagaagaucgccaaagccaugcgcaagcagucuucugaaguccgagagaagugggaaaaucuaaaugcugucacuagcaacuggcaaaagcaaguagggaaggcguuagagaaacuccgagaccugcagggagcuauggacgaccuggacgcagacaugaaggagguggaggcugugcggaauggcuggaagcccgugggagaccugcuuauagacucccugcaggaucacaucgagaaaacccuggucagcaccacugccuuugacaaagaauauuuaagaaauguauucuuguuguugcagagaacacauauaaggagacccacauauaagggauucuuauaagcugguaccacuucagcuccccaccuaaaucaggaauuauggcagauguuuuccauauauaacccccucaaaaaaacaagaccccaccaagauggcuuuaugauaauuuaguuuguuuaaacauuuuaaaaauuccauucaaguaucccuaaauaguguagauuaggcuuaaccauuuaaaacaagacaaaaccucucacaaacuuuuuaaguucaauuuguuucuagauaugccuuccauuucauuuacuuuuguuuccuauucauuuguuuuuuuuuuuauauuguuuauuuuguaaugauuccugcagccuagauuuaauagaaucgugcccaugugguacagccuacaggucugucuccuagaaacuggugguuggauuuacagguuuaauaaaaaaacaaacugccuuagugggaauucucaucuauaauuucuaucuuauugucuaaguaagugaaaaauaaauuugguuauaaauuccauuuguaaucaggaguugcccgagguuaaggauauuaguucuaugguguaaagcagcuuugcuuacucauucuacauuuucaggauguguguguguguguguguguguguguguguguguguguaugggugggugggugggugggggaguaacagaauuuaggcagcagaagacacagagagaaacuuuagagaaagcaauguuuguauagacaugaaucacgccagagggugagcacugagacaaucagaagggaugcauccaacauuauccaucaugcauggaguuuucauugcaaaagguacacacauccuguguucauagacaccggguaacagucuuccuuuauaugaguguggcugaguggaaaggcaagcucugggaaauuaacuuaaugcucaggccaguuacaggagugagagcaucuguguguguagacaggggaguagugacagccagcauuucuuaaagcugaauuguucuuagucauuucacgugguuaucucguuuaauccacacacugucaacacgguaaggauuauuuccugaaggcaaaacugcaguuguccaagcccacacagcuaguuagguuuagggucucugugauacuuuuuugguuuuuuugguuuuuuuuaauuguccuucucuuucacugcagagaucuaauguuaaacacagccuugaccaacccuuugaauuuaaacccucuaaaauucaaacacuuuuaaacuuaaaacuuuuaaauguaaaacaaauguuaacaaagaauauaguguucuccauuucugaugauagauaugcaucugccuacucuauaaauuaagcagaccucuucaagaacuuagagcauucugaaaaacauuucucuggauacaugugaauuuaacauagucuaagaaaaaaauaaucauucauuuaucagugcaucuuuaucaaauauuggacacuggauuuuuccuacuuguuuaucuuagguaguguggguuguacuugggccuuguguauucggguuaaugcagcgccacucagcugggugcaaagccuucuuuuuacuuuuuauuuugauacaagauccugcuagggugugugggcuagucuugaacucacuccauagccccaauagcccuuaaucuugcaggcuuucugccucacccucccauguagcuguuauuacaggccuuugacaucaaaucuggcuuaacuaauuuuaaagccuaaaaagucuaaauacaauuaguaucaaaaaaaaaaaaaaacccaacaaccuuaauaccuccggauuugagugggaacuuaccuuuuugaauuugaaaguaucacaugauaacuggggaaaauuaguguggaaaaaaauaaaaauuuguaucugcagaaaagaccaaagaguuugagaauuggcagucuuacuaaauuaaaggacugacuugccucuccagccaaauucuuuuguucaaaucuacuuaagugggaagcuuaaaaaaaaaaaagcaaaaacacagaagcaaauagucuaaugggaaagaauaaauuggauuaaauuacuuuuauaucuuuagagguaaaaauuaaaaauucaagucucacugaaucaaaucaaguaaacucaauguguguaauaguuuacauuuuccguaaaguauauccccucucuuacuguaggcauauagagagguaaaaccuaaauacuagaaguugcaaaauauuaguuaauaugucaaagcuggaaauaaaauccucagaaauaaguaaauaauuucaguugcuaaaguugucuuuaauaaugcugguuuuuuguuuuuuuuuuuuuuuuugcauauauaccuugugguaccagacggguuugagacacacaccugccaacagucuaaugagcaccuuugauaguagcagauguuucuguuuuuauagcagugagggcuacguagacuuguauucucuuauaggaaaauacagucaaaacaugaugaauuaguucuuuauacaagaacacauggcaguucugaaagccauuuauaacuccauuuauuucaagccccaauuuggaaacucuuaaaaggcaaaagauaaacuuccuugauagaaaguuuccucauugccauaaaaacaccuugccauaaaagugcaaacagagccagaaagacuuuccuguuaaagcucugucaauguuucaccuaugacuuguaauagaaacaaaacaaaacaaaaauaggauuuuuuuuuacacaguagaaauauaagcuucuuuauuguuccuuaaaauuaaaaaaaaauccuguccugaaauuaugcaugaaguuauaaucaaguucuaaaacaccuuucuaaauuucuaaaucaccaucuguugauauaaaacugguuguuauuuaaaauuaaaaaccuaucaaauagcauguuaacuuuaaaauuuuaauaucuaaaacuaaaaggauauugauuuuaaaauauggauccaguuuuaaggucuuugaauuuaucugugaaagagaauauuaauauaccaagcuaaaaaaucccaguuaaaaacucuagaaacauuugaggucuagcauguguguucagcugugucugggagaaucugacuuguuucagaguccacgcugauaaacucuguguccuucccucugucucccacaccuguauuauuuguuaauccuuugcaccugucaugccugucacuaugucacuguaugccccauaaccagauuuauacauugugcacauugcccaauuacauuacaaucugcgugugcauuuuggaccaucuucagaugucuggcaucggcagggauagacaaaacugacugcaaaucaaaauucuuucucuuuccauguuguagcaggacauguguccuuuggggcuuccuuucuucugacuucuuuugauacagugguaucuacugagguuggaaauagaucuuauuaaacaccuggugacucccaugucuacaaauucaaacagcauucauacccugcucucucugaugccuguauuuuacauguuggcuucuggcucucagucucuucucaugugguuuguucuucaacucuccuuugaacuuaaccgcaugccuuuaggcagagucaagaacuugaaaacacuaaaguauauucccuguuuaccauuggaaauauuugauuccugaauauuggguuuuagcaauaauuauaauucaggauagguuuuaggagaggcaaaauuuuaucccugccaucuuggaaggcuguuuaucuguccuaaaaucuaacauaagaccaaggaacaaaggagguacauuccauuccuuacuauaaaaaagcaucagaaagacagcagaugagugcgugcgugcgugugugugugugugugugugugugugugugugcgcgcgcacgugcgcgcagguucuaaauguaagaaaguguccccucccaagcagcuucuuccauggggcaggaggaaugugaaugcuaagggauaggaacugaaaucugagguguccagcagugggguuggaauagcucugaacugucagaauagcuaugucaugacaugugacacgugugugguuuguacguuuugauauguuggcugaaagucauagcuggguuagugacaccgaacagaaaauccaggagugcuggggaaaggccuccaggcaaggcugccgagggccaucuccucacggaggcauuucagcauccagugggauguagagaaagacuugucagagaaagcgaaccagugcuuuagaagacagguggaauucagcggagaacugaggccaugacuauaucauuaugcuguuugcucucauuggcuuuaaagucuagcuucccuuuucauaugcuugcccaggacauauacuuuuuaccugggucuauucuucacccagaggcagcaguucaauacugagacucagcuauagauuuuccaugaugcucugcucuuccugcccauccccuaagcacagacugugauccuagcggguucagggagauacagaacuuuucucuccuauccaauaacuauagcuuaguagugaggaaagcuacuuuuacucgaccccuaaucuaagcaugacugagaucaagucaacuuguugugucuggugaaauaaaggaguaaggcagccaugcuucaauaaaaacagcaaauggaccaugcaacaguaauccugugguuugcauauuauagacuagacagaaauguuuagugucuuaaaugaguucacaacuugaguuugucucauugcccacauacuuuaaggcucagggagucucuggcuguauagguuauuacaggucugauccagucagcugcuguuaaguagugucucuacuugacagcaucacuauggccuuccuauggucuucacuaagaagauggcaacucuggcuuuugagaaagucucuucuggcgacauucuaaaauaaucuguuuucuaccaggcguuuagagaagaaauugcaccaaucaacuuaaaaguaaaaacaaugaaugaccuguccagucagcugucuccacuugacuugcauccaucucuaaagaugucucgccagcuggaugaccuuaauaugcgauggaaacuucuacagguaucggcuuagccccuucagaaugcuaucuaacacugcauaaagaauacagaacaggaauagaaaugucaggcuauacaauuguugauuuguauuuaguuucuuaguguaacaauucuuugugggguuuuuuuuuuaaaccugaaaaacacacauuaggauguacacaaacagaaacacucagauggucuuuaaaacucaccucaguuguaaacuacauauuaucucgucucucucuuuacugaggguguuugauaauaaauuuaguaggcagguacuugucuuucuauaucuugaaaccaagagcaucauuuaguuaugaguauggauuucuugguuauaauuuauauuuacacuguauauaauacuuguaaaaaauacacaaaagccaguaaguugcagcaaugauaaccuggagucagccacaggauccuuuguccuguuguaaccuguaaagaaaucauugucuuacuuucauuauguguucuuucucuuuugaaaaaguuacaaagcuuuucuucguuuucuuuacauuguucacugugcaggaguuuucuuucuguuuacagaaagcacaccugcacuuagugucuagauccgaccuucccaaggcaauuguuucaguggcuccugacccuacuuguagacuccagauuagcugagccaggacucaugaguguuccaggucuaagcauuggcugacuacuguccaugccaggcagcaguucaugguacaaagggucugggacacauuugcucuccaccuccuaucagucaaagcagcuaugccuuuuugcugaaaauccgcaggggaggcuguaacuagaagaguaauaguaaauaauucugacuaauuucucuacaauauaacauguaguaauacaaaugugcaguuccgucauuuuauuugaaaaguacuguacauuuuagguuauaauauauucuuacauuauccaacaucaaaaugcauaaggaggugacugagauuggacuugguauguaaaugcauuuguaaacaccagaaucugucccuagcaacucacuugguagaggaaagggccaccuucuaaaagaugcuuugugacgccuguguccugaccacccgcacgccucuccauguagaauacaugaacguuaauuuuuuuuuuuaauuuaauguuacauguuuucuuaaugaaguugaaagugugagaugugaauauuccauaugugacgaucuuuccuauccuugugaaggaugucaauaauccgggauuagucaggcuaagcauauuaaauuuguaagugcucacagagaugucugaaccuaauucuuuuugcuucugucccaucucucugcaucguuaucauucauuauacucauuugaagauugcuuuucuggucuuucuugauuuccuuuugcuuugccucuguuauccucaucucuacagaugucagauguauuguuagauuugaugggaacauucuuccaccuuuaucuuugauguugguagcuacuaggguucaaauaucaguccuggauaagcaaagacaaaucccuguuagcagacagugcuguuaaauuucaggacuagcagcuuacuuauaaaauaugacauuugagcaucucucauaaugaauaaaguacacucugaugcaauuuauguagcugaccaggagaaagcugagaugcccagugagcuaggcagaugcaaguuuuauuuacagugugcugaaaaugaaauuguucauucaaauggaacagcucaccaccacugcacagacaaauaacagggccagggaaauggaaaugucagaaggcaguaugcaauuguuguucauuugcauuugguuucauaacugguuuuguccuguggcacgguaacaauagaauccacacuaacaaccauagaagggagucauggcugggaugcacuggugacacauugcagccuggagcagggauucucagaggcuccucuuuccuuugguaaagaccaucagaugcaaacuuguagggaaaucagaagauguuucacacccagcuuccaguuuucucucuucugucaucucauauacucauuuaucuaucucccaucugucugccugccuaccuuccuaccuacuuaucaauaugcuuaucaaccuguguaaccaucuaggaucaucugcuuaacugccugucuacccaucuauccaucuguuuaugucuuuaucuuuagaguucucuaagcuccauuuccuacacauucucugugguacuuuuauccucuuuuuuuauaaaagaggcauggauaagggcuccucccauggccacaucuuaagcugucuuagaagcaugcuuccugccaccaaguuggggagaacaguuuucaggcauaaagaugggcuccgauggccaaggcaugaauauucacuuuguucugacuaguuguguccucuggcccuuccuugugucuugcuuucuucauaucuaaaaugauaaccacaauuaauauuaagcuaaugugguuauuguauagauugaaaguucauauagauaguuuagaaugaucucugacuuucuuuaccauuauuuaaugucagaaguugauuuucaugcugccgcauuaauaagaagagaaguuuucugcccaaacaguaaugaauugauagagcaacagcauuacuugauaaaguaauuacgucaaggauguuaugaaaaccauugucuugaagucagucguuucaucuggcgugugcuugugugcagguuuccguggacgaucgccuuaagcagcuccaggaagcccacagagauuuugggccaucuucucaacacuuucuguccaguaaguaucaauaaauuugaguguucuugcuuaacuugaaugaauuugcaaauucguucaguucugcccaagaagcucuaucuuugcucuaacuauacuuuaaauuaagagaacauguucaugaaauauuacuuauugcuuauguaauaaaugcaguauguaaauugguaaauauucaaaggaaaacaaaaguaaauuuguaucuagauauguuuucucauuuaaacauugguuaugauaacauauaugguauuugucaugcaaagcuuaugaaugucucauaccaaaaauuuaugcuguaagguuuuuuaaccaguuuauuucaauucucucucuauauauguauacuuaguuuuuuuuuuaaagcuucacaugaauuuuaauucacuauauaaauacuuaaaugagaaaauguugguuuacuaagcucaagguagucaucucauggacaaauguuauacauuaaguguugcaccaagguagguuuaauggaacauccuccaacuggaacuuguaauuuuaugugcacuucaugaagucuuagggaaauaauuuugagcccuguuuuauuuaucauccacuucugaugauacuuaagaaugcugaauuuugaaacucccaaacugauuuuaaauguuaacauugucuuuuacuagaccugagaauuuuugaaaauuaauuucuugaucucugcauaccuauuuccucagauugccucaagaaugaaauucaguagucuauccuguuagaccaagcacgcaagccacaccuuggcaaagaugcuuucagcacauauuaaugccuuuucuuuaauuuccuaugggaaguauauggaaaaaaaacaaguuguguaauuuaauuaaauuuaaguaaauuuuaagcucaaggccaagaauacuucucaauuauggaaacuuauuuucucugaaaccacagagaaagggucaggguuuauuuacuuuuguauucuugugaagucacauuugucauuuucuguccccuaccucuaagacuuacccaucuucaguuccuaagcugagccuguggguguuugucucugagugagguauagcccuuugugguggguaagggcggaccuuuuuuuuuaaugcuuaacauauggauagcacuauuguugaaauaaauagccucuuauuauacucauuagauauuaaguauuauagauuucuaaacccuauagaauaacuaagaccaaauugaagaagcauuuguaaauaauggagacucuguaguucaaaugaucaguuuaucugcuaauauugauggagcccuaccuuuccaccuggcaaccucucccauggaaaucuaguucauguuucuucagucauaaagcacugcagaauugcaauacacuacaugguguucaagcacguggucuucaaccgacaguccaagaagcuugguuauucgaaucaaaauaauuacugaauaaaugaagaagugugagaaaacuugcaauuaguacauuuaauaauucuuauuccuugcugcuuacggucuuuggcuugauuguguucuuuggacuuuacccaugcuuguuaaaaagcaaguuccaugaggcacacaauaaaaccugaccuaucagccuggugccaccaugaagugaggcuagcucuuaugagaaguuuagcauaccugagucuucauuucugugucuguuugugaauaucuguggacacaguuguaaagaugagugcuugccuuugaucaagaccagaacaauuguuaaggaggaaguuugcugagcuaguuuuuggaaagguguuguaguaucugaacuacaccauuuugaaaaggacuuugggcagcuucuucuuuuuuaggggaggggggcucauaucacaggacucucucucucucucucucucucucucucucucucauuauuuauuuauuuuauguauaugaguacacuguuacucucuucagacgcaccaguugagggcauugauucccauuacagaugguugugagccaucaucugguugcugagacuagagcucaggacgucuggaagagcgggcagugcucuuagacagugagccaucucuccagcccuugggcagcuauuuuuaacucugcguauuuagcuucuucuccauuauacuggacauugguguguggaucuugcugcauuuucaaaauaaaguuuggauuugggaugcuuggcaaaguuuagaauguugcauauuugcaagauaucaaugugccaagaaauuaugaaaaaauagugacgugucuauaugaaggucuagagauaguuguaaacuuucauuuuaauuuaccugguaccuugcuuagcaaaauucuucugguucuaaauucauguggcuacucuacuuaaauaaacauuuaacuaauugauuuacuaaagcacuaauguaauguaucuuuacaaguaaucaguaaacagaauuucaaaaaggaaagaacuuccauuaaaaggcaucauaucucaaucguggcaaacaucucaaacauacuacaaacauggaaaacuguuuuuuaaauacugcggaucaaaauaaauaucugauauuuuucuuagaugaucugcuugcuucuuaaaaaaccccuugccuauuuuuauguugaauuuucuuucuaaaaccuucuuauaauuaaauuugcuugagugccaucuguucauaauagcugagccuaugaauauggugcaaagugaagaauacuauuagugaucuagaaauuccaucuugggaacugucauuuuaaaucugaauguacagcauauagggagcaugcuuugcagauggcacuguguucuguguugcaauguuuaugaacaauaaccugauuuugugaaaguguuuucauuguuagggucugacagaaucggcucuggacguugagucuugguucuuuuccucacuucacaugaagcuuuaaagcugugcugcuuggccucgugcuuuucuuaauugcaggaauccagcucagagccagaacgggucccucaagaguugcuccgaaauguguucauuuguuuuacauuaagguguaaggcuugcugcuuccaauaacuuccuuuuguuuccucagcuucaguccagcugccguggcagagauccauuucacauaauaaagugcccuauuacaucaaguaaguccacuucaguucucuuuuauguaccaagaaaauaaaguuuuaccgaauaauugaagagcgcuccugcuccccuauguaacuuguuuuguuguuggucauuuuuguuuguuuguuuguucugagacagggucucccuauguaguccuggcuggccuggaacuuauuaugaagcuagguuggccuugaacgcagggagauccccacccccacccccacccccagccuuugccuuccaagugcugggaauaaagcuguguaccggacccagagggucugcggcacaaacccagcucccuggacguuuuaauccagaauucaauccgcuuaccaagaggaagaugugcaugauaauaaugggaagaaauuaauuuuaagaucagcgaguuguccuuccuuaggucuuucuggccuuggggacaggucacugaguugcuauuuuaucaucaucuucaucuuccucuuucuccucaucauaagguuuuuucagccuaguuucucucuccuguuacuucuuaugugacauauucugacccuuaucuaguuugcacaccaucucaggaugcugguccuuuacuuacuguauacuuugucccagaaaagaaugaugaagcacuccucuguuaucucuggaaggggagguuagugaagcaguugcuuuacaacgcaauccagcacuaagcauugucaucgacccuauuauguauuaggagaacuagauuguaauucugagagugcacacugaguaucaaaagacagcuguggcucacauuagcuguguggccuugggugaguugaauaaaaaaaagucucugugccaagaucucuuuguauggugucugaaacuaacuguggucucuugaaaaucaaaguguguucucuuaaaaauccuauuucaauauuaauugacuuucggaucuuuguuuggaaaaagcuugugaaaccaauauuuguugaauaggacauuuuaauaugcccuuccuucuauccugaaauccauucuuauuuuuaaaacaaacuggucaucaucuauaaaaauauaagcaguauguguuacauugucuugugagaauugaacucuuuuguucauagacagcauuugguauauugaguugugauggauucuagaaugaggcaucaaggcaauugaugagugugucauuucuacagacaggaauggaaaggacuccaagacugggugagaugauuugucuugguugaaagcaguuguggccaucuaauuaaaauuuuaaaauuucuuagcuguuuuacauuuuaauuucaauuaauaauaacuuuagcaaugguauugaagagcuuuagucugcuuggguaaauauuuaccugaaucaaauaauaaggcuuuaguuauaaaucugagacagaauaagcccuccccuuaaagaaguccaauccuaaccccugggacuuugacucaguucucuuuauacauaacaguguugacaacaacauuuagcaacagucuccagguuguaggcuaccauaggcagauuauccugaugucagugaaaucaugugagccuuuuaaaaggaagaaagcagcugaggagaagccagacuggaagagggaaauacagaugcaacuuugaaaauggaggaaguggaauguccuucugggaauagagacaauuggaagaagcugggaaagaaggggugugguccuuauagaccucccagaagcauccaugccgugcucaaugcuagccuuuggaagcuuuuugugugguagcauuaaaaaaugaguauacauacagucccaaguuuagaaauccauaaagauugauuaaaaugaauucauggauaguuugaccuagacuccucuauaaucagauauuuuaaaauguaaacgcgaucuaguaaaacagaauuuguuuucacuagauagagaaaauuggaaauggcuuacucuuuuccuuuguuuuguuuuugugggggucgggaagacaucuacaguucauuucacacacacacacacacacacacacacacacacacacacacacacacacuuccauuagcugaagaauuuccauuuguauacaucaguaauagaugacgaagaauuaagcaguuggaccuugucuaaccccuggaguuuauguugcggcacaguggaagaguguucuugcucagucagucaauucucauggagagaaaacacgugggagcaaaguuggccuauccgacaucuuauugcuugcucauaaccaacacuggaaaaauaauauauaaaacagcacuggcaauucuuuaauucuuuaauguuuaaagguuaagcuuccuauaauguuuucuauaucuuaguaaauaucagauuuucuuuucucuuuuuaguaauuauuacuuggcaguuucauacauacauucugguaacugcucaucuccucacucucuccuguccuuuucccaccuccauuaauccccccuccuaccaagagcuccucuucuugcuuucuugucuuuugcuuuguuuuguuuguacuuugugccucagauccuccauggcuacccaccuggaaaugggucauuuucuuaaauacauacagauuuagcguuaaaugucuuuuaugguauucacaauuuagagcaaagucuccggguucuauaaaauucacuaaucuggcaguuuuucauuguuuacucuguuaugcaacuuuccaguuuauuuccccauagaaaaaggaacauuaaacuugggagguagaguuuagagugccaguuuucacuuagaauuguuacgaaaacaagagucaauccuuggguaaauucauaagcaaguaaaugaugaaugaaagaacuuuuaauguguauuuccucuugcaugucuguacauauaaguagaaaaaaauguuuaaaaccuacuuagcauuauugucacgcuauuagaauuuccuggggcaaagugagugaauuaauuuagcugucagaaaauaguauucaaguagaaauuuuaagcuugcauuuucguacauguaaugcuggagugcagcaagagacuuaaggagaggugaaacuuauuuugggguuauaucuuaauuguauaggugaauuaaaaauauaggauacagaucgagauggcccuucauuagcguuuugaaguucaugguagugagaggcaugucuuugaagagcaucaggauguagaugugaacugugagaacaugucuaucuggcaugacucuguuacugccugugauaguugggugccuggugcacuaacaaaugccagagaggaauaaauaaggucauaaagaaaaacagguuuaaucaaaaugcugaguuguggagccugguccuaauggcuacaucuacaaacacucccucaccuaagacucagggaauauugcagaagaggugguggaaagauuguaagagccagaggggaucagggaguuuacucugagacuguguuuccuaguaacauuggaagcuacacccauaaagucucacugaccuaucugcccaaacaggagcgcaaggaugacaucaguggaugccagccugacuggaggaaaauccacagguccucaacacuggacaaaaaacuauaggcgacugaagacggcugggaguaggcgagguggccuuccccagugaagagaauaccaauugguugccuagggccuuacaaacauacauacaaacaaacauuuagcagcuuauacuuuggagugugugugugugugugugugugugugugugugugguauagagcauacaauaacaaauagugaggauggcaguguuguuuuucccuaaccaaggguagggaagcugggcuauuauaggaaacccuaauacccagccagacaacaaaggggaagcucgugaagguguuucucuaccagcaacagcuuaagugauaaggacaacuuauuuuuaaggauucuugaaaguucaaacuagaaccaauugaaucuauagcaaugguuuaaugcccaguacaagaaaaauauguuacccucuacaucucucccuacaacacauuuccuccuuuucccuuguccaaaggacagauuauaucucugagcuccugauuuguaaguagaggcccacaggacacacugagucccuuuaaaggggaaggcuguguauguguauguguguguuuuguuuuguuuguuuguuuugcgucccagggacaaggcaaaaggagauggcuuccagcaguguugaugggugguccccguucccuuauuugaggaugagagggagguggagauauuagguggcaguugggggugccuuauuaguucuggugccccuguaucuauugagguagugcacauguuuauucuucuaaucaaucuuuagugcccuguagcaaagugucgccugccccuccccuuaccccagguucauuccacccugaaaauuaauucugcugguccuuuaaagccaagaaccaacacagcuucucgcacaguucuauaccaacuauucugucaucccugcccacaguauugacuuucugaauuuagggauguagugaaccuacuuauagcuuugccuuuggacuugcuccugaaucucaaauuaucuuaaauaaacuguacagucaaauccaguucuuugcuguuuguaguuuguauuuucuuccucauguccucauuaccaugaggagccaggacauuuuuaggguugacucuggcccuuuacaaucugucucacuugcaugaggaguaacacucucuguuauggaauguugacugucaagcccucuccuuaacucugugaguuucuaauuccauucccucccaaaaaauauaaucuuaaauuuccugccuuuaaaaguccaaaagacaaaaugcugugacgagguucgagaaguuuucuauugccugaggaucaugggguuacuguuaggcuugcuggacagugccuugcugccccagcagacccucagccuaugcaauccuguucacagugaggacucaaguuauguuggugagcgcugggguacuggaguuucuucuuauggggcacacucggcgaaaccaaaaauugagaugaugacgguggcaaauaccaucuuuuagggcuuugagacuguaucacuuggaugacuggcaucacuugggacuaacagcguuuguuucacuauauaguuuaggggccucuaaaaaauugauugguuauuggauuacuaauccaacuuuuauaaaccauauuuaaacaauuguuacaauaaucucaaggcuuauguuuuaucuuaaucagguuuauuaucuguguuuuuuucuuaucauuucuuaucuucuguccuauuacauaacauccuuaggaaaugucuuaucccuuaaguuagggcuuuuccacugggaacguuguggcguguugacaguuuugauaagaccaguuuagauggaggagaaauuuaggagccaaaggcaaauugauugaguagauaaugugacagcaggaaguuuaacuauugcauaauagaugguaaugguaaguuuuguuuguggagaagcgggaaaaggguauguuuaagguuaugguguguguguguguguguguguguguguguguguguguguguguguguguguguuuggcaggagaauugagcagaucaguuuuauugugagaugagcugauaauauagcacauuuuuuucccuuugaaucauugguggggaauuggccacugcugguaucagugacuuucaauugaggguggcaaggaaggcggguagaagagagaacguuguggauuuggaaguagggagauggaaucuaucaguuuauaguuuuucaaugaagugugagacaaaggcaagauaguaucagggaagggaacuuccuuuuggguaagcaaggagaaggaggaaggaaggggugugugaucuuggacuuuagggacacuaguucacuuguuuguaggcaggcauuugaagcuuggaaucaaauguuuaaaguagaaacagucuguauguagacuguuuuuuuggguuuuuuuguuuuuucuucuccauauucaggcgcagcugcuuugauucagaaacggcaaaguaauugaguagauccaggcccgagauuugccagggguaagggggaaggcagagugauaaaaguuguuuguagugauuauaaugauggacugugggcucaaaucuggauggauucaucaagaaauauuuaaaaacguuaauucugcaaauccacuuccauaucaagagcucaggcuuaaaucagaccaucuguguucagaucuccauacugcuccuggcccgaggccuucagugaguuaucuaagugccuucucuccacugugcccucccacaucugaaaacagccaucagaguccccuaagucacgggcagcaucauaacguggacugagcuuuucacauacagaaaaguccaagcugcucacuggaauauuaggcuaauaccuaauauuacuuaguaaaacuugauuuucaaaauguauagaauauguaagccaugccuuaauguaauauuauccuauuacuuaauaucccucagcagaaguuugcucagaaauccauauauuuccuauuugccuaucaaaaaggacaccaaagcugaacugugcaguugguugcuucauggccucucugcagugcuaauuucguucguuugaaugcuuuccuguaugaucugcauuuugcuuucuauggcauaucaaaauaaauguaagucccaggguacccuguagacuuuuccucaucaaaggcuucaacaguuuugcuauuguuuccccuaugaaggcaaacccuuggauggaaggccguccuggugagaggucacuucucacacuauccuuugcuucaagagauuuuuugaaccuaaauauucauuuggauauuuaaauuuuaauuuuauuccgggacaccuuccuggaucagguacaauuuuuugaaguaagauuuugguagcagcacuccaguguggcagaauaguuucuccggggugcugugguuaacuucucccccuaccgggccuugggauugcuuggaagauaagaagauugccucuguuguuuugagggaagacauuccuuugcuucugucuugguugccugcucuaggcaagcuggaaguuuuauggcaaggguucccugcucuagggauccugcagcugcucauauacuuagcuuuuacaucucauauggauuguguucugauccucuuucuccacuuaaaaaggagagaaagaaagagagagagagagggagggaggaaggaaagaaggaaggaaggaaggaaggaaggaaggaaggaaggaaggaaggaaggaagaaagaaagaaagaaagaaagaaagaaagaaagaaagaaagaaagaaagaaagaaagagagaggaagaaagaaagggagaaagaaagacauccccccccccaaauuguuguuguguaacccacagcuuuacuuuguaaccagaggcuguguuuacuuugagccuuugcaguucugccuaaugaaucaacuaguauugaauucacaaaggagccucccugcuccucccuccaucugcuugccaaauguguguguuccuuaggcucccaggaugccgagccaucagcgcagaaccauuagcagccugcuuuggaauccucaauuguuugccuaacuugccagugguauuuugcccuuguggcaauguaggauuguccaaggggaagguccacauuuguaguucuagagaaggcauacauaauauuuaagccugaagucugauucugcauugcugagagcucuaguuuggcccgugagcuuugguuuguccugguaucuuuggaugagauggguaucuuuggacaauagugcugugaccaggacugaaauugcuuggaggggaaaaaagagagagagagagagagagagagagagagagagagaaaacuaucaacugagucuuaguuguuugagauuaggaacccaugauagcagcaugggacuguacuacauuuucacuaaacuguucuuuaaaucuuacugguggcugauagauguguuucugccaagcucauggcuauacugugaacagccauucuuuuaggccagacaucuucuacaugcccaugaucuuuaaggcaguauggguaguuagaggauagagugguuuuguugauguucaggucaaguggaaauacuugucccuuuguacuggagcuaagcaugagaggaugggaggcaaacagcuuuccaguggguucuaaaaccuauucccuccauagaacuauucgauuugagauucuuaggacgucuuacugacucaguucaagggcauaggacgucuuacugacucaguucaaaaguaagcuuuauuuauuuauuuauuuauuuauuuauuuauuuauuuauugaaacccacuuugaauuaccagggcauucuauuacccaaguauacaaaauaaugauucuguuccuugcccagcaaugcaagcgacuuuucuggugcaucauguaaguuauaaaagcagugauuucucuuaaauuuauuuuuaugaauauucuaauaucaucucucauggucugugcuauuucacauagcuugcuaaacaguuucuuaagaauuaagggucaucugagaagucuuuugagaaccauuagcuguuauugcuuuguuauggccuagauaauggacugcaaacuauuuuuaaauauaaggcuacuaaaucaucaaaguuaacucauauuaacucauuauuaauauuaucacauugauucauauuccccccacacaugcuuacacucacacacauauguuugcaugcuaacagucacacacacauacaaacaugcccaugcacacauauaugcacacaccuaauuugugacccacuguaauuuguuuuacaaucuauucuuuuaagauuuccaaguaacauauaugaauuauagcaauaaaauaaagguguguuuuucaaauaaagaauagggaucauacguaaaauuauccaccuccaaaaauaauaguacucguuauugaguaaaacuaggaagauggagcuagaguuuaaaaaucacaagagaaaagcacuuagcuaaggagaggcuggggccugggguuguguaaggaaaggagagcuagcaggcaugaacuagggaggaagagaaccgggguuaacaaacagaagagcucaggagauggcaaagugagcacaugauauucagauuuagagucuucauuucucugcucuuuagaaauuugauuaggacuuuuaaagugugguaacucuucagaaugcagcaacucgucauagccuucugcugucaaagcauuuacugggaauggaaaaaaaacaucagccuaacaagauggauauuauuccggaggccacauugauuuggccacacccuacucuggguccaagcaucccuggcagucaucccuuaugucuguguuucagauuguaguugcaauuguuuuuucgauacagaaggcagaauuuugucuaucuuuucuuaauacaguuacacaagcaaaauugguuauucauaguguuuuuguauguauaugugucuguguauugugcaaguuuaugcauguucccauguauguggaaaaugacgagagagagagagagagaauauauguacauauauggaggucacagguccuuuauuccucuacacuuuauauauugaggcaggguaccucacuugaacccagagcucaccaaagucuagcuugcuaguucacugcagacacccccugccucucuccgcuguccuggcauuauagaugaguuccaaaccuaccaggauucacagaguacagggcucugaauuuucauccucauauuuccuuggcaaacauuuuacuccugaagccaucuccccagccccuauuauucauaacuugaauacugaguaauaauugaguacuagauuucugagcgauccauaauggaguuuuuuuuuuuuuuuuuuugccugcuuugcaagucuaugugggauuuuagaagacgauagcuuauauuguauuuuguaguguguuguuuauacuuacauuuuuguuuucuccccagccaucaaacacagacaaccuguugggaucauccuaaaaugacugagcucuuccaaucccuuggugagugcugcuguguuuaugaguaggccuuagugagugcugcuguauuuaugaguaggccuuagugagugcugcuguauuuaugaguaggccuuagcgaguguugcuguguuuaguagugaugaacggccuucauagccaaggacugaauagucguaaaaagaaacucagcuacucaucuuuucuucuuguguggaugaaaggaucaugcuguggcaugagaagacagugccccgacaugcuacaacaagaguccugaaauuuaaagguaguugcacuccuaagguaaacacacaaagcaagacucggugauuuggaaguguaccagccaaaaggacuucauuuucugggagagaucugauuguuguaggucuuaccucaucuuauaguucagcucugcacacuaaaaaaagggaaaacauaguaacaauauaguaaccucaaauuuaccgauuuaaaccauuuuguuuucuaugugggaaaauuuucucaaauuagcuuacuuaauuuuuaagucauaaacuaaacuuauuuugacagggggaaaaaaagauuucuguuuuuagacugucaguaggcagugacuuucagcuuauuggugagauggccuucaucagguugacaguagucacugaaguuuaguccuugagaaaccgaggcggugcuaagggaggauauggcagcauccugugcuccacuccuucccauuuuaagaccaggcgcacacacuuguuucucuuaaacacugggcucuguugggcacucucccuugguaguugagucugcagaagaaaagcaagagaaaagucacugcuuugcuugauuuagagacugagaugggggaaaagaggcagugaucuuugaguuuucuuccaacucugucaguuucugcuaaccuaucuuuagggaacagaggaagaaauuguaauauucacugguuccaagauaggaauguugauuauuuucauagaucugcuuagaacaaccaaaucugugaaccaauaaaagaagcaaauugaucaggguagacagagcguagaagaacagcccccaugaguacugggaugagcuggcagaugacagaaaacuaauugccccaguaagccaaugacucugaaggagaaacccuguuagcugagcagucugguaguccccagucauagugguaccuccuguuuucccgcagggcagaacuuuuccccaugcucauuacccccacgggucauggcugacacacccacagcacaagacagguucuauagaaaagcagugcaaaauuauuggaucaaagcuuuguguuaugaaagagaaguggaaaguaaggaaauguuuuacuucuguauggcucugaugaagucagguagucugaugagacgaggagagauguucugcuggugaauagaaugaaggagaagccaccuuauguguccagguucuccccaacuucuaugcauauuguucuuuuccuccaaaggggaggacaugauauguuacuuguaguuucaaaugaggauggaaaaggucacagugaccuccauuuuaucacucgucuuggaaaagaggcgucuaagaucugugauuuggucauggaaagggaauuugaguuuccuguauaagauuguuuugcagugucucccaauaagguaugaacaaucauuugaucauauuuuuauagauugaugugaaauuuaggaaguuuuuuuuuaucaugaacucacacauuuuuuuaugauccaaaauaagcaaauauguucauucuuggcauucaguagaaguuaaauaauaagcaggccuuuaacuuguucucuuuuccauuucagcugaucugaauaauguacguuucucugccuaccgcacagcaaucaaaauucgaaggcugcaaaaagcauuaugucgugaguuaucacacuaacugaaucaccuugcuuugggagguugacuuuguuguuaucauuaagacagagacaaauggcgaggcugagguauuugcagagucaaucugacuuucagugccccucauugaaggaguuagcugcauuucuacucauacuucaugauuggugucgucaguggguacuggcaaaaccaaugagcagugccacucgaauucagagugcaaaauuuauccaaacgcaggaaaagcucuuuggaaauuuauacugccacccaguuuuaaaagauuaagccauugaaucaaagcuguagguuguugccuaguaaguccuuuuuguccacuccaaacuggaggcuuccaagcuguuugacucaguacaaucaugaaagagaaaugcaaagcagucacauugcugauuucucugggaacuaaaaccauaaacaugauagaaaauucuguuuuccuuuaaacaugacagaaguuaucugugucauuaauggauuuuucccuguggagggcaugcucaugggauauucuaugguagucauucuaaccaaagguucuuuuuaugccgagaauaucaaaaagugagcagacauguguauccuuguaaauagaguauugauuuaggcuuucuggauucugucuuugcuuggauuauugaccugacccaagcaacauuuaagccuugcuagauacuauuaugcaaaguaauauuugcauguacuuuaaagauugggagauuuggaaaauuccauauaugcuuguuuucuacucuuuguuaagaacuacuaucugccuggguagcucagugaaguuuugaaaacuacccucagaaaaaugguauguuagggucaaaaauugugcuuaaaaccaaucaugggagggcugaugagugucucauauggaagaagaacuuguuguauaugacaaugacuucuguugccggaucucaugguagaaggagagaaccaacuccuguaaguuuuccucuguggacucacaguugcacaccacaccccuccccccaacuaaggaaaauaaauuucaauagcuaaauauaaguuauggauccauuuuaaguuggcugggugagcagagucgagcaaagggagauguucaaucacuuagagaagacagaguuguacaaaguauuaaauaagaaagaccuauguuccuuuuggaugagaugucuaacaggcagagaaacagcaauaucuaagccacggaauggaaggaggaggugaccucaagccuugcguuauccccucaggcucaaagguagucagcauguuguaguaguuacaaaacauguuccagaaugaccuguucaaaacaugggagcucucgcacuugggcuagagaucuguguauugggugggaaugggauaggaagcugacugugaacagaaggcagguugucuaucuccucaaugugucuguagugauaauaguuuugaacccuacauccagcuagucuugucuuuccaggccuguuggguuuuaaaaugagggcagaugacccagccauggacuuuccacuggccaaccacuguuuuguaacauggcgaacauguuaccaauguucuguucugcaccuggguagagagcccucuuuaugcacuaaggguuugcuuucuugguuucucuuacuccugaaggaagaugucucucucuggaucacguccaaacccgagaggagcagaagagcgaaaagauauuuuauaaaguacagugaacaauguccccaguuugugucagcuuaaauagcuucagggaucuccugacagccacuggcaucccucuuuccacugccucuggccaccacagggcuccagccuggagccucuauacuacuugucacauuuaccuguuugaccaaaucaacuuuucucucucaaauucucuguuuacuugaacugcccuggcucaucuuuuauuucuuccugaugcuuuuuagaauuugccucuucuacaauuuucaugcucaucccaccuguuucuaauuuucccagcauuuuuaugauggccugaagcugcuguuuuucacuugcuugccugguguaauaguugugugucaggagguugaccugucucuacacacaguggcuuugaggucauggucaccucucauucugugccugucugcacucagcauagugccuucuugccagcauaaaagagagagcacauuugucuuuauucuuucacucuugcuuuauugauuugguucugagaacaaggcaagagacucauuccacccugcaaagggcucagauccaaagggcacaaugcagguggcuggaagguucaugcuuucagcagauugcacuccccuuauaauuuagggcucuuuaccuggcuggcaucugcuuucugucucccuacuuccuucccuuugcucccaucagcucaccuugaagaguggccuagcagauuauacccaguuucuccagccuaaaagcucugggugccagcucuucacauuugcaaucuucccgugacuggugugugcuauccugugggucucaggcugccagcuaugcuuuaauaccauggcuccucuucccucacuccugguagcuccaucuagucuuuucuuaugugagugugugcuuuuguuuuauuacacugcuugucuuagacacguggucagaaucauaacucuuaauauucuuucuacauacuucuugccugccuuuccaaaauaacuauauuuuuaugagaaggaagagucugugcuguguucuucccuaccugagcccuccuauaguuucuggugcagagcuggagucauguaggccauccugagcaagguucgaguuugaaggugacauagguguguacuagaagacacguaaaagauuuagagucaugcuuuguaguagucagauuuauuuaauuuugacuuacucaaaauauguuacaauacaggaacaaaaccugaaugaacugaccgucagcaucagcaugguccaugcgaaagcuguaaaacuaaugggaaaagacauuugcauaguucacuuucauuuauauauaguucaaagccuuacuauucuauuuaugguacacacaugcuuuuaagaacuuaaaguaaauucaaaguuuagagauuacccucgugaucaugauggcauauaauuacauaugaugcuaguauguucauuuucuuugguguguaacagauuguguauucuuuuuucuucaacacacuaugcauucuauguguuauacacacacacacacacacacacacacacgacuuuuuguagcaggccaugcagagaaguaagagaaaacacuggcugagacagaagcagucccuaugguguuuagaaagccaguguccuuguaucacaguucuauuuacucgaccauaagagccaccuuggauuucggcauguggacacuaaucugagauaaggauauaggaguuagaugcauccaaucaaaugcuuggauacaggucgagagugucaaccaauguauuaugguuaauuagcuuacucaguaucaagagguuucccuaaaucccauuuagauuccuucagaguucauuuaaauuuuguucuugaaauuucugauuuggagguauuauuauuaacuauuacuaacauuacuuaucaagacaguauuuuacuauguagcccagaugucuuggagcucacuauguagcccaggcuagccuugcauuccuccuguuucccuaguucuaggauaagagauguuugacaaagugaagccauuucuaauuucuuuaguauuuugaucuccaugguauuggcuuuaaaguuuggauaauuuuucugucuagaauucaguaguauacaaucauuuucuacuuugagacagucaaaccaaguagacgguguauguccuaaauaguauuuuagcaugaagacaagagagaauagaauggguaggugcuucuugccagagaugaccgaggcuaagcccacuauaagggaagauucauaggacugccuguuugugacugguuuacaaagggauugguaguuggagaauuguaaaggaugaaggagagaagguccuagaauugcuaaagaccagauuuccgaagguaagguuuugauuaggaauacagccagguagaaguuucugagagauggggacugagcagugaaaacaggcugguguucaccacgagacucgaggcaggaaagggaauguggaaucaucuaaagagaugcuguguggugagagguaugagccaucaucucugcagauuaaaacuccaagccugaaagcuugcguguagaaguguuucccaggaagaggacauggugcacacagccaagaccuggagagguguccaaagcccugaaucagguacucagcaguguccuucuguuuuuaucaguucuacccuccccugaccuagaagagggcaugaugaugucucuuuuugaccccugugcuucauaugugagaaucuagaaaagucuguaacuugcuuagaaaacaaauugccuguuuguuccauuuacugcaugcaugacuaagcugucauuuuucucccucugaagagacaaaaaucauaauuuccugugauuuaaauguagucuguucuuuaaaagguaccgaaaugugacaugcuucagcaagaugccugcuuggcuuaggcacuaagucaaagugucaguguaaaucacuggaaauugaagacaggaucguuugugggaaguggcaaguuacugucugggucccagaguggauaacaaggaaggcuuuucugaacggagugaaggguggacugaucccggaaugauguuuuugcaauuugguccauugucccuguguguuuugcggcuggcauaauuaguguuggaauucagaaaucuuaacauucuggcaguaauugaauauauuucuuuguaucuguggagaaccaugcuucucagucgacuguccuugauuaagcaggucccuuugucagaugcuguagaaaguggauuuugcuacugcuauccuagguucagaguugaaaauaauuuauaguaccaagaaauggagcaaaaugauaaugaaaaauauagaugauucccaggucacuuacucuuguguggguuuuuuuuuuuuuuuuuuuuuggcacuauuuccagcucauggaaugcuuaugcaaauuauuuuuguuaguagcauacauuuagagggugauauuguugacaucuaaaagaaaagggacuggccucuuccucagaauuccuaugucuccugcuggagucuuuuuaagaagucuucccuauugaguuauugaagaaguuguauuugucuauguuauuuuaacauauacuucuuuucuacuguagucaacuugaaaaaagaaauguuguuuaaacagccagcauagacauauuucauaaauguacuuaaaauuuaaaauuaguaauuagucacuagcuacaaguacucagauacaaaggaagcuguuucuuugcuuugguucacugucaaacgaugccaugggggcuggggaaguuuauuuauuagaaaagaaagaaguaguugcuuaaauguucucagucccacuuagaugcuuuucagugcuaaaaaccuggaaacggaagaugaagcaaacauuuuacauaauggucauuuccaugagcaaacuuuaaauuagcgccagccugcgauuucccuugccugucuguuacgaauugggucauuuccacguucaguaagugcauagugguuugauggucugcuuggcuuuguuuucaccuugcuaaggaauaacuuuuuuaggggguggaagcuuuguguacaguagcugccucaguaagaccauagcccacuaugugucacaauugauacuagcugccaucuguuuucucuaguggaauccuagaguaauuuaauuucugucuuuucuaaagcaacaucucuuccuggaagauagugcuuuuaaauaucucccccucccuugcuuuccuggaucucuuauauuuugucuaucuuaucuuucaaagacuauuucaaaauuuaccuucuagggagucuuuucaagcuuuccuuuggccaagcauuccuaauccaaacaucugcaaugugaaaaccacaggaucagaagcuuaugguuugcugccaugguugcagaauugcaugccugacccuuggugcaugaaucucaguagaaaugcagucgcauuaaaaauacuguauaagggguuagagagaugacucagcaaaauguuugcugcucuuuuggaagaacaggguucaguucccagcacccacaucagguacucacugaucacucuuggaaggcuccaaaccuucaaggacaucugcagucacaugguguacagauauacacagacacaguaauaagcacuguucuuucaaauuacuuaccagcuuacuuuagggcauacauaagguauacaugaaacauaaaugacaauuguauuagacuugagccccauccacaauagcugcauaaaauagcugaguuuaugcauauguuacaaaaccaccaagaagguagaagguaaagaaaguaaaaaugcaaaaugcuccccuuacagcauuuccaaccaugaguugguagccugugucugcucucucacacgguuguccauccuucucccagguguuucccuccuuccucuuaguaaugugcuuaagaaagagcuccgugcacacccuacaugcucuagcaccagccuuacccuccaucugugcuuuacauaagaagaguaaagaugaaaugaaauaaauaccugaaggccagugaucugugaagcaguaggaauccaucuuagugacagguggucugaaaugcaaaggggcuugacuugauuugggccaauucugguaguugagaauaauucugaugucacucauuucaggugguagagagcuauuacuuuucuaugaaaucugguucuuuuauuuauuuauuuguuugcuucauuuuucuaaaaaacuaucuccggugaucuuuuaaugccauuauauacauuuuugcauacuguuagagaauuguuagcuugacagugguauggagauuaacugcuugauaggccauaauuauauaauuacagguuauaauuaaaacuaggguucuggugucuguuguugugacuauagauaauaaaacuugcuuuacuuuucaaagaguuagaguaaaggauuuuugaauguuuucccugcacacauguuaagaaacguuugaggggaugauggguuacccagauuuaaauaucaccuaguguagauaucuguugaaaucacagaguuccuccucaauauucgcaacuuugguguuucuaugagaaucacuuaagacuaacuuuagagaauuuaaaaagcaguuagaaagugagcuaacaugaggugaccaguguuguuacuugggauauuuuaauguuuggaauaaauuuguagacuacucauuucuguacugaaaaacacagagcgacuauaacaaggaugucaaaaagaaagaaaaauucaaagaccaaaaauuuguaaaagauccaaaagcuacagcgucuagaugaacaggcacaaagguagagagaauauauuugaucugagagaaugaaaauguuaucucacuaacagcugaaguuaacugggaaggaucaguucaugaguuggccagucaagcuaaaagcuggagaauaggagugcugggcuucaauguuguuggguaaggcgaugccucucucuaauccuuucuccucauucaauuaguggaucucuuagagcugaauacgacgaaugaaguuuucaagcagcacaaacugaaccaaaaugaucagcuccugagugucccagacgucaucaacugucugaccaccacuuacgaugggcuugagcagcugcacaaggacuuggucaauguuccacucugcgucgauaugugucucaacuggcugcucaacguauacgacacguaagugugucauuuauccuuuaaaugaucacuagugagcgaagcacauugauaauaaacugggcacuaucaucaucgccuuguuguuguuguuguuguuguuguuguuguuguuguuguuguuguuguuguuguucuucuucuucuucuucuucuucuucuucuucuucuucuucuucuucuucuucuucuucuucuucuucuucuucuucuucuucuucuucuucuucuucuucuucuucuccuccuccucuccuucuccuccuccuccuccuccuccuccuccuccuccuccuccuccuuccccuuccccuuccccuuucccuuccccuucuuccccuuccccuucuuccccuucuuccccuucuuccccuucuuccccuucuuccccuucuuccccuucuuccccuucuuccccuucuuccccuucuuccccuucuuccccuucuuccccuucuuccccuucuuccccuucuuccccuucuuccccuucuuccccuuccccuucuuccccuucccuuuccccuucuccuucuucuucuuucuuccuccucguccucuuccuccuccuucuccuucuucucugucacccucauuaaugggugauacuaaaguuuuaacuugggaauaaguuugcacauggcaaacacuuuaccauugagcuacaucuccgacccuagugugauuucuuuaaaaagauguuuucauaauccucucgcccaguagaaagauuuauucugauuguuuaaaaguaacugguuuuccaaguccuuuugcuccuaaccauaggauaagagggaacauacaaguguucuuucgugacuuccuagucagugaaggcuggggauguagcaugcauucucuuucaggaaacagcuagggaaaccugagcugcaugguuucuuuucuuucucucugcuccuuacuaucuuagauuauuauuuuucaacaggcaaacaaaagcugacauucacugugaauuaaaaugauuuuuagcauauaagaaucucuauaacuuuguaagguggcgguuugaguguaauuuggacagcagugaauaaaacuugguuuguccuuaaauaauugccauugugguuauguuuuucuaaaguggucuugccuuuauaauugaugcuauaugacacuaacacauguacuugaacuguuucucaguguauagaaggagcacccuuaacuuccagcccagcacaucccgcauaugugugacccuuuugauuuugacaauguauuugugcacuaaucaguuaucaaaagacuugcugugagcugacauuucagaaauguugggaauuauucauucucugguaggggguugaaguaugcaaaaaugaaagaggaaaaugaagacuugcuuuucucuugaaucucaaaacuuaguucucauuaaguagcuacaugaagauuuacauuugucagccuuugaucugaagacagagaagguaaguggucgucauagacagagaauauagaugauaguucauaaauguacauguucugaagccgauucauucuguguaaaugaugaugauaauagacaugacuuaucuauaauuuuaucuacuccuuucauuaggaaaagagauccuuuaucuuucaguaguaacaaauaucaauauaucuuuuaaaaaaauaaaauaaaaggauagccuugugagugagagugaagcucaguuaccagaaagagaagaggauuuacuguaauacacugcugccugguaucuuuuauuaugcuuuuuaauacaaaguuguaauucuucuuggauacaauauuaauuuuaguguaaguagcucauuaauuugcucaucacuauuucaaagucucaaaggacaucuuuucuacaauaaauucaccgcaaauagcucguuauuuccguguuuucugugcaguagccuguaacauggcuucccaucucagaaagaaagcuaaaugagaacgucuggggacuucaucugacucugaaauagcaagaggaggacaacuugaucaaaguuucuggggaacaaucugccccccagcagguuccuacuaugacaauuguagauuucuagguugcugaaaccaaaccuaguauacuagguugcuuaaacaucauuuccucacaucuguaaaggccugaagacugagcucacggugaugguggggcugacugcuguguuguuuucuccagaacgucuccuuggcucuucaguuucucucuucuuuccauaaagagccauaaauucuuucuacuugcucuuuuuuccuacaagugcaccaggcauucuggauuaaggucuccccuuccaucuucauguuaacugacucuugaaagaugcuguuggcaugaaaagcaguauccuaagauacaaagaguuaggacuucagugugcaaaucgagaggaacacaguuaagcucagaacauauagagaggaugcuguuauucuagaaugaggaggcagugacucuuuguuaggacccacccagugugcaaaauguugugauucauuucugggaguuaaauguuggcacaaucccauuucugacugccagaugugaacacauagaaaugcuacauagaauuuuuuuuucuacuagaaaaacaauaccucgaaauaugccauuguuuuguuuuuaauggauaaaaaaaauccugcaaaacuuacuuccccucaauaccaaugaaacaucaaucaccccucugggucagauggguucccuucggucucacuuucuauugggauaaaugaauuaagcuaagcauuugaaauuugaaauguauauaaagaaaauaucuaauaaaaaacaaauaacaaauuaauuaagcuaaggaaaauucaguuacuuuguaggcaguaaucacugauguccagcaaugacuaccugaguuucucuacuucauauggcccauucguuuaucugagcaaugacuguuaacucuacuucaaguaaugguccucugagugacucugaucaacuaacuauaauuuuacucuacccagaguagggaucuuggauauuacagaaccaucagaaggcuuugaacuuaaaaaugaugccuguguucagcuaauuuuuuaaaaaaguuuuaugugacagaguuauaguucuuuaagaaaauauuuuaauguagauuuacuugaagcacagguguugggggagcgaaagaguuucuuaggaaauggacagugaauucccaagagaaaagcagaccacuugaaagaguuacauugauuuaccuauccauccaucauccauccauccauccacccaucaauucauucauucauucauucauucauucauucauuguuuggguuucuauuguuguaaaaaaacaccacaaccaaggcaagucuuauaaaggcaaacauuuaauuggaguuagcuuacuguuucugagguucaguccauuauuaucauggcagaguccagauagaugugguggacgaacagaguucuacaucuugaucugauggcaauuaggagacugugucuuucccugggcagagcuugagcauauauauuaccuaaaggccccgccuccacagugacauaccuccuccaauaaggcuacaucuccuaauagugccacuucccaugggccaagccuauucaaaccaccacacaacacuaucauaagcaggugaugaaaucaacucacacagaggaagauaguuuuuggauagucauuugagagguuucaacccaugacuggcuugccccugacuguaggugagguagcacagcauggugggaaugcugguggaccaaacugucaucacaugacccagaaaugcaagaaagggaagacaauccuguuuucuucugggaggguuugccucucagaggucaucuaauagguucuggcuuuuaaaguuucuccugguccucagggaccuuuucagauguaaacuguaaacuguuagguauuuucaacuccuugauuuauugccauaugauguaaccagggcagaccuucucaacgucaacuugaaauaaugagucaugcagauagaggagaucaaagaauucuaauacacauaugacuuagagaugagauaugaucuuuccauuuugcccucuauuuaacugauuggaaaacaaacacauggagauaccagaguuuuucuguaaccaccuguuacaaaucaaucauaguuacagggcuaacuuguagauuuuauuuccuugguugcauggauagucuuaucauauugcuguagcuuagccaugacgcuuuauaaaaucaacuaaacuuuugaguuuuaacauauacccagcuucacgucauauuuucaguuuugugcccugguugcuauguuacuuggcaaccacuuaacuuuuggcaucucaguaucuggaaaauuuaguuaaaaauaaacacacagcuuaccauacaaaaggugaauacuaggggcaaaugagcuaauauauauagaaaggggcuuuauaaacuauagcaaucaaaucgauuccauuuaugaauucacagccucacucugucuuuaucuugccagguucaaaagucuuaauuucacaaucuuccuucuagauuuaauggaaauccaaaucauuuaaaucauacuucagagcaauagucuggaacacuugguucaaacauuuuuuuucucuauagagaauauuagcuucauuuguuauaauaagucauauuucucccacuauccugagaugaauauaauuuugaaggcacuuaacuucacaguuaaacuaauuucagaagucacuuacaaaaacuguccugggaauuggauacuuagcuauugggcuagaucgcucacucauacauuuuauuagcucucagaugcaucuccaauuagauauccuacuugacaucaaaauagucaagaauggccccauguaugcacagauuaaucagccagugagccuguguauaaaugcucaccccacccuauguguuggaggggguguguuugcacccacaccuauguucucuuacgcaggcgugugcuaugacaucucauguaugucugauuguaaucuucucuuucuuagagggaggaggacaguacuagggauuaacuagggcuggcccacuccauguaaggcaagcacucugccacugagcuccaauggcaggccuuaaguuugaacuucuugauuaacugugagaggcugggaacuacucaaagugcucucucaaaaaccuaccaaccacagucaucuuguauuugguuuuucauuuccacacauuaggguugauacuguauuuucuauagucacccucuugucuuacuucccuagcuaguauguggguuauugaguaagaaucagguucucuacuucuucuugaaguucauggaacaauucugggaucuuagauuacaguaagccuuuacagcugaugguagcugauugacauuuucaauugucuuucugaugauguagcucuccuguuuucccaguagacuuggaagucagcucuacugguaucuuucugaucccuuaaaggacugguuuguuuuuaccaacauucuugcaccaaucccuuagcuacauucauucauuaaccuuuauuacuuucuaaaaguaaauugccuguguucagaggauaaacacuuuccagcucuugaagggaauaaacacuauuucauaugauaauuuggaaaacucuacaaauauuaaguagaaacaugauuugaaguauggcucaguuuauuugaaacuggcugguauuucuugacucuaggcuagguuaggcuagaacuugucauuuuucugccuguugaauucucagagguugcuaccauccuuagccauaaucuaagcaugcuuucuuuuucuuuuaaagaacauuuauauguuuggugucaugcuauauaugcagacauuuacuugaucauuuaucacuugaaaauggaagacuauuacuuaguaugacuaacaaagcacauuacagauguuuauguauuuuucaaauacuguaaaucacaaccuguauuaguuacuuuucuauugcugggauaaaacacuguguccaaggcagcuuauagaaagacagguuuuuuauggcuuauaguuccaggggcaugggagaccaucagcaucaugguaaagugccaaccauggaugcaauauggggccuggaggagcaagcagaguaagagaacucaaaguccgccuucaguaacaucccuucuccagugaggacacaccuccuaaaccuacccaagacagggccacaaccagggacauagcucaaaaacuaacauugcuuauucauacaacuacacugucuuaugugcccauauaguaagugaacauucgcuuauguguuuuaaacguucaauauguaugccuuaaaucuaagaaauuuuagagaauaaacccaagcugaaaacggaugaagauuaugaaacaagaaauauagugagaagacuuuuuccuggguuguguguuguuccacuggaaagaucauguucuguuaauuuuauggugcuuuucugcaucccagggcuuguuuaacagcuuaauacuuugauaggcauuggaauaaaaauguguguguguguguguguguguguguguaaaaucuccaguucuuaagugaaauugaaaugauguuucacugucuuagugugaaaguauuuccuagagcugacuaauuaauacauuccauuuuuaauuacaauuucaugcuuccucuaauacagauaucaccccagccuauuugaaaccauucacuauuaaaauugcaauaauaauuuauagacuacauuggcagagaucaaagugaaugaagacagcaaacucuaaaguuucauaagcccugagucuucaacauauaauuuucuacguauauuuuuuuuacauuuggguuuuaauuuauuaguauucuucucuugcuauauaauguugcguucauauguuguacagccugcuugcuaucuagcuuugaugcguauuuugauuuuacauuuaaaaccaacagauuucaguuauagcauuucuuuaaguaaaaucuauuuggcuuuaugauuguuguuuuuauauucauuucauguguucuugggcugugucuuguguguaaaaggacgucaguguauuuuucuggacuuguucaaagauguugaacugucaugaaguugugauguagguuuggcaguaaugguuaaaaccaaguagacaaguugaaucuuuaacucgaauuuauuaugcaguaguuuacucccaagaaaauggcauucaacuugcuguguaaaugcauauaacccaucuuauaauuucaggggccggacuggaaaaauucggguacagagucugaagauuggauugaugucucucuccaaaggccucuuagaagagaaauacagauguauguaagaccuuuuacuccauggugcuucuaauaauaaucuaaauuuauugggcgcugacuuuauauaguuugcgguaauguuagcuuccaauuggaggugcuuacuauguguaccaguuugaacaaagaugacaaugugaagagaauuuggaugauuugaaaaacugauuguggggcaagagugagguguacagauacagcacaaacuaagcacaaauguacauucauuuaauauuagaauauucuaguagguauuacaacucccauucuuuuaggugagcaaauuaaugcugaaauaggucaagaaucuagucaaaggccguaugacccauuaaaauguugguguugagcuaaggacuccauaacccccuuuuuuuucucucuuaaaaaucucauuucuuccguuuauuguagcaaguaguuuuugcuaccccacuuuaagcuccagguggaccacacuaccagccccacccagacucccuugcauccauggauuaaaaacaacacacauacucuccagugagucuuagagugcuuuugcuaacucagugaccgcaacugaaaacucacaucacugguuggcuuaaucuccugcugcuacugccuccuucuucuuccccagauucucccugaauccuccuggguaacucuuaaguaucccaccccauccucagucauugauuggucccugguaucuuuauugagcaaucaagaaccaccugggaacaggaccuuagcauuagacucccuacaguuuaugguuaaugauaauuagaaaaaaaaaagaaaagaaagaagaaagaaagaaagagagagagagagagagagagagagagagaaagaaaggaaggaaggaagaaagagagagagagagagagaaaaguaagagggacuaaaacuuuuauuagccuuuauucuaaauaguauuauuuuguaauuuggacauuauaaagugauagaugcuuucaacuuuuauuucgguuauucaaguaagugccucauuagcuauugauuacugaacaaugucuuggcaugcucaagagugggaccuguaguuauaucuuucccacuuagugaucaagugucauuagaugggugucuugaucccuuuuaguacgucuagccaaaaguaauauuaccacuauuuccugguacacugagcuguacaccagagggugagagaugagaccaacaauuguaccauugggaggaaaucaagguaauagauuacaaauugucaaaaauagcaguggucaaguaaaugauuaccaucuccaugugucuccaaacucauugccauggugacagcaugucguuuaguuuuauuuguucauaaaauauaaguagcuugaugcugccaagccuacuucuagaugagucugugcaaauaaaucuguguauuuggaggagaguguggauaauaauuuuugaauagaaagauaucagaagacaaaaauggguacaagaaaggaguaguaguaugagggucuauuaauagcucagugguccaucucaugcuacgcaauguccuugcuccuauccccaaaaucaagaaaaaaauuuuccccaaguaaagguaugugaucauuguucuuauaaccuaagucaauugaguuucuucuaaaagcauucaacaucguguauuuuggggauaacuguuauuguuugauuuaaaugucaagccuagaauccaaaggcaugauuuucuuacaaauguuaacaagaauguucaagaaagagcuguggguuuuguacagagcaugagcuuacugaagaaccaggaguugaggaugcugaagugugucugagccuugcaagccauguagagagacgggaagaagcccugaauaaauaaaccuuacauaaaguuuugucuaugguccuuugucuagaacuucaggaaucuucaccauuaucaggaaaagauauuuccaaagcggagaacuugccauuucuaaacugauuaggaaaggaaagaauuacugaaaaaucaguguuccaaaauuaggaaaagauuuucuuacuaaucaucugugauucgggguuuuucauacgcucccaaaagacuuggggcuuuaaaaguaacaguuacaucauagugcugaauggacucuaaaaugaaugcaaauucaagcucaagauuugcauuuucugcaaaacagcauuaagugcucacauuugggcaagaaagcagaggcccuugcauugcaaguuucuacuagucuauauaacucaugauggaugucacuucaggacauaauuaaauaagaaaucucuugggcuaaaucuuuaaucuaaaucuuuacuuaaauauugaggcccuggaaauguccugagguucaguuuuguuucuuaucuugagaucuugagcaacuccgauuccaccuuugauuuccccaguguugugggaacaucucuucauuauuauuuucuuuguuaaaauuaauauucaaaacaaacugcucguuagccucaguaacaggaggcauccaucugaaaagcauuuugcaguggcugauauuagagucuuuguccuacuugugccuauuacuugugacuuacugagaaugacuuuggagugguuucugacauuccaugggccguccugcaaauggccaggggcuugcuggcaucagcagaagcacacucaggaagcaucuuuuggagagccccuuggaucuccucugguuuguuuuuuuuuuuuuuuuuuuuuuuuuucaagcuugucucuuaguuguuucuuuccauuuuuuuuguuaauuauuuauauuucaaaugcuagauugcucuucccaauucccccuccucgagcuguccaucucauccuuccuccccccaugcuucuaugagagugcucccccacccauccacuccugccucaccacccuagcauuccccuacacuggggcaucuagccuccacaggaccaagggccucuccucccauugauacuagaaaaggaacuccucuguuacaugugugacuggagccaugggucccuccauguguacucuuugguuggugguuuagucccugggagcucugggggaaggaggucugguugguugauauuguuguucuuccuaugggguugcaaucccuuuccguucuuucagaccuuccccuaacuccuccauuggggucccugugcucagucugaugguuggcugugagccaaccuccucuguauuggucagguucuggcagauccucucaauuaaaaacuuguugugacccauucuucacauccucugcauaccaccucuuguauacgcuucuaagaauaagaacgcagugcuuggugucacuuuuucuccaugcacaauacacuuuuucuuuaugaguagucucaccuucgcaguggcauagaagcuuagcuuucagccuagaugugggaacguugggcagaacugaugcucuuaaaaaugugcaccucucuauaaggaucauuucacaugcacauagaugcacaauaagcaucaugguaagaauucggggccaauguuuugggggagaugauagccuuuuucaaauaauauaacaaguggagcucuauaaacaaaucuaaaugaacaaaugauaacaauaauuaauuuuaucucagaugaauuuccuuccccuucuugugcuuauauaauuaaaacuguauuucaugauaauuacugugucgauaucacucaggaugcuucaguuuggaacuucacuguugacacuguuagauaaggggagaaugacguuuuaucugcuguuuauguuuuggauauuauuugaaaaugguuugggggaacaucuuaaauauuuaauauuuaaugcuucuucuuagcauuacaugacgaacauuuaaauaguauguuuuuuggacuguuacaauucaacaaugccucccaaaugugucaguuuuuaugauaaaaggaauauuuuuuaaugaggugugucuccaugcagaaaaaguaauguccuuuccuacauuagcuucuucauugggaaucuuauauuaauuauuuuuuuucaacuuuuuguuagauauuuucuuuauuuacauuucaaaugcuaucccaaaaguccccuauuaccccacuaccacccugcucuccuacccacccacucccacuucuuggcccuggcauuccccuauucuggggcauauaaaguuuguaagaccaaggggccucucuucccaaugauggccgacuaggccaucuucuuauacauaugcagcuagagacaugagcucuggggguacugguuaguucaaauuguuguuccaccuaaaugcagaccccuuuagcuccuuggguacuuucucuagcuccuccauuagggacccugugauccauccaauagaugacugugagcaucuacuucuguauuuuccaggcacuggcauagccucacaugagacagcuauaucaggguccuuucagcaaaaucuugcuggcaugugcaauagugucuguguuuggagacugauuaugggauggauccccagguggguuagucucuggaugguccauccuuucgucuuagcuccaaacuuugucucuguaacuccuuccauggguauuuuguucccuauucuaaggaggcaugaaguauccagguacauuuacacaauggaguacuacucagcuauuaaaaauaaugaauuuaugaaauucuugggcaaauggauguaucuggaggauaucauccuuagugagguaacccaaucacaaaagaagucacuugauaugcacucacugauaaguggauauuagcccagaaacuuagaauacccaagauacaauuugcaaaccacaagaaaaucaagaagaaugaagaccaacgugagaaucuucuauuaauuauaauccucaaaauguuacccauaguagaucaaagauaaauauccugggaagaggaguuuuaauguuguugacuuaagaauauuagaaaacaaagcacuguuugccuuguuuaugcauggaaaagccaaagaaaggcaaagauacaaacauuuuuaugucuuaaaauugaaagaaaaaaauguuucauuacagaaaauaacuuauuaaguuccuaaaaugaaaagcuaaaccuccuuauuuauuuuugguauuuauaauacaaaggagguaugaauauaaacauaccuaaaauaagaugaaauguucgugcauaggauauugaauuugugagugaacaaagaaguuaauaaaucaauuguaaaaugugaagcuauccuuuauauacuauaugcucuagcaaauuauaagggaaccuuuguuuugccucaugcuuuuucuagggaaugccuuagacuauaaaauuaaccaauguacauuucuuuauaguauuuaaaacaguaauuuucuauuagcugaccagauuuaauguaauaaucuauaacauaagauuauucuuuuauuuuuaaagauuccuuuauguuaauaagauuauucuuuuauuauuuauuuuuauuuauaugaguacacugaagcuaucuucagacacacaccagaagagugcacuggauccugcuacugauaguugugagccaccauguggguucugggaauugaacucaggaccucuggaagagcagucagugcucuuaaccauugagccaucucuucagccccauauaagaucauucuaggacaugugguucuguuuacagauggcagauuaagacaccugaucuggauaauaucccuccuugguuuuguuuuuuuuguuuguuuguuuuuuuuuguuuuguuuuguuuuguuuuguuaguuuuugugggguuuuuuuuuuuuuuuuuuugguuuuguuugguuuuugguuuuaaguugacauaguuuaaucuaccucaccgaagauaacgcuuuaaguaagauaauguuuugaguagguagaugguaacaucucguucuucuucuuuguaggucucuuuaaggagguggcagggccaacagagaugugugaccagcggcagcuuggccugcuacuucacgaugccauccagaucccuaggcagcugggggaaguagcagccuuugggggcaguaacauugagcccaguguccgcagcugcuuccagcagguaggcaugggcauuauggguauguaugguguguugagaaagggacuuaauguuuccaagaagggagucaguugugcuagcaucaaacaguggagguuucagguaucagcccucuaagcugaugauuucuuucuuaaguuacauuugacucaaggcauaguaaaaccuugguagauauacaucuuuuucagggacuauacauugaagugcaguguuggaauugcaacaugcuggcucuguacucaugucugugaccuguccccuugugcucagcuucucguaauacucacuucacuccuugauuccugcuuccaugcccucggacaugcacucuucuguuuagaauguucuuccuuugugugcacacacucucuucucccacucguucuguucugucuuuaugugcuggcuuagcucuugugucugcucaagcccuaucaggugaagauccucugcccugucaugcucacuacagugugacaucauacugagauauguaauuaauugguuuguauugcuucuuccuuguccaccuaagcuuccuggagacaaagcuaugccuucacacgucucuccagucuuagucugcucaagcugcuauagcagaaucuaugaacugguggguuaugaacaacugauguuuauuccuuaguuggagaggcugagagccugaagauuaagguuccagcagguuugacaugugcugaagaaagcuuucugacagcguuuucuuggccugcccaaugcacuucagaagaacaaucugaugguugcucaucccuucauaauacguugaaccucauauugacuuugauacguuuucuuauugaaggaauaaaaaugcuuuaguguucucuguggagaauauccuuuaaaauaugaaagcauuacaaaaacagccaucuuuucucaaaugcacauacacacaaagucauguacaaauuuuugcacugaucugagcugcuaauuuucaccugggcaaaagccacaguuucuuuuuuaaaugcuuacggugcagaagaacauuuauaaaugcuacugaugucauccauaugcauaaaguuagaagccuacagauauuuuuccaaagcagagccaaugauuuaucacuguugagcgaaagaaaugcucacacgguaucuuugaggagaaucaaugucacggguuauuacauuuuauaauggcccuuuuucuuauuuuagaaauaaaaaaaugcuaaaugauuuuuuuucuaaauaugauuuauagucauaugugucagugcucagaaugaccucaaccccugcgggaagaggcaguuggcggaauuuaccucugcucucacccacaaucauucagcauuaggauucaaggaagacuugaguugccucacaaagucugucuugaugagcuuagagaaccuaucugguggauccgggcuggucugccuccagugugaugcucugauagaacagaggcggggcguagcaaugacuccuuuugggaaacauuuguaaagcucguguagagucuuccacuuugucuggaaggugaggaguccucgucucguacguuuaccaucuuagauaaacuugugcuacagaauuaaaggcuggguuaccuggaaucguguggguuuucauuuugcuuccuuuuucuuucuuuuugauuugagcacagagggacuagguagacggcccaguuaaagggaguuuccguagaagccugaggacuugggauuuaucuccaugacccgcuuaagucacguguaguagcgcauggccuguccuuguaaucccagcaucaauguagcagagacaggcagauccuugggcucaaucaaugaaaggcuguccacgggccuccucauguaugugaccugcaugcaaguguaccugcauagaugaacauuuaaaaacccacaaauaaaaaagaaaaucugagcacuaaggaauugccccccccaaccauauggcaauggcugcuucccuaccccuuccugcauucuucuaauuuuagcuucuagaauuuucuuaccuuaaagaaccuauugucuuggcuggccuggagucacuugacuuuucucucgugccaauuugcagcagcagcacuugcugcagcuucaaugaagagcuguucuucacuuucugucucuucccccagaauaacaacaagccagaaaucagugugaaggaguuuauagacuggaugcauuuggaaccccaguccauggugugguugccgguucugcaucgggucgcagcugcugagacugcaaaacaucaggccaaaugcaacaucugcaaagaaugcccgauuguuggguucaggugagaagcacuaagagaaaucagaacucaauggucucugcucuccucauauggccaucccuucccauuuauuccugcuuggugguuugucuuuggaguacauuuaugcuccacagcguccuucuuuccaauguaccauuccuccucaugaucuauacacaaacuuauuuugauucuuguaguuauuuguaauacuuuaguccagaaucagaaaguuuuauaaauauccuuucacugaggccauaggaauaccugcgcaggauaauugcauuguagauuagguacauauagucuugaucaaauuuguuggcuguucuaaguuguuugggaucaaaguuaguaagacaaaagcaauauguaaaauaugagcaagaaguuaucagaaaacuguuucgugugcuaaguuuguugugaucaauucuacauuucaccugcucauuaauucuguugauugucuauucucucucucucuccaucuccuaccuuuuucuuaaugagcauguauguauauacuccuggauauguguacaugugcauggagaccagagauugaggucaaguaucuuuaucuuucucaaugacucuccagcuuauucuucauccagagcucucucugaaucuugaguuugacgucagcuaggcugaguggcaugcccugggcaucguccugucucugcuuccccaguauucagaucaucucggguugcuggugcaugccacuagacucagcaucuuuaugccaacucugaagaaucugaacucagaucuucauaguuggcuaagccaguccugccacacucaguccaucuuuuuuucucaucgugucaaggacacugacuuaaagccuuagaggagacuguguaggacucuuaccuuggucuucacaggaugguguguuuguucacguugguuccuucauuaccucuugaaaaaguaugccacauucuuuuccugggguuuaugauuucucagaaauaguuauuacauagcuauuaguauaugcuuuaaacauuauugcugaucacauuauuaguuauggucagccaaaaaugauaauacacugaccuuaugaguaauauugaacuuuucuguaaaaguggagacaugaggaauguacguguguaagauuuauuuuuauuuaugcgucuguauguguaugcgcauguaugugccugugugugcacccauagaagaggguguugguucccucggagcuagaguuucagaugguugcuagccucuguauggguucugggaaucaaaucugcaucaccuggaaguacagugaauguucuuaauugcugagccaccucuccaguccuucaaauugagcuuuagugaaaucuuagaucucuaagguguuuaccgagcugagaauuguuucauuucaaauuccacacagcuggucacaguagcaugaauaacaggcaggccucaucuccuuucaugugaacaaaaugcuaagagauaugccaaggcuggggcugcaugcucaucuugacucucgguuuugccugccuucauaaucucuguuauccccaacccaugacuugaauuuucacgcugaucuccacuggcaaauuggcuccucuggaugucauuucugccuuuugaagagagggaaaagccaugcccuucuucccauucaauuggucccuuaaaaucccaagggaaagccuugcccaagacuucacccuguauuguccugcuuaccaccaucagcaagcaagacugagaaacagcaguuuuagcaaagcacauggcuaaaacauagugacagugcaagaguuucucccuggugaagaaaagggaaggguugcacuaaagaagauuucacaaaggacagacaaugccagccauauuugucaaccuaugagaaaagguuaaaagauauaagugaucuaucaagccaggagcauaacaaagcugguauaaauagauugucuucagauaacuugcauuuuugcaugucauuuuaaaaguccuucaucacuugauaguguauauuaaccucacauaaccuuuacagugucuuucuaguuugacuuugcuagucuuggcauuuaaaaugucccucuacagauacagcuguaauguauguuucuaucuauacagcuguaauguauguuucuaucuauacagcuguaauguauguuucuaucuauacagcuguaauguauguuucuuaguucccccaguugucuuaacugagugggcuauuuggggagcauuuuccuuucagacuccauagaaguuuaagacuuaagaguguuguuucugcaaauagacaucagugcacaggguuacuuucuacgagaggcuuaaaacauuauuucuuucaagacuguguaaugaucaagguuucucucucucucuuccuaauaacgauuuuaaacaaaaccuaaaaaugcucaagguagaaacgaguguucuuaugaaggaaucuuauauucauuucuuaugaguggucuuguugauauuuuaaaauaaugugugaugcucacugucauaacuuuucucuaucauuuccucuccacacucagaucucaugcagacucuucugacauugauucuagacuucacaucauggguaaacaugugcaagcauguuuucagacucuuagaugcauuuacacauguuuaucaucuuucaugguaugccugcaucuaauucucaguaauaaagaaaaaaauuaauuaaaaaguuuacaaaaccuaacuuaggaacaaggcuucuaccuuccuucauaaucugagauccuuuuuaacaaauacuuaaauuccucuccccuuguuagagagauaaacuucuuuuuuuuccccccuagagcaagaacaagcagaagucuuauuaagacagacaagacacaaaauguacauaaaucuaaaaucuaauguaaugugacuaaauuauaaacgcauauaccuuccucuaacuccaacuuuauagaagcaaaagucuuacacuuaauaaaaauauacagaauguauaaaagcuuacuccagauugguuucuuucugaauagggucuuuucauauggaaaccucacauuaugucauuuauccuugguagucuacaugugauuacagccaucgcuuuuaaauugacacugagaaacaucaucuugcauuuguagcagaugcgcucuugguuuccuaagugcaaagcuuguugcuaaggcacaggguuggguucaguggcaggagugaugccuguucuuuucuccaccacagauacaggagccuaaagcauuuuaauuaugaugucugccagaguugcuucuuuucuggaagaacagcaaagggccacaaguuacauuacccgaugguagaauacugcauaccggugaguaucuuuugaaucuacugagcaguuauaucacugguuucuuaaucuuauuuuuauuuccuuauuuguuuggcugauugguuggcugguuguuuguuuuggauuuuuugagaaggguuucucuguguauucuuugcugucccagaacucuuuuuauagaccaggcuggccaugaacucacagaucuaccugccucuggcugccaagugcugggauuaaaggcaugugccacuaccuccuggcuaguaaugacacuuuuaucuaauacauuuuuacuuaacuauuuuuuaaaccuucaaaaauuuaugguuguaaauuuuguuguuuucuuuccuuuuaaauauaaguguuucuuauguugaauuaagaaaaauucuacauuauaccaaauguaauuuguuaacuuaccaaauauguguuuucauuuuaaacuuaacuuuuuuggaagcauauuaagaacucauacugauuuagcuaugaugaaaaugaaaccacuugcugaaaacaaccauguuucucuuaaauuuuuaaaggauguuuuuugaaaaaaagaguuauaggugaucaaaaaugaaaaauagagaaauuaaaaauucauccauacauuuaguuucugaacaaacuaccuucuaauauuuaagcauguucuaauuuuauaaaacauauguauaguuuuacuugauuuuuuuuuuaaagacauuguaugucacucauguagcaugggauggccuggugcucacuauguguauuaggcuggucuuggacuuacugagguccaucuaugucugcuuucugagugccaggauugaagacaugcacuaccaugcuugcuaauaaaagaauuuucuucaaucuggaguuugucugcccccccacccccacccccauuuuuccuuagacaauagcuuccuggaacaaaguauuaagugaaugaauugcuauagcuggccuaaccaucuuuuagauuuaagucuuuaguuuccuauaaacagcauuuaagagcauuacugagaagguaacauuuuauauguguuauauaaauuacauuuccuuugggcaaaugaccagaaguaggugagcuaggucaaugacuaugaguagcucuguggccaaaauacuuaaugucaaguuguuuuccaaaagaggucccugccaccauaucauacagucacauuugcuaauguguucauuuugccauagcccccucacacuggacacaguuaugguuccuuucaucuaaaguugcuuuguccuaagauuauccucauuuucugucaauagccauuccuuaguuuuguuccagauuguggcaaaauuuauuuauagaguuguauauuuucuuugguuuagagaauuaaguaacuuuuuagcccauaaaucuauacaaaggcagcaguacuuguaaaauaugcacauauaauucuccuauucuugcugucuuauuuuaagucaauagagauucuuucauguggagaggaaauuucuagaaaauguugcugaauuauaauggaugaaauaaucuugaugcccaacauuaacuaggaaaauauugcucccaaugaagcuggggaaauaucuauuacaguuauuaauuuauuuacuaacccaguuaauauugaauucuuacuguaugucuuacaugauuaucaaagcuagcugcuaguugaagugguaggacaguuuauucaguagaauccacauguaugugugaggaguaugucuguacacauaguggagugcucagaaguauuugagcaugugagaaggggauacuggcuuggcagugagaaggacagggacagagcuaagcagaagacaaaagaaaagugacaaaagugugaugcuggagaccagcugugucuccaguuagagaaguuaggauaaaucuccauaaaaacuggaaggcauugccuucuuaccuaauaaucuccuuucagagaaauggcuuucgagguccucaaggacaaggcuccugaguucuaagcgaucaucugcccauuucaggaccacaccaagguuuccgacuccucauuccuuuuugauaaguccucuuggaguggucagggcucauuucagugugacauuacacagacaggaaauguuuugagcagcauaguuucuacaagguaucuacuuguucuaugcuguuaugugcagcuggaggucauaagaaguaugcagccuugagcuaucagaaaucaaggugaugccuguucaagucuuuuaaaagaggaugggaugggguggauggaacaauaacugagaauguguuauuuuuguaggucagaaauucgacagaauagaaggcuaugaaccuuaguuagauccaagagagaaucugucuuuagagucaacucuaaugguuugucgguugucuaggaaagacaagauuacugauguccccacugcugucuauauaggaagaggaaauaugugauacugagcaaggcaacagagaaaugagaugacuacgggucuaguggcuguauuugaaaagcaggaugaggagaugggagaaaccaucuuagauaagagcaaucagguccaguuugagaagcuaacauuuggauugaauaugaagguggagagauucagcaaccauguacagaaugggguagaguaacaaggcauugagacggaagaagcagcagucucagaaagaacucugauagcaggcaagaggcugacaagaagauauagaacagaaguggaaccuguccuucaaacaagacacagggcaggcugaagugccuagagaaaaaugaaaagguaggguccccuguucaaaagauacuaugaauuuccaagugacaauaaaggaucauuaaacugagcuggggauguucugagcaugguagcucugcgacuagcuaggccuucugucuaaugacaaagacagugggagaacaaagggccugaugaaauagugucagguuguacaaugcucuucagauccuuauaauagauuuggauugggaagcaguauaauguuaauauuuacaugauaauagcuagacauuuagggagcugauuauaaagaucugguauuaaaugggaaaaucaagauaaguggauaaggguagaggaaugacguagaauuacuguuuuuauucucacuaaauacaauaauuuuaaauaaauucuuaacauuucuaagcaaguugaaagcaaggcauguuuaaugaucauugaucaacggaagccuguuugcaaccaguaacacauguaugaaguuuccuuuccuacuacuaauguugaauuuaaaaagaaaacaaagcuccaagucagcaguuuucaaccuguagaucacgaccccucaggucgaaugauccuuuaauaggaaugccaagaccaucagaaaacacagauauuuguauuaccauuaauagcuaacaaaauuauaguuaugaaguagcaaugaaaauaauguuaaccacaacaagagaaaccuuauuaaaggguuguaccauuagaaagguugagaaccaccgcuuuaagccuucccaaaaucuuucuucugugugguuauuuccaaguggcuuucauuucugagguuccaucuugcuuuuuaauuuccuggaugguaucauccuuucggugcgggaggggaucauuucaccuuuccugaucuuauguggcaauccuaucuggguuaguuucuacauuuaaccuacaacuucuaguccauuuuuaucugauuuguguugggaaucagccccagacguacaugcaugcuaggcaaacaacucaccacagagcaugcuagacaaucaaucuacuacagagcuuaacuuauaaccuuuccuaacuucuggagauaugucuguaaacugagucuuagaggcauagucuugcuuuaaaugguaugaugugacuuaauuacguuccaguguuuuucaccuaaauccuuuagaccuuuuccauucuacucucuucguuauaaacaagcuguauguauggcccauucaucuuuaccuugacaucuaccuuaaaaaaugggcuuaaacagugcucagguuuguuuuucuuuuuuucagugaagugauauuugugcauuaaaugguuguggccuuuccauaagcaccauguuauuugcaguucucccaaccugucuucauuucagguuaagaaaauggcccauucauaucacuggcuucucucuuucuccuccaaggucacaucuuacccuucuuucaauguguuuauuguuaaaaaguauacuuugucagccuuauaaugaggcuccagacuccccaaauauuccaccaaccuaucagcuuauugccuaugacuguguuuguguuuagauguagggaaacuaaugaggucuaaauuagcucucaugauucaugaagguauuuuauuauacuacuaauaaaauauucacaugaggaaauggaguggaauuuuuguuuuuacgaaacugccuuuaacucuuacuacccauuacuauucuauaauccaaauguguaccuuuauaauuccuucaguucaacaaaaguuuauguucaagugauagcgugacuuggauucuaguuaguguguguccccuuucucucucuauucauuugcaucuuaccuuucccccaaaauaacucgacugauucuuguagaggaaucuuuagagguuccucuaggcuuuagaccucuaguaaggacagugcaucauuauagaagcaugcaguaaacaaacuacuuacaucauuagccagagagcagagaagagaagcagagacaguaucccacaauccccuuaaagaucaccauaccagugacuugaccauccaauaggcuucaccuuccaaaagcuucugccaaguuccauaaggacacacuggagauugccuuugauauauggaccuucaaggaacgcucaguauccaaaguuagcccuauaagcugcuguaauaauacagauaggugauguguaaugaacagacucuuacuuggcuguuucuaaaagugaggaagucuaaguuggaagggaccucauggggccagaaaucucuugcaucauuacaugguagaaaauagaagggcaagacagcuccugugugaaagagaggggaaggaucugaacacauucucuaucgggaaucuucacugcuaaaaaguagcucuugugaucaaauccauccuuaaugguaucuaugauguaauucacucuuaaggauucuacuuuuaaacacuguugccuucagauaaaauucccagcacaucuaaaaaauaaaaucauuugucucuguaaugaaaauucagucuccuuuaaauaauugcugcuguaaauaaccaaaauuuaauuugaauuagaaaaaucauucauguaauuagagaauuugaaaguucuuuuuuuaaaaaaaguuauuuuacuauuucauccauacaacauuuuuguuagacuggguuuugauuuugguauuggcauuacuggggaccaaucucacggucucacacgugcuaggaaaccacuuuucuucugagcuccaucccagaucuuuuaaaaggcauuuuuauuuugagauaggguuucaaaauugcauagcuugaccuugaacuugcugucugccaaccucagccuucugagaaucuagaacuacagggcugcccuaccagacccaacauacacucuuaacuauagcuacagugcuaucuauggagacucaggaacucacucuuguuacaacugacaguuuggauggcuuucuauuuuugaaccucucuccagauuugagaaucaccauucuacccucuccacucucagcuuaacuccucacuuauuuacauucuuuguauaaaugagaccaugcaauauuuuucuuuguauaucugaaucauuucacucagguccaucuguguugucaaaaaugggaagaauuccuucuuuuauaaggcugaauauaaauuauaagcccuuccccauguucucucucucucucucucucucucucucucucucucucucucucucucuguguguguguguguguguguguguguguguguguguguugauuuuccuaauccauguauuguggaauauuuaacuaguaccucuuugagaccauguugucauuguccuugggugugugucuagaaguagaauuucuagaucaccuuguauugauccuuuaacuucuuuaaaggacuucagaccauuuuccaugguggcugaaucaguaauaguauaucuuuagauuucaggcuggugguauacacauaguuuauaagagugugugcaauuucuaacuaugagcgagcgcuaaauaggguuacagucuaaggagagugggaaaggcuuauaaucucugcuagggucaggcugaaucaccaagagaaaagucaggugcuaucuugacacaagcgcacagcugaggcaaucaccaaagaguuguuagcucuggcucuccagcgcuuaggagcuguagacuuagacaaugauaauuuuaguuaaaggccaaagcaguaagaaauccccaaguaguuaugguauugugauugucaugggcuuuccucgugcugaagaaacccuauugcagaugaaagggcuagagaugaaaguacuggggugacaaagacuuguauccaccacccccaaggccucccccaaaaggagagggagacuucaaagaguccaguuaacaguuuuuucccuaguuauuuuuuauagacugaaaaauguuuugaguuuuagcaaggcuuaagguguaguuacaucccaacauuuaacuaaaauugaauguagaggguuucagaaguaagaggacauuuaagaaaaugacaaguuauagcugugugauauuguaucuuuagaaaggcuucaauaguacauuggcuacagauggugaggcugaggggaauaauguaagggaaggaaaagaaauaucucuucuuccuauuuuuaagaucagagcugaagagagauuaucaaaugcacacaaguucauuuagugccaaguuucccugaccucugaggcuuccaugaggaaaugcagacccaggaaaaugggaagccuauuuaguucagugcuaaggauuucauaaagaauagacagagaauucuaagugaacaaagauguucuuauauaggguauagcuuaugauccuagagaaauaaaaagccugcaugugaagacucugcuccauguccuguaucuucaaaacccaucaagacauuugcugcugccauaacagaacacuugaaaacgagauguuuacaaacuacagcugguucguugucacauaguuuuggagucugagaaaucuaagauuaaauucugccucuggucauaacaauuguguuagguuauugcaugcugaaggacacucaagauaacacaaaagagauggaggggaaaagagaaagagcuacacacauccuuuucaucaggcacucuucugccauauccuuaauccacugaugauaucagaacccauauuacccaaucaugucauaacauccuauccacaauuugugggacacuuucaacacucagcaacaagauggugauuccuaccucuccaagagaggccucaugaguuucuuugguggagaagaucagagagugaccauccugguucugcugguuuuuuuuuucaaaugccuuguuugaggcaacauguacugagcuccauggaauagaaaccccauuuucuguugucaucagcacugggauucauuuauggaaaaagauaugaacauguuauaggggaaucuuuggaagcaaguagaggguacaacagugaagcaggaaaaguagacagaggcugugugcaugugcugagagacaguggcccccgcuaaguuaggggaaaggaaaaacccagaggcugugguauugcuacauacagaguucagaauaugaaggguuggcuaggguguuugagagauguguuuucuagagaugagauuuacaaaaacuuguuaccuagaagggcagaaguauuggcuauguccagauucucacuguuggucuugagucacaguaaaucuugaucaguugagggucauuggacagagcuagauuguacuggugguuacucugggauccacuaagaagaacugggauggggcuggggagugaguaccucugugaagacacuaaauuacugucacuuaaaacagauugguaguguaauuuuuaagcaaguacauggcuguaucuucauuacuuagaaaauacuuuguuuaaucaaaacuguguagcuaaaaaccguauguauuuaauacaauguguuacuucucacaaacagaaacaacaacaaacacucauaccuagcugugaagugcugugugguauaaacccaacacaggaaacugagacaaaucuuuuuacagaagugacagcacggcuaagguuucccgauaccuacaguuuguuuaugugaaaaguccaauaguagcaguguauuucagaaucccaucaauagcuucaucagguucugcagucaacuuagcaaaaguauggagacuuccaggguacuauaguuaaaaaaaaaaaaguuauuuuuagaacagcucuuagcauauuuguuaugcaaaauauaguguggaagacaagagguaugggcagguaaaaaggauuuacugagaacagaagcagagacgauguacugauauauugugcaggggcugcagauaaguucuugcagaguguagaacagcuggggacagcacauauuugaucuuaucuccugggcuaguuuacagcauacguugucuuccuuggggcugggcuuuuggguagaggacguggugaucucuuaagauugggcuccaaauauuuaccucguugaaaucacauuccaagucaucauagcccaguuguuaaaguauaggaaauauccuauugcucuuggccuuuggcuauauaauauucuuaaugcucugaauuuguagguggauaauuaucugugguuuuaggauccaauagaaucaaaauauuauauuaaaaaacauuuuuuaauuaaguuaaaugugccuuuuugaauuguauuggcaaaaagugagaaaaaaaucaaauaaaagagaaaaaagggaccaacuggcaccaguggcuuugucuccucccuuuugccagcauccuuguguucugaaggcugugaguaucaacuggaagaaagugcugacucuguccuggugccgucggcacgguuuguguuggcaggccugcuucuucagaugugcauugggauauuggccaauaugcuaaaacugcagccucguugccauuucucugacuucagcaucccgaaguggugauuuucggcucuuaucucccugauguugguuccccagcaagucugguacauuuagaugagccauuagcucuuaagaggaggcugcaacaagcucugcuuuacaucgguggcuuauuaccauccuuguucacggugauucugucaauguuacuuaauuuuuagcuuucugggcccucccucauuaagauucagaaggcuuugaguuucucuuacugauuccaccaagcuguagaauccagacaugucuuaauuuuacuuuguugaaaucagugaaaacccaggguuaguuuugccauuaaaaaagaaaaaaauccuggagugucuucaagucuuaggauaaugaaaugcacauuuagaagugugcaugugucccucagcucuguccucaguaaaccugcuagugagugugcuuccuucgauuuaauaauugcagcguuugugcgugguucacauggcagcauuuucuuauucaccccauguaucacaugacuacgcaucuuuauauuaccuugauuuacaucaucacacuucuguaucucccuauguacaacuuauuaauauuugaauuuaauaguugaaaaucuaaugcuggacauguuuguuauggacaucgauguuacugucacuugaguuaugacugagaaaauuacugggagguagaaaaaaaaacaaacaugguuguaguuuugcuuauuuucaguucuuuuuguuauucagcuuaaauuaaucuggaauuagcaguuggguuuuguccuuggacuuuuuuggcaucauugugagcagacucuuucuccauggugccuuguggcucucuggcauuaggagcuguugguucuucagcugaaguagaggaguaauuuauucaacaagucaauugccaauaaauuacauggagguccguauuucugaauccuagacucuucugcgccuuggccuugcauuuucauuugucacauuaaaugagaaggaaguaacugucagucauccaucaaugcauuucaaguguaagauugugcagggagucaacaguuaagcuaaggaugugcaguuuaaaacauggaccaggaacauggggauucauggacaugcauuaauauagagauauucaauugaagccaaagauaaucucaaagucuacaucaccugaaguagacuauuuuuacucucaauuaaggaguaauuagagaggacuuuaaaauauucuugauaggggcuagagugaagauuuagugguuaagagcacuggcugguuuuauagaggacuuaaguuugauucucagcuccaaaguggcuuuuaacuguaacuucaauucuaggggauaucauacccucuucugcccuauacaaguaguuuauauguauggcacacagacauacaugcaagcaaaacauacuaucaaauauauauaaagauuauauauauuuuuuauuuuuauuuuaauacgcgcacacacacacacacugcaggcuuuuauuauuguuauugucauugguaaaauagggccuggaaaugcaguuacuugguuucaauaccuuaggaguuuuguagaggcuuacaugauuagguuggaucugugguagccuuuauaauuggguaaugccuuucaauauuguauucauucauucgugaugauggaaagccaguggagaacuagcuguucucauuaccuaaauaagcuuugauccugucguugcugcuucacuucaggggaaugggguguuucuugaggauccccacacccaguauuuucacagugccgcacuaucacuagcuuugaaagaaaaagagaaggaaaggagggcagcucucuguugugaguucuuacaggcugugagcuaucagucuagagggacuuugagggagaugguggcucugugguuucaagcuaucucauucucuuuguguuugcuguuuccucuucuuuguuagcuaccuaaaaaguaacagagcaguuaguuagcaaaaucuagaaauccacagagccaauaucugcaauaaaauccagguccaagaaagucuccaaacaaaacugaugacaggccaccaucagccacaggaccuacuggauuaucaccaugucagggaaagagaaggaagcaaaagugcuugggaacuguagauccucuagagacaucacaugguuuguagaaaacaggacugcugcuuuugagcagaagucuaccauugaggugcuucuccuguccaacuuccaugugauaguuuuguuucaucuuuccauauuuuauuuuguuauauuuuaauauuaucuuuuagaagucucuucuuuccuaguaagagacaaaaggggagugaaucuggauaggagggguggagggaagggacuuggaaaaguagagggaggggaaacuguauucaggauauaguaugagagaaaagaaucuauuuucaauaaagugagaaaaaaaccguaccuaauguuccaagaaaugcaucuggcauuuaacagguugacucauugugcaguaauuuccaguaaguuccuuuccauuccaugcuucccgccguaacagcaacagcugucugcuuuuaaacaacaaaacacuacaccuaaugugcagcgggaguugaguuugauggcaaugauggcuuccauuauccuaggugguggguuucucuuugccaaggcauugcauuagcacuauaaaauagagaggugcuagcaaaugccguuagguggcuaauuagacgaagucuacaacaauguuuuaccauuucagugcaaaauauuaagcuuaaaucauuuccuuggcucuauuccaacugcagaauuacauucucuuauaccaaaggucaucucccauggcuaugagaagagucacuuuucauaucuucuuugguguugcgauaaaguuuauagagccagugaaauagcagccuuagauuacaacuuuggauggcaaacaguuauauucccugaacacaaaaauuacugaagaaauuaaaacaugcuguuucuauguggcugucuccuuuauaauacacaugcacuguuagaagcaaucuaacuccacuguaugccuuaacucugggggaaaugaucaggggucuguuggguuuuuggugaugggggaagaauagagaaauagugcuucuuuauugcuugauuagauuggcccugguuuucuagguccuggauauaguugaagaagaguguguaaugugcgauuggacauuugagugguaccuuugagugguuucucucuuuuuauucaaauaugauucuacauagguacccagaauagauaagccagaacagcauagaaaccacagaagacauacuauaugaagaucugucuaugaaacacccagaauaagcaaucucauagagacagaagcuauauuaauaccuggcagggccugggcauggguaguagucauagaguaucuuugaagagugauagagucauuguauauguaaguagacaggguugugguuguuuaaguagaaguggacucauaaccagugaguuguauacuguacacuacuggggaguuggcagcgaagcuuggaaccuggucauguggcuuucuuucauucaucucagggcuacaaauucaaguccucuggacucagcgaugaaugccuaaccauagccaaacuuaguuacaggccgaguugaagcuagagcacauucuucauuugguauuucuuuguauguuaacugccuaugcuaagagcaggcacaggagcaguggaaucacaaaucccuauccagaaauaaacaguuucaguuuguaaacaagucucuaugaugcugggucacuugccauuaaauaaaaggcagaaagugggaccaguuggcacagugcauucacauacgcaucauuccguuuguguuauauagauaacuucucugucuccuuauaaagagggcaaugaauccacucugcgcuaaguguggaagcaaacuaccugaguaguaguucagcauucugcuaauaaucugaauauguaacuggaucgccaggacuagaguuucugucuguguugaauaugaacacuagaauuguugauaguauaaaauuaggcuuagaaaacaguugauggaaucagauaagagaguuggcuuugaggauucuaagcauaucucacauguaaaugguuauagauuuaucaucuugccagguauggugacacaugaccuuagucccagcacucaagaagcagaggccagccuugucuacagagcaugcuguagcacuuucagggcuauguaaagacacccuggcucaacgaagcagagaaacaaacaacaaacuaaaacaccaaucauuuugaaauccuuaaggaaauugcaacaucauacaucauauuacauuuuaaucuggguauaacaauaguuuuucugcuugguugauaaagacuugagaaacuuagacuguuuuccuaacagaauccugagguggcccuuugcuuccucuccucuccccuccccuccccuccccuccccuccccuccccuccccuccccuccccuccccuccccuccccuccccuccccuccccuccccuccccccucuugugcuuuuuuuuuuccuucuucagaaagugucucauguagcucaggcuagccugguaugccuauuccucuugcuuguaucucccaaguccugggguuuaugggccugcacaccaugccugguuagaaggguuuguucauuugacugcuuuguuuucuuccucagcucuuuugagauuuacuuagggccucaccaaguagccgaggcuggccuugagcuacauauaaauccuuugucucuuucuuguaugugcugagauuaugggcaugcaccuuccauguccccuuccacugcccuuucuuuauuauugauuaaaauuucucccaacuagaaugcgugguagcuugugggcagcauaggcuaagcacugaccucaguuuuuaaacccaauucaaaguauguccucuggaaugucaucacuacucuuguagauggaaaucaguuuacucacaggaaucuuccaguaagcuuuccaaaacuguaauuuugggaucaaguuuuaaaauauagaauaaagaagcuauuuagugguuuacuuuuaacacguuuuauuaaauuauggcauaacugaaugugucuuucauagagucucaauuacccuuuauuuuccugauacugggcuuuucaaagguauauaaagguauuuuuggcauuuaaugaccgucaccuuacuucugcucagcuuuuguuguagauauuguuguagccuuuuuaaccagaacugugaauuuuucaaccuauagacaacaucuggggaagaugugagagauuucacuaaggugcugaagaacaaguucagguccaagaaauauuuugccaaacauccucggcuuggcuaccugccuguccagaccgugcuggaaggggacaacuuagaaacgugaguucuguucuagcauucaguuugugcgugcuugcaccucauugucuuuaauacuagugcuaacaacaugaaacaaauugcaucuuuucaaagagauuuguguccugaugaaauauuuuauuuugaaacaaguugcucuucaacaguuaauuuguauuaucuggggauuuuuguuuguuguuuccgaauguguauuauuauuucuuccuccuccucuucuuucuccucuuccuccuccuccuucuccuccucuuccuccuccuccuucuccuccucuuccuccuccuccuucuccuucuucuuuucuucucucucucucucucucucucucucucucucuguauuuagaaauauuugcccaaucaaugugguauuauuugcuccuucauuuuuucauuuauuucccuuccuuucuucccuuucauagguuucaaucuuuuuguuauaauaccuuucauuauuuuguuucguguugugguacuggucugaacccugagccuuauacuuacuagagaaggacucuacuuuugaguuauauccucagcuccacauuauaucuuuuuaaauuaaauuaucaaaaauauuucaucuuacacuucaaaugcaacucuucucugaacccucguuuuauguuucauugucaucuccuuaaagauaaaguuggcaaaaaugaaguaucuuuaugcaucuaugaagcagacaaaauugcuuacaagucugcaauuugaguuaacaagcaucuucuaagaaauuaggagggagaaaaaaaauuacaaugggaucauaaagcuaagaaagaaaacaaaagacucuagagcuugaaaugagaugaagaaagauguuaaaaugagccagaagacauacauacauggacauuuuaaaucaccaggcagucuucuauugagaucaaaguagaugugauuuuaacucaucgaaucccuuuuuaaagcauguacuucagcguuucaacugcaaugcuuuuuguaugcuggaguguguaagcaaagcacccaugugacuauaugaggggugauugauuaaggaagacacccagcauucaccucuggccuccauguguagguauauacaugcauacacacacccaaaaaaguauguacacuacccacaacaauacauuuuuuuucucauugcuuccauaccacauaagacaaauuuaacauuuguuuuauuuuaaacaaagcuauuuaaauacauuuagaaaaugcaugucuuuugugaauaugcuuuugucuuuaaagaguguauauuaauuauucuuguuguuguauccgauacaaguuugacuuccugaagaccugauaaagucuuucuucugcucugaucacaucgacuuaaccuuugacauagcucauuguggcauauaguguuguagguugacuaucacaucgugcugggaucuaagagggaagagaguagacuuguauugagcaauguugccuugcacuauuuucauaaaucaucgccauuuuucaucccaaauaucuccacccuucacaugagccauagauagauggauauuuccugcuccuuucuuuuaaauuuuaauguuuugccuuuacaugucaaaaugaucaugacauuugauuugugggcacacacuugaguucaucuguguauguggagccuagagauugacaucaguugucaucuucaauugcugacaacuuauugauugagacagggucacucacugagucuggagcuugcuuucugagcaaggcuggcuagccagcaaguccccagcauccuccaguuucugccucuguacugggauccuaggugaccagauuccaugugggucaggggguugaauucauguguuuugugcuugcagugaacacauuuuacugacugagccaucuucaggauccacuuagagacuuuuuuuuccaaguaaaaaugaacagaaaaccaugcaaaauaauuacauucucugcuuuugauauacuacgcugaaaaugccucacccugauuaacauaaauuucccaccauuuuccaagagagauacaagaaggagaaaggaaggggcaucugauuaaauuggaugccaccaaaucccuuuugaacaagauuuaugagcuacuagauaguguggguggguguucuucaaauccuaugcagagcucuguggauuugcuguaguucauuuuucugcugaacccucuucugcuccaaggucacuuaaucauuccaguggaacaauuuaugugaguggguaggguuuuguuuuuuuguuuuuuuuuaaagaaaaaaauguuugauuucauuuauucuccuacuugugggaggagagaacauuggagaaaaaccauugaaguggugaaaguguugaaguuauuuauggagcuggguaaagcuuccuuugacuucuuucaucuuugccaaugugguacuuuaauuucugaccagugauuagccaugcaggcaugcaugcagggacucuaugaggagaaaugcuuauuacuaaauggggguaaacauguccaugcuaaggcuuauucaguuaauuuaauaggucucuaugcaagaauuuucaaaaugagaaaaauuuauucauaaugaaguugaaaaaaagagcuaaaauaaaaugguggcaggaauaauuugagaguucugagagauuauuagugacuuuagaauuaguuuaguuucccuagagauuaagaaacaacaagaaacaccgacuucugguauuggguaauauauccauagugaauauaauauauaauauauagugacugagucacucuuugaagaaucccuacagagcaggcgcaguuguggagagggauguucaaggcuggaagggacggauaacgaugcugagaccugccugaaucaucugcugaggacucaggauggccagaggugaaggaaaagacucacuggccaaaugaaucauuuucaaaagccuggauuaaaguucuaacacgaaacuaauaucaaaaacaaaugagagaggcagagccagaugauaaaggaccuuguuaucuaugcucacaucuccaggguuuaacuugagaauagugagagaguucacagguaacaauuacgagaaaagagugguggaugguucaggaaagauguugauaugaaauuacccuucagaaaaugaacuuuaguaggagcaagggggcuucacuaacacaggaaccauggucauggcagagcauuuugagcaacaauauaucauaucagagguaucuugaugggccugaaagguaggagagaauuauagaagcauugcgaaaguuugccuggggcuagggagauucccuaguaguuaccagccugaucugcucuuccagaguuuaauucccagugacuauguuggguagcuacaaccacuuguaacucuagcuccuggacauccaguggccucuccugguuuccgaaggcacccaccccacauuuggcauguucagacauaggguagauacaguggcauauacacagacaaauacaaauauaagucuugaaaagaaaguuacuuuaaguugaauguguagaagagguaguguuagccauuguagacaguguuauagguaguguuagcuauagacaguguuauagguaguguuagcuauagacaguguuauagguaguguuagcuauagacaguguuguagguaguguaagcuauagacaguguuguagguaguguuagcuauagacaguguuguagguaguguaagcuauagacaguguuguagguaguguuagcuauagacuguuguagguaguguuagcuauagacaauguuguagguaguguaagcuauaaacaguguuguagguaauguuagcuauagacaguguuauagguaguguuaguuauagacaacaugguaaagguggaaaguacacaaucuagagagacagagaaguuggggagcuuggcuauaacaccacaugacgcagauaggaaaguauauuuguuuacauuuucacauuauauuuuauggcaugcgaaccagccagaauuacagggucuuguuaauuugcuguccucaguggacagacugacuauagggaguggagagggaggggguaagacuagucugguuuucaagcaccaggcuaugaucuaacagguagaaacaguuaacagcuuuggagcaaauggguuaaagaaucaaaaacacggaaauaugaggagacugcuggcaauuugcgucauuagaugucuauguuggaauucauagacuuacauuuauauuagagucugauucuucucauagcauaugaaauuagucaaaccccccgcugagcugcuacacugaaaacaggaagcagcuccauuuugaagucagugguagcucacagauugaugcugccuuuauuuuauuauuuacuucucugcauuugggugcuggcaguagcagucagagacucaucuaugccaaacaagcagccuggcaagugagcucaacccuucuuacuguaggucccagggaugaagcgcggcgcugcuguucuuucuuccuacugagugugagcuuguaucacaacuucucccugugagccaaaguccucugaaggcaaagaaaccuaaaguuugauuuuguaucuguuuccuuuauuugauauuguccgugaaaaauguucuucuuucaguccagcuuucugccuguuccauucuuaguucacaaauuuuugugccaacaauuaacuuccuaagaaucgcuaaagccaauccacaaagcuuugccaggguuucuuaagauaagugcauauauauauauauauauauauauauacacucacaauuuuuuuucuguugaaagcuuauauugaauguuguccuaggcuugaauuuuagagauaauuucuuaagcaguugcuguuuuaggaagagugacacagggugcagagcugucugucucuugccauuugcaagguuucagggauaaugagaaguagugauauacuaaagacgaggaaugauacugugucuccacugucccggcuucuccuuuacauggacacaguuaacucuauuuacagaauacauauuuuggcagacauagaggaugaaugcccacuuuugaaagcagaucuaaagaacuuuagcuuucuacccaauaagaugaccuccaucucuuuaaugucuguagugcacauaucaucuugugcuucacacagcaggagauaauaagaucauaguuaugucuccaguccacauauguaauagaaaaggaaaucugaaaggauuuugcuugaucagcaauagcuuuuucaagagacuuuacauaauuagaguacuaauuuuccuugugcuuuuaaaauucuacauucaucagguaauucgucaccaccuucucucaaaaguuaagaguuugaacuacuguuuaauugggaugaguuguuucaauggcauuucauggagauuugaggcucucaggggaucugaaaaucuagggcggccccugcacugccucagacccaagccccugauucaagcagagcugguuggcccauguuguuuccuagagcgaacuucuaguuaauagcaucauaguggauggaagucuguccuguccuggcgaggucacccucagugugcugaugcucugacucugaggagggcauagguaggaaggaaaacuuuucuuuuccauguguuucugaaauugagaaaugugguguacacauaauuuaaacuuuuauauuucugaaugaagagccauaaaccccucuuacuucaauucugaugucaauagucuaguaauuagguaauaaauucaccuuucuaauucaaugucuuuuccaaggaaaaaaaaaaaaaagaacugugucucccuuagaauauucuggaacaucaucuuccaacagccuauaaugugggacgaucuuagcacauuuggcugaucuuuucacucucacuguucuaaaacaugaugcccaucuugacacauggaugcugcaggugugggaaaguugcuuucaguuucccuggcggugaggugaugaucaaggaagccaaaugagaguggaagacgaaucugccuccgucugcuuuugucugaaaucgcucuaaauguuuguucugugacuuuugucucccuguccccucucugcaguccuaucacgcucaucaguauguggccagagcacuaugagugaguauucacagcccccugugcacaggcggggaguucuaaucaggaauauuagcaugggucuaaacuacuacuuuuacauccugggugacagugcuggugguuuguuugcauggcagauucguuacuuaacuaaccuucuaacugguaacaucugucaauauugagaauaaauccuuugccuuuuuauuucccccuuuucagccccucccaguccccucagcuguuucaugaugacacccacucaagaauagagcaauacgcuacacgguaagagacugauaaccaucccccacucugcuuuuguaguaguucagugcugcugacaaaccuugugguaggaguguauuugcagaagucaugguucuauuccauguggauccuggccuuuuaucuauucaugauguaauuuguacuuuaccaaacaccugcuauauauucugugaagaguagauuacaauagacugccauuacagagcugcugagacuccaaacaucaagcagucaggauaaagagaauauaaccuaauuccaaugaauaaagguagcauuuggaacugcccuugggagacugcgcacauaugaauugcaauauguaauuaaacuuaugcuaauauuugauuauuaggguuuguuuuuaagucccuaagcagagcaaacuauagaucugcaugcagugugcaaaacuuucaggaaaguguguaaaaucaaccauuggucauacuagaaggcagcugucuccaaaguccuuaguuuaaaagcuauuuuuaaaaaauagucggccaggcggugguggcgcacgccuuuauucccagcacuuuggaggcagaggcagguggauuucuaaguucgaggccaggucuacagagugaguuccaggacagccagggcuacacagagaaacccugucucgaaaaaaacaaauuaaaaaaaaauggucacauuugugcugaauuaagacuaagucagauuuuuuggagcuguuggauaacaugcuacagaagaauguagcuucuuuauugaacuacagaagggagaggaguggagagucugugggguuaacaaagaccauagucugauaacacagagcccgguugaucaggaguugguucacauucuaggucaagagaagucauggugaaucuucagaccugagaggaacaaaauuagguuugugugaaagguugcucuguuucaguggagaccagcuagagggccugagggcucaaugagaagaccucacacugugguauaccgccuacaggcccaaagugaauggcaaucaaauuucagcucaccaguacagaugguuuuaauuccaccacugagugagaucuggacuauuuucuguuaggucauaauauagauuuaaaagccagcaagggugcuucuggaggacuguuccaguugcagccguguaaugucaucuucucguuuuuguguuuccagacuggcccagauggaaaggacaaacggguccuuccuaacugauagcagcucuacaacaggaagcguguaagugcaucgugcauugagucugcccaagaggccaacugaaauaguugggguugugaaagaguaucucagagauuggggccaaggaaggccacagacaccacaccaugcaacagaccucauagaaaagauuuacuggggaagugaggagauguagaaggcugccuccgaggagggauggaacaacagagagaugggccaggucaugauggugggcuuuagaggggauauggagcacauacacugggaggguaugugaugguggaaacguguccuauuggugaugacugggccauggaaggcaggaaggaaccugguucuggaaugugggagguucuuggcugacuaaccuugccuccuuguauuauggucucaggauuaaucuucauagaucauggcaucugaguuguuaucccaauccaaacugauguguguuucauauuagucuaugcacauuuuaacuuuuaaagccauguuaguguaaaugaagcauguuuauuuacuuaggaaucaacuuaucugcuuuagaauaaucagauugcugcauaauuauauaauauugauauguauuuuuguggauauuuauauguuuuauguuuguauuuauguggguauguacacauauauacguagguucauaugguugcacauguauguggaggacagggauaaauauuagauaucuuuaucaauuuucuccuauuuauuuauuugagacaaaguuucucaaugaaaauggaucucauuuauuuggccacccuauaagcucugucucucuccaccccccacccccaccccuauccaauucccucaacuagagaugugugcuaccacaccccacuuguacaucagagcugggaucuggacucagguccucauuggcucccuggcuaguguuuuaccaaccuagccgucucucgcacccauaguauugauaguuuuacaaauuuauugauaguuuuacaaaugcacauccaggaucaacacacuuuuguaacuuccucucuccugugcguucuaacauuuucuucauagucucugcuguuaacagugcccuccacacaugcuuggacagacucauucugccauucacugaaaaauaacucccuuacaaauauuuuauuuuaucaggaaguggggaaagcuucauugacuuauaauaucuuuuagaaauagcuucggagcuagauauuuuauaucucauuuccuuauuuguacaucuuaagcuuggcuguggaaugcucuuggcaaacgcuuccucucugauguuaauguuguaauagaucuuuucucuuugggacuuguuuugaccuuguuuuuuuaugagaugauguguaaaaaggcuuguauaguuucaaguugaugugacuuguaggcucacuaugguuuugaccagucagggagcccaggagaaccugagaagcucuagaauauagugugcacauguucucacucacaaagacggaagaaagccaaguagaauaauaccucaagccagugguucucaccuuuccuaaugcugugauccuuuagacacuuccucguguuguggugaaguagcauucauugcuacuucauaaauguaauuuugcuacugauuggaucauagugcaaauauuugcuaugugacccuugugaaagagucacuggacucccaaagggguugugacccucagguugauaaucauugcuaagaacacugauaaagaaugacucccuuaagucuguuucauauuucauuuaucauuaagcuuauaaguagaagcucuugggaacuuuuuucuauuuuaaauaucaaaaguuuggcaucuuaggcaucauaagucauggcugaggcauuauuauucagguguuaugaaccagaaaccacuucagcucaagauaauaaaauauuugcccugcucuuucauauauaaccuaacaguaaguguuucauauaaaguaauuaaguugcuuaaauaucucuuaaaucaggcuaguccucaccucaccaguguuaaaagcagcagggaauuuaaugaacugaaaaauaauaguuaugauaaaaaucuaacuucuucagaacauuuguguuccuuucuaugugggcagaacauaggaaauacaaugugcacuguccuuuaguuuucucgcgaaugugucagaacggagaaguuauccagaugauuagcagcucaacagauuuaacacagagaccuuugguguggugauucauucaacagauauucauuuuauuccuagacgguagugaagugauggagccacuugugagaggcagcuguuacacucaggacguauguggccuguuuggcagagcccuauuccagucuguguauucucucauguaugugcauugauaaguaaauuaaguuuaguuuuaggagagagugcucagaacccaccagcccuguuuuuguucuuauuguguuuuguugcuguuauuuuauuguuuguuuguuuuuauuuuccucccucuuuuauagacaggguuuuacuaugugccacaugcuggccucagauuuccaaucuuccgucucacccuguaaaguguucuggugacaagcaugugcuuccagcuccuuuuaccucauuguacucucgcugccccugggugauguuuagucgggggguggggggguaugcagcuguguaucuuccgcaucuucugcacacacuauugaagggugagcuugcucaccaugggagaccuccaaccacagagcuagcaaagaucauucaccaauauuugguuuuggguuguuuuuuguuuauuuggguuuugugccuucagcuauagccaacauaccuguaguuggagguggcuuucauccuucaaguaggaucauggaaacaauucccuguccccucuccaaguacuccccuccaugaaccuucacuguguauugagcauucauguaucauauauaccaguuucccaaaauugaccccuacauaauccagucccaaguacuccccuauuucucugaaagccagacuccagaugaucuguuggggcauuaguuuuaaggcuucucaguaucuucguaggaaguuauucaaauacaucuucaggaggggcaagacucagagagacccuuagacagcagucccugaggccguuaaccagcuucucacuccauccacuuucugccuuugggugaugcuguuuuauguggacugaaguuggggcuuggucauggucuaccucaacauuaccauuuguaaaucugaaagcuggaauagagcauugguuuuaaaguucaucaagggaaucacagcucuuucaucaugugacagguacuaauuuuguaauguagauaguauuuacuauauguaucacauacaguauaauuauauugcaucuaaugauaccucuugauacaggcuacauuuaaaaaaacuuucuauuucagcaugaugcacacuauugauguuuaauagcccuaaucuggugcaugauguaucaucugcauaaugagggugcucuugguuuuuauuauacacaauuaaacacuagaacagaucuauuuuuguauuuaaccuuuaaggcuaauaaucuaugaaaauauuuaaggccaagauuuuaugcuacauguaaauuauucuauuuuucauuuuacagaaaugaccuuaauucucuuccagacaccauaacaaacaauguaguuaguggccaugauaauuauuacaacgcccuguacaucaaguucacaaaggaggcgaauuuacauuaauacugacaacaaaaugcuucccaaauagagaaguucaagugguuucccagugcccagauuaaaaaaaaaaaauuucucaguugugugugcauaugcauacuugcauguguacagagaccagaagacaacuuacaggaggcuaaucuuuucuuccaccguguagcuugcagauguuggaaccuaggacaugagcaaguacucuuaccacuugggccaucuugccagcccaacauuugaaaccaaaagugugguuuauguuauuacgaagcaccuaguccccaggcccaagugucuacacaaauguucuuagggaauaaaugaucucugcuaucucccaaucgcaggggcucuaguccaaaucuguggccaguccuagccauaagauaauucaggcuauuuuggggguacaugauuuuuauucagaagauucuuaugauuuauccuuuuuaagguauugacuuugaguuuuuuagggauaguauccacaggcauuauauaacuaauuugacuugccuuuuauuuauuucaauaacuaaaucugcgucaaucugaugcgaaugacugagguaggauuccacacaucacccccuugucauugaaucuuagguaucugggacaggaggggcccaagcuuuucuuuccuuuguaaaugacugcucauuuugcuuugauuuuuaguggauuacucaugguguuuuauccuuaaaacauagaacauuuacugacauaacacauuuuccgcuuucuuggauaucccauuguuuaguugcuugcuuagguguguuucagccugaaagggaauauuugcaguauguucugcugugcucucauuuugcaguugcuuuagugugugugcccuccauccuuacaccuugcccaucuguucuguccucgaugcaucuuggacucacaucuuuuccuacugccuuauuuuccacuugaucucagaguggaaccaccacccaugauacacagucucuaacucgugucucaggcuauggauuuauucaucacagggcgucagggcuucaucucugcuucugccucuucaaguacuuaugucuaggcuacugaucaugaacuugugugugugugugugugugugugugugugugugugcaugugaguuucauacacaugaaggucagagggcaacuuauggaaguuaguucucuccuuccaccuuguggcuccgggagagcaaacuccagugaucuggcuuggggcaaccacuuucacuuguagagucauuuuccuugccagagcucuguuucauucuucuguguggguagcugucuuaggguuucgucacugugacgagacaccaugcccauggcaacuuuuauacaggaacacauuuaauuggggcugccuuacagguucagagguucaguucauuaucaucauagcaggaagcauggcaacauccaggcagacaggauuauaaagaagauguugagaauucuguaucuugauccaaaggcuaccaggagagaacucucuccuauacugggcagagcuugagugcuaggagcccuuaaaguccccacacacaguggcaucagcacuccuaauagugugcuucccaugagccaaacauauccaagccacuagaguagccuagaaguuuuagcugcugugcaggggucguauaucaacuuuccugcucuucucauccuuugaacccucaggacaucaugcgacuucuuuuguucccucuagagaucuugcauuuacuaugaaaggugagaugacgucauggccaauucuaucuuuugugucaucuaccugcuguauuuuuauuuuccaccaucauuguaaacaaccuucaaaagacccucuuuaaaaaggccacauuugucaggagggagggaaguuaaguuaggcuuuaagcuuagccaaaguacaugaguuuuauuuuugauauacagucacacucucucauaugugugugugucugugugugugugucugugucuguguguuugugugugucugugaaggaaggaaagugagagugcucaaugcaggaaggaggcccauuaagucaccaagaauuucucccucucccucucccucucccucucccucucccucucccucucccucucccucucccucucccucucccucucccucucccucucccucucccucucccucucccucucccucucccucucccucucucucugaucucuuugccugaaacacauuuuuuucuaagaacacacuaaaucauagaugcaauuucagaccccugacuaucagaacaaaagugugauaugccaaggauggauuuucuaucacacauaagaaucagagugcuugcccaguauccaguacugcacaagagcaaagggguuuuaagguccagguggaacaauaaaguucccagacugccaggcucuccuuggcuguuuuagcacagagucugauccagggcuacagcgaaagaugcugagagaaccguacagcugcacagcuuauacugaaggcucagccauaggacagcuccauuuucaacucuggugaacacaucaguuaugucuuauuuuccugaugccuuauccuuuauuuccccucuugacaaaaacuaucaaaccaggccauguccaguaugcuagagggcucugaaaucuccugagccaggagauggaugugacagucauaccuuccugaggacauccaacuagaucugccucacaaaggaagaacagagauuccagcccagcuggaaagcuuuuucauuaccacagacauauuuggccuugucucccuucacucuucugcugcugacagucaugcaucaacacuacugucgaugugucuaguucaguaacagaucauuggaugaagaacuucaaugaauuaaauguaauuaaugauuuaaugcaggauauugauccuaaaaauuaguuaugaugacaccaaguaaaauagcuacugcuauuuuauaaauauguacaauuguguuuaugcuguuauuuaaauagaaauacguuguaaauccuuuggguuaucaaacauaggaaaacugguuauagccaaaucaaaagaucagucauucuuggugcugugaucuuuuaguccacuguuuugguagucagugggcaauaugcuugccuauaucaucuuuaacuuuuauguuaacugcuucuagguauguccaacccauugauauuuguaacauguucuuaucuaaaaaugugguggacuacauuucaagcucuccugagcugcaugcggcuuauggucauagguugggugcaccccauuaagccugauuuauagcaacuuauuacucuuauuuauaggcauggaugugccuuuuuuuuuuuuuuucuguugaguggaauggcucucuggggauugugagaauaacaaauuguggcaugagaguuuugauauguugagcucauccuacacaagcacuguagcaugaacuccagcauccagcucgaguuucaaaggauggccauggagacacagaguuccgaagcagccugguccagccaccgguccaggcgucacagguuuuauuucuugugugcucugagaucucagcacccagaugugagcugaugggcaucuuccuugucucuagggaggaugagcaugcccucauccagcaguacugccagacccugggcggggagucaccugugagucagccgcagaguccagcucagauccugaaguccguggagagggaagagcguggggaacuggagcggaucauugcugacuuggaggaagagcaaaggugagcuagacccgggagaagaaaauacacuacucgcuccccuucccuuccuucugucuuuucagagauguuaucuaagacaucacaaugagguccaaguuugagaggacauuagcaggcugggauguggguagggccucgugcaucugugauuuaaugauggauccuggaaaaacucuugcuugaagcccauuuucucccuccuagcucuucgugcuaauaaauguuuuucuaugagaugaagaguaucaaacuaaauuuggaguucccaggcaguuugggggagauaauuaucugauaauaauucugguuaauuuuauauuuuucccuuuccauauuagaaaucugcagguggaguaugagcagcugaaggagcagcaccuaagaaggggucucccugugggcuccccuccagacuccaucguaucuccucaccacacaucugaggacucagaacuuauagcagaagcuaaacuccugcggcagcacaaagggcggcuggaggcgaggaugcaaauuuuggaagaucacaauaaacagcuggagucucagcugcaccgccucagacagcuccuggagcagguagggguguggauuccugugcagcaccuccacaggacccacccacccacccacccaccucacugaagccuggacccgucaauucaugagcaacacaguuaauucuguguaugaguggaaucuccacugauacaaaauugucuguuuuccuaucugacucauagaaauucuuucuucuuuuguacuaaaauaucaccuuagaacaguuugacuuuaaaaaaaaaccagaauccugugguagccacgagccugacuuucaucaggaaagauuccacagagaauagggacagcaggugaccuacaaucuucaaucuaacacuuucuuccagagaacuaggacuaagaagguaccucagaaaucacugucuguaaaacaacgacgacaacagcaaaaggaagcagaggaacagguggcugcuaguuugccacugucauuucuuacacgggggaugcucugcuauagcagugacuuggaaacuuucuugacaacaagcaguacaauuuucauuuugaggaaaacguauguuucugaugaguaugaaaugaugcacaccuuuaacagagauggaugcacaccuuuaacagagauggcgucucuuacccuccuccccuuccccggccccuuccucccucccucccucccucccucccucucucccuccuuguuuucucuugcuuuccuuuuuauaauauugggaccguuuuuaauacuggcaccuuucuuuuaugauuaaauacuggcuaauaacugacaguuuugagaaacuaccauccuuugguuuguggcuucugccuuucugcuucugccccucugugagggggaagaaacaacguggcaaggagccacaggcagagaguuaauaguuugacuaacuuaacuagaagagggcagucagcucgcagagcuaacagggagaacaccuuugcugcagacagauauaauguugauuuccccacauaauauuuccugacuggcaccagcaguccuagcacgguugccuuuuucuccagccugugugggguggcguccugugacauccuaacagagaugcccuuucccacaugugcuguacugcauuaaagaaaaccauuucuccggggauuugcuuacguuuacgaaagcugucuuggcuuaguugccaccagggucuuuuuaucuugucaggaaucuugaaagcauuauaauuuuugcauuaccaacauaguggacaguugaucccuuucccuccuuuggccacuugcuuuucucucucucucucucugucaucauagaguuucuuugauauaacugugugaaucauuuacuuaaaagacugaaaauucuccaucuuuggaaaauaauggcuugcuaagugagucaaaacuuggcuuucuguuaagaccucagacuguuugcuugauccuauccucagugucacauauauuggcaggggcggguguugcuuguagagugaauuugaaguucccacguaguaccuuaguacagcauaaguuuccuugugugaucucuuagagcggcaguucugagccugugggucacaaccucuuuggaggcauuggauggcucuucugcagggguuguauguaagauauccugcauaucagauacucgcacuaugagugauaaugguagcaaaaucgcaguuaugaaguagcaacggagauaguuuuaagguugagguuaccaugacacgaggaacuguaguaaauggucacagcacuaggaagguugcgaaucaucaacuguugauguccacaguuuagcguccacuuggaaccaucacacaagcucugcucgaagcccuugcgugcuguauaccuuuuugaugcucuugggaggaaagaaaagguuccuggacucauucuuccaaccuccccccugccaucccauuagaccaaggaccuaguggcucauaggccuucacaauuacacaguaauguuuuuggaacuagcugaugucuaaguggcucagaauauccaaggcuguggagcucuuaucucuucauaacgauuuagugugcgugccagaaguagauggaaauuuuaacucaauauaaacagggaaaacuaccagacaucaacuaauagggauuuaauggaaaaucuacaucaaagaggaauuucuacauucucauauuauagauccugcuuucuauuuugaccacguacuuaucagcaugcccuucgguagcacaaagauaugcacgggaguuaucauggaggguucgcccugugucggacugggcaaauggcuuuggaaagacucauuuaucacuuuccuggcaaaauucuaugccgcggcuauggcccauaaagcuuuauuuagcaucucuuccuccggguucuucauccacacuaagguguuaaugcuaaaacaguuuguacacagcaucuaacacaaaaguuucuguaguuugccuagaauuguacugauucuuagugcuccaaguuggacuuugaauucaagcugcugaauccaaaauccagggggauaaaagcacucucucucuauaucgccucugaggggagcuauugaaaguuaguacauuugccauuuucaaaguacaauggcacuuucugaaagaugaacccaaauuacuucuaaguuuacuacauugguguaaaaauaauguaaaauuugggagaugaaaauggcagacauaaagaaauucugugguguaagaagaaguucuucaaagcacaaacauggagcaagcauuugggucucaggagaaguguucgggccauaaccuaggcugaaauugcccaaggaccauggcaggggcuggaggugggggaggaauacuguccuuucuagguugcaggcaucuuucuuacucuaacaucccaugugauugcagccugacucugacucccgcaucaauggugucucccccugggcuuccccacagcauucugcauugagcuacucacuugacacugacccaggcccacaguuccaccaggcagguaagugucacugaagcacaguugaauuuggacuaggcuggaguuuuuaugguuuugguguuugguugcuagcauucuuacgucugugugcucuggagcauagaacauuauucucuuuagucugaaaugaauguagauccauuuuaauaauaaaaaaacacuuuagucauaaugugcuuguuuauaaaauguguaggaguggauucaauuuuggugaaagaugaaaaauuucuccuuucauuugaaauaagcaagacuuuuauuuugcuuugagaauauuugugugugugcucauguguacauguauguguguacacuugugugugugugugugugugcacacaugugcauguaguguauguucauguaugugugaagaugcuccaagagccagaggaggacauccggugcccggcucucauccuccacgugauugcuuugagauaaguucccucacugaccugggauaggaugggcaggaagccucagcaguccuucugucucagcucccuccccccucguuacuaaggguuacgggcacacaucaucacagccagcuuuuuaguuggacucuggaauccaggcucggucucauacccaacgcaggaggcucucuuaccuacugagccgucucuucagccccaagacuggucguuugcauauauguuucucuacaacuuuuacauucauguacaugcagaaccuaaugcugaagaguagccugcaacguggucuucucuaccuuauccauccuagucucuguggacauugcuccaccuaugcucuacagcagaagugccaccaacaccaucagugacagugucaccucacuguuaugcuguuaaaaacacuauuguaguuucaaucauagaauaaaauacauaucgagauaauauaaagcaagacaaaauagacugugauaaaagcuccaaaauggaaaagaaagaaauugcuagaauauuuuaugugcaaaauaauggauuuuucagcuagcacacuagcgucaaauucacugcuacuuauuuuucacuuucauauuuucucuuaguauauaaauuuauccacauaaacauaugauacauuuuuaacuauauaaaagucuacugcuggagcuaaggauguugcucagugguagaauguucccccuauguuuuuauaaagaucuauguaucguuccuguaugcuuuguguguguguguguguguguguguguguguaugugugugugugugugugugcgcgcacuguaucguuccuguaugcuuugugugugugugugugugugcacaugcuugcauguaugacaugucaaaugaauacagaugcuucuguucccccagaaguuguucuuuucaaugacaguucauauccuguuccuauuuuggggcugguuacgguauuuuuugccugcaagcgguucuuugguagaaggauggacauugauucuaagcucccuccuuccuccguguuuugucucagcaucugaggaccugcuggccccaccucacgacacuagcacggaccucacggacgugauggagcagaucaacagcacguuucccucuugcagcugugaguaguaacaccuuuaugcccccguggugugccuguccuguccuuccuccuuccccacuugcaacucucuugucuucuuucggacgacagcaaagccaauguuagagacaagauugcaggcuguuuugaaauaacacagacauauguguugacagagaaagugaagccccauucagauggcagagagauucugagguccacugaugguaugaucccggccuuggagauuuucccacaggccucaaaagcgacuaaauagaguccauuagcacaaugucugcuuuuagaauauaacuuggguuaagugcaggcuauaagaaacuuguguuacuucaaagaagagccuugaacggcaugccaaucuaggaugaacacagcuuuucuaagguaacuuucuacguuccuugagauauaucuccacaugucuucguagucaggcacagaaagcaauuauuucuggccuccccucuccuuuaaaagaauucuuuuuuuuuucccuucagggaauaaaauaaucauugugugaaaaccagaugauucacagggucacaaauuaugagucugaagucuccauaugaacagccaggagccaaaaaaaaucgcccaaugagagcaguccaaaucccaggggaaauuacauaaugauuuuaaucgauugaauuuuuuaagugguuucucuccuggcaucuugccacccuugagauucugcugcacucucaccucagagaccucuguggucucucuacucaggagcuguccacagaguccauagacacagacucaccacuggauugugacaguuucaaauacuuuuaaggagcaugaaagggucacuuaucauuuggggguggggccucucaaauggauguuaaaaccagucaaucaguaaacuacaguuuuguggaagucucuguuuuuugguuuacuguuuucugucagcucccuagacaaaucuaagucaggagaaagagauucaucaauuguugguguaauugauaaacauguuaaaucuguuacaguaauugaaguuaaagguugaauuucaucucagaaguuuuuguucuggcuuauguaguacccaauggcuagaaaaacuaucauguuuuaugaauuagaguuucagaauuaaaguuucuaaacacuaauacuuuuuagcugaacugccaccuaaauguauucaucacuaaagagcaaauucuguaaguggaauucuguuuagaaguuuuuauuuaaauuuaauguuggaccuuuucaauuuaaaacucuguuggcagugaaaucagagugugagauaugcuuaaaucuacgcuuuguaauaaauauaaaaauauaaaaugcauaguuucuauaauggaaaugugcuucaaguucaggauuuuucuuuuacgagucuuuuuuucuaaagcacuucuaaaucuuuccuaaggcauauucugauauguauauuugauuuuuaaaauguucaucuaugccuugcuuaaaauagaauauaauggaaaaacuauaacuguauaacaccuaaucuucaaagguaacuguugcuaccucaugcccugaccccugauacaaggauaaaauucccauugaguugaaccacucacggugauugguuccugagaagaggcuuagucucuauggagaccacacugcaguggcuaaacccuucccuugcauugagaccucuuuaccugugacaucauccuuggcgcucacuggguuauuuaaagaggcuugcaguuccuuaagaggaaaacuguuggcauucucuggcaguguguauaucuaccaguguuuauaauguugagauuuucuauacaugagcacuccuagucauuuguuauaaugaagaauccaggcaccucuuaaauaagaaaugguacauaguacauuuuagaguccugugggauccacagacuauguguucuuacuucugaaaauggcauuguuuguuccuuuucauuauuuauauucauauguuucucuggcaaauauaaaaaucuucaagguaaaaaaaaugcuuuccaaucuagaaaaaaaaaaaaagaacuccauugucuuguuuacaaaauuaaugcauaccucagaauuuuaccuaggauuacuaaaucauuucaaauuguacagaaucaauuagugcaugguacagaccugguaccuaacacagacuuccagauugauguugucagugguuuacagggacagucauguuucuagcuagagaaauauaaugguugaaaauuucccagcuagcacuuagaaagguuuugcaggauucauuagcuuuaauguuccauuuaaauugcucaguuagcaaauauuuuaucgagagucugcaacucccaagcuuccugaucaccuuuggaaguuuaucuaacuaaauaggauuggcaugcucucauugccuaaacaaucucuugaguuucuauagagaaggagaauguucaaauugcuuguagccagugugugauggaugggcugagcugcauguuaaucuugacuuuugauccuuuguggauuaaacaaauugcauggcuacaaaugaauuucacucauggcaauuuuggaauuaaaaugagugucuguauucauaaauccuaauagcaugaauagcucuguuagcuuauuuuuuauauugugucuuauaugcuguuguguguaaagacuuuuaaaacccuugcauuuugaaucaauauugcaguuagcaaugguagcaucuuugaauuaugaccucuuaaaaugacauugaaucucaaagcagagacacaggcaucgccaucuuacccuaacaauuaaagaauugaauuuaauuuguguugacaguuauccagucauguaguagaaaauucuaaugacuauaacuguuucuuuguuggcauaauauagucugcuuauaguuuguucaaauauguggaauauuaauaguaaauugagcuuucuuucuuucuuucuuucuuucuuucuuucuuucuuucuuucuuucuuucuuuuucugcuagaaguaaugcuuuuagacuuauuguuaacuuaccuuguguuucugcugugaucagccugcauuugucaggcuugaauggcauccaucaaaaacucaagacuuaacaaaagcacaaugauuaccuaauuuucuuuuaaaauacacagcuuguuccaggaaccgccuauaauguuuuauuugauuaaaagagauaggaaggcaaaauggcuuugacuucugucuaggguuugacuauuacauauccauuauuuaagagagaagccuaacugucuuucuuuucagaugggguguauauuuacaacaugucuuuacuaauaauucaccucagcuaccuccgggguauagcucacaugaggacagggguucacucuuuucucugaugggaaacaccuuguaggacuaggcuuauguuucccugguucuucucccaaauaccggggcucacauucuccccugcuaucacagggaggaaaucaaucucaaucaaucaaucucucucucucucucucucuuuuucucucucucuccucacaaaugagccacagauguccuuuuucccccuuaucacagaaaaaugaaggauuggaagcauguaacaugcuacuugauuagagacacuccccuuuggccaaggauagauauugucaucauuacccuuucuuucccuauguugaauaugaaucugcagcgaaagugucaaauauuggcaggcuuagaggacauagccagccaauggccuguaaagcaaaauggugaagcaguuagacuucaauuacuguucacaacaacagcaacaauggguccugaaaugugucucuaguauuagaaggagguagacauccugccuggaagacuauaggaauccuaaacuuucuaggcguugaggacaaaggcuuaccccuucucccuccuaugggagauaguuacuugcacagcccagauuuccucaggaaaguucagagauaguuuuaaaagaauuauuuacucuuauuuuauguuauguucaugcaaguuuugcuugcuugcuugcaugucuguguaacaugugcauguagugccaauggaggcaagaagaaggagaaguggggaggaggaagaggaggagaagaagaagaggaggagaagaagaagaggaggagaaagaggaggaggaggaggaggaggaggagaggaggaggaggaggaggaggaggaggaggagaagaagaagaagaagaagaagaagaagaagaagaagaagaagaagaagaagaagaagaagaagaagaagaagaaaaagaagaagaagaagaagaagaagaagaagaagaagaagaagaagaagaagaagaagaagaagaagaagaagaagaagaagaagaagaagaugaucuuaacugcugagaugagcaucucuucagcccuuggauuuuuuauuuuuucuuucauagaaagcaacaauuuucaaccugugcaccucuauacucuugagagucaaaugacacuuucacaggguucacauaucagauauccugugugucagauauuuauauuguaauucauaacagaagcaaaauuacaguuauuaaguagcaaugagaauaauuuuacagcuggggucaccacagcauguggaagggucacggcauuuggaagguugagaaccacugauagcccgccuauaaugucugugugaacaguggucucuuggaccauugcugcucuucagaggggcucuacccugcucugccaucagcuuugucuucuagacuauacucauuuuaaucucugaauuguuuuuagugaagaucacaagaacaaggggucaugaacaugaucucagugaaaaauggaccugacaaagcagagaucuagaaaagucuugguagugccaguucuccguaagcccacgacaucagcuucuuugucaugggcuccgaugcaaggauaauguugaaggguuauuagcacccuaggcuaacuucugugcucuuuacugaacccauguaaggcaucacuguugauccccguucugaagacugcugaugaaugacuagccuuuucacugaugcaaauguaccuucuuccuacagcuuucagcaagggugugccaaggugugcagaaaauacuaauucccucuaaggacccuuuuggucagaaucaaacuguauauucaacacaacauauaggcucuccucuguacuuauuauacaaaagucaaaaaauacauggcauaguuauaaaaugaaguuuucagauuuuuuuucucauuuauaaaacuaagaccuuccugaauguuuuauuuuuuuuuuccauuuuuuauuagguauuuagcucauuuacauuuccaaugcuauaccaaaagucccccuuacccacccacccccacuccccuacccacccacucccccccuuuggcccuggcguuccccuguaccgggucacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggauacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguuuaggaaauuguaucuuauauuguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuauagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuauuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaaggauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuuuuuuuuuuuuuuuuuuuuuuuuuuuuuauuagguauuuagcucauuuacauuuccaaugcuauaccaaaagucccccuuacccacccacccccacuccccuacccacccacucccccccuuuggcccuggcguuccccuguaccggggcacacgaagucugcguguccaaugggccucucuuuccagugauggccgacuaggccaucuuuugauacauaugcagcuagagucaaaagcucagggguacugguuaguucauaauguuguuccaccuauaggguugaagaucccuuuagcuccuuggguacuuucucuagcuccuccauugggagcccugcgauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauucuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguugccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucgccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuugagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauucucgguuuuuuguuauuccagaugaauuugcaaauugcuccuucuaauuccuugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucuguaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaagaauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccauuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggguaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugggugaauuuaguuuugucguggaauacuuugguuucuccaucuaugguaauugagaguuuggcuggguauuguagccugggcuggaauuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuuuuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacacuguguugcuuuggcaguucccaggugguacagacucuaaccuaagcagacuaaauuccuaaguuccuuggagucccgggacgaagauggugaccgcugcugcuguggcuuaggccgccuccccugccgggugggcaccuguccuccgguccggaagguggccggcuguccccggcccacacagggugcugccucagcgccucugugcuucugccuguuccagaagcugucagguucucuggcgcacccucucaccuguucagacuaauuuccuaaguucggcgggucccggaccaagauggcgaccgcugcugcuguggcuuaggccgccuccccagccgggugggcaccuguccucugguccggaagguggccggcuguccccggcccacacagggugcugccucagcgccucugugcuucugccuguuccagaagcugucagguucucuggcgcacccucucaccuguucagacuaauucccuaaguucggcgggucccggaccaagauggcgaccgcugcugcuguggcuuaggucgccuccccagccgggcgggcaccuguccucugguccggaagguggccggcuguccccggcccacacagggugcugccucagccccucugugcuucugccuguuccagaggcugucagguucucuggcgcacccucucacccguucagacuaauuuccuaaguucagcgggucccggaccaagauggcgaccgcugcugcuguggcccaggccgccuccccagccgggcgggcaccuguccuccgguccagacgguggcuggcuguccccggcccacaaagggugcugccucagugccucugugccucugccuguuccagaggcugucagguucucuggcgcacccucucaccuguucagacuaauuuccuaaguucggcgggucccggaccaagauccuuccugaauguuuuaaaagagcuaguauauguuuugugugggguuuugguuuuuucuuuuucuucucucucucucucucucucucucucucucucucucucucucucucucucucucuagaauguuugcauuucaaaucacauagaauaugagacauuuacuuggaaaacuagccuugcuuagagggucaggguggcuggccucugcuuccugcuagcauccuuggaagggcagagcuauucucuuccucugaaaagcauucuauacauuugcaugcaugagaagggaaggcacaaagcaauaguaaagcccucaauugauuucuucuauuuucuuuuucagcaaauguccccagcaggccacagguaagaguuaaugguucaauugacuucgcuuucuugaucccaucugggcguaagcacauuagcugcuauugauuuaguuuagucuuacuucauucuccauauaaaugaguaaagccacgugauguuuaaguguuacuugguucuguacaacagauuguugcuuugaagauguugggugggaccauuugguuccccaaaccaaacucuaugaggcacccaaaguacccaugcuggauuucaguucucauuccaugcucucuacuauacaaguuucuguguaaaucugacugaccucaaaucucacauuugucacagaacagugacuuugaaaugucccugguacuacagggcaauacugagaucauuacuccaaugaagacagaguugccuuuuucauuuaagaaaauacguugagcucuucuggcaucuuuagcccaguagcuuucaguuuuguuugguuccuuaugaggagccauuaauuaaaauauaccacggagccaaagcagaucuuuauaaaacauuuucuugagugaauuuauuaguccuuucaaaacagucaacauuguuucaucuuauuagcaaguggaacuggggucuuggcuagaagacaggugucuguaaagcagucugugacacaguagguaggguuagcaucuuccggugaugcccauuguccugguccauuggaagcaaggauuuuaaagggaagugagaugacagaagaacccucagagguauaagaagagaugggaagaugugcucaugugcagggaagcagacacaucccaaaacaauccauuuguuaaaaguacucaaguuagacauguuuuuucaaaaaucuacuucaaaauuguguagcccguauuuagacccauuggcauuuuccacauagcagacaccacuagacaucugucuccuccucucuaggacaugaaggaaugggguacucuuuugguagccuaacacauauaucaucgcuaccuuucccaagaagcaaagaccucucaauuugaccuggguuucuagccuguuuaaaaaaaaaaaaaaaaaaaaaaaaaaagacgucuugucaccccuggccucugcuuuuauguugguguugacuacuguaauaaacagcuggcaugugacuucagggugaaggaaauguccucaucccacaugagcaguugggggaggguccccuuugaacacagccauauaaaguuuuaguuaguucugaaagaugcccuuauuuucccaugaagaacugacaagucuucauuaccugaauguccuuaugcagaugcuguucugaccuugguguuuucccuugccacaggcaaugugagcaucuauccagccagccaacauuucccgaccuucaguauugcccucuucugcaaaugccaaucccaagacccauucaaccccaaagcuccguggcuccacgacacaagcuguugagugcuuacuggguguucuacugagggaaccaaacacugacuauccaaagagaaaaggauauuuugguuuucuaauaacguauauuauuguuuucuucuccccuuucuaugcaacuguaaauuaaugaacagagaaguauuuggaggugguaaagcauuugucacugauuuguauaauauauacagccaugggaaagugggugggggcuuucuaauaugaaacugucuuuuuaauaaccaagagaaaaaauugcauaagaauuagaccacuuuacauuauuacauuccuucugcuguucacauuaaccuuguacaauaacuucacuuauuauuugacuguuuuaccauuauguuuugguuauuuauaaauuuaucagccauacaaacaaauagauucuauguauuuguuucuauaaucuggccaaauuccuaaguucauauauuugaaucaaauauuuuacauauguggaguaggcaggcauucugaagauacuauuuaacuuuaguugacgucacacacaccauccuuuaguaaccacuggaugacuacacuaaaaauccuguggacuuuaacggcaagcugcugggguauuuuuccuccuguuuuuauuccuuuuuuguaaguagaucuugacgucuuuauuuauuucaucuugcaaucucuauaauaaagaagacuguauuguaauagucucaaaaaauuauuuuaccaaggguuaccauuuaagcauauuuucauuuugauucagaaaccaaaguugguacaaccucuccuaguacuugcaaccuugguuuucaugagaaaacacacggcaggcuuugcccauugugaggagagcacacaucaugcucuucaguuuccuuugaauagacuuuuauuguuguuuuuguauuuuucgaguccuguguaaguuuugaaagcucugguuguuuccuuugugaaagcaggcagauacuuauuggcugucucauuugaagcuuuggagcagauagucagaugucucaugaccccucacuuggccagcagcacauccgagaaggaugucacucacaagccuacaccacggcuucucuagaaugaaaucagugcucggaugauuguaucccugccucuacuucugaguguguucaacuagguauuggcuucuuuuucuuuuucuuuucuuuuuuuuuuaauuuaacacuuaauugccgauuuuagagaaaccaaaaauaaaggugaagguaauauguuuugauucaaacauauaugcuuuuaaaacaucaggacaugcuaacuuuggguucucuuucacugggaucuggccagaaggaggcugaaaguuagaaauugcuauucuuuuaggaucgguuggguggguuggggggcaagggugucuauuugcagcauagauauuuugagacgaagaaaauuguuuuauauaaggggagagccaugaucaccuuucuaccucagaaccaccuuccuccauuguguuggacauagcuuuauaugccgcagugugcaaaaccuagggcuguagucaggccuuuccauacccaggaagcaccuguguaaagaagaucaacagaaacucccggaacucagaaccccaaguuguagauuuggugucguccuuguucuugcuuugaggagucauguauucuuuuauuuccugccuguauuuguaugcaaaaugaucucuaucugcuauuacagaaaaagcuacacaaaacacuacauuguaaccuucugaguaauaaauaagaggaaauauauuacaguaaccaugaugagaaauaaguguauuguucuuuugaaauaugugguuaaucgcagacugucaucuaaucuguuacauaccguauuuuucauccugaauaaaaguaauuuuaacacaaaaugacuuugauguuuggcuguguucacugaugaaaucagaucucugaauguaugugaugaaagcuaacuauaagaugaucuauauucugauaaaucuaaauauuuucugaaacucucucuuauacauuaaucuagucuccauucacucauuaucucucucuccuuucuugcauauaaauaugauuauauauuuuucaauuuccuguacaaaucagagucuuauuacuagggaaaauggauguuauaaguacauuccuaaagcccauugggccuucauuuuuauaacuuggagcuacugagauuuaucagguuacucucucaaauccacuuucaucacuagacucauaguuuucuauguaucuauauuauuauaacuaaauaaaaauauacauga

SEQ ID NO: 5423 - RNA, 6484 nt, Mus musculus
uuugaaaacucagaguuuauuuuucuuuucuuuucaagugagauuucaaaacauuacuuuaaaaaacaacaacaacaaaacccccaagacauuauuuaaggaauuacccacaauucugccuuugaaggugcugccacuggaaaacuaggcauuuaaagacuguuaagugaaacaagaaauucaauaaacaucagaaaaaugcaauccauguuuuccuccaaaauuccuguuuuugaaaugaaaucuuuuuuuuuaagauuuauuuauuauuauacauaaguacacuguagcugucuucagacucaccagaagagggcgucagaucucguuaugggugguugugagccaccaugugauugcuagaauuugaacuuaggaccuuaggaagaguagucagugcucuuaacugcugagccaucucuccagccuggaaaaaaaaaaaaaaauuuguccugaaauuuuauggaaauacaagauacacugcauagauuucucgagcaaccuugccauuguauaaaaacugauucauaaauccugcuagcacagggauacuuugaucuguuagccaucucuauaggccacgcccucguuacacuugcaucacagcggccccucugaaucaauuguuauaaagaucucauaggcgagaccacagagggcuggaggagcucaagcgccuggcuggggugggggguaagggguggggggugaugacuucagagcccccuuggaucucggguuaaaaggagcugagcagaaccgggaacagcagggccgggaucucagcgaaggcucuaaggggccugagcauggcaagcacggcacccguagguuggcccgcuacccaucuucuccccucuuguuaaaaccauuagauugcauuccugaagcuagccuucacgguuucauuuguucacuuccuccuccuaaggccgaucaccaagguccagcuaucaaaguacugauguccaucagucaaaagccaccuuuaaggcugaccaugcccaaucaaaacaaacuaauucacccuaacacugaucuccucuccccuuuauaaccacauuugccucugggccauggucugucuccucuuagaggcagucuuuuguuccucugggcagaauaaauucucccuugcuccuuuuccuccccucauccuccaucuuuugucuuuguccuuuauucccugcccuuugucccuaggggcaaauaaaucuuugugcugagaacuugguuuuguguccugugccgaauccaguccuuucacucaguacuggagcaagggacaggaaugccuugaguucaagaccagcaugggcuaucuagugagucugagucuauccugggcuaaauagcaagacccuauuuaaagccaaccaaucaagcaaccaacaaacaccaaaccaaaaaaauaucugcuucucccaaaaucucuugugcuauguguuugcuaaucacacucacuucuguguggccuuaugggauguguauuaauuauggauuuuacaagcaugccuacuucuguguguaguuauguaggagggagacuggagaacucagacaaauauacuuuuuuuuuaauugcucuuacuauuuuuugguaaauauuuauuuauuuauuuauaauguauaugaguacacaugugguugugagccaucaugugauugcugggaauuugaguucaggaccucugcuugcuccgguuggcuccgcaggcucuggccuaaagauuuauuuauuauuauaucuuaaguucacuguagcugucuuuagagacaucagaagaagguaucagaucucauucaggaccuucggaagagcagucagugcucuuaacugcugagccaucucuccagccccugaggcaaauaucaacucuuucuguagcugauguugcuguagcuauagcuguuguaguagcuauaacuauagcuguagcuguagcuguagcgcacgagagagagagagagagagagagagagagagagagagagagagagagagagaaucuacauucagguacaugcacuugagugucaguugugagccacuaagugagugcugggaauugaaccugugucuucuagaagaacuagcucuuaaccacugagcaaucucucaagccccaagaagcaaauaucaacucuuucuguagcugauguugcuguagcuguagcuguagcuauugcuguuuuacuuuccuuguuugagacaggcauuacuguagccuggcuggccuggaaucuacuauguaacucaggcuccugagugcugggauuacagauuuccacuaggcccaggcuaucauuuuuuuuuuuuaauuuuuaugugcauugguauuuugcauacaugugaauauguaugaaggcgccagaucccuuggaacuagaguuguagacaauugugagcagcugggaauugaaccuagguccucugaaagaacagcuggugcucuugaccacugagcaucucuccagccccucgcuguguuucuuaauacagcagucauuugugugucugugugucuaccaaaccugauuaaaauuuauuuguggcacauuucuaccacauccuccagaugaggauacaaugaacagaaucaggggugaacuauguccaggggauuugggggccauucauuuauucaguguucagagagugcacguaacauucuagaggcgcucacuguuaggcuuaggucccaguucacacuggugagcacccagggcgggcccugggcugagagggcugacagagcagccagugcugcccuggccugacucacuuccugugucccagaccauuacugccccgggcagucugcucacacuggcaggccacuuccuaugucucuauguggacuuuagucugugugcaauacugaccccuaucgccuaggauucaguuuuaacuauguccuuccuuccuuccuuccuuccucccucccucccuuccuuccuccccuccuuccuuucacuggggccucauuaacuagcccuugcuugccuaaaauguguuauguagaccagguuggucucacacugucagagauucaccugccuuugccucccaaguguuuaauuagaagcuuaugcacuuaauuaaaggcauucauuuguaucauucguucaaauggugaaacagccaucacucuguucuaggucuagaagcacuguucauggaaauuaagcuuaagccagauugguucacacgcacaccccuaaaauaguccugugccuaauuguacagauaugaauagaugcauguucucuaccuccuuuggugucauccuuacuauuaaacuaucucgagauuccauuucaucuuagucagaaaggcuaccauuaagaaaucacacacgcaaaaaaaccauaccaaaccaaaccaaaccaaacaaacaaacaaaacagaauaaaacaaaaccucaaaccaacaaaacaaaacaaaaucaauuaaaauaaaucuccuccuuccaaaagcugugcauaguagugaccccaugucuuuaauguuaacacuugggaggcagaugcaggcagaucucugugaguucaaggccagaauggucuauauagugaauuccagucuauccaggacauagagagagacccugucucaaaacacacacacacacacacacacacacacacacacacacaccccuaaaaauagaccuaccauauaguauacuacuccuggguguuuaccaaagaaaccuaagacagcaaccgcaaagaucugugugcacagacacauaugcaggcauguuuaaagcugcacccccgcugccaaggaaagaggucagcccaggcacugaacaguggcugagugaauagagaaaacucaguguaccugcacaaucggguuuuuguucugccauaucucagaacaaacuuaggccauuuucagaagaaagaugaaacuggagaucauguuaacggaaacaagacaguucacaaagacauauaccacagauucucucuccuguggaaucugcuuuggaaauggauaucuauaaaacuugaacguagauggcaguacaugggaagaguaaaggauuugagcacaagggugggucgagcaucacagagcaacaggcugcauacaagcaaaccacgggauacacagguuugaaaaugucacuaugaaauacaucauuuugugcuaugaauauacuaauaaacuuuuaagaacccgaggcauuaaauuuuacuuccuuugaaucauuagcacacgccugaaguacauugcaugcauuugagguguuuaucgacuaauuaaaacucuaccuaaagauaaacagcagccuggauggagcugaggagguggcucagcagcuaagagcacuugcuguucuuacagaggaccuggguuugguuccuggagcccacguggcagauuguaaaccaaccccaguuccagggcaccuguagcuuccuccugaccgcacagcaggcacccaugugguguacuuacagacaaccgcgcauacacacuaaaauaaaugaauaaaagugaaagaccaaaaagcuaaucaaaacccccaagccccaacugaccgcugaggacugagaacgcuucugguguaggagucuuccaacugaccacgaugucuguuuaacauugauggcucaugcaaacaaacacacacgcauacaugcauacacacauacacacauacauauacauaucccccuaacuucauagcugucuucagcauuugaaaggaaaaugcguaacugaaacaaagauuauugacgccaaagaaggguuucaucauacaguuaaaacaaugcucaugaaaauuauuucagugaugaguuauucugcuuaauggaagaucuuuuuuaaauaaauaaauaaagauuaaaagauuuggaggaaaagucaacuuccugucuguaacuuaagacaguuauuaaaaaacaaaaaaaaaagauaagguuuauucaaacaaacuuaccucaaguuuaccaguaggugucacaauuuaaauaugcugauaucauuucccacagaguuccgaguuuuucgaaaaauauuuuucuacgacuccagauaacugaauggaccugaggaacacgugaaaauaaaugaucaaugguaauaaccaacguuuccgagguuuuaugauuguagagagggguuuauuuaaucagugucucaacuuauucaaaaggcuggggaguuccuugagccacgccuacaaaauguguuuaagaucuuggacugcuuugauaaaaaacacuuuuggagagaauaggguggcacacgccuuuaaucccagcacuugggagguagaggcaggaggauuucugagaguucgaggccagccuggccuacaaagugaguuccaggacagccagggcuacacggagaaacccugucucgagaaaccaaaaaccaaaccaaaccaaaccaaaccaaaacaaaaaaacccaaagaaaauaggagaagauaaaaaucgaaaauauuucaaauucugggucuucauggucaaaugguacauuuuugaaagacugcaugugaacacguuaaacuuugagggggggggaaaugaaaagaaaggaaagaaagaaaacaaagggaaaggaagaaaaaagaaggggguggggagcggacagaggaaaggcaaaagcggacuuguuuuuuuuuuuuuuuuuuuuuucuuuuuucuucugugcaaaaguacuuuugcaaaaaguuagccaauaccagaccucuccggggagccucuucccgccuggcucaggucgguuccuggagacacggucgcuucacugcgggaaauugggcugccuuguagcagcgcccuauuaaggauuaaagaacauuucuuucaacugaaauaagacuucuaaauuuccaaaagcucuggaccuaaaaacaacugacagaccgcggcaaggaacaaaacagcaacuuuaccaggagugggguucgaacccacgcagacauauguccauuggaucuuaaguccaacgccuuaaccacucggccauccuggugcaggcgugcucucuucucuuugcuguuccuacaaagcucacaauaccguccucauuuuccccaguuacucgaggaugcuucugcgcaggcugcgcggcgcuuucccgacccggcuacagagacucggagacugccgccgggguuucgcgccgccgccgccgccgccgcucacugucgccccgagaucucggcggcagcgaaggaacugcaggagcagagagcgggacagagcucugggccggcgggcgccggcucuccuugcucacuguaggugcgcgggcgcgacaaacaaacuccacagcuaacuucugggcuccggagcggaggugggaggggucccucgggcgguguaggcacggguccgcagggcaaccaucaguguguuucuucuaaaucgaauagguucccggggcccggcaccugugcgcgcgcggcuuuccuuccucgccaguguuaccacaugccggaaggagg

SEQ ID NO: 5424 - RNA, 1331 nt, Mus musculus
auugccagaugcuuagcauuuauuauauguagguauauaugccagggaauacagucucaaaaacgaaauacagagucuaaaaaggauaggagauaaauucuggggaauacagucucaaaaacgaaauauggagucuucaaagguuaggagauauaugcuggggaauacagucucaaaaacgaaauacagagucaucaaagguuaggagauauauacugggcaauacagucucaaaaacgaaauauggagucuucaaagguuaggagauauaugcuagggaauacagucucaaaaacaaaauguagugucuucaaagguuagaagauauaugcuggggaauacagucucaaaaaugaaauacagagucgucaaagguuaggagauauaugcugaggaauacagucucaaaaagaaaauggagauucuucaaagguuaggagauaugugcuggggaauacagucucaaaaacgaaauauggagucuucaaagguuaggagauauaugcuggggaauauagucucaaaaaaaugcagugucuucaaaagucgggagauaugugcuggggaauacagucccaaaaacaaaugcagugucuucaaaggucaggagauauaugcuggggaauacagucucaaaaacaaaguacagagucaucaaagguuaggagauauaugcugggaaauacagucucaaaaacaaaauggagauucuucaaagguuaggagauauaugcuggggaauacagucucaaaaacaaaguacagagucaucaaagguuaggagauauaugcuggggaauacacucucaaaaacaaaguacagagucaucaaagguuaggagauauaugcuggggaauacagucucaaaaacaaaguacauagucaucaaagguuaggagauauaugcuggggaauacagucucaaaaacaaaguacagagucaucaaagguuaggagauauaugcuggggaauacacucucaaaaacaaaguacagagucaucaaagguuaggagauauaugcuggggaauacagucucaaaaacaaaguggagauuauucaaagguuaggagauacacguuggggaauacagucucaaaaaugaaauacagagucuucaaagguuaggagauauaugcuggggaauacaaucucaaaaacaaaauacagagucaucaaagauuaggagauauaugcuguugaauuccaucucaaaaacaaaaugcagggucuucaaaggucaggagauauaugcuggggaauacagucucaaaaacgaaauacagaguugucaaaggucaggagauauaugcugggaaagacagucuca

SEQ ID NO: 5425 - RNA, 17737 nt, Mus musculus
cagcaaggagaacugcaguacacugacaacuccagaaaacacauuguaaguguugcucugugccaggcucugcugcccugaaaagcauggcacccaggaagagauuguaaguguucuuaaggaacucacagucuaaggcgauugggaucucuagccagccaacucugaaaccaccuguggacuccuguguuagugguuaggauacgguguccuauggaggcacuugggaggaagugggauguuauugggggaggggugguuauggcacagagcauccuggaggagguggcauuugaaauguaccacaaaaggauaaggguuuugccaaagcggaagcaguagagauuccggcuuuaggccaauggcauuuaaauaacuuuaggauacaguuccugaagauguaacuuugaugauuauucuaagugacuggcuccuuuucuuuaagucuaccugaagguuccucucucucugucucucugucucucucugucucucugucucucucugucucucugucucugucuccgucucucucucucucucucucucucucucucucucucucucucucacacacacacacacacagcucuaggacauuuauuacugaacuacggcucccagaucguacuuucauucccucccuccuuuccucccuccaacccuccuuccucuccuuuuuuuccuuccugauuuuugagacagcgucucauguagcucucuauguagucgaagaugaccuugaacucugauucuccuguuucuguuuccacacugcuguguugaccacuacucugguuuuauugcauucuaggcaagcacucagccaccccagcagguucccaaacccuccuucuauacaaacuucuuaaacauucauucaacuaagauugccuuauuuccuaacgcaguuucucagaaaaguuuguuccaccaacaaccaaagucagaaauaacaagagccugaguagaaauguaaaaucuuggacccgaacccagauuggcugaacccaaacuuugggauuucaucggcuacaaauucgaggauggcagaggcagacccaaaggcugagagccaugggagcuuccucaaaagcccugagcagcccacgaaguuccugucucaggcuccagucccacgguagggcagacagcucugacacauaaagccaccagggccugguggucgaggugaccucuugagaguuuucuguuaggaguccuuggggagggaggucgugggucaaagaccauccuuuagguuuuugucucacagcagacaaaccgggcgucuuggcuaaguagaucagaucugacugggaaacagagccaagggcuguuaaaaaugaggagggugggcaaaaacugacuuccuugguugugcaccugaguaaugcaaccuucuugggguccuuaaguaaccagagcucauuaaaacuccuggccacucccuacuccagaucacaguagucaucugaccaaaccggucugggucaggugacaggagcaggguacacuuagcagaagccggaaggccagcgcuaggcagcuucugcggcugacagagaagguucccggcuucccuggugacuggcgguucccccgaggaucccaggcuggcgcgcaugcgccugggguuccugaugcuucugccgcugcugcugcugccgcuccugaggccuuggggggucacgagagcccuuagcuaugaccccacuugggaaucucuggacagacgcccgcugccagccugguucgaccaggccaaguucggcaucuuuauccacuggggaguguucuccgugcccagcuuugguagugaaugguucugguaagugcauaccuuugcccaaagggcucgggcacggacgcgggcgcgcgcgcgcgcgggcgcacacacacacacacacacacacacacacacacacucacacugggcuuuaugucaccccagacaguggcagucucugucucucucugucucugucugucucugucucugucugucucugucucugucugucucucucucucugucucucucucucugucucucugucucucucucucucucucucucucucucucucucucacacacacacacacacacacacacacacacacacaaacucacaccggaguucuuaggcacucugcaggugggccucccuauagcaguggcaaugccugcgugauugagggaguaccagucccagaauuugaagaauuuucaaaagggcuggugaaauuucucacugguuaagggcccauacugcuugugauuuguauaugcucggcccagggaguggcacuauuagaaaguguggccguguuagaauaggugugucacugugggugugggauuuaagacccucauccuagcuaccuggaagccaguauucugcuagcagccuucagaugaagauguagagcucucagcuccuccuguaccaugcaaugcuuucuaccuugaugauaaugaacagaaccucugaaccuguaagccagccccaauuaaauguuguccuuauaagagcugcccuggucaugaugucuguucacagcaguaagacucuuaacuaagacacugcucuuguagaggaccuuagucugacuccucacacccgcccugggaggcucacaaccaucuggucauucugguuccggggggggggguucgugcucccaaagccccccccucacaugcacacgccuacacacacgcacacauguaauuaaaaagaaaaucagaaaauuuacaauaaaugcuuccugguucagcuaugacgugaagauccuugaaugcuaaagcaucaaaaacccaaagcagagcaaaggggcaauaauagagauauauuaccccacaguaucuucauagucacaugacgguagacaggcaacacaaacuuguucacucuuuaacuaucgcuaaccugaaagccagcuucucucuucacuaggagaucccauuaucugucugauccaccagccagcauggguugcggugagggauguuucugaaguaggcaugugacuuugggucugauagacgacaagcugcuugcugccugugagggcuuugaaucuaaucucaggcaggcaaaggccgugccaacugugggaacugcccggcccuuggaaauguuucucccuaucuacccaaaauguuuucuguuacugacuaggaccgaugcaaguuauguuuuagguaugucgucuugucuugaaaucuuagccacuuaaguuccacagugagcuagugugugaaggcaaagaugauaucaugacuuaaaguggggaauuuggagaaucgguggcuggguuacaggaggacuacacaaaggaaaagacagagaauauggccagagauucaguuugcauaagcuguccuuaaugcaaacccaccaggacagagagaagcggagagaaucugugcauauucuucauacuaggcuggguaaagccaggaauuacuuuaagcaucuguguuuguguggucaugugcucuuucuuuuuucugccacaggugguauuggcaaaaggagaagaaaccccaguuuguggacuuuaugaacaauaauuaugcuccugguuuuaaguaugaagauuuuguagugcuauuuacagccaaguauuuuaaugcaaaccagugggcagauauucuccaggccucuggugccaaauauguggucuucacuucuaaacaucacgaagguaaguagggcacauaggauauaugcugacaagggcuagaaaauguaaggucguucuuuuggauggagacauuaaaggaaggccguccugugaaacccgguuucucagaauagccauagguggauagugauguuuccgcuuaaguuggaaacauuauggauccagacagcugguuucacagaaugagaggaaagauggacacaauuucuauguacacauuuaaccauuuauggugguuugaauaugcuuagcccaugagaagaggcacuauuaggugauguggccucucuggaggaaguguguuccugcugggguggacuuugaggucauaugcccagugcagaggagucccgccugacugucuuuggauggagauguagaacucuggacuccuccugcaccaugccugccuagaaacugcugugcuuccuguccugaugauaauggacugaaccucucucuaaccuguaagccagccccaaugaaaugcuuuaagucuugucuuggucauggugucucuucauagcaaugaaacccuaauuuagacaucauuuaaauaaauaacuagauuuauuuaaagcugguugaagagaaugaguauagugagugagugagugagugagugagugaguguguguauacauacauauauagugaguauaguauaguugcacuuuccuuucuguccaucuguccaucuauauacauacauauauuauauagugaguauaguauaguugcacuuuccuuucuguccaucuguccaucuguucuuucucucucccucccucucccucucucucuguguuguuguugcuguuuugagacagcguuucucuauguagcccuggcaguccuggaauucacucuguagaccaggcuggccuugaacucagagauucaccuucuccugccuccugagugcugggauuaaaggugugcgucaggcucccuuucuguucuugaaugcauucuuuaaaaucaucauggcaucuacgcucaugcugccuuaagcuugacucucacaguuggcugugcuuugugcauaacuuuuagauaugcaagcaguggguaaguugcuacugaugaaagaagacagaggccccaagggaaaagaguuagagauuuacaauaaugcccagaaacaucaaaagaacuuaagguagcacaaaaauccugcauuaauagaguuuucugcuauagccacccaguguccauaagaccagaaagcccuggcuaauguuaccucaguucuuaaugacccaaggcacgugcugaaauuuucauggacuuuauacuaguucuucagccucuuaguuaucuaugucuucuaacauuuuauauaggauaaugaacaaccuaggagccaauuccuguugaaauacaaauuauuuccaagugcuuguauaaugcugugugcugcuugcuuuacccuuucaguuguuaggacggucaauauugggggacuuuaaagaguaaaauccauguuuauggcuuuagaguaagaugggugucuuaguuaggauuucccugcugcaaagagacaccaugaccaaggcaauucuuauaaagaaaaacauuuaaucauggcuggcuuacaguuucagagguccaguccauugucaucauggcaggaaacauggcagcaugugggcagacaugaugccaaagaaguggagaguucugcaucuugaucugaaggcagccagaaguagacucucuucugcaugcagccaggaggagguucugauuccacacugugugguguuucagcacaggagaccucaaagcccaccccgcagcgaugcacuuccuccaucaaggcuacaccuauuccaacaaagccacccucuuauggugccacuucacaugagccaagcauauugaaaucaccauaaugagggagguaaaauguacucccuucauuuaaauuaauuaucaagccacggaaauuuacuucuuguccucaugaauauucugagaaucacauuguagugaaacccaugcaagcgauagaccuuacccauugguucagaagacacaugggaauugcacaaucgaguggcgagcauugcucagugugauagauguggaaggugugcuucucuuacagaccacuauuguugaguguauauuuugcuuuagaugcuaagcuaacaaucagcugguggguguagccagaaauguggcagacaccaugacauuagacuguuccccaagaaccucagcuucugagacuggagacggaguguacagcucuuacagucauccugagaaucugaaaacccccagccucacauuaauuauauucccauugguugguccagaugcaugcaagccaggacgcaaagcgggccaagaaacaguuguuuggggaggcggugaauuguggguucauucugaauuguuuugguguucucuuggguugaaguuuaucagcgucaaggugguaacuagggcugucugccgucccuuuccaggcuuuacaauguggggcucagaccguucuuggaacuggaaugcagucgaugaggggccaaagagggacauugucaaggagcuugagguggcugugaggaacaggacuggcuugcacuuuggucuguacuauucucuuuuugaaugguuccauccgcucuuucuggaggaucaguccagcucauuccaaaagcagcgauuucccguuucuaagacauugccugagcucuaugaguuggugaacagauaccagccugaaguccuguggucagacggagaugggggcgcgccagaucacuacuggaacagcacuggcuucuuagccuggcuguauaaugaaaggucuguacacuuuuaugcaccuggacuagucuuaaacauuccuacuguguguguacagcagcauuuacauuccugugguuccgugcucauuugugccgugacaggaccaaaucguuauaagccaugcauauuaccuuggucaguauuuaguaaaaaugaucagaaauaugucaaacacugccaaacugauuguguaaucaauuuaacaaucccaggaucaagacaugacugggaccaucgucuuuaauuugugagucauaacugccccuguagcuagaguccccuucucucuacuugagccaccagacauaagaaauuggggaguguauuuugcaugaugacaacacucaauuuuuucagagauuuuccaguaggaggcaccaaucauaggaugaggaccuaaaacaauagugaaggaauucagucuucagagagguugaggaauuugcucuaggccuagaauuuggaaugugaguucagacuccagucaucacagaucuauuugguuuuagaaacaaaggcuuucugcuuucuuauagucaggaguagguagaucuguuuguggugacauugcccucugucucaagaaugcuuucucuuaaagggaaacuguccuuuucauuucagcccaguucggaaaacaguagucaccaaugaucgcuggggagucgggucuaucugcaaacaugguggcuacuauacuugcagugaccguuacaauccuggcuaucucuugccacacaaaugggaaaacugcaugacaauagauaaguucuccuggggcuacaggcgggaagcugaaaucagugauuaucuuacaauugaagaguuggugaagguacaguaaaauauguuguggaacuauuauucuggaauauucuuauaaugagagaguuacaggauuuuuuuucccuuauaguugggauuguguaaugccacagacucaagacacuacuuucuguggguguuuuacuauaaaauuuuauguauauauguguguguguguguguguguguguguauguauguauaauguauuauauauguguaacauauuauauauuauauuuauagauugauuaaaguuuauauuucaaaacuagucuuaauuuuucucuauuucaauuguauuuauuuuuauuuuauuauuuauuuagaaacuuguggaaacagucgcaugugguggaaaucuuuugaugaauauuggucccacgggagacggcaccauuccugucauuuuugaggagcgauuaaggcaaaugggaaccuggcugaaggucaacggggaagcuauuuaugaaacacacacuuggaggucucagaaugacacugucacuccggaugugugguacguuuuccugguuagcgagcacuguuugauagaggaaagcacucaguauagagagagagcaggauaaaaagagggacuggauuauugcugcaugaccgcauguguuccaacuugacucaaauacaaagagaaggaauaagaauugucauguuauugaacauaauguuuaucaaauucugcuuaaauagugccuagauauccccuagucguaggcacuauuuagcuaaacuaccaguuacaaaauugaaaggcauuuagguaacugaagauuaucaaguaguuaauguagaauggacucguguuucgacacuaguaaauuuccuagucuuggcaauaucauauuccaccaaauuggcaagcaagaggucccuaagggcaaaguaaacaguaaauaagcuagccaggagaagauuccgagaaaaugguaaaauaaaaguaaugucugcuccugcagagacagacugugauggaaagauuugcaugacgguggagaaacaccagaaaugauacuuaaugucacauuaaggaacugcaggugaaaugcaaauaaaaaccacagccagaagucaucucauguccuuuagcauaacuacccuuuaaaaaagggcagcugaugaucuuggagagauuggaauuucuauacacuccaguguaaugagaaucugaaaucucagcagcugugauggacagugugccagucccucaaaacauuaaaacagaauuaucccgccucccagccacuccaccuccgaggauauaugcauaagacugauaccagaagaacuauaucccuagauacuuaaagugucgagcaauggaguccacuuacgaauaguuaagcuuaagcugugugcauuguuauauacaccguguauauuagucagcucugaaaaggaagguguuguaguuaaaauuaguuggggguuuuaccccacauuugaucacuuaguucccagauaaagggcacaaaaccuuuauauuaaagcacuggagaugggcagauaucaacccucuaaacuauuuugucuacuucccuuucaauaaccuugagcuauaacuugccauguuccaccugggccucucuuacuccaacugaccagcccucguggccaguucucaugaucucuuaccccaugauaucucuccuuuucuccuucucugcccuccacuuggucucuucucagacccccgggccccagcccucuuuucugcccagcuacaggcuguaggacaaggaccuccuugucccugagguaaccagaucucggggcccaauuacaguacauacagcauuacaguacauagcaacagaacaaaccucaacaagaaggaaaugcuacaacacaaaaaauuuucaggaauucauuugaaaugaagugacuuagucacaaagagacaaauauuauugaugagguaccuagaguauucaaaaucacagagacaggagcggggugugggguagagaaugggacuugauuacgggguguagugaucugucacuacaaugaauuccucaugugucccuuauuccuucccuuucuuacacucacuugcaggagacugccacagcuaagugugguacaccagcagucacaucuguacaaugucuaauuagcucacaauuggccuuaacccagccugcguuuucuccuccacaucccaagcccuccaggcaaggaguagcaagccguucuacuuccucaucuccagccuccuccuuucuuucccgucugcccgcgcagaagcgugugauuuauuuuaucuuuaaaaguuccuccuugucuccacccaccuuuccauucucuccguuuauucauaauacuacgucuugcagaacaauuuguaaacauuguuucuagcugaagaauucuuuaucucuagaauucacuugguucagguuuccaugccacccgccuguaccugaucuuuccagccucucauuuuucaguguccagcuuaauucuccaccugaaauuuggcgauuuuuuaaccugccuuucuucuauauucacaacugucuuagauaggguuuauauuguugugaagagacacuaggaacauggcaauucuuauaaaggaaaaacauuuaacuggggcuggcuuacaguucagagguuuaguccauuaucaucaaggcgggaagcauaguggcaugcagucagacauggugcuggagagguacugagaguucuacauccggcuuggcaggcagcaggaggaaagagacucugggccuggcuugagcuuuugaaacccagugacacacuuucuucaacaaggccacaccuccuaagaguaccaccacauuccacucccuggccaccacuggcuuguugccaucuaagcauguaaaauugcagucagucuaacuucagaaguccccauacacacucuaucaaagucucaacucgguuucaaagucucuucugagacucauggcaaucaaacuauaauccccuauaauaaguuugaaauaaaaaagaucacauaguuacaacaauagauggugcaguauuuacauuaccauuccagauggaaggaaagggaccauagugagaaaauacuuggccaaagcaagaccaaaagccagcagggcaaacuccgaacugcaucuccaugucugauacccaggcacucuuccaaucuccgauucuuuucagcuuugaugacugcaucacacuucuuucucuuggcugucccuaaccuguguuggcagcuuuucuccacaacucuagcguuuccaacaucgcggggucucuaaggcuucaccuucacagcuacacacgauggcuucucugggccuccaugcagggaccccccgcccacaugccuggccccagcagcuugccuuaaccacagagggagauuccauaaccuccuuuuugcauccuugacucuaaagccagaauccccuggccaaagcugccaaguucugcuccuggcuaaggcuggaccguggucccuuuuuucaaccgcaucuucaccagcuuucuguuuuggaugggguccuucacugccuaagcuuggcuguccuagaacucacucuguagaccaugcuggccuugaauucuggaauccacugcuuuucuaauccaaaauuccaaaguccacauuccuccaaacaaaagcaggguccggccuaucauagcaaaacuccaauuccagaugccaaccucugccuuaguucuuccaacagaccacacuuacuccaacaaggccacaccuccuaagagugcccuuugagccugugggagccauuuucacucaaacuauucaaacagcaauucaccaucagaucuacuguuuugauuucugaaaugaguauagacucuggcugccucaccuucucugugauggcuccccauugucccaccccuggauuauucuaguaccuucuugacuaauccuauuucuggccuguccuuuauguucuauuauuacucauuuggggaaucugaacaucuugcugguacaauauacacauaugcacagcaugcaugaguucaucagaggggcaaccuuggggucugucuucagacaccuuccaccuuucucuuagcuucucuuauuguagugaagccuagagcuucaccccauggguggcccccgaguuuccagggauucauguugcauggcugagacuagagguguaccacuguguucagauuuugaaacacaggcccucauacuugugagacaagcccuuuacagacugagccagauuccagccccuauaaucucaggagagcaaucaagaaaacuguugauuuauuugugcuguuagcaugucaugacauagcccaggcugaugucaugccuggcuuaggguucuccuguacacaaauuccuccaagacguccagucucaagggaaaagugaggccuugggggggucuuggccuuaggaaaucugguccuugcuuguucugaucaccuugguucucccucucccugcuccccaacucuccugcugcuaugucugcaggccaagcacacuagugcucugugucuucuguaccugugucucagccuggaaggcuuucuuucccacaucucacagagcauccuguucugcggguuucauggcugccuucucagagagauggugccuaacucuucugcucaguguucagcccaaggccuagucuuucuaaccuuagugggccucguucuucugcgugguuuuguuuucucuguggagucuuggcugcccuggaacucucagagagcucucugagugcugggauuagauccgugugcucccgugcuuaggacuucgcauacauucauuugcucauucuuguuuaucccacugggacgugugcgggugaggucagggacuguuugaugcuguaucucuagccugacgacacugaggaccguuuacagauuccgauaaguauuguugagaaauuucgugaacaaugaaugguugucucuguguccccuuaugauuuuccacuguucuccugugugcugugacucuugggcuaaguaagaagcugucugaugucccaaucuuaaaacaauacaaaacaaaaacaguugucacaauuuuauguuuucuuuucuuucauauugugauucugaacuuacacuucauuugugugauugucuaccuuuuccguucuagccuuagccacauagaaacaagaaucgcgcuuggcuuuccguugcaucucgaguagugagcacucugucuaucuggaaguggaaagcugugcagcuccgguuagcuuauuuccacacuguucucagcuccaugggagcaguuugaguagagaugucagcucaugaagcgccuccccaaacuuccuuuuaggcagacaugacagcauuccaggaaugccaacauugaggaggcaaagacaccgggacugucuguccugaguucaaggcuccccugaguuacagauuaaggcaggcuauggcaugagacagagcaaaaaaacaaaaaacaaaaacaaaaacaccccaaaaaaacaaaacagcaaccuguuuuuaauauuggagggcuggaaagggaggcaccuuucauaccaugcaagugggggaaguggcucuuuuuuauuuuacuaguggugacaaguaucuguaaaauaauuccagacaugacccauaaauacggacaaacaugggauauaacuuguuacuauucuggguuuuuguuuguuuauuuuuucuaaccagguacacaucuaaacccgagaagaaauuagucuaugcuauuuuucuuaaauggcccaucucuggaaagcuguuucuuggacaacccauagguagucugggggaaacagagguaagaaugaauuuuaucuugacuguuccuuuaaauugaugaguacuacacugggggagaacauagcuuguuuuaacgucuaggggaaaccuucaaguaaccucaugaaccuaggaaaaguuacuuuaaggcgacuuagacaaagcaaggccaguggcugguuagucccaauguuuugaaauucuaagaaaacugaccguguaagcuaugguaccucuacgcauaaugauguaaaauagcaccauucuguacaguuacugugccauugaacuucacucuauucacugaaagugaguuuuucaaagaguguuaauugccucccuguuuuaguuagaguuuuacugcugugaacagacacuaugaccaacuccuauaaaaaaaaaaaaaacaacauuuaauuggggcuggcuuacauguucugagguucaguccauuaucaucaaggcauggcaguauccaggcaggcaugguacaggacaagcugagaguucuauaucuucauggaaggccgcuaggacaagacuggcuuccgggcagcuaggacaagcaucuuagagcccacacccacagugacacaccuacuccaacaagaucacaccuccaaauaaugccacccccaaggucaaccauuugcaaaccaucacauuccaccaacaccacaccaaggacacuucgaaucaaaggaagaugucauucuucugggauuauguaaggccgucaucagacccaauggagugccccguauauaucuuguauauaucuugggcccuuuucuagaaguugauagugucuuuggagugaaauguccugugguucuccuuuuuuguuucuguauuagucaggguucucuagagucacagaauuuauggguagucucuguauaguaaaggaauuuguugaugauuuacaguguguaguccaacuccccacaauggucacuauuagcugugaauggaagucugaagaucuagcaguuguucagucccacacgcaagcaggcgaaggagagagagaggggcuuccuucuuccaauaucuuuauguagaucuccagcagaagguguagcccagauuaaaggugugugccagcucaccuuuaaucccagaugaccuugaacucagagaucucccugucuuaaucuggauucauagccacuaugccucacgauguccaugccgagauucaggucagaaacuucuaucucccagccuccagauuaggaucacuggugagccuccaauuuuggauuguaguucauuccagacacagucaagcugacaaccaggaauagccacuacagucucccuugcacaucuuaguucuaacucuggaggcugaccgggcugaaagauggguuuuaaauccaguguuaaagcacagccuccaaaccuugauauggcacuguuuuuauauuuuuaagccuaugucuugcuuggcauuaacaaauacaauaauuacaacucaggacuuuguguuuuuccaugugauaaaguauuaugguucaaauaacccuagaguauguccagaauucacuuaauaugagcaagaccaagacuacagaccaaucauggcuaucauugguugaauuaauacacuacugaccagugggcaucacuggaaaaucugacagucauagcuacccgggagaaggaaggcguuccucuguguguaagaacugggcaggccugaacuggccagauugcucccaguuauuucccaucucccauccucucuucgagcaucacccugacucuggcauuccauuuuccuuucccaaucugugcacguuuguucacgucuuucggguaaugugggaacaaggggaguaagauguaaaauggugugugagcgcuaaagguaaaaauggagcucuuuuuuuuuuuaaguacauuuuuagaaucucugacuccuuaggaaguggacaucacagugcuccauuagggaacauuuguacauuguugucccuguuuccacuuacagguagaacugcugggccauuggcagccacugacuuggacaucuucacagcccaguggcaucaccguggaguuaccucugcucagcguacaucagaugcccuguaaauggggauggacucuugugcuaaguaaugugauuuaaccugcagcagaaagauguaagcugcagguaccucuaacuacaggaaauggcaggguuuuuuguguuuuguuuuuaaaguaccacuaaagaaaucaggauaaaaaugauacaaaaacugaaaucauuagguaauacaguuucccuucuuguucuuccuaaauucuuuccuaaaccacucguguuaccauuugacuaugcuucccuccaaagucucuuccugcugaauccauuucacauguaacucacaggugcaaauauuuuuuuuucagagaagcuagaaacuccuaaccuucuacugaaaccuuaacacuccacguggcuguauuggaaacagagcucuugaaauggucaagauuaaaccaucauagggcuagcccuaauaccagaggacuuggugucuuauaagggagagacaauaaagaugcaaaaccaccggggaaagccaugcaaagaagacaguuauccgcaagccaaggagaagagugcaggagaaaccgaaucucucuaacacccucaucuuggacuucuauccucuaggacugugaggaaauauaacuuccuguuguugaagccauccaggaugucuuuggucuuccccauaccuccuaucauaaauccucauauauaaugcagacuauguaaugaauuugauuagauauauguguccaaugaauuccguaauuaucuuuucaucuuaaagacuucccucauauucauuuucuauuugcuucuauuugcuguagaaauuuugaaauacaagucaccgccuagaccacugcaauuauuuuauaauauuuuaguauguauucuuccaauuuggggacagaaagaggugugagauuggagggauaggguuauuuguuuuaaugagggcuaaaacagguuguaaaccuaguugaaaauugggaagguguuauuagcuucuuuucuguuccugucaugaaacauaaugaccaaagcaguauacuggaggaagaguuuaucauggcuuauagugucagaggguuauaugagagucugucauaguaugaagauacagcagcagaugagcacagcagcuggagaccaccacaucuucaacugcuagcaugaggcagagagugaacuggguagggugagcacuauaccugugguuuucuaccuuccuaaugcugcaacccuuuuuauaguuccuuauguuguggugaacugccccccccccauacaauuauuuuuguguguguaauuuugcuacugguaugaauugcaauguaaauauuuuugaagauagagguuugccagaggggucacgacccucagguugugagagcaccacugcucuaaucuaucaaugccuacuggcccugcgguacacguccuucaggaaggcugugucacccaacucuucccaaauggugccaccaacugaagaccaaguguucaaauacccgaaucuauggagaauuuuucucauccaaucccccucccccauccacccacucccaaccccacacacaaauagccuacuaagaucuuugucuaaguuucuuuucuguugcugugacaaaacacugugagcaagggaacguauaagagagagaguguuuaacugggcuuguggguacagaagacuggagccuacaguggcagagcgaagguguggagguaggcagcugagcagcugcugagagcucacauagugauccauaugcaguagacagagaaacacuagagaaagcugacaagccuccuccagcaugcuagcaccuccuaauccuucucaaacuuccaucgaaugagaagcaaguauucaaacuuuaggcaacaggggccauucucauucaaacuaccacuguguuccuguaaaauaagauaaaaauaauuguagcagaauucuccccuaauuaauuacauaauaaggaugacuagaagacaaucacggggcaaguagcaggugggccuuccaaguaagagagaggaagaggaagggaaugcaggaggagggcacccagaaucugccacuggaagauuucuaacagaauaguuaaugaguuuagggugauagauucugcacccaggaguuguguuaucuguugauucuaaaccaagacagucugguguuuuccauuugcugugacucaacugagcucuaggggaaagguaccugcagaggagcauggguuggugagagugcgcccccagcuagcuuuggacauuuggguguguugagcgguuuggcagcaccuagcugcagggguugggugacuggaaacugcaccucagcagcaagcauggcgaaccaccacauggggauagccacgggggcagggagacugccucagccaguguagccggugauagcauggauugauuuuuuaauuauuacacauaaaaauaauagugacucugauacauguuuaaagaaaaauugauuaaagaacucauucccaaaa

SEQ ID NO: 5426 - RNA, 17737 nt, Mus musculus
uuuugggaaugaguucuuuaaucaauuuuucuuuaaacauguaucagagucacuauuauuuuuauguguaauaauuaaaaaaucaauccaugcuaucaccggcuacacuggcugaggcagucucccugcccccguggcuauccccauguggugguucgccaugcuugcugcugaggugcaguuuccagucacccaaccccugcagcuaggugcugccaaaccgcucaacacacccaaauguccaaagcuagcugggggcgcacucucaccaacccaugcuccucugcagguaccuuuccccuagagcucaguugagucacagcaaauggaaaacaccagacugucuugguuuagaaucaacagauaacacaacuccugggugcagaaucuaucacccuaaacucauuaacuauucuguuagaaaucuuccaguggcagauucugggugcccuccuccugcauucccuuccucuuccucucucuuacuuggaaggcccaccugcuacuugccccgugauugucuucuagucauccuuauuauguaauuaauuaggggagaauucugcuacaauuauuuuuaucuuauuuuacaggaacacagugguaguuugaaugagaauggccccuguugccuaaaguuugaauacuugcuucucauucgauggaaguuugagaaggauuaggaggugcuagcaugcuggaggaggcuugucagcuuucucuaguguuucucugucuacugcauauggaucacuaugugagcucucagcagcugcucagcugccuaccuccacaccuucgcucugccacuguaggcuccagucuucuguacccacaagcccaguuaaacacucucucucuuauacguucccuugcucacaguguuuugucacagcaacagaaaagaaacuuagacaaagaucuuaguaggcuauuugugugugggguugggaguggguggaugggggagggggauuggaugagaaaaauucuccauagauucggguauuugaacacuuggucuucaguugguggcaccauuugggaagaguugggugacacagccuuccugaaggacguguaccgcagggccaguaggcauugauagauuagagcaguggugcucucacaaccugagggucgugaccccucuggcaaaccucuaucuucaaaaauauuuacauugcaauucauaccaguagcaaaauuacacacacaaaaauaauuguauggggggggggcaguucaccacaacauaaggaacuauaaaaaggguugcagcauuaggaagguagaaaaccacagguauagugcucacccuacccaguucacucucugccucaugcuagcaguugaagaugugguggucuccagcugcugugcucaucugcugcuguaucuucauacuaugacagacucucauauaacccucugacacuauaagccaugauaaacucuuccuccaguauacugcuuuggucauuauguuucaugacaggaacagaaaagaagcuaauaacaccuucccaauuuucaacuagguuuacaaccuguuuuagcccucauuaaaacaaauaacccuaucccuccaaucucacaccucuuucuguccccaaauuggaagaauacauacuaaaauauuauaaaauaauugcaguggucuaggcggugacuuguauuucaaaauuucuacagcaaauagaagcaaauagaaaaugaauaugagggaagucuuuaagaugaaaagauaauuacggaauucauuggacacauauaucuaaucaaauucauuacauagucugcauuauauaugaggauuuaugauaggagguauggggaagaccaaagacauccuggauggcuucaacaacaggaaguuauauuuccucacaguccuagaggauagaaguccaagaugaggguguuagagagauucgguuucuccugcacucuucuccuuggcuugcggauaacugucuucuuugcauggcuuuccccggugguuuugcaucuuuauugucucucccuuauaagacaccaaguccucugguauuagggcuagcccuaugaugguuuaaucuugaccauuucaagagcucuguuuccaauacagccacguggaguguuaagguuucaguagaagguuaggaguuucuagcuucucugaaaaaaaaauauuugcaccugugaguuacaugugaaauggauucagcaggaagagacuuuggagggaagcauagucaaaugguaacacgagugguuuaggaaagaauuuaggaagaacaagaagggaaacuguauuaccuaaugauuucaguuuuuguaucauuuuuauccugauuucuuuagugguacuuuaaaaacaaaacacaaaaaacccugccauuuccuguaguuagagguaccugcagcuuacaucuuucugcugcagguuaaaucacauuacuuagcacaagaguccauccccauuuacagggcaucugauguacgcugagcagagguaacuccacggugaugccacugggcugugaagauguccaagucaguggcugccaauggcccagcaguucuaccuguaaguggaaacagggacaacaauguacaaauguucccuaauggagcacugugauguccacuuccuaaggagucagagauucuaaaaauguacuuaaaaaaaaaaagagcuccauuuuuaccuuuagcgcucacacaccauuuuacaucuuacuccccuuguucccacauuacccgaaagacgugaacaaacgugcacagauugggaaaggaaaauggaaugccagagucagggugaugcucgaagagaggaugggagaugggaaauaacugggagcaaucuggccaguucaggccugcccaguucuuacacacagaggaacgccuuccuucucccggguagcuaugacugucagauuuuccagugaugcccacuggucaguaguguauuaauucaaccaaugauagccaugauuggucuguagucuuggucuugcucauauuaagugaauucuggacauacucuaggguuauuugaaccauaauacuuuaucacauggaaaaacacaaaguccugaguuguaauuauuguauuuguuaaugccaagcaagacauaggcuuaaaaauauaaaaacagugccauaucaagguuuggaggcugugcuuuaacacuggauuuaaaacccaucuuucagcccggucagccuccagaguuagaacuaagaugugcaagggagacuguaguggcuauuccugguugucagcuugacugugucuggaaugaacuacaauccaaaauuggaggcucaccagugauccuaaucuggaggcugggagauagaaguuucugaccugaaucucggcauggacaucgugaggcauaguggcuaugaauccagauuaagacagggagaucucugaguucaaggucaucugggauuaaaggugagcuggcacacaccuuuaaucugggcuacaccuucugcuggagaucuacauaaagauauuggaagaaggaagccccucucucucuccuucgccugcuugcgugugggacugaacaacugcuagaucuucagacuuccauucacagcuaauagugaccauuguggggaguuggacuacacacuguaaaucaucaacaaauuccuuuacuauacagagacuacccauaaauucugugacucuagagaacccugacuaauacagaaacaaaaaaggagaaccacaggacauuucacuccaaagacacuaucaacuucuagaaaagggcccaagauauauacaagauauauacggggcacuccauugggucugaugacggccuuacauaaucccagaagaaugacaucuuccuuugauucgaaguguccuuggugugguguugguggaaugugaugguuugcaaaugguugaccuuggggguggcauuauuuggaggugugaucuuguuggaguaggugugucacugugggugugggcucuaagaugcuuguccuagcugcccggaagccagucuuguccuagcggccuuccaugaagauauagaacucucagcuuguccuguaccaugccugccuggauacugccaugccuugaugauaauggacugaaccucagaacauguaagccagccccaauuaaauguuguuuuuuuuuuuuuuauaggaguuggucauagugucuguucacagcaguaaaacucuaacuaaaacagggaggcaauuaacacucuuugaaaaacucacuuucagugaauagagugaaguucaauggcacaguaacuguacagaauggugcuauuuuacaucauuaugcguagagguaccauagcuuacacggucaguuuucuuagaauuucaaaacauugggacuaaccagccacuggccuugcuuugucuaagucgccuuaaaguaacuuuuccuagguucaugagguuacuugaagguuuccccuagacguuaaaacaagcuauguucucccccaguguaguacucaucaauuuaaaggaacagucaagauaaaauucauucuuaccucuguuucccccagacuaccuauggguuguccaagaaacagcuuuccagagaugggccauuuaagaaaaauagcauagacuaauuucuucucggguuuagauguguaccugguuagaaaaaauaaacaaacaaaaacccagaauaguaacaaguuauaucccauguuuguccguauuuaugggucaugucuggaauuauuuuacagauacuugucaccacuaguaaaauaaaaaagagccacuucccccacuugcaugguaugaaaggugccucccuuuccagcccuccaauauuaaaaacagguugcuguuuuguuuuuuugggguguuuuuguuuuuguuuuuuguuuuuuugcucugucucaugccauagccugccuuaaucuguaacucaggggagccuugaacucaggacagacagucccggugucuuugccuccucaauguuggcauuccuggaaugcugucaugucugccuaaaaggaaguuuggggaggcgcuucaugagcugacaucucuacucaaacugcucccauggagcugagaacaguguggaaauaagcuaaccggagcugcacagcuuuccacuuccagauagacagagugcucacuacucgagaugcaacggaaagccaagcgcgauucuuguuucuauguggcuaaggcuagaacggaaaagguagacaaucacacaaaugaaguguaaguucagaaucacaauaugaaagaaaagaaaacauaaaauugugacaacuguuuuuguuuuguauuguuuuaagauugggacaucagacagcuucuuacuuagcccaagagucacagcacacaggagaacaguggaaaaucauaaggggacacagagacaaccauucauuguucacgaaauuucucaacaauacuuaucggaaucuguaaacgguccucagugucgucaggcuagagauacagcaucaaacagucccugaccucacccgcacacgucccagugggauaaacaagaaugagcaaaugaauguaugcgaaguccuaagcacgggagcacacggaucuaaucccagcacucagagagcucucugagaguuccagggcagccaagacuccacagagaaaacaaaaccacgcagaagaacgaggcccacuaagguuagaaagacuaggccuugggcugaacacugagcagaagaguuaggcaccaucucucugagaaggcagccaugaaacccgcagaacaggaugcucugugagaugugggaaagaaagccuuccaggcugagacacagguacagaagacacagagcacuagugugcuuggccugcagacauagcagcaggagaguuggggagcagggagagggagaaccaaggugaucagaacaagcaaggaccagauuuccuaaggccaagacccccccaaggccucacuuuucccuugagacuggacgucuuggaggaauuuguguacaggagaacccuaagccaggcaugacaucagccugggcuaugucaugacaugcuaacagcacaaauaaaucaacaguuuucuugauugcucuccugagauuauaggggcuggaaucuggcucagucuguaaagggcuugucucacaaguaugagggccuguguuucaaaaucugaacacagugguacaccucuagucucagccaugcaacaugaaucccuggaaacucgggggccacccauggggugaagcucuaggcuucacuacaauaagagaagcuaagagaaagguggaaggugucugaagacagaccccaagguugccccucugaugaacucaugcaugcugugcauauguguauauuguaccagcaagauguucagauuccccaaaugaguaauaauagaacauaaaggacaggccagaaauaggauuagucaagaagguacuagaauaauccaggggugggacaauggggagccaucacagagaaggugaggcagccagagucuauacucauuucagaaaucaaaacaguagaucugauggugaauugcuguuugaauaguuugagugaaaauggcucccacaggcucaaagggcacucuuaggagguguggccuuguuggaguaaguguggucuguuggaagaacuaaggcagagguuggcaucuggaauuggaguuuugcuaugauaggccggacccugcuuuuguuuggaggaauguggacuuuggaauuuuggauuagaaaagcaguggauuccagaauucaaggccagcauggucuacagagugaguucuaggacagccaagcuuaggcagugaaggaccccauccaaaacagaaagcuggugaagaugcgguugaaaaaagggaccacgguccagccuuagccaggagcagaacuuggcagcuuuggccaggggauucuggcuuuagagucaaggaugcaaaaaggagguuauggaaucucccucugugguuaaggcaagcugcuggggccaggcaugugggcggggggucccugcauggaggcccagagaagccaucguguguagcugugaaggugaagccuuagagaccccgcgauguuggaaacgcuagaguuguggagaaaagcugccaacacagguuagggacagccaagagaaagaagugugaugcagucaucaaagcugaaaagaaucggagauuggaagagugccuggguaucagacauggagaugcaguucggaguuugcccugcuggcuuuuggucuugcuuuggccaaguauuuucucacuauggucccuuuccuuccaucuggaaugguaauguaaauacugcaccaucuauuguuguaacuaugugaucuuuuuuauuucaaacuuauuauaggggauuauaguuugauugccaugagucucagaagagacuuugaaaccgaguugagacuuugauagaguguguauggggacuucugaaguuagacugacugcaauuuuacaugcuuagauggcaacaagccagugguggccagggaguggaauguggugguacucuuaggagguguggccuuguugaagaaagugugucacuggguuucaaaagcucaagccaggcccagagucucuuuccuccugcugccugccaagccggauguagaacucucaguaccucuccagcaccaugucugacugcaugccacuaugcuucccgccuugaugauaauggacuaaaccucugaacuguaagccagccccaguuaaauguuuuuccuuuauaagaauugccauguuccuagugucucuucacaacaauauaaacccuaucuaagacaguugugaauauagaagaaaggcagguuaaaaaaucgccaaauuucagguggagaauuaagcuggacacugaaaaaugagaggcuggaaagaucagguacaggcggguggcauggaaaccugaaccaagugaauucuagagauaaagaauucuucagcuagaaacaauguuuacaaauuguucugcaagacguaguauuaugaauaaacggagagaauggaaagguggguggagacaaggaggaacuuuuaaagauaaaauaaaucacacgcuucugcgcgggcagacgggaaagaaaggaggaggcuggagaugaggaaguagaacggcuugcuacuccuugccuggagggcuugggauguggaggagaaaacgcaggcuggguuaaggccaauugugagcuaauuagacauuguacagaugugacugcugguguaccacacuuagcuguggcagucuccugcaagugaguguaagaaagggaaggaauaagggacacaugaggaauucauuguagugacagaucacuacaccccguaaucaagucccauucucuaccccacaccccgcuccugucucugugauuuugaauacucuagguaccucaucaauaauauuugucucuuugugacuaagucacuucauuucaaaugaauuccugaaaauuuuuuguguuguagcauuuccuucuuguugagguuuguucuguugcuauguacuguaaugcuguauguacuguaauugggccccgagaucugguuaccucagggacaaggagguccuuguccuacagccuguagcugggcagaaaagagggcuggggcccgggggucugagaagagaccaaguggagggcagagaaggagaaaaggagagauaucaugggguaagagaucaugagaacuggccacgagggcuggucaguuggaguaagagaggcccagguggaacauggcaaguuauagcucaagguuauugaaagggaaguagacaaaauaguuuagaggguugauaucugcccaucuccagugcuuuaauauaaagguuuugugcccuuuaucugggaacuaagugaucaaaugugggguaaaacccccaacuaauuuuaacuacaacaccuuccuuuucagagcugacuaauauacacgguguauauaacaaugcacacagcuuaagcuuaacuauucguaaguggacuccauugcucgacacuuuaaguaucuagggauauaguucuucugguaucagucuuaugcauauauccucggagguggaguggcugggaggcgggauaauucuguuuuaauguuuugagggacuggcacacuguccaucacagcugcugagauuucagauucucauuacacuggaguguauagaaauuccaaucucuccaagaucaucagcugcccuuuuuuaaaggguaguuaugcuaaaggacaugagaugacuucuggcugugguuuuuauuugcauuucaccugcaguuccuuaaugugacauuaaguaucauuucugguguuucuccaccgucaugcaaaucuuuccaucacagucugucucugcaggagcagacauuacuuuuauuuuaccauuuucucggaaucuucuccuggcuagcuuauuuacuguuuacuuugcccuuagggaccucuugcuugccaauuugguggaauaugauauugccaagacuaggaaauuuacuagugucgaaacacgaguccauucuacauuaacuacuugauaaucuucaguuaccuaaaugccuuucaauuuuguaacugguaguuuagcuaaauagugccuacgacuaggggauaucuaggcacuauuuaagcagaauuugauaaacauuauguucaauaacaugacaauucuuauuccuucucuuuguauuugagucaaguuggaacacaugcggucaugcagcaauaauccagucccucuuuuuauccugcucucucucuauacugagugcuuuccucuaucaaacagugcucgcuaaccaggaaaacguaccacacauccggagugacagugucauucugagaccuccaaguguguguuucauaaauagcuuccccguugaccuucagccagguucccauuugccuuaaucgcuccucaaaaaugacaggaauggugccgucucccgugggaccaauauucaucaaaagauuuccaccacaugcgacuguuuccacaaguuucuaaauaaauaauaaaauaaaaauaaauacaauugaaauagagaaaaauuaagacuaguuuugaaauauaaacuuuaaucaaucuauaaauauaauauauaauauguuacacauauauaauacauuauacauacauacacacacacacacacacacacacacauauauacauaaaauuuuauaguaaaacacccacagaaaguagugucuugagucuguggcauuacacaaucccaacuauaagggaaaaaaaauccuguaacucucucauuauaagaauauuccagaauaauaguuccacaacauauuuuacuguaccuucaccaacucuucaauuguaagauaaucacugauuucagcuucccgccuguagccccaggagaacuuaucuauugucaugcaguuuucccauuuguguggcaagagauagccaggauuguaacggucacugcaaguauaguagccaccauguuugcagauagacccgacuccccagcgaucauuggugacuacuguuuuccgaacugggcugaaaugaaaaggacaguuucccuuuaagagaaagcauucuugagacagagggcaaugucaccacaaacagaucuaccuacuccugacuauaagaaagcagaaagccuuuguuucuaaaaccaaauagaucugugaugacuggagucugaacucacauuccaaauucuaggccuagagcaaauuccucaaccucucugaagacugaauuccuucacuauuguuuuagguccucauccuaugauuggugccuccuacuggaaaaucucugaaaaaauugaguguugucaucaugcaaaauacacuccccaauuucuuaugucugguggcucaaguagagagaaggggacucuagcuacaggggcaguuaugacucacaaauuaaagacgauggucccagucaugucuugauccugggauuguuaaauugauuacacaaucaguuuggcaguguuugacauauuucugaucauuuuuacuaaauacugaccaagguaauaugcauggcuuauaacgauuugguccugucacggcacaaaugagcacggaaccacaggaauguaaaugcugcuguacacacacaguaggaauguuuaagacuaguccaggugcauaaaaguguacagaccuuucauuauacagccaggcuaagaagccagugcuguuccaguagugaucuggcgcgcccccaucuccgucugaccacaggacuucaggcugguaucuguucaccaacucauagagcucaggcaaugucuuagaaacgggaaaucgcugcuuuuggaaugagcuggacugauccuccagaaagagcggauggaaccauucaaaaagagaauaguacagaccaaagugcaagccaguccuguuccucacagccaccucaagcuccuugacaaugucccucuuuggccccucaucgacugcauuccaguuccaagaacggucugagccccacauuguaaagccuggaaagggacggcagacagcccuaguuaccaccuugacgcugauaaacuucaacccaagagaacaccaaaacaauucagaaugaacccacaauucaccgccuccccaaacaacuguuucuuggcccgcuuugcguccuggcuugcaugcaucuggaccaaccaaugggaauauaauuaaugugaggcuggggguuuucagauucucaggaugacuguaagagcuguacacuccgucuccagucucagaagcugagguucuuggggaacagucuaaugucauggugucugccacauuucuggcuacacccaccagcugauuguuagcuuagcaucuaaagcaaaauauacacucaacaauaguggucuguaagagaagcacaccuuccacaucuaucacacugagcaaugcucgccacucgauugugcaauucccaugugucuucugaaccaauggguaaggucuaucgcuugcauggguuucacuacaaugugauucucagaauauucaugaggacaagaaguaaauuuccguggcuugauaauuaauuuaaaugaagggaguacauuuuaccucccucauuauggugauuucaauaugcuuggcucaugugaaguggcaccauaagaggguggcuuuguuggaauagguguagccuugauggaggaagugcaucgcugcggggugggcuuugaggucuccugugcugaaacaccacacaguguggaaucagaaccuccuccuggcugcaugcagaagagagucuacuucuggcugccuucagaucaagaugcagaacucuccacuucuuuggcaucaugucugcccacaugcugccauguuuccugccaugaugacaauggacuggaccucugaaacuguaagccagccaugauuaaauguuuuucuuuauaagaauugccuuggucauggugucucuuugcagcagggaaauccuaacuaagacacccaucuuacucuaaagccauaaacauggauuuuacucuuuaaagucccccaauauugaccguccuaacaacugaaaggguaaagcaagcagcacacagcauuauacaagcacuuggaaauaauuuguauuucaacaggaauuggcuccuagguuguucauuauccuauauaaaauguuagaagacauagauaacuaagaggcugaagaacuaguauaaaguccaugaaaauuucagcacgugccuugggucauuaagaacugagguaacauuagccagggcuuucuggucuuauggacacuggguggcuauagcagaaaacucuauuaaugcaggauuuuugugcuaccuuaaguucuuuugauguuucugggcauuauuguaaaucucuaacucuuuucccuuggggccucugucuucuuucaucaguagcaacuuacccacugcuugcauaucuaaaaguuaugcacaaagcacagccaacugugagagucaagcuuaaggcagcaugagcguagaugccaugaugauuuuaaagaaugcauucaagaacagaaagggagccugacgcacaccuuuaaucccagcacucaggaggcaggagaaggugaaucucugaguucaaggccagccuggucuacagagugaauuccaggacugccagggcuacauagagaaacgcugucucaaaacagcaacaacaacacagagagagagggagagggagggagagagaaagaacagauggacagauggacagaaaggaaagugcaacuauacuauacucacuauauaauauauguauguauauagauggacagauggacagaaaggaaagugcaacuauacuauacucacuauauauguauguauacacacacucacucacucacucacucacucacucacuauacucauucucuucaaccagcuuuaaauaaaucuaguuauuuauuuaaaugaugucuaaauuaggguuucauugcuaugaagagacaccaugaccaagacaagacuuaaagcauuucauuggggcuggcuuacagguuagagagagguucaguccauuaucaucaggacaggaagcacagcaguuucuaggcaggcauggugcaggaggaguccagaguucuacaucuccauccaaagacagucaggcgggacuccucugcacugggcauaugaccucaaaguccaccccagcaggaacacacuuccuccagagaggccacaucaccuaauagugccucuucucaugggcuaagcauauucaaaccaccauaaaugguuaaauguguacauagaaauuguguccaucuuuccucucauucugugaaaccagcugucuggauccauaauguuuccaacuuaagcggaaacaucacuauccaccuauggcuauucugagaaaccggguuucacaggacggccuuccuuuaaugucuccauccaaaagaacgaccuuacauuuucuagcccuugucagcauauauccuaugugcccuacuuaccuucgugauguuuagaagugaagaccacauauuuggcaccagaggccuggagaauaucugcccacugguuugcauuaaaauacuuggcuguaaauagcacuacaaaaucuucauacuuaaaaccaggagcauaauuauuguucauaaaguccacaaacugggguuucuucuccuuuugccaauaccaccuguggcagaaaaaagaaagagcacaugaccacacaaacacagaugcuuaaaguaauuccuggcuuuacccagccuaguaugaagaauaugcacagauucucuccgcuucucucuguccugguggguuugcauuaaggacagcuuaugcaaacugaaucucuggccauauucucugucuuuuccuuuguguaguccuccuguaacccagccaccgauucuccaaauuccccacuuuaagucaugauaucaucuuugccuucacacacuagcucacuguggaacuuaaguggcuaagauuucaagacaagacgacauaccuaaaacauaacuugcaucgguccuagucaguaacagaaaacauuuuggguagauagggagaaacauuuccaagggccgggcaguucccacaguuggcacggccuuugccugccugagauuagauucaaagcccucacaggcagcaagcagcuugucgucuaucagacccaaagucacaugccuacuucagaaacaucccucaccgcaacccaugcuggcugguggaucagacagauaaugggaucuccuagugaagagagaagcuggcuuucagguuagcgauaguuaaagagugaacaaguuuguguugccugucuaccgucaugugacuaugaagauacugugggguaauauaucucuauuauugccccuuugcucugcuuuggguuuuugaugcuuuagcauucaaggaucuucacgucauagcugaaccaggaagcauuuauuguaaauuuucugauuuucuuuuuaauuacaugugugcguguguguaggcgugugcaugugaggggggggcuuugggagcacgaacccccccccccggaaccagaaugaccagaugguugugagccucccagggcgggugugaggagucagacuaagguccucuacaagagcagugucuuaguuaagagucuuacugcugugaacagacaucaugaccagggcagcucuuauaaggacaacauuuaauuggggcuggcuuacagguucagagguucuguucauuaucaucaagguagaaagcauugcaugguacaggaggagcugagagcucuacaucuucaucugaaggcugcuagcagaauacuggcuuccagguagcuaggaugagggucuuaaaucccacacccacagugacacaccuauucuaacacggccacacuuucuaauagugccacucccugggccgagcauauacaaaucacaagcaguaugggcccuuaaccagugagaaauuucaccagcccuuuugaaaauucuucaaauucugggacugguacucccucaaucacgcaggcauugccacugcuauagggaggcccaccugcagagugccuaagaacuccggugugaguuugugugugugugugugugugugugugugugugugugagagagagagagagagagagagagagagagagagacagagagacagagagagagagacagagagagagagacagacagagacagagacagacagagacagagacagacagagacagagagagacagagacugccacugucuggggugacauaaagcccagugugagugugugugugugugugugugugugugugugugugcgcccgcgcgcgcgcgcgcccgcguccgugcccgagcccuuugggcaaagguaugcacuuaccagaaccauucacuaccaaagcugggcacggagaacacuccccaguggauaaagaugccgaacuuggccuggucgaaccaggcuggcagcgggcgucuguccagagauucccaaguggggucauagcuaagggcucucgugaccccccaaggccucaggagcggcagcagcagcagcggcagaagcaucaggaaccccaggcgcaugcgcgccagccugggauccucgggggaaccgccagucaccagggaagccgggaaccuucucugucagccgcagaagcugccuagcgcuggccuuccggcuucugcuaaguguacccugcuccugucaccugacccagaccgguuuggucagaugacuacugugaucuggaguagggaguggccaggaguuuuaaugagcucugguuacuuaaggaccccaagaagguugcauuacucaggugcacaaccaaggaagucaguuuuugcccacccuccucauuuuuaacagcccuuggcucuguuucccagucagaucugaucuacuuagccaagacgcccgguuugucugcugugagacaaaaaccuaaaggauggucuuugacccacgaccucccuccccaaggacuccuaacagaaaacucucaagaggucaccucgaccaccaggcccugguggcuuuaugugucagagcugucugcccuaccgugggacuggagccugagacaggaacuucgugggcugcucagggcuuuugaggaagcucccauggcucucagccuuugggucugccucugccauccucgaauuuguagccgaugaaaucccaaaguuuggguucagccaaucuggguucggguccaagauuuuacauuucuacucaggcucuuguuauuucugacuuugguuguugguggaacaaacuuuucugagaaacugcguuaggaaauaaggcaaucuuaguugaaugaauguuuaagaaguuuguauagaaggaggguuugggaaccugcugggguggcugagugcuugccuagaaugcaauaaaaccagaguaguggucaacacagcaguguggaaacagaaacaggagaaucagaguucaaggucaucuucgacuacauagagagcuacaugagacgcugucucaaaaaucaggaaggaaaaaaaggagaggaaggaggguuggagggaggaaaggagggagggaaugaaaguacgaucugggagccguaguucaguaauaaauguccuagagcugugugugugugugugugagagagagagagagagagagagagagagagagagagagagagacggagacagagacagagagacagagagagacagagagacagagagagacagagagacagagagagaggaaccuucagguagacuuaaagaaaaggagccagucacuuagaauaaucaucaaaguuacaucuucaggaacuguauccuaaaguuauuuaaaugccauuggccuaaagccggaaucucuacugcuuccgcuuuggcaaaacccuuauccuuuugugguacauuucaaaugccaccuccuccaggaugcucugugccauaaccaccccucccccaauaacaucccacuuccucccaagugccuccauaggacaccguauccuaaccacuaacacaggaguccacaggugguuucagaguuggcuggcuagagaucccaaucgccuuagacugugaguuccuuaagaacacuuacaaucucuuccugggugccaugcuuuucagggcagcagagccuggcacagagcaacacuuacaauguguuuucuggaguugucaguguacugcaguucuccuugcug

SEQ ID NO: 5427 - RNA, 556 nt, Mus musculus
aagauucuuuucagccaagauggcgccgaaagcgaagaaggaagcuccugccccucccaaagccgaagccaaagcgaaggccuugaaagcuaagaaggcggugcugaaaggcguccacagccacaaaaagaagaagauccgaacgucacccaccuuccggcggcccaagacccugcggcuccggaggcagccaaaauauccucggaagagugcgcccaggagaaacaagcuugaccacuaugcuaucaucaaauucccacugaccauggagucagccaugaagaaaauagaggacaacaacacucuuguguucauuguggaugucaaggccaauaagcaucagaucaaacaggcugucaagaaacucuaugacaucgauguggccaaagucaauacccugauaaggcccgacggagagaagaaggcguauguucgcuuggcuccugauuaugaugcccuagauguugccaacaagauugggaucaucuaaacugaguccagauggcuaauucuaaauauauacuuuuuucaccauaaaaaaaaaaaaaagauuaau

SEQ ID NO: 5428 - RNA, 556 nt, Mus musculus
auuaaucuuuuuuuuuuuuuuauggugaaaaaaguauauauuuagaauuagccaucuggacucaguuuagaugaucccaaucuuguuggcaacaucuagggcaucauaaucaggagccaagcgaacauacgccuucuucucuccgucgggccuuaucaggguauugacuuuggccacaucgaugucauagaguuucuugacagccuguuugaucugaugcuuauuggccuugacauccacaaugaacacaagaguguuguuguccucuauuuucuucauggcugacuccauggucagugggaauuugaugauagcauaguggucaagcuuguuucuccugggcgcacucuuccgaggauauuuuggcugccuccggagccgcagggucuugggccgccggaaggugggugacguucggaucuucuucuuuuuguggcuguggacgccuuucagcaccgccuucuuagcuuucaaggccuucgcuuuggcuucggcuuugggaggggcaggagcuuccuucuucgcuuucggcgccaucuuggcugaaaagaaucuu

SEQ ID NO: 5429 - RNA, 50815 nt, Mus musculus
cgucucagcaacggaugcgugggugagaauugcccgcucggaggcggaagcggaaguaucugugaccggcgaguaggaaguagcgcuuccgggaguggagauggccgcgcuggccccucugccgccgcugcccgcgcaguuuaagagcauacagcaccauuugagaacggcgcaggagcaugacaagcgggaccccgugguggccuacuacugugagucccuccgaguccccguucucccgcccgguugcgccccgcgccucccuccgcucuugaggcccgccccgcccccuggcuucagaccugagccuugaccucuggcucggccaggaggaccccaaguacuagacucccuccacacccggacccccgucucuccagcuuagagccucggacacgccucccggcuguucuuucuucugggaaugagaaccucgauagucauagguuucccagagaugggugggaagggagacuaacagaaaacauaacgaaagcugugcauuaaucacgagagcuuucaggucccuuccgaaacucagacgguucaguggacaguggcuacuacugaaaauuugaauuugacuguucuugacuuguuuuccguacuccucauuaccaccaguaagaauuuggagucauccuuuagcuauccugaaaguuaagaaguuuaaugccaauauuccuaguuugagauguauauacuacugaagaggacacaguuugaacuccguucagacaugcagaguuggugaaguggauaggacuaguaguuuuauguaaacuaugauuugaauauuauacuccuaucuuuguugcaagaaaugacuguacucugaguuucuaaagaacuuucagaauacagaaaugauguguccucuguuguggacauuguuagcaaaaaucuggaccaagucaagccuucccuuguggacauguauguaccucauuucucaaaugugcauggaugucccccuaccaccaccaauaauugccauucuccacuugauuuaugaucugaauucccaccucuucugcaagccacucgguggcuauacuucauuuuuauaaaaaucauaccaguauuguucccaccauucuuguucuuuugaugaucuucaaacauauccuaauuauugagccuuuuuaccuauugacgagcauuccuaaguacugggaaaaaaaaacuaaaacccagcuccugugguccuaggacuacugagaggaggggcguuugaacaguacgcauuuuauaauuucaggaacgggcauagaagugccacaguacuguagaggggaccucauuuuccuguguucagaaacacauugcucaguugacaauggaagccagaccuuugugcacaauugcugaagaauauaccuuuaaaaggaacaaaagucugaagguccacagagaaguuuaaaagaggaggagugaggauuuggagaguauagagccagagagaaguuggauacaacaaagaggcuggcucuggacugugaaccagggcccuuuguuucccucuaagccaauccuuauucaugaaccuguaacugugcaccuuugucacuacccaggaucuuuuccuuccugugucauuguggucauuccugcccuuuguucuaagcuugauuccccuguuuucuuuguuuaaaacaacaagaaccaaccaaacaaacaaacaaaaacaagagaagugcuucucaugucaguccccuaaaauuaagccuuacagcuuccugucauagguaaacuugaaaugggaguccacgcuuguccucaccuuuuugccugcugucaucugguuuuuauggguguuucuauuucaguagcaucccuucucccuagucaugaaugggcauuuuuaugacaaagucaguauggcuguacugcaguuucuguuaugagaccugcaugauauccauacagaauuuaaggagcgacaggagguaugcauguacucacauuugauguuacugaaguuuuaauuuuugcuaacuugguggcccuggaugcugucucuuugaagugauauuugcaauucucugagacuuaaugagguucaacaucuauucacaugcuaauuaagcaagugcuuuucuuuuuaacugccuuuuguugcuuuugcccaggcuucuauugaaaugucacuuccuaauaauauauacuaauccuuuguugcaugaauugcagcuauuuucucccaguucacagucugguuuuucuucaagaagucuuuuuuuccaaaaugcuugauauaaauugucugucaguagcuaggauacauuccaguuugcuaggccuugauuucuuuuguguccucacuugggauuuuucuuucuuaagacuauaacuggaucucuuaucaacuauagaaacuuuuguuguugaugcuauuuuauuaucacucuugugaaguuucuauuacaugugugcuauccuuuuccuuuuaacugucuucucuuaaagcuuucauauauuucauuugugguaugcuguguaaauccuuaaggccuuuucuuccacauaucuguugcuuaacacagcuauugaguugacaucaacaucaacauucauuuuuuauuucugaguacuguuuuuuuuuuuuucaaaucuuucugcccaguucugguaguuucuuaguauuaaguucaucuuuaaaccuuuuaaguuacauuccuacacacauaaccuauaugcuguaaaaauccaaaaaggcuauuaaugucaacaugaugacacaaguaaaaaaauucucacggagaaauauuaucacgugcuccagacuauugaaauauauaauuuuccucccacgccaaagaguuggguucuagagauugcuuacuaugcaaacaugaaaacugaguucagaccuccagcaccugcauaaaagauagcaugagucugggaagcgagaccuguagagacaaggagcuugccuucugccauaugacccagccaguggggauaaacuccagguucagugagagaccuugucucagaaaaugaggcagaaagcaaccgagaaaaacucccaucuuugaucccugccuucauacaugccugcagaaggauacagauauacacaccaaauuaucggcagucucuguguauaaaauacuuaugaaacaaaacuauguauugacuugaaucucuaguacagauaccauuauaauuaggaauuucuaagaauaugaaaugaaaauacauucucuguguuauauuuauuacugaguaauuuuuuaaaaagugauuccuggacuuaauaggaauucucuuauuuuguuugguuguuguuaccuuaguagucuuacauuucuagguugcuugcucuuuuguucuccuuuuaaaucagaaguuaaugcuaaaauauauauuagauuauuuuugucccucuuuaguaguacuaaggcauuuauuguuuacuugcuuggacuauuuaacauacucauuguaaaauagugaauacaccauaauugaaaaaucuguccauuccaagaaugaaucucauaaguuugucuuguggugguguggguuuuucaaacauagucaauagcucugguuucccuccaacucagcaagacucaccugaaugcugagauugcaggugugagagcccacagccagcaaguucauuuuuaauuacgaguguuucucuugaggucaguuuugauccaugugcagguguaagaaauaauacagagaaagccuguuguucccaaaaaugccauaugacaucucagccagaaaauugaaauugguacaguccaccaauguuuuucucagauuuccaagucuuacacauauuuauuuauguguauauacacuuaauucuaagcaguuuugucaguauugguuccuauucuuaucaucacagucuagacacaacagccuaagaauucauuucugaaaguaugaccuauuggcaguaagguguuuggcaagaggauguccaaacaggauuuguccuuggaauacacuugguuuauucgcacagagauuccuuauaaaaucgugauaauaucgaaguuaaauaggcaucuucccgaguggugaacaguuguuuaggcagaaaugcugcugcaggguuccagugcugauucuucuccugcaaggacucugagaagcuuaaagccuccgcucacauccaccauaaaguccuucaguuguggagcacuguaaggauggcacuugauggaaguucuggagguccuugaaagcauaggccaauugcuaguacugacaagugggcccagugacagagcuggaauguucaguggucgccaaggccaaagucucacaaagucugcacaaagucucagguccuuuuaccaaugaguaucagcacagaaacuagagaagccauguuuugggagcagugugauccuagagacaaucugguagcuuugugcucucagggcucagagcuugggacuggcucacuagcacaucaacaacaccuuggagucaugucauuaaaauaucaaggccuguucugugcuaggcuccuguguuuaagguaucugagcugccagguagccugccuagagcuggcuucugagguauagcucuuaacaaagaugccuaauugcaaacucagccaucauauuauuucaagucacauaaaauggugucuaaguuacacaaaaugguuuauauauuccuuacauccaucauggugcccuuuaccauaucuacauuauuuuccauguauguauguauguauguauagacauauaaucucuuauguguuuacuucagcuuaguaauuuaacugaugaaggacauucaggacauuuccuauuaauauuaugaauaaagcuaacaggucaacaagaauuucucagagauaaaaacaccagaaauugcaauucuuuuaucaucuuaauucccacguacaagcagucugaauagcaguggugcugggaaucuaaacuuagaucccugugcucgcacacgaaccuuaccauugagccaucuccccagccccgauuguuacagaugcaagaucccugugaauaaguagacaaacuaaugaaggacggaguacuaguuauuaacacucagcuuuaucaggguucccacuugguuuuuauaucagcuugauaugagcuagagucauagagaacuucaauugagaaaaugccuacaucagacucaauugagaaaaugcugacaucagauuuggcuguaggcaagccuguagaacauuuucuugguuagugauugaugagggaaggcucagcccauugugggugcugccaucccugggcagguggugggggagcaugugggagacuuuugggauagcauuggaaauguaaaugaaauaaauaccuaaaaacaaaaacaaaaaacaaaaaacaaaaaaacaaaaaaacuaaugaaugagccccacaagucaaauagcuuugaugucccuaaaagauacauacauacauacauauauauauauauauauauauauauuugaguucuauuuuauuuuguuuaugaaaauguaaaaaaaaaaaaccaagcuggaggguuaauuugggggguuggguguuuuauaagucaacugcuugcaauccauuugcucaaaaguuacugcgcugaauaaaguuugagaacugaaaaaaaaaacaagcaaacaaaaaagaaaguaggguaagcuuucuuuuuucagagcagugagaaacaagccauuaagcagcacuccucuguggucucugcaucagcuccugcugcagguuccuguuguguuugagucccuguucugaugcuuuuggggaugagcuaugaagggaauaaacccuuucuuccccaaguugcuuuuggauaugguguuucaucacagcacuaguaacccuaacuaagauaaucaguaauaaguauaaguuaaaccaguaccauauuuuaauauaaaaauugaacuuggugcacguucagugacauagcuaagugaauuggcacaaacguguugaaggcauuuugggaaaauuaaauaucugcaguuaagugcuuccaguuuggguaaauucauguuuaggaaaaagucaugaauauugcuuuaagcagaauuccuugaaauauauaugauguauaucuuuuuuccauuaauaaagccagaaaagguaagagucccuacaaacaacguacacugaaauauuuuggacacugcuagaucugcuccuguggguaacacuaagugcaggaagaucuuaacauucucguuuggugagcauuacaaccuacaccuguacuccuggcgcucaggugaguugagaggagcaagaguucacagccaaccugggcuacaugagaaccugccucagaaaagcaacagugcuaggcaaauagcucccuguuuagcaacugcuagcacguguggggcacaaguacuuuuauaaauaaagaagguguaaaauuucaaagcacagaguguggucuguguguguguguuuauguguguguguaaguguaaauauaucacaaauauauaaauacauaugaaaauagugacuucacugguagaaauuauuguugaaaaaauggcaaagugcauuuuauaagaugacaagcuauuuaaaaauguaggacaaagaauaagcaauagcauguuuguauauguacagcauuuuugcuucugauugcuuuuuucacuuucucuaaguugacauauuuuauauuguaaaaauaaauaaaaccauuaaaaacuguaaucaaaacuauuaaaaggcauaggcagugaggagccucaaaugcuaauaaaaaauuagcagggucuuuuuaagucuccccacccccuuucuuuaauaaaaccagaaaauauuugaguccucacuaacaaaacuguauuauaacaauuuugacaccaccagacuugauauuauaggccgaauccagaaagaucucuuuuuaaguucacuguaacuaaaaauaugaacauuccaguuuggcuuuuaaagauuccucuaggggguggcauuguaaaaccauacaccuucagugaccuuaaaaacaguuucuugggacuccauuuguuuaugugaucacagaaagauuaaguaguuuuuccagaaguuguggauacaugcaacuguuuuagucagauaugauauaacauauuaaagcagaaauguuuuuuauucauuuuuacaccccagauuuuauucgcucuccccccaguuccuccccccccaucaaaccuccugacuguaccaaaucccauaccuccccccacccccaucuccaugagaaugucuccacgccccaccccaccugaccucuaaacuccuggggccuccagucucuugaggauuagaugcaucaucucugaaugaacccagaccuggcagcccucugcuguaugugaguugggggucucauaucagcugguguaugcugccugguugguggcccaguguuugaaagaucuugggucuggguaggaguugagacugcugauccuccuacagggucacccuccuccucagcuucuuucagccuuucaaucacaggggucagcagcuucuguccacugguugggugcaaauaucugcaucugacuccuucggcugcuuguugggucuuccggaguacaggcucgcuaggucccuuuuugugagcucuccauagccucaguaauagugucaggccuuggggccuccccuugagcuggaucccacuuugggccugucacuggaccuucuuuuccucagacuucucuccauuuccaucccugcaguucuuucagacaggaacaauuaugggucagaguugugacugugggauggcaacccucuccaucauuugaugcccugucuuccugcuggagguggguuuuuuuuuuccguuuuuuauuagguauuuagcucauuuacauuuccaaugcuauaccaaaagucccccauacccacccaccccccuuccccuacccacccacucccccuuuuugcccccggcguuccccuguacuggggcauauaaaguucuuuaaguucccucuccuacugucaagcauuucuucucaggacccuuugagugcugagaguuacugaccucccaggucucuggugcauucuggagggccacccccauccuccuccuuccugaggcugccuauuuccauucuuucugguggcccucagggcaucaguucuuucccucacccaauaccagaucagguuccccucuccccacacacacaccccuaguccccccucccuuccaucccaggucacucccucccuccuuacuugugauuacuuucuucucccucccaaguaggacuaaggcauccucacuuggacccuucauccuguugaccuuuuugaagucgucuguggacuguaucuuggguauucuguacuuuuuuuuuggggggggggucuguuaucucacucagggugauaguuucuaguuccauccauuugccugcaaaacucaagauguuguuguucuuaauagcugaguaguauuccauuguguaaaugaaccacguuuucuguauccauuuuucuguuaugggacauuuggguuguuuccagcuucuggcuaucacaaauaaggugauaugaauauaguggaacaugugcuucugggcaugguggggcaucuuuuggguauauucccaagagugauauagcugggucuuccaauuuucugaggaaccuccagacugacuuccagagugguuguaccagcuugcaaucccaccagcaauggaggagugcuccucuuucuccacauccucgccggcaugugcugcauuauuuuuauuugugcaggcauaaggacacccauguuuuguucuauacuguagucauuuuaguaauucgaguauucuccuuuguuuaaauaaagcucuucagaaaaaagcugggauugcagaaauacagucugugcaaccccucaacuuuaauuuccuucuuugccaucccagagaauucaagccaguugguacugcuugcuuuucauaauaguuacauuugacugcucagaggugaaaaccugcauccuuuuugaauagcagcaggcuaucuauaauaggcuucaguagauaugcuugcuaaauucuacuucauuuagcuguuaugauuauuuuuuuauacuagagcuuaucaaguuuggaggagggagugcuuguguuuauugagacucaauuuauuaccauuuccuuuuggaaagaggacuguacaucauggaagagcaauucuuuguugacaggacuaccugguacauuuuagaaaguuauuguuaaguggcuacaauucccccacacugggaaaguggcucauuuguaaugugcuuaccauacaagcaugucgacccaacuuugauugcuaacacccacacaaaagccaggcaagacagaguuccucuguaaucccagcacucaaaaugcagagacagguggauaucaggaacugauugggcaaccagacuauuuaauuagcaagcucuagguucaguuaagagaccuuggcucaaaagaaaacaaaaacaaacaaacaaaaaugugggggacauugaagguaaacacccaaaauugccuuuugguauuuauaugcacguaacucacaaugcucccccuguuuuccugcucccucuagaagcaauagacaguucuguuuugccaccuuugagaaacauaggucaaaauaaugcauggguuuuguuuugauuuuuagaaacuuuguaauacguacaaaagaauaaagaaucacacaccuuucuacuuacagucauuacacacacuauuguuugaagugacuaaaguaacccugugugcaaaugcacgccugcagucuucuguagcuaugccaacuggcauccuuaggcuucaggucuucugaggggaaaaaugcuuaauuauguccgaaaggaagguuaugaaccacacagcucugacgugggacaguguucaaauggaagggcauccugagacacagcagcccaggagccacacacuucugagagaaagccuucucaggaagcagagauguugcagcuccauccugauuuuuaugaugguugugcuucuuuauauucccauucacggugcaugaaugugaccccacaaucaccagcauuggcugguuuucgucuuagccauucugauugagauaagaauccucaauguaguuuugacuuacauuuccacaaugaaugacaauguugagauguuuuuauuuguugauugacccuugaguaguuuugaacaacaugcauuuguucauuuauuucuuagauuuuuuuaauauuccauauauccugaauauuaauuuccuagauguauagauagcaaagauuuucuuguguucugcaguugucucuuguuugguaauuacuuugcuguguaaucuuacauaauuaacauuugucaauucuugauauucuucucuaagcuauuuugaauccuguucuuaaagucuuugccuaugccucugauuugaaggguuuccucugugauuucaaggcuuugacuggggacuuggauccauuuucaguugagauucagagccauagagacagagauugacacuuuuacaucugacuguccagguucccaguacugucuguuuaagaguccgucuugucuccgacauacaguuuuuguaccuuugagaauccgauggcaggaaguguucauuuuauuaguaaucuuggaccaaaaguaacauuagcuucacaauauuuucgugaugagcuccuuugauguuaccacuuuuaaaugauuguggaaaugcaugauucuuaaauacucacuuaaugcuaguuaucuuuaaauuacuauuacuccagaucacuggaguauugaagaacauauauucuugagucuauuuuuaauuggaguaagucauuuguauuacuaauuacuagugugcuugaauucaaauacucuugcaaaaacccgaaaucaaauacaacacugauagcgagaauaucugacucuuugacagauaauugggguacucuggugugguggggggcaaaguaugugcguauaagugaguguuuuuaccugccuguuugucaguguagcauaugcaugcagugccagaaggcaucgaaucacuuagaauugaaauuacugaguguugugcuccuccuuguaggugcugagaauaggacccagaacaacuggaguguucuuaaccacuaagccaucucuccaguccucucgagcauuuguuuugcuuaagaauucugucagucuuucaauaauauuuauaauauaauuaauaaguauuucuuguuuauuaguaaccauuauaaaguuugcguuaaggcauuauagucugccaucauacauuauuuaacuuuacacauaaaguauuuauuguuuuuuccugccuuuuuccuaucguugguauaguguucauacauaugucauauacccuguauuuuuauguuacuuuuuauuuuauauauuuuauauuuuuacuuuuaaccauuauucuauaaagugagaagccaauuuuuccuguguuugaccacauaaguaccauuuucaccagucuccuuccuuuuugaaugauggcauuccuuuucucucccagaacucugucugccauuuccuucuucauuccaugcugagauuacuucagccucugcugcaggaagugagcuuucaccucagcuuuucuuuuugacagaugcacuugcaguguacuggacuugacaguuuguuuuuccuuccaccuccuuuuggagaccuuucuggcuggaucgcuucauuuggaaucuagucacuuguaagcuagacacuugacacuuuccuggaccaacagaggcuggcuuuuagguuguuugucuuucuucuuuucuuaagauuguuuucucccgguuuuauuuugaugcuauuucuaaggcucauuaacacacacacacacacacacacacacacacacacacauccucuucuucucucccucccuuccuuucuccaucucucccucucuuuugcucucuaugauuauacuguacugcuaaucauaucaaguaaauuuucacuuuggaugaguuuuuucuagguguuacauuugagucccuuuguguauauuucucuuuuucuucucuguacuaguuuuuguuuguuuguauuuuuuaaaaugcuuuaauauuaguucccuaguauuugauugucaucugauauuuccuucauuuuaacaucgcuugaucugcuugaauugauggcuuacugcuuuauucgucauauuuucacaccugcaugcuuaguaauucuugcuuggacauaggacacuuugaaaagauuugaucuggccaacauucaagguauuugugguuccuuggaucgucugugcuuuguucuuuuguuuguuucccaguaaugucaccauuguuguuucuagcucuguguggagcauggguacaguagccuuuggagaggaugaauaaaacagguuuuucuuuagggacagguuagcccuacuacuaaagugugguuuuggagucuccugaauauucuggauaaauauccaggacucucuacggucuaguuggaacauaaauguauucuaccacacuguguaugcuugagaagagguagacacguagccuuugugcauucuuuggcccuguggaauuucccccugcacagaccuguaguaguguucagccaauuucaacuuuguuuggcugaacaaaccaauggacuucuuuuuguauagguuccuccaggucauuacucuggccuucaacuuaaaacugccucauucucccugaacucuuucuuuguuguuguucuuguuuuuaauuuaauuaauuauuuauuuuacuucauacauacugcucacugcaauuugucuggucuccuggucacccccucccacaauuuccccccauccccacucuuuucucaagacagauagagggagggaacugagugggaaaggggaugggggggguucaggaucagauguggggauggacaggagggauggacagauggccaugagaaugaguggaaaucugcaacugacagggguggggagguagagcaucuaccuaucuaucuccaggaagagacagagaccugggauaagggaggcuccuaagugaacuguuguccuuccuccggaguuuaaaugugcuccugcacagugcugggcugaucuuagguguucaugcuugugucuuuucucuagauaccauggaugguaucugcuguuaggaaaugcauuuuauguauuuuguucagauaucuuucuaaggccuaggcuggccuugaaaucauucaguuucacaggccaucuuugaaccuggcaauucucuugccucagccuuaaaaguacaggucuggcccccccagugcagcuuauggugucauuugaguaaucaguugccaugcacugcuugcugggcaucagcacagugcuacuccguaaucuuacgugugagcauuggcugauuuaguacauauuuuaaaaccuagauguauuaauucauuaguacuuguaucaugacauggagcuucaaaauccuuguuugaugaagggugaauauacauccuuuaguagacauucauuuauucugccuuccuuguucauuguuuuguuuugauuugugucaaacuuuguauauugucaggggaagagauuguugcugcaguuuuacuuuggaaaguagcaaaguuauaccugcuauaaaacagugcacagagcugggcggugguggcgcacgccuuuaaucccagcacuuaggaggcagaggcagguggauuucugaguucaaggccagccuggucuacagugugaguuccaggacagccagggcuacacagagaaaccuugucucaaacaaacaaacaaacaaacaaccccccccaaaaaaaaacagugcauauaauucaguguuuaacucaguaguugcugcacaaaggauaauacugagcauauagcagguacauacuugaaauaguauaguauuuucaguuuuauuuuuugaaauaaauuuuguuuuuaaaugucaauauauauucuaguauuccaaugccauguucuuuuaacauaauauuuuaauauaauaaaaccuuauuuuucacuggggguguguguguguacauauauauuaaaauuuuauacuuacaucauguuaggcauuuuuacauuucucuuggauaagcaagauguuagaauauuuauguuuagagucugaagccuugaauaaugcauacuuucaugauuagugaauguuucucuccugaaugccucacauuaaacuaaaguuggaauggaaaguacuuaguccuuuugcaaacauaccucauuacucaucaucacauaauguuuauuuauaaaaacaaacaaaaagagaccaugaauuugaaaaagggugggguggagguauauguggaaguggggaagggugccauuauaaucucagaaaacaauuaaauuauccaucucucucgccuagaagaaauuccaacaugaaauauccuuguagacaauguuagcuacacacauuuguucuaccuuaauagguguuuucaguguugcacauuaauuuguauugcauuucuguuucuauuaugaauugguugucucagacaucucuuugaaagugauccuuuuuuccauccauauggcaaaagaugcuuucuaauauucuuucauacagagauuuaagguuuuuugagguuuuuuuaaaucaguauuggagaauguaucuacucuuacuuauuucaaacuucaaauuguaagacacuuaacuaauacauaaauguuaaaucagagucugagaggaucuagugagucccaggccagccugacauucauagcaagauucuuaucucacaaagccaaaagaaaaaugcauuguaaaauuaaauaugguugcagagaaagcugaaagaagaaagauuauaauuuaaaaguggaaagauucugaagaacuggaagccuggaguagugcauauaguuaaguguuagaagaacagaguauugcauccacagcugugcuugacagacuuccuuccccuguguguauccgcuggagaugcuggagaugcuaauucaguuguggaauggcagugugugagcagagcauguagugcagaggucagucaguaugccgcuuuacauuugaauuagauuggguugcuuauuacagaagauucaaacuaaugauccaguuaaacaaggauuuacucccugauucaaagaaaggcuuguuagcaguacacauugucggugaaucucuaugaaguuacuagggccccaagcuaguguaguuucagagcuagcaacuagcacauugcaaaggcugcauauaguccaaggugaacacuagagaugaguuacgaaaugguaguguucuagauggcaaggaggaggugaaggaagugagaccuuucccugccauuuauggcuggaaagagacuuuaugaaagucucucccagcaguuucugguucuguaaaguuagguuuaguucuuauauaaggcuguacuuuuguuuugagcauagcaaaaagaugggaagcugccauaugagaaggcacccagcagucucugcuauaguaguauccauguaaccaggaaaguuucaggaguaccccagauggacaaggaaagacccugagauccacaggucauugcagacaugauaauauuggguggcagaggacacaagccacccaagagaguugggaagacacuugagagauuaaauuagauaacagcagaauuuguaaaucccagauaggcagucggggggcggggggcggggguggucauggauuuaauacauaauaguuaccugaggacuacaguccugaugcccugaagugauagcacguuucgguuaggacgaagcaugggaccaaggaaacauucacacucgguggaugcuaauucugaagcaguaugugaagaagaggcuuggccuagauuagggccaaaaaacauuugauugcuggaaaaauugguguacaguuuaucacauuuuucuucuacccugaaggacuagaaauauguauugaacaccaauguccaauaauauugucuauaauuuauuaacuuuaaaugaauguauaaaaguaaauauuuuagaacacugagauauacagguguuugcauauaucauagaaauaacuauauagugguacuuuguuuuaaacacaccuucaaguaucucucagugcaaauggcacuagggagugcuacuucuuguuuuucucuagcccgaggaacuugcagauaugugcaugggaaguacaauaacauaaaauuaauuguaacagucaacuuuuagaacugccucuguguguguuugcuagaagaacccauguguggugugaaacaguccugccaucuccaggacaugcucaguuuguagaaggagaaauugcagacuuuguguguauguugauccuguaaagucaccaccauaaagauuucuaguucuccacacuggaaacuguugaaacugggauguuugauaaagagggcuucaguuuuagccuuaucucaaacgcuuuuauuaguuuuuaaagagguuuauuuauuuaaagggaaagagugcauugaaaugacugaagcagcucuuccuaucaacuucagcccaagccucugauggcgccacccuaacccaagaugucuaucagcuccacucauuugcgagcacgcuugacaugggauuguguuuuauguugcuuugucuugucgugucuugucucuuaaugcuuugacucaccaguuaaauuauauauccuuuugacacuauagggcuaccuaguuuuuuauuuguuuuuaacauguugggaaaagaaggccuuacuuguaaagauguauuagcaugaugccugucuugcauuuuuagguaagauuuuguguuuuuuuuauaaauaaaauccauaagaaaucuaaucuuuauuuuaaauuuauauggauucugauuuucuuacuaggaaaaaauauuuuaaacauucagucacuuaaagguaauauuuaaaguauaaaaguucaggugcuucccaucucaaaagcugaugcuuuuaaaaauccagaaagcuggaccaaagguaaagccuagcaccaagaaagcagugugguuggcguguuucaacaggcagaacaggagacgagaauacugaagacccggguucccagucuugcugugugcucuggaaagggcguguaggagaagacauacucggcugcuaagcugugaacacuaagacaguuuacacaccaguugcuaggaacaagaguggcgguuccuuagcuuauaugcuuagcagaaugccuagguguuuuuucuacugaggauauaaugcaaagacucuaacuccuaguguccagucagcagugcuuaccucaagaacagcaacugucaaagcccagacacaaggaugcugagauagauguaauggaaaaaggaaaaugcaaaauuaucaaacagcuaaaauugaucaaaaagcuguggacuuaaacauuuugccaaaaaucaaagcuguuccccagguccaggucuguggaccguuugcuuauauccuaaccaauggaaguuauccucuugacucuagcugcauauguaucaaaagauggccuagucggccaucacuggaaagagagacccauuggacuugcaaacuuuauaugccccaguacaggggaacaccagggccaaaaagugggagcggguggguaggggaguggggggaggguaugggggacuuuugggauagcauuggaaauauaaaugaggaaaauaccuaauaaaaaauauuuaaaaagaauggguguuguaaauuucuuaaccauggaccaaauuaaauauccaauuaauguuuuuuuaaaguauagaaauuuaaagccaacauguguuuuucuuuucuguguaggucguuuauaugcuaugcaaacuggaaugaagauugauaguaaaacuccugagugucguaaauuuuuaucaaagcuaauggaucaguuagaagcuguaaguuacacacuacuaacuuauuaucuggcuguuuuauauggcauuuuauuuuguauguuugugcauguauuuucuguuauuucaguucuuccccuaacaacacuuagcaaugucacauuauaccuggagaaaaaugaguaaucuuaaaaacccacacuauauccaggggagucucagguauaaagcaggcccacauccacauugucauagauggcuuucuguucauccuuucauaaguaguaaggccuuuguugccuuccuucacauaauguggauuguugauugaagaacucuuaauagcucuuacuguaauaaagugggcuauuuagugaaaggaaucaugaagaaagagguaacaauugcuuauucucuuucccuuuuccuuacuggcaaaccacauacuguccucuacuuguuggauggugguggagccgcuaacaccucugacccuucgguaggguuuaacuuuacagguuacugugcagaucgauugaggggaaauggaguuguuuacauuggaugucauugaauaaagaaugcaaugccugccauuaauagucuuuaguaaugaggguuuacuccuuugcccugcucucagguguuauggcuaguuuguauugacacuugacauagcuuaagucacuggaagagggaaacucaauugaauugcuuugaugaaauuggccugugggcgugucuaugaagaauugucuugauuaauaauuggugcaggaggucucagcgcacuguggaugauaccauacuuacuuaggcagauggguauguaagaaaacuuaccgaagagaaccagagagcaagccaguugcaaacauucuuucacaguuucugcucuaggguuuugccuucaauuccugcccucacuuuccuuaaagauggauugugaccuggaaauguaaaccaaauaaaccuuuccucaaguugcuuuuggucauuguuuuaucacagcaacaaaaaacguagagcccaguuguaauuggcagccauagacauugugcccucccucucugacuugcuguggcugucuccugguuucuaguguugcuuccaugguugcaaggugaauuagagugcuauggcagagguacugcuggggaagauggggaaugacucucacacauggaauuuguaaaauuccuccuuucacaggcauccauacagaauauaucucuuucacacuaauaauaacaacuaagauacaaauucaggaugagcagaacucaguucuuugcaauucguauaaucacauuauguagggacucaccuggaguuuaaaugacaucagguaaguucauuccuaugaaugcauaucucuaugacacauuguuugcauuauacucuaaagccaucaaauauguugugguuuuaucagaauuuuuugcuugauaagaauaagaugaaguggcguguucucacgaauuuuuuuagaucuaaaucugguuuugcaaguucuuuuucagcuugaacacaguaaauuguauucugugagcauuugaguguuuuuucuacuguuuuucagaaucagauuagucaaaauuaccuuaaauuccaacauuacauauaucacuucugaucuuuaaauuauucuauuuuaauuuuuaaaguuuuacuuuagcuugcuuaguagccaagccugauaucaugaguauguguguaugcacacacaugaguguguuuguaugcaugcauguguuccacauggguguagugccugcagaggccagaagagggcaucagauccccuagaacuugagugacagauuauuguaagcuaucuugugggugcugggaacugagcccauguccucugcaggaacaguaagugcucucaaucccugagcugucucuccagccagacucuaauagaaguagcuguaauaauaugcuugccugaaucggauaaucucaaaagaauuuuauuucaauaauaugguccuagauaagaaaaacagaagcucuuuugauuguaaauauuucaaauugcuauauaugcaguggagggauaugcaaacuaaaaaucugcauagcugaaguucuguugacggggauuguacauguuuaaguauaaaauaaucugguaaugaguuugucacuguauacugaucaaauagauugcugugagcucaccuuuaaacuucuucugaaggcacuauuuuagggcacagaagcuucuagucuucuuuuuauauuugauacaaacugaaaugggucaaaguuaaauuuucaauuaugugcuugagaaguuucuaguuccauuuuaggguaguuguuagggacuugguaauauuuaggagguuuugauucuucaccaggauacguggcaauguugucuuuuauuuuugguuguuuuuaucuuuaggccucaacuguaccucuacauuuucaucccugugagggaaucaggcuuugguuugaauacaggagacuggcguagagcuauuuuauuuuuauaagauuuacuguuacagcuuuaauuaaaaugaauguaaaguaauuuacuuaaaauaauuauuagaauuacuugugccuaaguaaacccuucugagaauacaaaucaugagcuauaugucugauuuuauuuuagcuuaaaaaacaguugggggauaaugaagcuguuacucaagaaauaguugguugugcccauuuggaaaauuaugcuuugaaaauguucuuguaugcagacaaugaagaucgagcuggacgauuucacaaguaaguaagcccaggaaaauacaaguuuuacaaguuugucuaccuucugaccaguuacacagcuucuaguugaagucuuucugaccacccaaguaauggcuuauauauuaugggauuguaaauccacagugauucuuuagguuacagaugugggccucucuacuuaaagaaaauaacuuuuggaccuagcuauuucaaacuuauuucucaguaaauuuaucccaauuagccauucuuucauuuaguaaaaauagucaaaacaaguuugucuugauggcaguaaauuuuaaaaacaucccauuguagcugggugugguggcacauagcuguucugagaccaacagaggcugcguggcaagacacugcuucaacaagugaacacaaaaaccaagaaagagugcucuaccaaccaacuuagcugacucauuagucauuauuauaauaguuaaaaccauagagauagauuauggucugauagagagucaggccaugcucgacaguccuaaaaaaaacaaaagcaaacuccacuauaaaaccuuggcuucugauaauacuagcaauugauucccauuguguucuuggaacagauuuuauuuuaaacauuaauuucaguauuuuucaaagguuuguuuuuucuuuuacggguacaugacuacauuucaguguauguugguugguugguugguugguugguugguugguugauuuuuaauuuaaauuaggauacccuuucucuuccagaaacaugaucaaguccuucuacacugccagccuuuuaauagaugucaucacaguguuuggugaacucacagaugaagugaguauaugcuuuuaccugucuuauagcugaugacgaguaaugucacuuguuaccaguuuucucauugcaucauugauuuagaaaagcaugucugucagaacaguaauggaaacaaaaaaaaagguauuuuuuuuucuaaauauguuuugaaaaucaaaugaaauacuuuccacacaggauaacaauacuuugaaaaauaacuugauuuuucacuuaaaaaaaggagagagauagacaaaccagaaaauaauguaauggaauauucaagagcuuaaagaaaaggaauggggggcagaaauuacaaaauuguuccccagaauucuauugauagcauguaauauuuacuugagaaaaauaagcgaugggcaggagaggcagcucagcaguuaggugcacuggcugcucuuucuaaugugaaaguauagaaaaagacaugucccauaaauacuaagugaccagaaggcaaguagcaauaauaaacaaagucagcuuuaaagaacguauuagugauggcaaaacaagacaucucauaguagucaugggucgcuucaugaagaauauucacaugcuuaaagauugaucccauguguaacuguacugugaaaauguacaguuacaagugucuguauacuuaauaauaggauuuucaaauuacaugaaauccuuaaaaauguauuaucauuguuggagaguuuaaaaaccucagucacugauuaaaaaaagcaaacacuuucuuuaacaaucaguaaaauuaaccagacaaauaaggacuggccauggaauguuuagaaugaagaaaaaccagaccuuucagacuuagcuuaguggaaauguuagauguuacagcugcuuaguggaaagaauuggcagauuuuauaaaauuaaacagacucccaccuuuuuacccagcaauuccuuuucugauacuuacccaagagaaauaaaaacauaugucuagaaaaagaacuugcucauugaaaacuuacuuauaauagccaaaaucuuggcacaacauagauaucuacaucugaauaaauauuaaacaaaauugugauguuacucaauauaauacagaaucagcaacuuguagccuagaauauggauaaauccuguagauuugcugaucaaaagaagagucaagugguguacugugcaugguugccuguauauaauguauagcuacagacaaguucauaguaauaaaaaaaaugaaaaauacuuuuaagguauuuuuagggagucaagagaaauggaucacgaaugggcuguaaaaaguuuugcuuaguuguaaauuauauauauugagaagcuuaugguuuacacuggcaucucuuuauuggcucuauaauuuauauacuuaacauuuguacaucucaaauuauauaucuuauugcaaaaguuucaucauugaacuaugucuaggcuuauuuggagugguuauacagcagcuuacucuguuuuugagcaaauggguaaauauagaggaaagcaggucugucacuggaagaaauuaagcccaagaagagagaggcagguggauuguguugcaaaauuaaaagaucuuaauucaugcuucugaauauauugguuucuauuauaacguuugugcauauguauacauaguaugauuuaugucuauaguuagcaaguuuuccugaguauauauuuacacuggguauguaauaugugcaaaaauguauacaaccuaguuccuauuucucaauuucaagacagucuaauaacaaugaagacccagaagcagagaacacccugaguaccugauuuguuuuugaauaccagucuuuucuaacaugaaccagugcucuuauaccaaugacugaaugauaacucaggucacaaaaauacugcauuagguuggaccuucuuuugcuaacaaguuauaaugugugggcauaauugagaaaccuagcagccuccuuaaaaggacgcuguugucuauauaaagacuuaaaguggauggauaguugaguggguggguggguggguagguggaugaacggauggaugagauauaaagagccaaaaaauuggagcaucagugcaagucugauagugauagucacuaaccuauguuuacaaaucaauggaugcauagugcuaaauauaauaaaacaagugauggaagaaaaguucuuuauaguauuagacucuauuaaguaucuucccucagauuaguuaauaacuucaaagggaaaaacaguaaauucaaaaggaaaaauaaggacuuuuuaaccaggauaugaaaccugccaucccuaguauugaagccagccagcaccaccaggauccuauucaguauuaaguagucuauaacauugcugcuuaaacuguauaacaugaagcaagcaugaagaaacagccaacaguucuaaucaauacacaguuuauaacugcuaacuuuuuuuauguuagggucagaaaaaaauagccuuuauagauugaaauuaaauagacaugauuacuaugauuacuaaauaugacuaaauaaugcagcuucuuagacucgaccucugcuguguagagaaaugacugcagaggacauuguuggcucagcugacaaggugcugugacuauaaaccacacaacagguguuguguaugaauauuccugaucuuaaugucugcuguauaugagauuaucuucugucugaaggaacaaaagauagaaagacgguaucuuaaacaguuggaagaugauugcaagauauguggaguaucuugacuagauauaauauauaauauauuauauacuguuauauaguauauacuguuauuaaaacuuuccuauaaguuuaguaaaacuauaguauuaaauaguuaacuuugcuuugaaauacuuuguuugaaaaucuaacuugaauguacauuccaguguuauaauaauagaguaguuaaauccaaauauguagauugaauuuuaauuauuuuuuguaguaaaauuuugcuuuccucuucaaaaucuuguuuugugagauuaugguagcuuuaugcaacuauaaaacucuugucuaaagcugucaagaaauauauguaauaaguaauuauaaguacucuagcauauagauguuauuauaacaguuuuuauugcuuccuucucaaguauuucuuacuauauuuuauugcuccugccauuauauagaacaccucuuguuuguaugauacaucaugaggaccaaagauaaaaaugcugcaggcacuaagagauuauuagucuuuuuuuuuuuuuuuuuuuuuuuuuuaguuuuugagacuucuauucauaacuuggggauuucauaaauauucucaauacuaucuacugaaacccgucagaguauguauucaaguuuaauaaauuuauauuuauuauauuaacaaaaaaguguacugccagauuucaacgauuuuuaaaugugguuucucaauacccagcuugaggauuguuacagugguugauaaaaggaaugaauuccaaguggauccagugauucuuucacacaucacuugguaccuuuucuggacaguagcagugcagcccggacugggaaucacuuuccugaaagagacagacaguaaacgugaugucaaaugauagcuguaauugagaaacugaagguagaaauaagaauuggcaaauaaauugauucaaggaagaccuugcugagaaucaggcuguauuuuagcaagccuugaagcuguaagagaaaaucacaggguccaggaggaggcagaugaugugggacccaugcuuucuuaccaagugcuguaaugauucugaagcuaccauuagcuacucaucccuggucuggagguagcaagggcgauucugugacugaauugaagauaaaaaaaggaagauaguagaggaugagaugaggaacggaauucagacuuaguugauaagaauugucuuuauugacacaguugcuguuuucaguauagcagaccaggguugacuagggaaagcagacauuaaauaaucaauauuagaggcugcuugcucagaccagaguuaguaguagagggcaugacuguaagcagucauauugugauugugugccugucauagaccgauagaauuagacaaugucgacaugccugagagcuuggccgugagcggcuaucaagaaugguguugcaugccacgugugguaacauauaccaaaacccagcacucaggaggcaaaggccaaaggaucaagaguucaaggcuaaccuaguuuauguuuaguaccucagaaaaacagcaaaauuauaaaagaauugccaugagaaggaacaaauuuagugagggcaucagagaguggagcugaacauuaagacucuagaaguguagaguuguggcuuguugucaguugaaauacagcauugaggugugugagaucauuauaaguuuauuaauuuagaacuauaaggaacuuauaucuucuaauaugaaaauauucuauaauaaaacaauaggauugggggaucggggcggggguggcauguaaggaaggcuacaagccuacaagugaaauguuggguuagacgguuuagaauugagggguugggaagagguuugaacagaagauguaaauuggggaugauguauguuguuaaagccaucauggaccaaagcaaauauuauaaagaaaacguuuaaauugguguuagcuuacaguuucaaaaguuuaguccguuaucgucauggcuggaagcagacaggagugguguaaacagcucacagcuuuacaucaggcaacagcacaaagaaaaugcaaaccuggaccuggccacccuaagcuacaaaccuccuccaucaagggcauggcuccuaauccuuucaaauaguuuaugccuggggacuaaguaugcaaacaugaguccugggugccauucuccucguucaaaccaccacacuggauaagagaguggaggcuaagugggaaaggaaggauaucuaagagcuaggugguggcagucuaggccuugcauaacaagaacaagcaaggacuuauugcagugucaucaagguaaaaagaaaaugaggaagccuagagauccaguaaaacaagugcaaauggagacgaaagcagugggagggacagagcuggucugggguccagaaagcagugucuagugagggcgagcacagaagugcucagaaauagccgaccuugauaacagcaguuagcaugagugaugaggguauuuguaaugucagaucuaguaaguucaagacaaagucaagaagggagaauuaaaggcaagucaguggaacuuuccccagagugaagcugaaugugcugaaaagagacuauauuggcuuuuucaagcuggcaacuuuggcaggaaugugguuuuuguuuuuaaauaagucucuuuucacuccuugugugcacguaguucaagaccaccugagccagcuuuguguuuuccucccaguucaugcacagagggcgagagcaggcaaugaacugagaacgcaguggaaagcuuugcgccugcugcugacccuaccagcuaacauuugccauugucagugauuuucaucaauucaguuacaaaacaggaacuuggggccagggcaaaaguaaaagcuccuuuuacaauuccuguuucccagaaaggaugucuuacucagccaacgggagugacuggguuuuacagauauugacaucuuacucuccucuuuaaaugcagugcaucaucaauguuaguuauuuuuacuacaacaguauugaaaugugcauuaacucguuaaaaacugucagaaauaccugcuauauauuaucuaugccaagguuuuggaaaauagggaauaaaacaauuuuuuuucuuuauguacuauggggaauuuuucauauaauuauaaaauaaacccucuuaagcuuaaacuaauauuuucauaaaacuuuacauauuuaguaaagguacccaggaggguuuaaacuucucacaauaugaagcuaggagugaaucuuauagucauauauauacuaaaucuacacacaagguuaacuucuauaaaauccaauucauguuuuugcagaagucuccuuuuuuuuuuuaacuacagcuguuaucuuaaacaugcauuaaguaauugaccuucgaaagucauuucccuguaguucuucuauuugcaucugaauugcaaauuguaucauggucaugauuguuguagcuuacaaaaucauuucuaauaaugugccuggcuuauuacuaaaauaucaucacuauugauagcucuguaaugaugaaaugaaucaauccuaaaggaaaaggugaagaaauaacugcuguguccaaauauccagguuuuagaaugcucguuuccucacauccaguacauggaaauaguaggaccuuuuagaacuauuuuaggccauugaaaacacguccaccaaggaaacugugggacccggccuuucucucuuguuucuugaugguaaaguaugugguuucccucuccaguaggaacuaacaguagaacuuugaugccgguuacuguuggccuuccuguuggaguauauguuugugcugucuccuucauccugucucucucaguuagcauagugucugccgugagaagaugacaaauaauuauuaacuuccugcaagccagggaggcucuuugagaguaaagguguaagcugagccuggaggagaggagacauuagacuacacacugacaguauuaggaaaggaagagcagggcagcgugaggaacaaugccucucgggauugcaggcaauggaauggaugagacugaagcagaggugugaauggggaaggcuuugaaugccauacccaagugugguuuuguucaccuaguccuauaaugccucagacuuagaggaagaaaaguauaacuugcuugcucuacaaggugguugugaggaccaaacaggaaaguauauagaaguguuuuauaauauagggagugguauauaguguuuggcaaaaacuugcuuuggauuucucuuauccaacucauucaugaucuucuuacccaaaacagacugauuuuucuacucauuccucugucucuuuauuuccaccuuucugaugacacagaccuuucuuucuccccagucucuccugcccuucucugcaccuuuuuaugucaucuuugucuuggaagaccaaaccaaaguaacguuucuacuccaggguuuaauguacugcugucagguuugacaaggggaggcugggaaugaccucugagcuugccaaagaggaguagguuauuagugacauuaaaaaggacaaaagcuccugugacaagguacagagcaugccaccaaagguauaaagggauaggugcauucggauuguaugacucuguguguaacuggacagaaaagcaagcaagcaagcacacaggccagugagcuagacagaaaaacggugaguguggacagcugcuuugaaaagcuaguuaaagaaauggagcagaaugcagucauaccuggggagacagggaggagggaaaccaaucuuugggcugaagcaggaaagcacucuaggcuccuuaguugagugguguuuuggguuccucuuuagacaacagaaugagauucucugccaccccugcuuaagaacugacguagucagaucaaguacuuaggaugacaacauagaaauuaaaauuaacuacuguauuauuuuuaucauguaagucuuauuuuuauuuucaaggauuuguauauaucuuuauagaaccauuaucgguuucuuuuauauuuuaucuuaaaauuucauuuaaccaauuucucuagguacccaagaguucgaaauuuugcuggcaugacacacauaugcgucccuugcagacuuugugaugugaugugaugugaucguguucuaaugaacauaccuucucauggcgucugccaguuccugaccacucaagaaugagcaguaaaauauagagacggccagacucuuagaaggguggcuuagcacguguuaaguacuucucuuuuuaauuuuaccguggucuaauggugcugcaaauauauucccuuuuagaaugugaaacauagaaaguaugcaagguggaaggcaacauauauucauaacugcuuaaagaauggggagacuccucaagcaggcccuguuggaauagaggaagagaaugguauguauuuauuaauccaaaguuuuaguagucuuuaguagaaauguuuuaguagaaucuuaaguuuucagagauuucaaguuuucagaagguccuagcauuuuuuuucaucuauaauaauuaaaaaaccaggaauguagggacaaguaagauuaaggcuuuccauguugucuguucauguuagcuaagcggcuuggcugacuccuuuaucugccuagauuucaucccugcauaggaaaguucccaaacuccaaugaauauugucuuagugcugugauauuuuuauguauuuauuugauuugucguguauuggcaggaggaggggguaauacuucaagcuugugaauuucauauacuuguagauguucaguucugcuguuacaauggagaagugacuggacagugagcagacagguauaugugcuuauguucaguaucauguuacagagcauacaaaagugggaaguggaguucucacuuucauauacucgucuuccuagguagggccuaccaagacucagagaguaaauacauuagcuuuuguuuagcuuuacagacaucaucauuuuaugaauuuucaaacagauaggauaaauggauggauggauggauacaugcauacauagauagagccuccauuuuucccauacaguuuauaauauaguguauuacccuugacuuaugaaaaaagaaaaagaaaacuauguacaggagauuuuugacauuauuacauaguaaguugguuuauaauauuuaauaaugaaaauauaagcaucuagauaucuuuacuugucuugucaguuaauaugggauaaaaaaagaaaggagaaaauguuucucacuuuuaaaaaaauuagauauguagucaauagcuuaaaauaaauuaaaagagaauagcacuauucucugaacugaguaaagugcgaaugacccuugcuuuaugaagugauuugggaacauguguggagaucaucauuuauuauaggaucauuaagcucucuuaaaggauuagguaauauauacuuucagcuugugaauuucauauccaguauguucaguaagcagacagguauaugcguuuauguucaguaucguguuagcuagucuaacuuacuuucucauuguauugaauagggugaugagacuguccaacuuugaaauaacuuuucauugugacuaaaucucacuugucaugauguuuuuuauuacauaaaugaauuccauucauugcuauuauuguaauaauguuugcacugaugauauuuauaacuagaauugaccuagaauuuuuguuaaggaggauuaaaauguuauacacauggacugccucaggaauacuguauccgcagcuucagacccaguuccucaggccucuguggccaccuacacuacugggacauauaugacacagacucauguacucauaaauaaauauacuuuguaaauaaaacuugaaauuuucucguccauuuuuuuauucuuuggaacaguuuaaauaggcuggcaauuaucuguucuuuuaauuuucuguguagcugggugugguggcauugccugucauuuaauucuaccacacuggaaaacugagacuaaaggauuucucugagcagaagacagacagacagguuuauauagcuagauauuaccucuagaaaauuaaauagacaaaaaaguguguguggggggugugaaauccucuuugacacuauucuuaaucucuacccagcuaguaaauagauuuacacuaauuaaauaaauacuuuuuuucaacucauguuaguaaccuccagaugucaauguggcccucccauuaacucuaaguuauaguucucuacagagagaagcauaccuguacaaggaagcauguauguaucaacugacaaaugugacaaugaugcugagcuucugugguuccagggaacauugcggaagguggggcagaaagaauguaagacccagaauaccaggaaguugcuaugaaacaguuccaccuagaaagggcuacauaaagaaaaccagaacauggcauguuaaugaagaagagggaaaauuuugcagggucuuaccccuuagacagggaaguacagguagguaaugacugcugugguggguuggauaugcuugacccauaggaaguguuacucuuaggagguguggccauguucaaaaaaaugugucacuaucagggugggcuuuggaggucuccuuuuaugcuccgacucugccuacugaagaagaguacuuccuccuagaugcgugaggaugccagucucuccugguugucuuccgaucaagguacagaacucucagcuccuucuccagcaccauaucugccggcaugcugccaugcuuccugcuaggaugauaaaggacuaaaccucugaaacuauaaaccagcccuaguuaaccuuucuaggaguugccuuggucaugaugucucuucauagcaauugaaacccuaaccaagacagaaguugguaccagggacuagggcauugcugugauaggucugaccauguuuuuguuuguaggaauguguuuuggggggacuugaauuuuaaaaauuugugaaauauuuuaagugggacuuaaugggcauaauuccuagaaggaauuuggaagacauuggugcugagagugauuugaccucuggagaccguucuuaaugauuuuugaugaagaauguuguuacuuuugcccuugucuggagagucuaccugagacuaaaguaaagaaauuuauauuaauuguauugacaaaggaagucucaaagcccagcauagacuuaguccuuugguuuacucucaugaagagcauuuuaucaagcauagcaagcuuagaaagaaaauacaaaauguaugguucaaaguaaaggggcacaaagagguagagugaaacuaaauccuauccuuaaggcaagcucccacccagcuaaauuugcaguugcaguuguaugagagagaccggggggggggggggggaggagagagagagagggugagagaggagagagaaagagaggagagagagggagagagagagagggaggagagaggagagggagagaaaggaagaagagggaggggaggagagaaaugaaugaaugaaugaaugaaugaaugaaugaaugaaugagaauguuaggcuuuauuauaaccuaguuguuuucauuuguauauaaggagaugugucaaauugacaaggaauaguuauaccuauucuugguuuucaaccugauuaauaucuauaaugaaagguugggucaagacguguugguauaugccuuuaauccaagaggcaagcagaucucuugaguucaaggccagccugagacagagcaaguucuaaguagagaaaagcuuaaguccaggcaugcuguuacaugccuuuaaucccagcauucauaaaacagaggcaugcaggucucucagcucaagguuaaucuacagaacaaguucuaggagagccaaguuuaggcaauaaauuagaaaacagaaagguggugaugauauaauccaagagaaacauguuccagcucuagcaagcagcagaacuugggaguuuuggucacaggcuucuggcuucagagucaagaauaguagggacuacugggccaauugaugcugguuagcuggaacuaagaaaugagcagugauuaagagaccagcaucauugaggugaaaucuuguggaguguuuucugagaguacagagaaucuguguuccagagauaaucaagguuauacuucaugcuucaccuggacuugguaagguguaagaaucacccauggagaguagcuaaggcuuggcacugugagagaccagagacugccauuggugaaggugcagccucacuugcaguugacgguucaggacugaaggggccguguaaaguugagguuuggcaaaaugaagggagccugugagaggcaguugguaaagccuaguugcaguggaagaccccaguguauuggagcugccaguaccauggaaugacugcugagaacagcaacagcaguggaguggaaucaaucagagccuaaagggcagaggaagugacccaagccuuuggaggagcccagaagaucauguguggaucccagacacuugaacaaguagcugugaaguugaaguugccuuggcuacccuaagaucuuagagaugucagaguugugggauacccgucaaggaaaauuugcuaacauggaguggaacuaaccuaagagaacagcagucaacaaggauggaaaggaguuggagaucugaaguuggagaccuugacaucggacagggagacauagaauuuggaguuuaaccagcugguuuugaucuugcuuuggucaaguauuuccugccuauaauauucuggaacgguaauauauauccucugccauauguuggaaguaucugaucugcuuuuuuauuuugauuuuguaggggauuacaguuaaagagauuacaugaaucucagaagaaacuuugaacuuugggcuuuuaaaaauugaugagucugugauucaauauggggauuuugaaaguuggacuagauguauuuuugcauuaugcuuuggcuaauuauagcaucaguaggcucauguguuugaacaagcuucuugggggcuagggaauggaauauagugguuugaauaugcuugacccaucuggagugguauuuuaaggagguguggccuuguuggaggaagugugucacugugggggugggcuuuggaggucuccaaugcuuagacucuaccuacuacaggagagagcuuccuccuagcauccuguggacaugauucucuccucauugacuuugaaucaugaugcagaacucucagcuccuccucuagcaccaugugugcuacauacuaccaugcuuccuaauaugauuguaauagacuaaaccugcuccgaugaaguguucccuucucuaggaguugccuuggccauggugugucuucagagcaaugggaaucuaagacagcuguugacaggagaauuaaucucuugcagggaugagccugucguugauucagugcaaagugcucagcccuguugaagauucuguauuuucuucaguauguauuuuuggcauuuuugucaaaaauaggugugugagauuugggaccuuauuucuggguuuucagugcauuucgauugaccaaugacugucuaucuccuucccccucccgcuuuuucucuguuucccuaauauuaugcuguguuauuacuaaagcuccauaauacaaucugaaauguguaguagugauauuuccagcaguucauuuauuauucaguuauuuuaacuauccugagguuuuuguguuugcauauaaaguugaaggucauucuuguuguuuuguuguuguuguuguuuaguuucugugaagcauuguguuggaauuucaaugaagauuuuucuuaaauguguaaauuauauuugguaggauauaccaugucauugugucauguucacaauauuaauucuaguaaucaaugagcaugggagaucuuuccaucuucuguuaucuucaauuucuuuuuucagugucuuaaaguuuaugucagacaagucuuauacuuguuuggguaguuagcccaguauauuuuagggugcuauuguaaaagauacuguuaccuugauuuuuuuuccucagccugauuaucauugauguauaggaaugcuauugauuuuuguguugacuuuuuuaaaauccugcuacuuugcucaaaguauuuaucagcuguagaagguuccuaguggagccucuaucauuuuuaugcauaaaauuguaucugcaaacaaggauacuuugccuucuuccucauuuauauccuuuuucucuccuucauuugcauuauugcuccagcaaaacuucagguacuuuauugaauaggaaaauaaagaauauccuugucuuguuccugauuuagugaaagugcuuugaguuucucuccauuuaaguugaugcuggauaugaacuuguaguuauuuuacuauguuuaaguaugucuucucccuagccucaccaguaccucuaccaugaagggaucuuauguuuuggcaaaggccuuuuugcauauaaugaaaugauaauguguuuuggucuuucagucuuauuuauaauguaguuuacacuuauggacuuauauauguuguuugaauauguguguguguguguauguaucucaggaugaagcaaacuugaucaugguggauaaucccucuuaaauucaguuugcauguauuuuauugacaauuuuuugcaucuauggauaagguauacugcuguauaauuuuuauuuugagugugugguuuuggcauuaguuuaauaauggcuuuauaaaaagaguuuggaaauguucuuucaguaucaguuuuaucgaauaauuugaggaaaucugauguuaguggaucauuaaguuauuaguaugagaugccuucauuuuuugauguagcauuuugugcuaugaauuucccuauuagaacugccuacauuguucccuuaaguuugcaaaugaucaauuuucauuuucauuuaacucuaaaguauuuuuaauucccuacuucauuacuauccugacccaauuuacauucaguagugaguuagcuuccauaacauuuuacacuuucugcuauuucuucuguuguucauauccaacuuuaguccaugguagccaaauaggauucaguucuucuaguccaagcugcugaaaagaaaguguacucuguaguguugggguguaaugcucuguagaugucuguuagguccauuugauuucugauguuacuaaagucuagcaugucucucuuucauuuugucuggauggucgaucuguugauaagagugggauacuggaguuaguuucccaauaucaauguuugagggucaguauguaauuugagagguaguauguuucuuuuaugaaauaugauacccuuuuguuuuguguguaaauauuuagaauuguaauauccuccugguggguuuuuccuuuaaagaauauguaguguccuucccuaucucuucuuguuaguuuugguuugaagucugucuuaucagauauuaaaauggcuauauguuauuguuaagaaaaggauuucaguauauuugaaguauugauauauucauaaauugucuagaaaagugcuuaucucaauguagugauuugauuuauuuuuuuaaaauaaguuacauuaaagguguauauaauuagacaaauacucagaaauuugauagaaagcaaaauauuacauuuuaaaauuucauagaucuaacuuuauuauuuuaaauuacaaaccaaagguagcucucuccguaaguaucucugucaaauuuuaacugucucauguuuguuuucaaagucagcuaaugauauuauuuuaaaaguguaacuuuccaaauauauuaaaguauaugaucaccuaugauagauauaugaauuaaaauuucaguuuuaaacuuuguuuauuaaucuuugaacaauaguaauaaauaaucauuuaauagccuacauauagcagauagggaauaaaagacaauuaucaaaaaacaguccauuuuugauggcacaaauaugaucuauuuuaccaacauuguccuuaguuuucauuugaaauuuguuugguuuauagaaauaaacguauguguaaagaauguauagaccugguggacacuguccgaaagaaaugguauucauugucagccacaaacuuuauaaaauauuaaaaauuuuaaaauguaacaaugauuucaagaaauagccugcuuauuagcuacauauagguagaauugcuucaacauuuuacauguguuauauacagauguugaagaaaaugaagauguuggcgcaaccucucugcccacucagccaccucagccaucaucaucuucagcauacgacccaagcaacuuggcaccaggcagcuacaguggcauacagauuccuccaggugcacaugcuccagcuaauaccccugcagaagugccacacagcacagguaugagcacagaacucuguucccauuuucauaaaaacuuaauguuuucuguauauuguuaauauauugcuuuuauuauugaugaaacugauuguuuuaucaccagucuuuguuuaguguaauucaucuggcuuacaggcucuaggguaugugucaugacacagcuaguucagucaaugugaaauuguuuuguacauauauuucauaaaacacuguuuuaaauauuuuauagucuuuggaaacauucaucguuucuaaucuagagugcuuaagcaagaccagcuaccccagugaaucugcuggagggcaauucugaccagcaugcaccugacagaguaaacacuggcauucuuuuggaagcagcgugccgugcauuugacccagaccccagugucuucugguucccacuagacuaugaaccuuccagagcccagcugguaucuuccucccucacccucaguuguuuucucucuaggaugaaguuaguaucaugccuauuucucaugcuuaauuauuaaaagagaggaaagcauaaaauugacugguacuuagacaugacacaaaaauaagcauuccacagauucaugucuuuuccuuuuuuuccucuucugccaucugugcuagaaagacagagcugucugugacaaguuaaugagcauucagaauuauuuugggaaucaagacaaaugucauaugucaguguagaaguuuggaaagauuaccugaaagguacuucuguagaaacggaucugaaagcagcucuggaguaaaguuacucacccuggauccauauggaccuggugugugugugagacaacaaaccauacuuucaguuggaggauuguuuaauugcccuauaugaaauuaauauuuuguacagugaaagcauuaaaaucuugauagcuucguguggccacacuaauagucagaacuuauuguugagaauauucaugacaaugauagauauuagagggcagauucuaggaaguguucuagugugcacagugcauuuugaucugguuaacugagacaugugccagcuguguguucagucucccucucccuguucauauguguuuaaauguagcauauuuuuauaaucucauuaccccuuucugccuccuuucauucaucaaagaagcgaauacaaguaaaagcuucuaagaagcauacucagugaaaaaccgggauuugaacucaagacucuggcuucauugaguuaguuaggaaggugcccccuccugucggugucccuugugugugauccuugggaaacaagaaucuauaaaucuuuucaaauccaaaccugcuuucucaguggcaugccucuauuuaguucucaauuuuggaugccaggucuucucuuagcuccauuuuuguuuuuuucuguuacauuuacucaguugguagcugucaaauaaaagaaagcaguaacauuuuuaguuuauaaacauaacagauguuuccccucuuguucccuuuaagagugauuuaccuucucucauguaguagguccaggauacacuuuuaucaaagggaaauccuucagauagcugaaaagaauaguguguacucauuuacaagcuuuaguucuuccacagaaaagcagugggugcaaggagggcaguaguacuuguuuggcaggguuugccggugugccuaaccacugagcagagagcacaugagauaguguucacugugucucuugaagcucaaaaugugugcuucuuguaggcuacaucacaaaaggccuuagcagagaaguaaacgcaauaaaaaaugguacuacugcuauuacugccagccuuuuuuuuuuuccagagacaggauuucacuauguagcccugacuggucuagaacucucuauguagauaaucuggccccuaacucacauuugcccuccugucugggucucaggaguacuaggauuaaagguguacacuaccacacccagccgcugcuagucuuuugaccucucaccuacuacacugcaaaccugagcuuugugaggaacuggagggagaagacguuacgcucuuggauucugugaggugucauaugcuuguugacauccuggccuguguuuuucucucagugccauuuccccugguuaccuggaggaucagucauauccguucucagacuuucuuaccuuugcuucugguguucguuuuagguuaguguagcugugucuuccuaccugugcugggccucuucacuccacuccauugcaaggcucuguuggaagcugggggacaaucuuccuuagcuuccuaaucaacucuuacgucucccuacucaagaauuucuaugccaguuggccuguagaacaagauauuacuuaucaaaaaauguuaguguguucuugaacauguaugaaugucuucuaugcugcauaaguguggcucagaaguuacuuucugacauagcauuuuauuauugaguaacauaaaggacuuagugugcaaacccccugcuuucuuccaggagugccacuguagaaggaucaccucacaccaacauacuauagucuaaaaguugcagucauuguguagauugcccagaguguccuacccaaauacaaaacagaaaaaaacaaacagauuagcgcaccuaguggauaaauaguaaccuaaaaaacauuaccaacuuaccagguauuuuugagcuuaugucaucccaguauucuaggcuccugcugucggcaaaaggccuucaagacaaacaggaagagauauguccagacuauccugccucgggcauggaugacagcugaaugacuagacauaacuuaguaagacucauauagccuuuuaaagccuucuucacaugaacuauugcaggggaaccgagcagccucugugaauccuacuguguucuuaaugcagcuuguucauaggguuuguacacauaauuacucaaaaguuaccauagacugcuggccagaaauugugcccucccaugaaggaguccguugagagauguaaucuauggaugaguacgaguugcuggggaaggagugguguuaccugcuuggaggaguugcacagccgugugcagccacuuaagauauggcugcugaaaagcccuccuaggcuucacaaacagucccucucagaucuccugacuuucgcacauuccucuuuguuuguuuuguuuuguugucuuuugagacagagucucacuguguggcccugguuggccuaaaacugaaaaagaucuuccugccucugccucccaaaugcagggauuaaaggccugcaccaccaugaccuguuuuuaacauccuuucuaauguuaacuugguaugugcuuuuaaagguuugcuuggaaaaguaugucaaaugcuaauugcuuaauauucuuuguuagcacucaucaaaauuaagcaaaaacucacagaauugugcagcauaaauuccaugucuccuagccuuucaguaauaggugcauccauuguaguucuguaugucguuuuuuuuaaaaaguggguuguuuuuuaaauagugauuuaaaaaauagaaaagaaggagcauuguugucuuagucaggguuucuauuccugcacaaacaucaugaccaagaagcaaguuggggaggaaaggguuuauucggcuuacacuucuauacugcuguucaucaccaaggaagucaggacuggaacucaagcaggucaggaagcaggagcugaugcagaggccauggagggauguucuuuacuggcuuuccuccccuggcuugcucagccugcuuucuuauagaaccaagacuaccagcccugagauggucccacccacaagggccuuucccccuugaucacuaauugagaaaaugccuuacaguuggaucucauggaggcauuuccucaacugaagcuccuuucucugugauaacuccagcugugucaaguugacacaaacuagccaguacaauugaccccuugucaacuugacacacaaaaacaucacuaguaagccucaacccuuacaaucuuauucauccccauucuaaauaacuuuaaaagucccacagucuuuacauauucuuaaaauuucaaucucuuuaaaauauccaucucuuuuaaaauccaaagucuuuuuacaauuaaaagucucuuaacugugggcuccacuuuuuucuuccuucaagagggaaaauaucagggcacagucacaaucaaaagcaaaagucaaucuccaaccguccaaugucuggaauccaacucacgaucuucugggcuccuccaagggcuugggucacuucuccagccaggcccuuuguagcacaggcaucauccucuaggcuccagaugccuguacucaacugcugcugcugcucuugguggucaucucaugguacuggcaucuccaaaacacugcaugaccccuucaauccugggccuucaauugcaacugaggcugcaccuucaccaauggccuuccauggccucucacagugccgagccucagcugcuuugcgugaccccuucaugccuucaaaaccaguaccaccugggugacccuuacauauuaccaaguccugcugcagcaggaguccaaccuuggccaucucuggaacacagccucuuugugcuuucagaaaacacuucccagaagaugucaccucaaugaugcuggucucuucuuaaucaccgcuaauuucuuagcuccagcuaaccagcaucaauagucccaguaaugcaaaguuuuugcuuuaguaguucugguauuuuguuaaucacagcugauucuucagccccagcuaaccagaacuacagaaucuucacauucaaaacagcaauggcccugaaaagagucuuuaauuuucccucugaaauuucacaaaccagaccuccaucuucugcaguguucucaacauuaucuuccaagcuccuacacaacauccgacagagcucuuaacaacggauggaucuucaagcccaaaguuccaaaguccuuccacaguccuccccaaaacauggucagguugucacaggaauaccccacucugcugguaccaauuugucuuagucaggguuucuauuccugcacaaacaucaugaccaagaagcaaguuggggaggaaaggguuuauucggcuuacacuuccauacugcuguucaucaccaaggaagucaggacuggaacucaagcaggucaggaagcaggagcugaugcagaggccauggagggauguucuguacuggcuuuccuccccuggcuugcucagccugcuuucuuauagaaccaagacuaccagcccugagauggucccacccacaagggccuuucccccuugaucacuaauugagaaaaugccuuacaguuggaucucauggaggcauuuccucaacugaagcuccuuucucugugauaacuccagcugugucaaguugacacaaaacuagccaguacaauuguaaagucauuaaaaagaaagcaaggauuggauuguuaaucuggaauuacagcugcuaagacauaugaacagcaaagcagacagagguguacuacauagaacucuuuauuugcaagacacaugcauacagaauuuugaguuuucagagaucacuuggcuucuggaauuagucagcuugucuuuauauacuuucccugcugaugaaucacuacagucuuuuguacgauuucagugcauuuugcuaacuuuuuagcugacuaauagucuguaccuggagcagagcacuagauacucguugauaugagagcuuugacaagucuuaagagaaagucaagcuaaucacucauuuaccuguaaaaauaccaccuuaaaaaugcauuagcuuagcaaacacagaaguagaugaucacagucagcuaugggaugggucacacagcccccaauggaggagcuagagaaaguacccaaggagcuaaagggaacugcaacccuauagguggaacaacaauaugaacuaaccaguacccuggagcucuugucuuuaucugcauauguaucaaaagauggccuagucggucaucacugcaaagagaggcccauuggacuugcaaacuuuauaugccccaguacaggggaacgccagggccaaaaagggggagugggggguuaggggauugggggggggguggguaugggggaccuuugugauagcauugaaaauguaaacgaggaaaauaccuaauaaaaaaaaaaagaaaaaaaaagaaaaaaaaaaaaaaacaaacaaaagaucggaaaaaaaaugcauuagcuggauaauuccagcauucaacuucacgcaguuaugaacuguauuuuucugcugacuuaaaucacaauuaugucucuuugaccucaggguacuuagaugcuaagagauuagaagauaggaagggaaucuuccuuuaaagauacauggcaagcuugaauuaagaagcaguugaccacuuagucauaucuguggaaguaauaugauauggggugagcagcucauuguuauguuuauaaguaugagaauguguguguauauauauauauaccuauauauauauauuacuuaugcauacauauguauguaacaacaaugaaaaagaaacaguggauuugagaaagaguaagagagugcauaggaaggguuagagggagagaaaugaagggcgaaaugauguaauuaaaucuuaauuucaaagaauaaaaaaauugacccacuagucaugaagcuuaacacucauauuuuccaguuuguaaaauaaguucaaauuaaugcaucagaaucaauuaagggaaugaagcacuuugcuaucucugguuuugauucccagguguaacgaguaaugccguccagccuaguccacagacugucccagcugcuccagcuguugauccugaccuguacacagcuucccagggugagucagcuggcuggcuggaggcugcauugugucucuccuuauuuggggugguguuuguaauuguuccuugaguaucuagguuauuggaaacaagcuuuuuucacugugucugcuagcaugucaugggaaccaggauucuguaaguuagucccagggacccaaauccaaaagauauuccauucuccuucucucucucucucucucucucucucccucccucccucccucccucucucccucccuccccccucucucccucccucccuccccccucucucccucccuccucuuucucucucucccucucucccuccucucccucucucccuccucucucuuucucucucuccaucucucucuccucucccucucucuccucucucuuucucucucuuucuccucucucucuccucucucucucuuuccucucucucuccucucuccucuuucuauauauuuuucucucuccuuaccuugacugcucucucuuuuuuguuucuguacuuuuguuuugguucucuuguuuguccuguacuggguguaaugacacugaugucuagccacaaguacuguggaagcuuaucauuacuuuguuucaucucagaaccacuauguauuuucuuuuauuuccuuucuacuuuucugccucuaguuaaauuugagauauaucuuaacuuuucauuuagaguuuaacucuucuuauggcucauguaaaaccaaaggauggccuuaacauaaacacauacaccaaguaacagaauagauuucaggaaaauuaucuuagaccuaugcaucucaaguuaaccuacaaaggagccaaaaaaacacauuggagaaaggcaccucuuagguaaucagugcuggggaacguggauaucuuacaaaagguuaaugucaucccuuccuaucuccuauaagaaaucaaaccaagauuguuagaagacaagacuuaacauuugggaauuauuggagcaaaacaaaagaaguacuuguagaugcugauagaccagugacuuuauaucuacaugacuccuaaaggacaggaaauuaaagccaaaguuaacaaacaguauuaacucaaagggaaaaccauccgcagugaagagacagcccuuaggauggggaacauauuuccuaacuagucaacuguuaagcuaaguaaaaauaaaacagggaugaagucauuuaaauggagaacaaaaaacuugaaaaacuuuuauucaaaauaaccgcauguccaaauguagaaagggagccguaccccuugauguuuauccaaagagguggagaaccugaccacacaaaccgcugcacccacuguugaugccauccuuagucagaacugagaagcagccaagaucucaucacuaauaaagggauaaagugucgaauaccuggugacacaauauucuuccaugugaagugcaaaugagcugcccagccuuuuaaaagaaggaaaagaaaagaaaugugucuauuacugaauggaaaaccagcccacugucuaccuagucaaguguuucgcuaaucuaaguggucugcaaccguguauuuauaugaccccaccuugucaggagcugggauggguuuuuauaaagacaaaagagcaaaaguugcaguguaugaguagagagccaaaacuagaauaucggcauagcuccacggugaaccugccauugcaccuacugccugaugggcuucuuauucaauacagugcuugcuucagggccugaagaaccaaagcaacagaugcaaaagggcuacguacugccucaucccaacugggacacagaagaggcaagagaguggaggcaggggaaagaucaguauucaucaguuguggugagaaaaacagggaugacagugguagagaacaagaacugcacugcuguaagaaguauuuauaaggguuuuauaaguuaguccaaguucaucaagugcacaaaaccaaaagggaaccacacaguggccuuggggaucgcagugugucggggaaucacaguugcuggugcuggaaauggaagggcuuugcuugugugcaggagguuaugagaaaaucuuucuguuuuucaguuuagcugugaacuuagaacuauucuuagaggcugucuguugucagaaaaguaaugcagacuucuguguugaccccugcucucauaucaucuggacuuccggugcccccccaccccccauucccuagucuacuuucuuaguguuuaauaacgaccauguuucaggacuauaccuguugugcuaauguguagaugcauucauauuaauguagaggagggaguuugugacugacuccccagaagaaaauggaaagccaaaaaauuucaaaaucuagcaugguuuuuuuuugccucauauauuauuauaugaauuaaaacuaauuucaauauuuuugagucuuaaaugucacagugucugaaaaauauugaauauugucauuaaacucaauuacaaaauauuagaauaaugaaacugccuguauccaugguucacuccucuuaccauaauuggcaucuuuuaacaaugccuuuuuauaagaauucagaauuguguuuuucucuuuucucugccucugccuugagugguacauucaaaucaguaauggaguauaugcuacugagauuagacagagcccuugacauacuaauuuguaaaacuaucuacauaaauuggaaaguacaucuuggaaauauuucugguuauaaucuacagugcacaugguccugcucugaaggagagaagcauucuuauaauaggguggucuugguccaaagccaucuucugaggaucacagacuaccugagagagaugccagguuagacacacccagguuaugccaccuggggccauguggugcuuucucaccugugcugccuaaaacagcuuucauuugguacagugagacuguuuaugacacugaguaaaaaguuagcuccacuggcauuaaacugucuccucucuuguuuugucuuugcuauugaaauuuuauaugauaauuuucaagaaucauaaguagguggcaagauuuuauuuuuaauucauauuaaaaguugaguccuauauuucauugugggugacuuaauuauauuucuuaaaugaaggaaagccugauguguuacaaaaguaauuauuugucaugucuugguuaacuucuuuaaauuguugagaaaaaaaaaaaagccauguuauaugucuagaaauuuugaauaugaaucuacauguugauuuuuaccaucuaguuacaaucuuuuauauaugaauuaauugaugccuuaugggucuccauaagcuuuauauguuuguauuuugggugguaauauuucauuuaugcuauuaauauugagaugauuucauaagaaaauaaaaugugcuuuaguuuuauuauugguagauaaguuuaguuuaugaaaauaaaagugucacucucuuauuauucacccuuucucuuauuaaugagugaggcaucagcaauacaaagcuaacuaacugauacuguaaagaugagguugcucggggcaccagcuccuuccaaugggugugguacauagagcauuuaccuuuccauugaaguuuacuaagaugggaggagaagcugucagagaggagcugggcaguguuaaggugcacucagucuacaaaguguucuacuguaagagggugugcauauccaaguggucagagccuuaguuauuuugaaaaaccauugaagaaucuuggagcuguuuucaagcaaagcauaaacugaagugaccugacaaaacugugaagagaagugaaggcuaguuaguguucuuagguuuuguugggguggcgaauaacaacuccauaaacuacugagaaaugguaguggauuauguugaauauuuaauuuaaaauuguaguuuuacucauguuuugauuugaauuacuuuuaaagcaagugagaaauucaaggaaauuaaagaauuuuuugguaaaaugagacugucugauggcuuuaaugucuuacuaauucggugauuauucggaggcuuauuccgugcagcacccugcaguuacuguauggacauuuguaagcacauuggcuuaaaaauuuggaguuaauuaguauuuaacuguucaugaguuuuauuuagaauguggggaauuacugacaacaaaggcaaugcagugagccacugagcugguagcaccagccgcuucacacagggaaauacuaaaauugcacuacuuguauccgugcuugcuuugguaauauucaguaggauuuaauguaagccaaccuauaguucuaccucuuuacugggaaaugucauacuuagcuauuuccaucaauggcaaaaaaaagaaaaaaaaaaaaaaacacauuuaaaacuacccugugaaucagugcagccuuuaaaacacccagaguaagucaccugcucaucucucugugcuucugccuucuugucaggagugugccgugccauccucaaaaucucaacaccugaaugaaugaaugaucaucugguuuuuccaaagacaauauaccaugucugcuuuuuaucuuaccauagaaauucauauguagaagggcacacucauaucuuagauuaaaaugaauaguguauuucuaccaaaauuauuuaguuaggcucuugcauauuacucaucuguaaauagaaaacugcuggaaauaaauuuuggaaaauuguuuuguaaugauuguuuucauguuuaguuguauguuuuaaugauaaaaauguggagguggacuuaagugucuuuccauggaugaagcgaaaugaggaauauuuuaaugcuuaauaaaggaaccauguucugcauggauuauguuuacccccccccccaacacacacauacacuuuuauuggaggagauauuuauauucuagcucaaaugagggcugaaggguuuagucuguuugugguguuccaugaagagagccucagcagucuagggaaauaccaagcugcucuuuguguuucacacaaccagauguuuugguuuuauuucccuucacaguuaauuuacuaaaauacagacuccugguuuauuacuuauugauagaaaauuauaugcauaugaguuauuuuuauuaguagcaaaacaaagauuggucuuuuuacguaaguauaaacacaucguuuugaaauagguagguaaguaauagcacaccgugauguaauuaaucugugcugugucggaaugugcuucucuuaggggauauccgccugaccccggaggacuucgcuagagcucagaaguacugcaaguaugcuggcagugcccugcaguaugaagaugugggcaccgcugugcagaaccuccagaaggcccucaggcugcugaccacaggcagggagugaagccucuguucacggaagccaguguuuuccgcauagagaacuaacaguccguuacacuuuccucagccuucaggagcaggggacuacagaaggccucaguuccccgaggaagacaaugacuccugugugguucagaagcauuuaccagcugccucagccaguugucauugaguguguagagcugaugcuagcaucgaacccgcugugaaaugucccuguagaaaaucauguuggguauaauaugcuuucuuaauuuauacacacuaaaggaaguuuuugaaagaucuguaauauuuggacaaacaaaccauauuauguugcuuuaauauucuaaauuaaacuuuuaauaaagauuaccagaauaguccggguuggagauccugacuuuuucuucccuuaggauuugcaaggcaaaugugaacauccaaaagugguaaaugauaagagagauuaaaugcacuuuauauuccuguuuuaauauaacuguaaaaaucaaagaucacagaaggaaacaccauguggagugauagaaucauuguacuggaaaaucacacugguuuccugggacuccuccugcccacuggcaauuacaguguauugcucuccuucaucagcagcuaauguauguaugaaaaagugaagaaagggcugcauuuagcacaggaaacagcaggccgugguucucagaguugcaguuguaugguuuaugcuuauuacugucuagcccuuuuuuaaaaaaugacuggaaaucuaaucuacuagagagaaaaagucacuaacucauuauuuuuuguguccauuuuucugcucaucaauauauuacugugcacaguuugauagaacagauguacauagugacugaacugucaacaucacaaagaauccacaaaguacaucuccugaaaagugcucucaugaaauaaacaugacucuggcucaacauuugcaucugg

SEQ ID NO: 5430 - RNA, 2140 nt, Mus musculus
cuggcuucaguuaccuccacauuguuuuuuuuuugugccaauuuaaauaguuuuguuauuccauguuacuuguuuugggucccuguggaacaaagcuacaccuucuucuuggacugacuuaauccaccucuucaaugguggggccugaagaagcaccaccagaugggggagcuccuccaccugggaagccaccaggcauucccccaggcaugccaccugcacucugguacagcuugguaaugauaggguugcagacuuucuccaguucuuucugcugaugcucaaauucuuccuucucugcagucugguucuuauccagccagcugaugauuucauugcacuugucaagaaucuucuguuuguccucaucauugaucuugccuugaaguuucucaucuuccacaguugcuuucauguugaaggcauaggacuccagcgaguucuuggaggaaacuuuaucucucugcuucucauccucagccuuguacuucucagcuucuuggaccaugcgcucaauaucuuccuuacucaagcggcccuugucauuggugauggugaucuuguucuccuuuccugugcucuuaucuacagcagaaacauugaggaugccauuggcaucgaugucaaaaguaaccucaaucugagggaccccacggggugcuggagggaugccugugagcucgaacuuuccaagcagguuguuguccuuggucauggcccuuucaccuucauacaccugaaugaguacaccaggcugguugucagaguagguggugaaagucugugucugcuugguggggauggugguauugcguuugaugaggacagucaugacuccgccagcaguuucaauaccaagggaaagaggaaugacauccaagagcagcaaauccugaacguucucagacuugucuccagauagaauggcugccuggacagcugcaccauaggcaacagcuucaucgggguuaaugcucuuguucagcucuuuuccauugaagaagucuugcagaaguuucugaaucuuggggauucugguagaaccacccaccaagacaauaucauggaucugugacuuguccagcuuggcaucucgaagggccuucucuacaggguccagugugccgcggaauaggucagcauucaacuccucaaaucgagcccggguaauggagguauagaagucaauucccucauagagagaaucaaucucaauacuggccugggugcuggaggagagggugcgcuuggcccgcucgcaggccgugcggagaggacggacagcucucuuguucucacugaugucuuucuugugcuuucgauugaacucagcaaugaaaugauugaccauucgguugucaaaaucuucuccaccuaagugggugucuccagcuguugauuugacuucaaaaauuccauccucaauagugaggauugacacaucaaaagugccaccucccaagucaaaaaugagcacauuccuuucagcuccaaccuucuuaucuaagccauaagcaauagcagcagcaguugguucauugaugauucgaaguacauugaggccagcaauaguuccagcaucuuuuguuggcuguugcugagagucauugaaguaagccggcacugugaccacagcauugguaacagucuuuccgagguacgcuucugcaauuuccuucaucuuugucagaaccauggaggacacuuccucugaguagaaacuuuuugucuccccuuuguauuccacuuggaccuugggccugccugcaucauucaccaccaugaagggccaaugcuucauaucagacugaacaacagcaucaucaaaccuacgcccgaucagacguuuggcaucaaaaacuguauuggugggguucauugcaaccugauucuuggccgcauccccaauuaaucucucuguguccguaaaagcaacauagcucggcguggugcaguugcccuggucauuggcaauaauuuccaccuuuccaugcugaaagacacccacacaggaguagguggugccgagaucaaugccaacugcaggucccuuagacaugguugcuuguguguaggcccggcugcgcugacgacgagaccacacuaaugcccggcagcugccuccgcguucaaugagcca

SEQ ID NO: 5431 - RNA, 2456 nt, Mus musculus
agaaacacagcucauuguuggcagcugccuggcggucuugcggagcggcuagggcagcggaggaaaagaaaagggaacggcucggaauuugcuccagcggcugcugcaagaccucggcgccaaccucgcaccggcgagcgccucacagcccaucggcugucccucuaugugcugcugagccgguccuggacucgacgagcccgccuucgguguuccgagcagaaaucgcaaagacggaaggugagcgcggcgggcgaagcuagccagggcugcugccagccuaguccuccgagggcagggcuggcuccggggacaagcgugaggcggagcuggggaauaacaacaggaugugcaaccacagggugaggagggcugauugaaugccugaaguucgcggcccggcuccggggcacuuccuuuauuaggccacuucagggaacccaggggggugugggcuccggucccccuccccccgccacacuuucccggauccuaggggaaggggcaggucgcucagcgccaggcugugcggguccggcaggcagcagguccgccgagguagcgagcucgggugcacgggcugcuggugggcucucucgggggugguggucugcagcuugagacgugcucgcggguacggggggcuacagaaguggggugcgcucuggugggcgacacguguggcgcgggucucagcgucugcucguuucgcuuucaggacuggaaauggcagaccauaugauggccaugaaccacgggcgcuuccccgacggcaccaacgggcugcaccaccacccugcccaccgcaugggcauggggcaguucccgagcccgcaucaucaccagcagcagcagccccagcacgccuucaacgcccucaugggcgagcacauacacuacggcgcgggcaacaugaaugccacgagcggcaucaggcacgccauggggccggggacugugaacggggggcaccccccgagcgcucuggccccggccgccagguuuaacaacucccaguucaugggucccccgguggccagccagggaggcucccugccggccagcaugcagcugcagaagcucaacaaccaguauuucaaccaucaccccuacccccacaaccacuacaugccggauuugcaccccacugcaggccaccagaugaacgggacaaaccagcacuuccgagauugcaaccccaagcacagcggaggcagcagcaccccuggcggugcggguggcagcggcacccccggcggcuccggcggcaccucgggcggcgcggguggcagcagcgcgggcggcagcggcgguggcagcaccaugcccgccucgguggcucacguccccgcggcaaugcugccgcccaaugucauagacacugauuucaucgacgaggaagugcuuauguccuuagugauagaaauggguuuggaccgcaucaaggagcugcccgaacucuggcugggccaaaaugaguuugauuuuaugacggacuucgugugcaagcagcagcccagcagagucagcuguugacucgguuaaccucgcaggcggaaagaaaucacccuccccaccccacccccacccccaacuucuucggugugaauuaaaaaaaaaacaaaaaaacaaacauucccuuagacgcaguaucucgcuuuucagauccugaaaggguugagaaccuggaaacaaaguaaacuauaaacuuguacaaauugguuuaaaaaaaaaaaagauugcugccacuuuuuccuauucuuguuucguuuuuuguagccuugacauucaccucccuuauguaguugaaauaucuagcuaacuuggucuuuuuuguuguuuguuuuuacuccuuuauuuccucacuuucucccgugcucaacuguuagauauuaagcuuggcaaacugcuuaaucuuguggauuuuguagaugguuucaaaugacugcgcugcguucagauucaugagugaaaggaaacauugcauuuguuggcugcaugaucuuugaagggcagauauuacugcacaaacugccaucucgcuucauuuuuuuuaacuaugcauucgaguacagacuuaaguuuucaaauaugcuaaacuggaagauuaaacaugugggccaaaccguucuggaucaggaaaagucauaccguucacuuucaaguuggcugucuccccucccccauauguacagacaauaauaggguguggaaugucgucaguggcaaacauuucacagauuuuuauuuuguuucugucuucaacauuuuugacacugugcuaauaguuauauucaguacaugaaaagauacuacuguguugaaagcuuuuuaggaaauuuugacaguauuuuuguacaaaacauuuuuuugagaaaauacuuguuaauuuauucuauuuuaauuugccaaugucaauaaaaaguuaagaaauaaacuuguuuucuaaaagucag

SEQ ID NO: 5432 - RNA, 2456 nt, Mus musculus
cugacuuuuagaaaacaaguuuauuucuuaacuuuuuauugacauuggcaaauuaaaauagaauaaauuaacaaguauuuucucaaaaaaauguuuuguacaaaaauacugucaaaauuuccuaaaaagcuuucaacacaguaguaucuuuucauguacugaauauaacuauuagcacagugucaaaaauguugaagacagaaacaaaauaaaaaucugugaaauguuugccacugacgacauuccacacccuauuauugucuguacauaugggggaggggagacagccaacuugaaagugaacgguaugacuuuuccugauccagaacgguuuggcccacauguuuaaucuuccaguuuagcauauuugaaaacuuaagucuguacucgaaugcauaguuaaaaaaaaugaagcgagauggcaguuugugcaguaauaucugcccuucaaagaucaugcagccaacaaaugcaauguuuccuuucacucaugaaucugaacgcagcgcagucauuugaaaccaucuacaaaauccacaagauuaagcaguuugccaagcuuaauaucuaacaguugagcacgggagaaagugaggaaauaaaggaguaaaaacaaacaacaaaaaagaccaaguuagcuagauauuucaacuacauaagggaggugaaugucaaggcuacaaaaaacgaaacaagaauaggaaaaaguggcagcaaucuuuuuuuuuuuuaaaccaauuuguacaaguuuauaguuuacuuuguuuccagguucucaacccuuucaggaucugaaaagcgagauacugcgucuaagggaauguuuguuuuuuuguuuuuuuuuuaauucacaccgaagaaguugggggugggggugggguggggagggugauuucuuuccgccugcgagguuaaccgagucaacagcugacucugcugggcugcugcuugcacacgaaguccgucauaaaaucaaacucauuuuggcccagccagaguucgggcagcuccuugaugcgguccaaacccauuucuaucacuaaggacauaagcacuuccucgucgaugaaaucagugucuaugacauugggcggcagcauugccgcggggacgugagccaccgaggcgggcauggugcugccaccgccgcugccgcccgcgcugcugccacccgcgccgcccgaggugccgccggagccgccgggggugccgcugccacccgcaccgccaggggugcugcugccuccgcugugcuugggguugcaaucucggaagugcugguuugucccguucaucugguggccugcaguggggugcaaauccggcauguagugguuguggggguaggggugaugguugaaauacugguuguugagcuucugcagcugcaugcuggccggcagggagccucccuggcuggccaccgggggacccaugaacugggaguuguuaaaccuggcggccggggccagagcgcucggggggugccccccguucacaguccccggccccauggcgugccugaugccgcucguggcauucauguugcccgcgccguaguguaugugcucgcccaugagggcguugaaggcgugcuggggcugcugcugcuggugaugaugcgggcucgggaacugccccaugcccaugcggugggcagggugguggugcagcccguuggugccgucggggaagcgcccgugguucauggccaucauauggucugccauuuccaguccugaaagcgaaacgagcagacgcugagacccgcgccacacgugucgcccaccagagcgcaccccacuucuguagccccccguacccgcgagcacgucucaagcugcagaccaccacccccgagagagcccaccagcagcccgugcacccgagcucgcuaccucggcggaccugcugccugccggacccgcacagccuggcgcugagcgaccugccccuuccccuaggauccgggaaaguguggcggggggagggggaccggagcccacaccccccuggguucccugaaguggccuaauaaaggaagugccccggagccgggccgcgaacuucaggcauucaaucagcccuccucacccugugguugcacauccuguuguuauuccccagcuccgccucacgcuuguccccggagccagcccugcccucggaggacuaggcuggcagcagcccuggcuagcuucgcccgccgcgcucaccuuccgucuuugcgauuucugcucggaacaccgaaggcgggcucgucgaguccaggaccggcucagcagcacauagagggacagccgaugggcugugaggcgcucgccggugcgagguuggcgccgaggucuugcagcagccgcuggagcaaauuccgagccguucccuuuucuuuuccuccgcugcccuagccgcuccgcaagaccgccaggcagcugccaacaaugagcuguguuucu

SEQ ID NO: 5433 - RNA, 79471 nt, Mus musculus
caaaacaagcccgagacccgccuuuucccucgggcuccuccgcgucucgcucugcucgggggcccguugcgcccgcgcggcugcgagccucggguggccgcgcguggccgcgccggcuucugccgcggagggcgcggcggccggaaugucgcggcgagggccgcgcggcggggcgggcgccugaggaagagcggccggcccgcgcucuccguggccgccccggugcggcgggggagccgccuucgugggcgccggggaccgggacacccgcgagcgggccggggagaugcccaaccccaagaacagcaaaggcggccgcaaaaacaagcgcgccaacagcagcggggacgagcaggaaaauggagccggggccuuggcggcggcgggugcgacaggcgcggcggccggaggggcccuggcggcggcggcggcgggcugcggggcggcgucgcccggcgcggugggcaccggcggcgcggcgggcccgggaggugcgggcacgggcgccgccaacgccaccgucgcugcgggggcugcagccgcgggagacgcuaagaaugguaagacgacagcggcggggcgagcgccaacuuccucaccgacgggcgggcgggcgcgguggcggggcccuggguggcgcgggcggcgcguggacaaugcgagucaggaagugcucgccccgccccaccgccccgcgcugccuuuccuuucgugguccccacgcggagcggcguggaccggggcugcgggccccgcggcggcgcuccgguuggugccugcuccccguggugcccgcgcgggcugagucugaaaugucccggguuggugggagcgaggcagcgggcaagcaggaaaaggagcccaaguuagaaugauccgauuggaaacuucccugcucaccgcgacccacccacccaccauugcccccaaagaagaaaagcugcaauucccagcagauguaggccuguugccugauugccacagguggagagagagagagagagagagagagagagagagagagagagagagagagagagagagagagagagugugugugugugugugugugugugugugugugugugugugugguguucauuuaauucucuugucuugcucgaggaaggaagagaaucugaacuugacuuccguucccaaccugaaguguuugggugucuuuuucuuuuuuuucucucucuuucuuucucucuuuucuuccuuuucuuccuuuccuucuuuucucuuucuuucuuucuuucuuucuuucuuucuuucuuucuuucuuucuuucuuucuuucuuucuuucuuuuccugucccuuguauaauuguuucacauuuguuuuucugaagaagcccugauaauuucaugagcgcuugaaugauccuuuagaagggaggaaugcagguaauagcuaaggugugacaggauuuucccuucuuaccacaggaugccugacauuuauuugggcagcuuuuaaacuuuuuucuucucagguaguuuuucaggggaaaaaaauguacauuuuaauguaaguagaugagaaucguuagaaucguuauauuugcuucuuaacaguuuucaaagccauccucuauguagauggucucccauaaaaagggcuacaguacuuacaagaaugccacagugauucccauaggagauagacuacaggcuguuggaaagggccccccccuggcugagccccugcaguuuugaaauaggaagauuuguuuauuaggaggagcaaacuuacacguuugugaguguuugauaguguacuaucaaaacuuggcuagccuauuuggcuagccugugccggcucuugcuuucuuaucucuaaccguccuuuugauauugaugugacagagaagaugauacuuagacugcauaauaccagcucuuccucagccauuuagagcuuugauaucuggagaaaggccaguuuuucugaaccucaguuuccucauagacacacuugagggagugagggggggcagugaggguuacacugggccuuuagaggauuuuccugagggaggcuuagagugacccuuuacuuuuaaguucccauuucguguuauuuaaaggcuuauuauguaaaggucgauaaaagcucauugcaaauaauagauggcuggugaguaacagcuacuaguuauucauucaaaagauuauuuuaguuauuagauuauuguuauuaaauauuaaaauaaauauuuuaaauggacaacuuuuuaauuuguaauguuaauaguacuguguauuagauagggacuaggcuaaugguuauacuuuaguacauccucgguucucacaaagaccugugucuuuaccacacucugaaagauuugaguaucuuaaaguaguugaggaaguuuuucuuuggcagaugguaccugcuagacugaaaacauuaagccacuuacauuguucauuugaaguaguaaacugguagauuuagcaguacuguguauaucuggguaaagcuauggcuuucuuaguaggucuuuauucuauuagaugugggaaaagaagcagugggcccccauauugccauagccacaaucucagaagcugcauauucaggagcagcgagcugaggguuguggcgccuaucuuuggugucaccuuggugaaauaguuugauuuaacugaagaaucaucucuguguuucugaagacaauuuuaacauagguucuuaggccuacacaaaaugaauaaggagauuguaaauuauguguguguguguguguguguguguguaguauagauguagggagaggugauacuggugaauuuuuauaggaaggggcaauggacaugauaacaaagguucauuuuguuuuuuagcugugugcguguacaaauagcauacuuuuuggggucaggaguucucuccuuccccagguagauuucggggauugaaguccaguugucaggcuucgugguaagcgcuuuucccacugagccaucuuguuggcucaagacuaaauuauuuuuuaauuuuaaaauuauauuaguuggacugcuuuaugauuccuaaguauauuguagauuuuauuauuauauaauuuucaaaauuccuaaauauuuacagucuuuuguugguggugagacagugccuuagcuguauagcucucaggcuggccuugaaauguuuccuaucuauuacaauuuuacaugguuuguuuugaucaaguagguuuugaauguacacuuacauguaaacuuaaugacuaguagguguuucagguuuauagagugguuuuauguccuguaaguauggggcauuguaguuaccaaagcaaggucguauuagcccuuaguuguucauuguuaguguaaauaacuccucgcucuauaaaguuguuagccaggggaagccugaggaaacugguaugguuggaguugagguaguugaacugguugcuguuaugcaguugaauaggaauucaaaggauguuguacucguauuuuuuagauacuaauuuaugaagccuucugcaaggaauggaggaagcaagccugaggaaguaccaucguguccuacauaguaaacaucugugcacuacugcagcauugugauugcagguggacaggauuugucacucauucuuucuagacucuaguaaucaggcagcggauuacaacuggguucauucuaaaaggcuggcuccauuaggccucugccuuuuuuuuuuuuuuuuucuucagcucgaaaacuacuugaaaucuugauugugguauaucuacuuuccaguagaccugauuuguucauacuuuuauaaaucucuguuuuguggcugagcaagguucaccacacauucauuccuagcacagccuuugaacuaauucugccuuaagucauucaacagcuccgaguguuaguguuugccuugcauucuagggccuacuuuaaauuagucccucugauuuucuuggguaaguuacuuagguucugagccuaguuucugcauauauaaaacgagaucauagaaccucgguaaauaugaagcaagauagcuauuauauguuaaagagaguaugcuagaacaguuccaaaggaguuuauaguguaagucauuugugcuugguccugggaaauaaucucuugaaagaggaaagagauuuaugggcaggaggcuuauugugauguucucuucacuagugggcgagaggaggcaggacugggcagaggggagacuuguaggcacaccagagguaggaugcuucuuggugcuuuuaaaccuugagauagguauuuaaaccuauaagucuaagaacauaaaaccuugaaaugucuccccuagaaaauaguaguccuuaggacuuucugcuggagaacuuacguggggaggacucuuguuuugcugaccuuuacuggggucuucuuuagccauaucaguggcaccacagaagccagugugggaugaauaaguuuaucuuauuagcugcuauauagguuuugugagacagacugagagauaaccacuguauaacuguucagaaucaugucaguuuauaauuuuuugaguaccaccugaguacuaucuaugaacaggauuuauauuuugcuuuauuuuugaccaguaaguaaacacuuuauaaccagguuuguaguauaccuuaaauggauugucccuuucagguguuuauuuuauucauacauuuauaaguuaccuacaggaaucagaaguaaaacagugcuugccugauuuuccucccuuuuuuucuuucuuuuugcccaggcuuucuucaguuguuauuuccuugcuucugccucccgagugcuuggguaacaggcauguagcacagcacugggcuggacauugguuucuguagcacagcgcugggcuggacauuggugguuuuuuuuccuuugucaguguaucuuuguauagucaugguuauccuggaacuagcucuguagaucaggcuggccuuuaauucacaaaggucucccugccccugccuccaggaauagugggauuaaagauggaggacaugaccaaagcaaaaaccaggagauaaaucuggcaguuaaucuuguagcuuagucuuaugaguuuacuucaaguguuuaguugugcuaaauuuuaauuugguuaacgaacuugaagguaacugaaggaacguguuaagaggggggaaauauguccugaggauauuggugaucacuucucauacagucugaggagauuuauuuaaaacagugguucccacccuucuuaacacugugacuuuuucauauaguacuucauguugugaugacccccaaauguaguuauuugcauugcuacuucauaacuguaauuuugcuccuguuaggaauuguaaauacccaagauauaagauacaauuugcuaaacacauuaaacucaagagaacgaagaccaaaguguggacacuuugccccuucuuagaauaggaaacaaaacacccauggaaggaguuacagagacaaaauuuggaagugugacgaaaggauggaccaucuagugauugccauauccagagauccaucccaugaucagcuuccaaacgcugacaccauugcauacacuagcaagauuuugcugaaaggacccagauauagcugucucuugugagacuaugccggggccuagcaaacacagaaguggaugcucacagucagcuauuggaugggucacacggcccccaauggaggaacuagagaaagcacccaaggaacuaaagggaacugcaacccuauagguggaacaacaauaugaacuaaccaguaccccggagcucuugacucuagcugcauauguaucaaaagauggccuagucggccaucacugcaaagagaggcccauuggacuugcaaacuuuauaugccccagaacaggggaacgccagggccaaaaagggggaguggguggguaugggggacuuuugguauagcauuggaaauguaaaugagcuaaauaccuaauaaaaauggaaaaaaaaaaggaauuguaaauaucugauacgaaggcugucugauauucaaccucugugaaagggccauucaaccccaggagggucccgaaccacacgcugaaaaccacugaaugggaauguuacauuggcuugcagauguagcucagugguaaagcccuugcgugcccuguguaugggaagcucuggcuucauuucucaguacugggcuagaggaggaggaggagagaaagaaagugaagaguggcuggagagauggcucaguggcucagagcguuuguugcucuugcaaaggaccgggguuuggcucucagcacucacaugguggcucacagcccucuggauuugguucucguacacacauggugauuuauagcagucuguaaguccagcuccagaggaucugacacccuccuguggucucuguggacacuuguagacauagaagugagcaagacacucauacacagaaacuaaaaauacauaaaucuaaagaaaauuuuaagaaagaaaaaaguuaagauaugccaaauucuuuucacauuucuagucaaaaauauauaauccaaccacugagagauaacaaguaauuaauauuuuaauauuuuaagggcuggagagauggcucagccuuuaaaggcuaggcucacaaccaaaauauuuugacauaccuucuuucagccuuaaauuucuuuuuuuuccaaccagaaaguacuugagauauaaaaaaaagcauuguaauuagaagaauuaagaagauuuaauauagaaauuaaguacaugaaaaauacaaaaacaaaagacucagguuuauaaauucaucuuaaaaguagccuguguucagugguaauccucaccgcaagauuugaucauaguuugagacuuuuuaaauuuacauuuuauuuuaugauauguuuuguuuccauguaugcuguguaccacuuacaugccuggugucugcagaagucaaaagaagucauuggcuccccagaaacuggaauuauggauaguugugagcugccacgugggugcugggaaucaaauacugguccugugaaagagcagcugauguuaacugcugacccauguugccagcaccacaauucuuuuucuuuuaauuuauuugugaagaaaaauauguuugugauuagaugaaauguuuauucauaaaaaaaaucuauuacagaauuaagaacuauuaacggauaauugauaaaggucauuaacuauauauacaacacuauuggucagcuagucuuauucuguuuccuucuuuaguuuucccaagggaaauauuaaaucauaccuuuagcagaguagucaaguagaagucagugguagaaguuguauaguuggccuugagugaggaagcacugguccuuugucuuaccauuuauuguauugagauuauacuguaauuccaucauuuccuuuccuugcuccaaucuuccuguacacccuucugugcucucuuucaauuucauggccucuuuaauuguugcagguauacauguacaggcauacauacauguuccuaaauguaacuuguucagucaauauaaugucacuguauguuuuuaggacucacuguuggaauugaauaacuaguugguaugcucuucccuacgaaagauuauuuuucccaauuuuagcauuccuuaguucuucaugucggguugaggccuuguccuccugacccucuuccccacacacguuggcauaucucuuguccuuguucugcucauguugaugagacuguauggauguaguuucugacauuacuaggauuuacaaucuuacuuucugauccucuggcucuuaaagucuuaauacucccucuucugcaaggaucccucagccuuaggaaugggauuuguuuucuugaccuauccauugugacuggacuccacaaccagaauuugauugguuauggucuucuguaaugguuuccaucuauuguaaagagaaauuucccugaugaagaguuaacacuacacuuuaccugugguuauaaggacaaauacuuagaaugugauuagagaucaugcuguuuaaauaaagugaugguuguuggcuuuauccaagauugauuaacucacuaguccugaguagcuggcuagguuccuaguaccaaccauggucucacucuuguugaacaagucuuaaguccaguuagagagcuguugguuacuaccaagggaggagugccacuacugcacucuuagguuaucgugcugcaaugguuguugaggugguucagagguguuauaccuggguagggcuguugguugcuucauuccuuuggaagcuuacauggugacuccugguccuauggaagcuguccucaggggaggaggcagucaggucaguuccagcucaggagcccugggccugugucugacgugcauggaguccugagcaugaggaacuuaccgucugcuucuaggaguggccaaugccggcagcaagaguuugucauguuuggggggucucuuggauacuuccugaccagcuagucaaaagaagaagguguuggggguuuguuagguaaugucuggaucuugaagggaguauugucugcucaaagggcuuauguguauuauuucuuuuuuuauuuagucuuauuauuauuauuuuacuuauucacuuuacaucucguucacugcccccucccaaucaccccuucucacaauccuucccccaucuucccuucccgguuccucuaaguggguggggccccccuggauauccucugacccuagcauuucaagucucugugaagcuaggcgcuuccucucccacugaggccagacaaggcagcccgacuaguagaacauagccugcauacaagggaacagcuuuugggauagcccuuguuccaguuguucaggacccacaugaaggucaagcuucacuucugcuacauaugaaugggucucugguuggugguucauucugcaagccccaagaguccagguuaguugaaucuguuggucuucuuguggaguuucuauccccuuuggacccauaauccuuccuccuguucuuccuuaaaaguccccaagcucuaucuucuguuuggcugugggugucuguaucucucugagucugcugcuguguggagccucuuagaggacugcaagcauaacagaguaucauugaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuagaaagggcaaucggcagauucaucuggaauaacaaaaaaccuaggauagcaaaaacucuucucaaggauaaaagaaacucugguggaaucaccaugccggaccuaaagcuguacuacagagcaauugugauaaaaacugcaugguacugguauagagacagacaaguagaccaauggaacagaauugaagacccagagaugaacccacacaccuauggucacuugaucuuugacaagggagcuaaaaccauccaguggaaaaaagacagcauuuucaacaaauggugcuggcacaacuggugguuaucauguagaaaaaugcgaauugauccauuccuaucuccuuguacuaaggucaaaucuaaguggauuaaggaacuccacauaaaaccagagacacugaaacuuauagaggagaaaguaggggaaaagccuugaagauauggguacaggggaaaaauuccugaauagaacagcaauggcuugugcuguaagaucgagaaucgauaaauggaaccucauaaaauugcaaagcuucugcaaggcaaaagacacugucaauaagacaaaaaggccaccaacagauugggaaaggauuaccuaucccaaaucggauaggggacuaauauccaauauauauaaagaacucaagaagguggacuucagaaaaucaaauaaccccauuaaaaaauggggcucagagcugaacaaagaauucucaccugaggaauaccaaauggcugaaaagcaccugaaaaaauguucaacauccuuaaucaucagggaaaugcaaaucaaaacaacccugagauuccacuucacuccagucagaauggcuaagaugaaaaauucaggugacagcagaugcuggcgaggauguggagaaagaggaacacuccuccauuguuggugggauugcaagcuuguacaaccacucuggaaaucaguuuggcgguuccucagaaaauuggacauaguacuaccggaggaucccgcaauaccucuccugggcauauauccagaagaugucccaaccgguaagaaggacacaugcuccaguauguucauagcagccuuauuuauaauagccagaugcuggaaagaacccagaugccccucaacagaggaauggauacagaaaaugugguacauuuacacaauggaauacuacucagcuauuaaaaaaaugaauuuaugaaauuccuaggcaaauggauggaccuggagggcaucauccugagugagguaacccaaacacaaaggaacucgcacaauauguacucauugauaaguggauauuagcccagaaacuuaggauacccaagauauaagauacaauuugcuaaacacaugaaauucaagaacgaagaccaaaguguggacacuuugcccauucuuagaaaugggaacaaaacacccauugaaggaguuacagagacaaaauuuggagcugugacaaaaggauggaccaucuagugauugccauaugcagggauccaucccauaaucagcucccaaacgcugacaccauugcauacacuagcaagauuuugcugaaaggacccagauauagcugucucuugugagacuaugccggggccuagcaaacacagaagucagcuauuggaugggucacacggcccccaauguaggggcuauagaaauuacucaaggagcuaaagggaacugcaacccuauagguggaacaacauuaugaacuaaccaauaccccggagcucuugacucuagcugcauauguaucaaacgauggccuagucggccaucacugcaaagagaggcccauuggacuugcaaacuguauaugccccaguacaggggaaccccagggccaaaacgggggaguggguggguaguggauuggguggguggguauggcggacuuuugggauagcauugaaaauguaaacaaggaaaauaccuaauaaaaauaaaauuaaauuaaaaaaaaaauaguguuagggacuggugcucgcccaugggaugggucucaaguugggcugguuaugguuggccuuucccucagucucccuccucugugccugcauuacuuguagacaggauaaaaaaauguucaacccaaaauuuauccugcauuauaguuucuuuugguagguaguuaauaauaugauuccuuaagaguuuuucagacauucuuaaugguauuuuaccaucuuccuucuauauuuaucuccuuccucuguuccuagagucccucuuucucuuuccuaucccuuacccuaucagaucacuguacccugcuauucuccucucuauuguucucccacuacccuacccaauggucccuuuuuacuucucugaauucuguacuuacaccagaauauauauucaaccugaagauuuggaguuaggagccucugaugaaacaaaacaugugauguuuguuuucuucggucuggguuaccucauucaauauaaucuuuacuaguuccauuuguuuaccuagagaguucgugauuugguuuuucuuuacagcugaauaauauuccauaguuuauauauacaccacauuuucauuauugauucauugauugaaggacagugaauucauaucuagaguggucuuacuacuucgauuaacucagucuggaaauuuacagaguuuugugucuuaggugauuuuggacucuauugcucaguauaaaagguuuaucguggaggaugaugggaagaucugaccauguuugcugauagagggaaaggaaccaauggaaggggaaagaugaaagauggauucaaaggaggguauaugcaauacuuauaacaaagcugcacacucacaaaggcaggaaacacaagcauucagcaggaaagcugggccuugaaaggaagaagggguccuccuaagaaaaguaacaaggaaguuuagugguggcgcacgccuuuaaucccagcacuugggaggcagaggcaggcagauuucugaguucgaggccagccuggucuacagagugaguuccagaacagccagggcuacacagagaaaccugccucgaaaagccaaaaaaaaaaaaaaaaaguaucugauguagacaaaaguacauacacauaagaaguaaauaccacauagucacauuuuauaaccugcguuuauacuuaguauuuuauggacauuuuuaauagcuaacuaaguguauagguauuaucauuuuuaaagaauauguaguguaccauuaucuuucugugccuuagagaguauacuucuucuaugugacucguauccacacauacauaauuuaucuaguuacuucuaccuaagucaauuccuguugcuauauaucuguaaaugagguuauauugaaaccacugaacuagaccauuuguggguaggggaaaaaaagguuuauugggcuaucucaggacauggguugggggaaaaauggcacaacagcaaguagauuuuauaugacaguuaagaggaugagucuuugagcugauaaaacuguugcacuugacaagacuaaugcucuugcucaagguucaccugaggggugucgaggggcagauuaagggagguucuuggaaaacagaaacccaccuauaggcuucuguugccugccaagguucuuuucauuaagacauugucaucaacaucagacuuccaugggaguaggcaggcuuuggaccuaacagucaaaguaacgcaggcuuugacauuuuuaaauccuagaaauaaaauuuuacaguucugaaaguugggaaguaaaagaucagguaauagacuuaguaucugggcagggucugcucuauggauuauguuauuuuaucacagcauccuuaaagagcagagcagauagaaaggaugcaccuagucgaagucacuuuucuaaggauaguaaucccaucucuauggccaccuucugagcacuagcugccuucuuaaugcuugugcauugggaaucaaauuucaacaaaaguuuuaggcgagaccucgguuuuuagaguguauguuacguauggacuugguauguaaagauaaucaaucauuccaccuaguguggugcucaccuuuaauuccagcacucagaaagcagaggcaggcagaucucuguguuuaaggccagggcuauauagugagagccuauuuuuuuuuuaaaagguaagucuauauuuucaauaaguuauauuuuugugccaucaaaaaguugugucguuuuuccaugaccuuucuagucucuaguucuuaguuuuacaagcaugcuagagaguuugugggacccauaaaggucucagcaaugggcgagugcuguuuugacucggugcuuagagcagaugcuauuaugcuuagggagguuagugauuugguagcucacagagauucaagaaauuauguacuaagggcagaugacagauuaguggcuggugauaaugaaggugcaagcauagcuguugacauucugugugcacuauucuaauguuaguguugaagaugacugguauuauauggguuuuuauuuaagcaaugcuuuaacuauaaucuuuucuucuaccaucauuucucuccaguuuaacuggaaacaaaugggaugauuuagaaaaaaaauaaauacaacaaaguaugaaacaguuaugccuuccuuauaaagaacuaaacacaaggauuuuauugcauguacuacagcagcagcggugaaauaagagcugggccguguguaguaaagaauugcuuuaacuguaggggcuggagguaaagacugagaggugaaaggaucaugugaguugaagauugaucaacagcaagaguucauuccauuaguguguucauuguuuuguuuugugcacauaucuauuuacuagacauuuauuaugugcuuauugucuucuaaggcaggaaguauaaucuuacauuauacacaggagcaccagaaucuacacuuuuaaagauguuccaaguaggaggaaguaagaaaggcccugaguuuugguugcugucaacgugaugugacugauggggcugaguagucaguuugguugugugguagccagugaacuaccaaucaucuagcaaagauuguaaccaggacagcugcaggagccauggguuauugaaacgcuugccaaguaauuguauauuuuaacaagauuaugauuauucuagagcuuuuaaaaacugguaaaaaguaagugguuuuaauaauauuuguaaauuauguuguaauuuaucagauguggaaaggggaagcaaauaacuuauacuguuauacuuaggacuauaaaauacuugaacaaucugagaaaaauauauuaagagggagcuuuaagaaagaugacuuaaugagaaacugaaauguuaguuaucuaaacaguuagcuuagacugcauuugcuaaguuacaauggcucucagaugcacucaguacagugcaggucauggugaaagguguuaggaaggcaaagcauucccucuuccuucauagagucaggccucgaggagcugcagguuagauuguaacagaaauaugugcaacaaagucauggauagaauuugaagcuuucuucaauuuaaugguaaggaauaaguggggaaaggacacuucuggagaaagucaacuuuguggaaugacaaauggacucuuaggauaaauggaagaguccaaagauuugugauggugucuccuuugugugguggagagacuucucaauucugguaguaaggagcagucucagucaggugaguuuuggaaacugaguucuuuuggugggaagagggaggcuguucuacuuuuaggcagauaagagauuucaaaaagcgaaagcuguuaacaaauacuuuuguaaagaauuuuuuuaaccauaaugacauauucuggacucuuaaaguauuuuggugcucaaauuguaucacccuccaagagcaacuuaagauaguaaaagauaacccacaugccauaauucagaauuucugcuuauuucauuucauugacaauucacuugguauagaaugcuuuaagguauaagccuguauaaaacuaaucaagaggauacauuguagcaaaaguuucgauuacuauuguaaguuaggaagaucacacuuuaauguauauuuuccccuauggguaaacauagguuugguuauauuuuagaucaucuccuuucaagcuauaaaaauaugucaggagagucuuucugguguugggugaaaucacaagcucugcuugacauuacuuugugagcgugaagaugauuccaacaugauauuucauagaauucuauuaaaaaacuuacuacuacuuguuaugacuagcagagugucuggucagaaguggaaacugggcaauauacagaauuaaguucuagcuguuuuuuauuggcagcagaugaagccuguaaucugagagacugagccugggauaguuggcagcaguuguuaaugaacaaauauggugugucuagagcagugauagauuccagaagucacagagagagcuuggcauugagaacucaaagugcccuucagugguugaagaagaaaugugcauaucuagcacguggggcagcucaaagacuucuuccaaaggguuuuuagcuccgugugucuucuuccucucugaugcuuaugcucagguagcaguaagggcgcaguaaggggagcugcuggucaggagugccuuuccuuuucuccccuuccuccucucuuuucucuccccccuucuuggggauugaaccuaauaccuucucauuacuugcaagaaaaacauacuauuacuaagcuauacacuauccuguggaauaguuauuucaucauauugucuaauguaaauuuuuaacaucauuucuaucuuugcagccacauaaaugaaaaauacacaaaucauuugcauuugaaagauugucagugaguaaacauuaucuguaucuuggucauuuuuauuuuuuuuuccuguuaaauuuuuaaucuuuuauuuacaaguuuuuguguuuuauugauuuacacagucuuuguauauucaggguuuuuugcaucuguguauuacauuuuacuauuuauuagucuuucagcuuuuuuaggucagucuauacuaccuggaaaugucuuguaugauuauauacuaucuacauagauacagagucucuggaaaagcugaagguuuggaaguuugugcauagcaucguuauugacacuuaaguccuuugaauacaguugcacaguaaugcuguuaaguuuauggaaucuacugauuugacugcaguuucugcugcccuccucggugauucucuuuaucccuggccacuacagucuagcagacagcugagcucagugcucaacaccugacucagauucuuugcaguuuuuaugccauccaaguggcauguugcagcugguugauaaaggcuccuguuuccucuucucaugaaccagguugcaaaaugagaccucuuaaaauccaaauggccuauguuugguuaugauaaccaacuuaaguucagagucagaagaaagguuucauuuuccucauucaggcacuuaaacugaaguggcauguguauguuaguaaaauuagaccugugcucauuuaaucacaguuuauucaugcacuguucaugcugcuaauccaggcaggcccacaccuuagauaucagugauuuggaaaaggcucucaaacucacugauuaugcuagugagugagauugagaggggcaggugagaguuguacauuuguguugccauuuugcaagauuccugacucuuuccaagccuaauuuaucauuaaaagcuaugugcauguacaugcuucuaugcaugccucuguguguggguuuucuggugugguugcuguaaugugguccauugugccauaguacacauguggaggucagagagcaacucugaagggcguucuguucuuccaccucugugagaguuccugggaucagacucagguugucaggcuucgcccuaagcccagucuuaucuagagaacgugaggguaacaugauauugcucgugacgagcccucuguaaaccauaaagcuguuugaaaaagcaauuaguugugccaugaucuaggaguuuuagugcuuucuagaugaauuucugcuucucgguuugugaaggagaauggcugcauuccaacuagugaugaaugcaucugaucuguugcaaccagcaauccaggacagaccuuggccuuucuccaaggaguucacagugaaugcuaaucuuccaaaauucauguggugcuuuuguagggggggggggcuuuugugucucuacagauuuggauaugagagcucuuacugugcagauugcccuagagaaccuuccugcuggccucagggaagaugaguuaucugaguuagucuuucuagaauugcugcaaaaggcuuuaugauacaauuuaauuuccaggguuuuuuuuuccauuaguuuauaagugauacuucacuuuuucccuuucaguuuugaaaugaauaauuuugaaucuuggagaauguccauaguacaaaacuuaucuguguuuccaaaagguaaaaaaugaagguuuaguuauuguggcaucccuagcuuaaacagucauugggagucuguaaguuggcacuuacuaguuucccuuagaacauuuuaugaacugcuuuucaaggguuauaucauagcaggcuacguuaagugucuauguaugagguaagguauccuuuuuaggccaagaggauauagucaggacugauuugagguuguuuucauuugcacuaaaguauauauaggacuuaagcaugcccucucagucuagaagccuugccuuguuguaacggauucuuuguugcuugcugguugcuacgagauaguuugagagaugcuguucaguuugacuguaggcaaaggcuugucuuccuaagucccgauagaaugacugcgugggugauaacuaggaagcuuucuuaccagguuauuuugaaggaaacaugugauuagagaguaucuuuuauuuuggagauuucagcucagcaaauuaaauaaguaaauguaauuguuuauuuaaggauauagauagagggaggacauuagcuguauugugauaagauauuauugguuuaaacucaaaucacacauguuaguguguuauuccaccaggauacaccugaaagaggcuaaacuuagucuuagugcccaguguuuuuucugcugucugauuuaauauucuccauaccauauugcguuucuugacuuucuuuucaaggaaaacugcuuuuuuguuuguaacuuucucccuuuccuuuugaucucagcagcugucucagcuccaguagauuugucuccuugucuuuuaugaaagauaagggucaggaagcuuuugugauguaguuggguuuaaauauuucuucaacguggcuuagcuuagaaguuuaguaaguuugagugcuaauuaugagugagugcugaauguuuugaauagacuguucuuacuuauagaacuuuaugugucuuacucuaucugguuauucaaaauuauuggugacuaucucugugcucuuuuuuuuuuuucuuuuccuuuuuucuuuuuugguuuuuagaggcaagguuucucuguguaacagaacccuggcugcucuggacucucuuagaagaccaggcuaaccucgaacucacugagaucugcuugccucugccuugaguaugggcuuaaagguguguagggccauggcgcugccuggcuuuucuuugcucuuuuaaaagugcugcaggggauucaccccaggaccaugagcgugauggacggauguuucaccauuaacccacaucucuagcccagcucuuuacucugugugugcugaugccuggggauggaggaaggaaggccacgaaaaagcuaaaugcccuggaguauaugacuaaaggauccucugugugucugggaagugucuguagacucugcaugaaggguucuucuuauuucuauuauguggaacugugauauuuuuaucagaaagaaucauagaucauuuucucuacucugauagucagacuaaaguagccauauuuugggucuauguccauuuggguuuugacaugagucauaauauagcuuauguuagaaaaugaaaauggggcuuuucuaccuucaggagauuauugaugugucuuuuuuacugauguuagcaugccaagccagaauaagaauuuaaaauggguaaauaucuguauuuaguuugaauuugaagcuagguuaacuuuuagguucuaauugaauuuaaggaaagaauagaucuaggagaauagacuggguagacugagauaacauaaaaguguaugauguuaaauacaagugaagaccugcuuggaaugacagcauuccugugcuuaugaacuuagggcagcugugguugcuugcacaaggucaagucagacaacauucuaacauggaguggaguccuuucaugaggccuuccuuuuaauugggguuaguuugcaaugagaauaauagcaaaauugucaaaaucaaguuuucaaacucugguaguuuauuuaauucuaagaaugccuuuucaacagaaguaguuggaucagaauaaugggguuuguggugauuuagcuugucuuguuucuacccuucuucuuuacguccaugucaaaguagcuuucaaaacuauaguugcuugguaaucauggaaggugggauaggucugaaguuccccuaacaauccuagcccugcugaauugucacuauuuaaucugucuagaagcucucuggaagggcauguccccuugaccugccauuggugcaaaguccugagaugucuguugaaaacaguugccugcaguuacuuacugaagcugcagaagugccaauaguaauuauaauaguuggggccaacaaaaauugguucaugaaacguaaaauaaaaaaucuggggaaugaaguguccuuaugggucuuaaaaucacagauauaauccuguaacucuugaaaaccaugucuuugugcaggguaauaugcauucuuugaaaacccuggaaauaaggcuccaauucuaccuguggcuaaccuccagauuccacaggaccagaaauuaauggcuaaaagagaguuuaaaacuguuacaucaccauuugaaggcacgccccaauguauguauguacauacagccuuucugcaaaggcuauuaggcuuauucagguuacuuaagaaaguccgugcagauacuaaccacuaaguuagaugaaccuuacuuaguaacugcacaggacaaaacaaaaacaaaacaaaaccaaaaaacccagucccccccccaaaaaaaaacccaaacaaacccuuaccaaaauuacuucaagaauauuagcuuaucuguauagcaauaaguaacagugacaagucuuggaagacaaggaaaccaacauguuaguuuuuaaccuaauauuaggcauccagguuuuaauaaaacaaaaauacaaggugagcaaaaaaaggggggcuaugacuuacuuuuauuucccucauguuuaacccacauaacaaacuccacauugggcauauaacaguuauuuaagaugcuuuuugaauuggccuacaucuucagcaguugauaggaauuagagcauuuucagagacuucauguauuuuuuuuuucuucuauaguuugauagucagguuuuucccccuguaacaaguauuuaaacggcucuguuuauaaaaagaaaaggcugcugggugugguagugcaugguuuuaaucuuagcacucggaagacugagacagcuaggccuuugaaagcaagguugguauggucuguauagugaguugcagguccaggcuucagagagagaccuagcucaaacaaagaaggaaaguuuguuuggguagaugauuuucgacguuucaguuaauuggcccuauugcuuuuugacuguggagguacaucgucagcacaugguagaccaacuccacucacauggcugggaaguaauaaagagaggaaacgguugguaucccacggucccugugacuugaaagccuuccaguaggcccccacuucucaaaguucaccacauucugugaaccaagcugaggaucagacccuuaacaaagagagcccccuggauuccagaucaauacagcacacacugcagucuuugacccuaaaaugaaccuggugauuuuauuuuaucuuuuagaagaguccuuuuuaaguguugcuuauccaaaacaaaucccauaccuaucuucauuaguauccauguuacguggcagucaguuuuaauugucauuuugacaaucuacaaucaccugggaaagguaucucauuggaauuaguuuagcuuguggccaugucuugauucauaggaagacuugcuuuuuuugagagacacaaaacaaaacuaaggcagucaguauccuguaaaauagagagacucuuucuguacacaauuauaugugauaaacuugcccagaaaacugagucauaguuuuaugaagugauuaaaguuuauaguuugaguaugaaggcacuuugggaguguacuaugcacauguccuuguauuaguuaaguuucuggauacuuuggccaaauacuugacaacauacagcuuaccuuuuuaauucgguucccagggcagaggguuuuaauucucaugguggggaagucauggcagugaauguggcuugauuuauagugcugaccaaaagcagagaaaggggaauaucauuguuuaucuggcuggaccaagaccaugagaauggugucccuuacauuuagaguggauugucuuucucuaauaagccucuauguaaacacugucaaagaccugccugaaggccugcuuuagugccagggguauucauuaauccaaucaaguuguucucacaguucuuaucuguagugacuucuacugccagguacucaaguuauucuauauuuuacuuuucuuuuuucauuuuccuuuucuuguuuuuuccucuccccucuccccuuuccuuucccuaucuuuuuauuuauuauuuuguaggaacccagggcauggcacaccaggguucucucuaccacugaacucuacuucugccugcuuuguggggagagggauaguaucucaguguguagcacuggguggcuuugaacucaacaauccuugauccuccugccauagcuuccuaagugcugggauuauuacugugugccgcuaggcuugguucccucuuuauuguaguuaggcuuuuuuuuguugguuuguuuugcuuguuuuuagucugauacaguaaguugauguugacuauacuuacuagcauauacuaauuaaaaagaaaucugaccucauccguaauauuuguaaguaauuaaauauagcugugauuaguuacgaugggcaagauucagguugucauuuaaugguguuccauucacuguagaaguagaaaagaggaaguggaaaguguggauaauagcauauuagcacacaaacuuaucaguauuuccaauagucauuugcuuuuauuuuuuugucuuccauauuacucuuuuguuuuaauacaaaaaagaaaaaucuacuagacuggcggucuagucauguguuacugcaaaggaaggauuucugcucacugaauuugcauugaggccaaccaagcuacacccuucucuggcuggcuuugcaaaaugagggcuggaacuuuggcaccuaucaaguacagacuuuaauucauauuugauaaaacugaauuguaaguuaaggaagcaugugaagagacuuuugcuuuaguuaugaacuuccuuuacacaauuaagcugucuuucaaaagaauauacauaguauaauguaaauaaucacagagaauauuaaaaauagggacuuaauaggugcaauaguguuuaccccaagccauuagaagaaguaggucacaaguuuagcuuuaguucuagcacaaggucaggaggcaaacaguagugaugugcucuagucuuuauuagguuaaauaacuaaagccagccacuuaacugucagggauguaaacaacaaaaaaauguuaaggacaauauuuuuuaauaaauaagcaauauuuauuuugccugcuguuauuaugaaaggcaauuuguccaagggaugaaacaguguggcucaguaaccaucucuuagccauuugacuugagaagucuauuuuauuuugcauaggaguccuccaccuuauuguccccaguguccacaucugauaacaaaacccaggacugauuuaagaugucauacuauagggcggauugccuguuggggaaguuugagggcucauuauacauauaucuaugauaacuuacugaagaaaacuuacuuaaaucacucugaaguauuuccuaugugaaguuuacaguuugaauuuuaaaguacugugcuggcuaggguuuuuuuuuuuuuuuuuuuuuuucaacuuugcacaaaguacgagucauuugagaagagggaaccgcaauugagaaaaugacuucaacagauuggcuuguaggcaagccugugggacuuuuuuuuuuuuuuuuugguuagugaugauguaggaaggucuggaucauuguagauggugcucucucugggcaggugguccuagguuguacaagaaagcaagcugcacgagcauugagugagcaagccuguaagcaguauucaucuaugaccucugcugcaguuguugccuacagguuccugcauuaagcucuuuuccugacuuccucacgggugaaguauaaacuguaaauuguaagcugaaaaaaccuuuuccuucccaaauuccuuuugguuuuggugguuuuuaauuacagcaauagaaacccuaacuaagacaagcauuuggggaauauauuaugcuuuguccucauauguccuuauuuuagcuucuaugcuuaccuauggauuaugacuuaaaauugcuucuuaguugagcuuuuagaagauacugaauaguagcaaauauugguuauauuuucugacaggaagcuggcauguacugcucacacugccagauaagucaguauuuuaucuauuggacagccagggagagguaaaaccuuugcaucuucagccauugggauuccaaagguggggaggacagggacucuccugugcucuuucuccuuagacaccacuuggcaacucagaggagagaaguaguacauuuugagguccugaacuauaacuuucauggcaagugggaaucuauauaagaaaauaaagacauuuaauuuuggccaaaucuugacuacuuguuacugaauacaaaggauauuggcaaagauuaugaaaacccagccuguuuucucaugaacaaacaggcuuuaaaaucugaguacagugcuauaaaaugauguaaagacuuuaaaagcuguccaaaaagcucccugcagauauccacgucuacaugcaugcacuugcacauauaacuuuuuaugaugugaugcaacuuagaaaacuggcccugcuuuuccuucagaaagaugcuaguacugcaucugggugcuauaguaccacauaguuuucuaauauucuuaagcuguaaagcugagcaagagaaaagccuacaaauuuauugucuaggacaguaugauccuacuauauaaaucuaauuguacaaacuucagauagaauaauauuaacaaaagacuuacauuauaugcauaacuuuagcagauauaguucuccaaauuaugcauuaaaccacuuuuuauuucuaaacuagcagaugauuaaauuauaaaaaugcuuuguuacucagugguccuauuuagagcuacuaaccuuaggcaguauauuuccaugaauccuuaaccuuaauagaacaucuucaaggaucugggugauuuggugauauuuugauguugucuguuauaauuuauacccuucaaaguauuugggugaauugauguuaguguuuaaaaacauugugaaaaaucagcaacuuuggaggagaaaugagauggggugaaagauacugacacaucccauuguuaauuuaugagauaaacuagauguagaaauaaagcuaauacaaguuaaaagacacccauuaaauuaaaacacaacacacaaugauugcuuauuuaggcauuuugaacauguuuuucuuauacauaaaucacagacucaagaugauugauuuguuuguuuuguuuggguuuuuuuguuuguuuuguuuuguuuuuugguuggggcaggucuuuaggaccaguuucauaaauaaaauuauauuuugugcuuuaugaaucccugucacccaagcucgggauaaagggcuuagguuggagaagauauaaaguacuuauuuuuugauauugaggacaucuuuaagauguuaaaacaagucaguuagugaaguguuuggaguaugcuagccugcuuuguuuauuauaggggaaaauacaccucuaccucuuuguagcuuaaaacacacaugagaagucauggucaacaagaagugaggucgagaguaguacaggcaagauagugguggcguuuugcaugagagcauuuauuuagcgugguacuuggagggucacuguagagagaugugugaguuggagucaggagucuauggccuaggagucugugauagggaugugaggcugagaggaagcugagaggaaccaggugggaaagaggagggggugugcuugugugcaguggaaggggagaaguaaaaaaggguuaauggacacugugccauccuccccgugugucucagcagucugcguaugugacagaagauugguuaccucccuggagcugugcuauaaacucaaauuucuugauauuuuuauuuuuuaauguuuuuagcauuguguuguugcagacugacaggaguuuuuagcaauaauugcuuaaaguuaaaugaauagguguuaagcucuauuugaacuacuucaguaauuuuuauuacucauagugacccuuugauguaggcacuguuauuucuaccauuuuauggguaaagaaaaaaaaacaguggcacgggaggggggggcaguuaaauguccuggccaaggccugaaagcgaaggaauugagugcuacacaggcugacuuccaugucugaagcuagaagugaagacgcucagcaggaguacaugcugugaaagagacuacuuagacguggguugcucagaaaugcugaaauucaucuugguauucugaggaaagaagcuugggcguguaguuguuugagaaagugagguaacaauaaaaggcuggguauaucugucccuccuuccuaucucuguucaccagcacuucagcuacuccagaguagcuugguccauuccuuccauaccuacugcauuuccuagucacagacuuacaagguuagguaacucugcuacaggcuucagaguuuagaaagucuuuauaaagucagaugaucuaucuuccugacccagccccccccuaacucucaucaugcguaggauacuugaaauuguuuuaaaggggguggagauaacucaguuuuacaguuaaauuucugaaaacagaguaccucauaggugaacagugaugacuagucuuuauuguuuuaaauuuaaaguuuuaguuuuugagaauucauacaugaauacuguaucacuucuacccgugccuccucccucccuccaacuccuucuauguggccccuacucccucucaaguucaugacuaccucuuuaauuauuguuacauauauguuuauguauauauacauauauacacaacugcugaguccauuagaguuucucuuguguauauguauuuacggcuuaguuuaaaucuaucaggcuuaugccuaaagaagacuaaaacucuccuagcagccauugauugccuauaguccuucauucaaagguggggccgugugagauuuucuuagccaauauuggcauguuagcuaguauuuucuuuagauagguuuuguuuuaauggccauauuguugagauuucauggguacagccucccuuucaagaauagaagacacuaucuugaagcacauauccugguccguugggucuucugcccuauucuucauggugcuccaugguauuguagauguauuaauuugggaugaacagccaguucuucucugcaaugucagguuaccagacccuuuaaaaaguuguuaggccugaaguggaacccaguauauaguauggagagagaugacaaauugccaaguaaccuuagcucuguuacuguguuguagagacuugaaacuucugaguuuuauccagaaugagcaagauugcauaagaaaaaaaaguguauauuuuuuccuugaguacggggaaauagaaguuggguccuaaauacuugaggauaaaccugugaaaacugguccuggaagguuuauauacacgauuuugguauauauauauaucuggagggcaggauaugagugguauguggaguauuugugugguacauuuaugaacaugcuuguauguaugucccaggguucaugugagagccagaaguugaccuugauagccucuaccagucuccacuuuaucuuaaaaaaauaaaacaacaaaaccaaaacaaaccaaaaaguguuccacuaaagguggggcugauugauuggccagccggcaagcucuagcaaacugcauaucucccugccugcuccaguacugggcuuacagaugagaugaggacaccacaccuggcuuuuaugaaagucaugcaugugugggugacaggaagcaccuuaccagcugagcuguuuccucagcucucuagacauuuuuuuaaacauugcugacuguguacaggccguuugcagugucgcuugugagauuaucaugauuuaaugucucaggagacgguugugaugcaugcuuuuacugaacggagaguuucucuuacuaaaggguuuuagaugugucugguuaguucaucuuauuucuaucucucugggacugcuguucucuuaaggauuagggauuuuagguggugcuuuuaaucucagcaucugcaaaggcaggcugaucucuugaauuugaggccugcuuuggucuguguagcaaauucaagacagcuuaggcuacauagugagauagcaacacaacaaaagaguuagggauuuuauaauauaacuaauuuaucguagauaugauuuggaaucuguuggugcuguuuucuuagagucacaaaaucugauucuagaaguuuugguuaggaaaugaagagugaagcaucacucacuuaauuucuaagcacuuguauaguauauccaaaacagaaaagugggaaacagaauggggcaguuugcauuuaguuggggagcuagccacaagguaggauguuauggugggaguaguugaaagcaauacacaauauaauggaacuuugcaguuuauaaaggcuacauccaucugagaugaguagcagguaggugcuuuugucuugaugggugaugaguggcucagugugggucagcagcagaauuagcacaugcacuccaucuuucuuacucaucucugcugccuguccuguguggucaggggaaggagagagugcaugagaggauagggcagaaacacaagucccugugcuguccccacugugcucuuccuguuauuauuucuaaucauccuauugcuuaaucuccugccuuccucccauccucacucugggguuggaggugugucagagugugaugucuguugcguguauuacucaauguuaagcaggcucuugacuuuguauuguuuuuguauccuagcuacaaagccacauuacagaggcugauguguaaacauacagagcuggcaagguggagugcuggccgauauuugucagccuuucauugcuauaaugaaauaccugaggcaggguauuuaugaagagguuauuuaacucauagguuuggagguuccagggcguggugugugcauugguccaguucugugugggcucuguauggcucuaguaagggaacaggugcccagucagccagguuacuaggacugcauuucagaaguauuccuaacuaacugcagacaaaaaucaagaaauagagcaacucagugaucauccucuugcuccaagagacugaguguccuuccaagggcacaguucuuguuaggcugcaccccguaaagguccauauccucucauauugcuacaguggggaucaacacaugcauauaugggaauacucaacuauguccacauuguagcagggccuuuccacauagaaauguggaugcagaaagcaggugagacuugcuaugaugagugaugguggguguuuaaagccacagggagguguggguagaguuaugaaguuaugucuuucuuccauguaucuguauuagagcucuuaaaaaagauuuauuuauuuaauguguaugaguauacugucgcugucuucagacacaccagaagagagcaucaaaucucauuacagaugacugugagucaccaugugguugcugggaauugaacucaggaccuuuggaagagcagccaguugucuuaaccacugagccaucucuccagcccuaaagcucuuaauucaguuugcugcuuaaggguccagcuuccagggucuguuagauaggaguugcuuaauguucagauuuaaguguaucugcugcucuuuggaaagaaucuaaauagaauuuuuccuuauuaguuuaccuuagucuuuuuuuuuuuuuuuuaaggcaaauggacuucaggauuuacauuaugaauaauugugagugaagagaucaguagccacccuguuaauccuggguucauauaucuuaguuauuauuauuacuacauuuccaagauaugcuauuuaaggcugucccucugaagaauugaagguuaaagcaacugaacuuuauuugacaacauuuucaaggacauaguccaagugguuguaguuacucaguaugaaucacuuguacaguuuuuuucagugugcuuugguauaauuggauuuuuguuccucuaguauuacagcucguucuuccuucugcuuuugucagguaugaguuuuacauggcagugucuuaaugaaacuuuauuuugcuccugauuguaagaggccugggucaggugguauaguagguguguaaagguaguauuugaagcaguaggcaggaagaccuaauguuuaauagaugucauauccuuucuguucuaagcacuguguguguauguaugaauuuuuuaucauuaacaacuaaaguauuuuuaucugcauuuuccacagaagaaacugauaagaaguaacuuguccaaggguacuagcuuguuuguaaaucuaugggucacaacacccuugaacaacccuuucacuuaagaccaucaggaaauacauauuuaaauuacaauucauaacaguagcaaaacuacaauuaugaaguagcuaugaaacuaauuuuaugguugggguccccacuucaugaaguacugaauuaaaggguugcagcauuaggaagauugaacacuguaaaugguacugguauacaggcauccugauggcagaaucaaugcucucgauuacucgccuauacaaaaugggauuuguacaaaugaggauuaagggcuuagacuccuuggaggcagauggaggcccacagcagucaucuagggcugcucugcugagacccuggcacccugcucugaaggagacaacuggaguucaggaggcacagcuaggauuugcacaggcuuaaagguaugcccacccaugcuguuggaaguggugggaaguuguguuaguuauucauugggcaguggucagguuguguuucuaaggaaguuggggauuuguucccuguguuauguuuucaagcugcugaguuguccuaagcuucuaaaacaugcucugaucucagcauuggcuguccccuguuccauucacauucuccuuucuucccuuuguggcuacacuccaagucucucagggaguuacagacacauaguugccaccuuuucaucuugcacacccuuugcucacuauugccuuuggugccucccucccucaccagaagaacaacccucacagagauggcagugcuugacucccugcucauucugugagcuuuugacccuuaccuuacuaguaguuuucagucauuuugcccuacaaggaguaucugaaaaugucugcagacauuccgggcauuaaauuugagagaaaggauacuauugguaaccauuggguggagggcaaaaauguagcuaaauauuuuguaaagcacaggaucgcuccugccugaggacuuaacuggaguucuguguaggcuaacagucuaaccagacauccugcauuuaguaucuggugacucuagaagaagaguugagaugaggcuggucuauuuucucagugcuauccacuauucgggacagaugcuaucuaaaaccccuggugauaaagcacuuugagggcccuuuugaagaugccaccagaacugguugggguagacgcuucauauuccuaguugccuugcaguuuuaaaggaacucugauacugucuguuguuauacccacaucuugagaaaacuuuauaccacacuguuagaaggccagacacacaauugaacuaggaaggauuuggacuucuugaaacguaccaguaugguuuuuuguuuuuuuuuuuuuuuuuagcaaauaauaauagaauauaaauuucuuugggacagcaucguaucagaagaaaauaauggguguuucuaaaucugccugguguuuguucuaggggagguguaacucgcacgaaugggccaggcggacagauggacgcccucuggaguccuuguguccuugugcugaaucucguuuucuuccucuuucaggagcuccuugugccacgccucugaucugcagcuuugggagaccaguggaccuggagaaggaugacuaucagaagguggugugcaacaaugagcacugucccugcagcaccuggaugcaucuucagugcuucuacgagugggagagcagcaucuugguacaguucaacugcaucggcagggcccgcagcuggaaugagaagcagugccgccaaaacauguggaccaagaagggcuaugaccuggcuuuccgcuucuguuccugccgcugugggcagggccacuuaaaaaaggacacagacugguaccagguaaagcgaaugcaagaugaaaagaagaagaagucugggucagagaagaacacagcaaggccuccaggggaggcuggggaggaggcaaaaaaaggcagggcccugaacaagccccagaagggccugaaccaugaccuuccucggcggcacuccauggacaggcagaacucccaggaaaagacagucgguucugcagccuauggcgcccgcuccccuuguggcuccccuggccaguccccacccacaggcuacucuauccucuccccagcccacuuuagugguccccgauccuccagauaccuuggggaauucuuaaagaaugccauucaucuugagccucacaaaaaggccgugccaggaggccacguguucagaaaugcccacuuugauuacaguucggcuggucugucuguacacagggcaggacacuuugacaccccuguccaguuccugcggcggcuggaccucucugaacuucucacucacauccccaggcauaagcuaaacacuuuccauguucggauggaagacgaugcccaaguaggccaaggcgaagaucugcggaaguucauucuugcagcccucagugccagccacagaaacgucguaaacugugcuuugugccaccgggcgcuccccguguuugaacaguucccucugguggauggaacucuguucuuaagccccucaagacacgaugagauugaauaugauguuccuugucaccuucaagguauagguguuaauucaccuugccugguuucuauuuguuaaaacccaaaaaagcaaacaagauggaacuacauuuuuacuuuauuuaauuguaacugacauguuuuuauucuagccagggacuaaauagguaacaugaguauuccagcuucucccaguggcuggugguuuuuguacuuggaucucacuguacuggguacaauuuuaugucuuuguuuugugcuacuuugaugaaaggauagcuaauguuuagcuuuuuauaacuggguaaaaauuuauagaagaaauuacauuuuucucuuugcugugaaguaguuugaaaccuuuaaugugcccagcaggcuguuauccuuguaaacagggaaaggaggaaacaagaagggccaguguuagucgaauuaauuuuaaaauugugaaagaugagaacauugauaguaucaaaaggaaaaugggggaugauugaagcccaggcaugccauuaguuggggaacuguaguggucagcuuauauguaugacaaagacuuggguacuuuuuagccauaacuuaaauagcaaguaguugggcaguagaggugugaaauuaaaacuguugaacuuccaaagaagagauacauguauauaauaguucauaacuuuaacaauaugcuacagugucagauaaaaaugauuccugucuucuucccacuaaacccugcgguuuccacccccagagccaaacacauugaaaugcuaagugauucuucaagguuuuugacaucaggauuuugaauacaguucucuuaagucucugguuuuaaguacuauaucuuuugauaagacuggcacauaagauggaugacuacggaucucuuuccuuuggagauaaaucccuaguguuucuacucuauguuaaugguguugaacauuauauauauauauauauaugugugugugugugugugugugugugugugugugugcgugcgcguguauguauguauauauauauacauacauauauauacauauauauauauguauguauacacguguguauacguguauacacgugcacacacacacauauauuuuucuucauuauaucccuugaaagggauacuuuuaaaaauuagaguucauuucuuccauuaccauguguuuguuguuuugguuuuuggaggcaaaggucucacucuguaacccaggcuuggugcagucacagaccugggaagacuuauuauugagaacuaaccguugguuuagcgucuuaagguucaagugccugagagugguguauuuauuuuuuguuuuaacuuugggcaguugcucucaucuagcagcuuuguaaaccacuuuucuaaagcauuucuacacacuuaacauuuuuugaaguuucuuuucuucuguaaacaucucuucugaaggcuuucauuucuaugcucucucuauucuguccugaagaacucaggaccugcuggacuugaaggaaagccuuucuuauuucucaugcuuuaugucuugccuucuaacccauauuuucuuuucuuuacuuuuucccucagacacccucagaagcugcgacauuggaaguuugagaaugccuucauucauuccuaaacacuugguuguuaccuagccgggucaugcaguccuuuaaauuacaaacauuuauuuuuggaaacuuagaaaguguuucuuuacuaucuccugucuuaccucguuacugucuugaagucugaacccccaacccccaaucucuguccucuuuaaagaaguugacuucucccuuacucucucuccuguuaggaaauccuacuauauauugugguuucucagcuccucugccuucacagacugugggcugucuuggauuauugauugaguacagaaacuuagauccucacuuuggagaaacuuugcuuuuguauuauaaauacaaaacuuugauaaauuucucucuuuccacuuaaugugugauauuguaccucuuagcuugacauuucugacuuucuuuugacgggaaagaaaauccuguguuuuucuguuauguguuacucuguuaaaccuucuggaaauggaauguuucuuuagauuucucuucuaguauuuugaauuucuaggaucuuuugugugcuugcuuuuuugagacacucacuauguagaucaggcuggccuagaagagauauuccuggcucugccccccaaaugcugggguuaaaagcaugugccgccaaaaaaccaagaaacauucuuguuucucagaugcaauuucuuuucuuaucuuucagaguaagagaaagguugcaguuacaggguagucuucuguggauguucugugugguucucaggaauucuuuaguuuuuguuguaaagugaaacuccccaaagcccaguggccucaagggacuuaagcccucucaugguuucauggcuggguugguuaggacgguuucucauccaaccggugauagacagguuggcuucuggaacucccauggaauggguucucuguuagccaugcccaccuuuauccuccauuagguuaauuugagguuuuuuuuuuuaaguugugcuucuaauugaacggauuguaguguaauguuuuugugccuguuuauauuauguaauaagauuaggguacugaagauuccauucacuucauauuuauaaucuaugugauaagaauguuccaaauccuacuaauuuugaaaaauauauaaugaacuguagucacuacaauacagugaaacauuagcacuuuuacuccuccuaacaauauaguuguuugcccauuaacuagccucuuccucccaccccagugucucucucuucccuaggagagguaaccacuguacuucauccuuguacaucacacagcuauguggaucacaugguaucagucuuuuugugccugguuuauuuauuacuuaauaaaauguccuucagguauauccauuuaauggaaguaugauuaaauuucuuugguugcuaaauauguguguauauguauguaaacaaaauauuuucuuugucauuuaaucuuguaauggacacuuaguuugauucuguagcuuuugugaggaauacugcagugaauaugggaauaccuguacuucugacauacugauuugaccucuggaucaugugguaauucuaauuaauucuaauaauuacacaagucaagaauuauauaauucuaguuacacaagucaaaccauucuauuauuagguaauucauaauuuuuauuuauguguuuauuuuugaaacagaaucuuagaguguagccuuggcuggccuggaacuuccuauagaucggguggccucaaccucagagaucaguauggcucuuccuccagagugcugggauuaaaggugugggccacuaucccuggccuauuuuuuuaguuuuuuuuuaaaaauauucuucuuuuuucuuuuuuaaagauuuauuuauugaauauauaugaguaugcugucucugucuucagacacaccagaagagggcauucgaucccauuauacaugguugugagucaccaugugguugcuaggaauugaacucaggaccucuggacaagcagucagugcuauuagccgcugagccaucuguccagccccuauuuuuuaguuuuuuuuucuuuuucuuuuucuuuucuuucuuuuucuuuuuuuucuuucuuuuuuuuuuuuuuuuuugagggaacugugugcaguuuucucugguggcuuugcuauaccccacuagaaguagaagggggugaggauucaccuucuacuuauucaaaugcaugaagcuagagggcauaauuaaaugaaauaggucagguacugaaagacaaaugcugccguaugauuuuauucagcuauagagucaaaacaacugcucucaguagaauguauugaauagugugcucaacuaacgcagggcacccuugccaggguaggaaagggaacagcuaaaggcagaaauaccauuagauggcacuuagguuucuuccuguguuuuagagguaggguuuuuguuucuuauuuagcauaacuccuaguaauuuuagaggaaaauggauggaaauaccuuuauuucuacaccuuaaaacuuguaccacacuuuauggaaacgaauuagggugcuacaucuaucaucagucaaacuuugcacaugugcugcgugggaucauuaguauaugucuuaguauauaaaaugcuuuuuaugugcuaacuuauauaacuuaacuguacugagcccgagccugugaauaguagcaucauacauggaauuaguaaguagcacaugccuaguauguacauccuguacucugagcgcucugagauuuccaaggaagaaagggccaguucuuggguuugguucuugaggaggcaguauggaauaggagaugugggagcaggugggguauuucuuucaagccaaagaagcccuuugccguguuauuaugaauuugaauuuaaaaguuuucagcauuaaaaaaaaaacccuaauauacuaaaaaaaagcugcuugaaaaguuuguaaccuggagacagaguugaaauuuugucacaucuguaugcaugaagauaaagaaacuacuguuuguagauggugggaacuaaaaggaaggaauaucugcaggagacuuaaggaaaauuacagauuuggagagucuuuggcugugaaaaugaagggucuucuuuaguucacuuugauuccaaaccauauaaaagacauuuuuacaggcuagaguagacaagguuggaaaaauacugauuuuaugggaaagaagaugagguuauuuguauauauuuaguuaacuuucugugaagaaaccuagcaagcacuguuagaaagaagcauuucuggugaacaugugggauauuauuuuuaacauugguggcgaaaucuuggaaaugaaaagaagcagugugauagcacucaaggcuaaauccuuaagguguugaucagagagaggauggagaaagaggcaaguauacagagauaauggcugugcuugguacacucuacagagguaccaagaacuaacugcugauuuuagaaucuggucaagagguuuaauaaaugcuagagaagucaccaguaccacaacuaaggcauuagucaugggucaguguuucuauugcuguaccucggaacucugggugaucuuauuuauagugagcucuuaggccagccacauuuauaaagcauuuccagcucccaacaggauggccacauucuagggcacaggauuccacaguucacaguugauuuuauguuggugagauguuuacugugcucauuggguuguuauucccuugcucugccccuuaauccuuugggccuuccccagcuuugucuccagacccugcucucagguugagaaaaugguuuuauuuggucuuucuaaguaacacuggucuauuuaagagcgauucgauggccuucuuugcuacugugcaucguaugugauugugcuauuaggacacugcuuacagaaucuuuucuauggcucagaaauucucuuuauaggacaucauggaauaguaauagaaaacaauuccugaaacuaaguuucgacuugggcuucccaagaguuuguuugccuguaaguuuagagucaagugagacaugaauugaaucucguuuuggcuccuuauuuucuuuguaagcauucccaagcugccuagacucuuuaagcaucugccucuccuguuugaaaugggaauaaaagucaugagcccuuuguaguguugcagugaaaguuaaaugaaaggauguauggaacgcucauggcacaggguaagugcacagugaacauuccugucuucaccaucacagccauuguuaccagcaccuucugugucuguguuaacuuccacuagcaguccugauguaucauugagcacuguaggaagagacuggaaaggaaguguucuagugguucauagauaauuaaauugacuuggauauggucccaggaacucaguuguauggcauaugagaccuuguuuucaguguuuuagaacauaggugggugguacugcaaggagcucuugcagucgccccgguuuuggcagagaccccaccucccaguuuauaguguucuuggcuguuaccaugcuccauccacucauucagcacucagagcuuuucacacuguggacauugugcuggauaccaaauugacaaggaagaaugagguguggcuccugcucucgaggaggaaucgggccauguaaacaaaugcaaugaaaauguucucuccaaagacaacuagaagucuuugcaguagagaagggagagagagcugcugguccuggcaagguaaugguaaaaacccucagucugcguuagauagcagcgcacucugauuaagaagccacugugcuguguucuagcgcucccugcucucagcaguguugcuguuacacauggcccaggagcauccuagacaugcuuacuaauuugaaugcuuacccuuccauauauuuggacgaccuuuucuuauauagacauuaaguccuggauaaacagugaagaaauugagguugugacuuuuaaaagcucaguaaauauuauauugaauuucuaauguaucacaaguacuauauaauucuaguuucuaaguuagcuguggugauagcaguuuugggauugaggaauguuaacauaguaauugugacuuuuguaaaaguucugggcugucgauaccaagacuaaauuauuuacucaaauaaaacauuugcuuuuuguugaugaugggggcuuuuuaucagcacuggggauaaaguuguuuugcaccuucacucuuguguuuucuuugugcagggagacucaugcaucuguaugcaguguguguggacugccuggaagggguucacaagauuaucugcaucaaaugcaagucacgaugggacggcagcuggcaccagcugggcaccauguauaccuacgacauccuggcugccucucccugcugucagguugguaucagcugaacugaaggugcaguagauaccuaugggcuuuugucaccaaguuaacuuagagaauuaaaggcugcuuuguggguacuuggcgugugagguaugaggguuuggucaugguguccgucuaaggaauaaaaauucagguaagguaaaauacuguuuagucaaagggaaacacacacauauauacacauacacacacacucacaaagagagggggcauagagagaaguagauuuggaauacuuuuuaucuguuaaaucaaaacuaaaauaaaacugcaaagcaccuugcuuccuuugagacagcaugaaagugcucucugauuaucagcaguuggguagguggcccaggggguuagguaucuguguaugguuucuuuaguuuucauuuugcuuauaacuuucucauuuugugagauuaauuuauacuacaaaucuguaacaaaggguuuuaauuuaaacugaaaaggaaauuuuuuuccuagaacagaaaaaaauucaccaauugcguacuuucugugagauguuugcaaaacccaguaucucccacuuaaguuauaugacauugaccagaaagcuuuauaauuccucaagugcuagaagcagcacuauucuuuccugacuuguaggaaaggaaaggaggaggugcugacacaaaaccccauuaaauaagaaauagaaaccaaagggauaaaaucccaaggaauaccggaauuauuauuauucaacauacuugaggaaggcguauuacauccuucccuggugggugacucuggguagcagauguucucugcuggcauuguguuaacccauauccuuuacagauagugaguauuacacuguggcuacaauaggaguuuguaucauuaccauuguaacuucauuuuuaaaaaauauucuucuaguaucaguuugauuaguaggugaccuguuuguguugaguucaaagccacagacaguaguuccccucuuuuuugcucauuaguguuuuacagaagagaaaugugcuugugagcgagguggauagccuucuuccuaugucuuuugguuuuggauaagguugacuaguucucuuuucuuucuuucuuuuuuuuuuuuaauuggacauuuuauuuguuuacauuucaaauguuauccccuuuuccgguuuccccucugcaaacccccugucccgucccccuuuacccugcuucuaugaggaugcuuccccacccacccacuccuguuucacugcccuagcauuccucugcacuggggcauugagccuucacaggaccaagggccuccccucccauugaugucagauaaggccccuucagcuccuucaguccuuccccuaacuccuccauugggaucccugugcucaguccgaugguuggcuuugagcaucugcaucuguauuuguauuggucagaaucuggcagagccucucgggagacagcuguaucaggcuucugucagcaaacacuucuuggcaucaguaauagugucuggguuuggugucugcaugugggaaggaucuucggucucuguuucacuauuugucucaguauuuccuuuauuucaggguuaaaauuuuggagcugguuggguggccccaucccucaaccuggguuugggggguggagugccuaaccucuggauauggucacaacagguaugcuaagcaucuccaugggauccugauaggcucuuuguuuccuggcaucugggacuuucugguugcuacccccaguugcccaucccccauugcuacacaucucuguugauuuccugacccucuguacaucuccuccaucuccucccauaccugauucugccccucuuuuuccucucccauuccucucuuccuccaauucuuuuccacccucuauuuccuuugauuauauugcucccccuucuaaauaguacugaagcauccacucuuuggucuuccuuccucuugagcuucauguggcccaugaguucuaucauagguauuccacaauccuugccuaauauccacuuaucagugaguacauaccauguguguucuuuugugacugaguuaccucucucaggauauuuucuagauccaugcauuugccugcaaauuucuugaagucauuguuuuuaauaggugaguaguauuccauuauguaaauguaccacauuuuuuauauccaucccucuguugaggaacauauggguuguuucuagcuauuauaaauauggcugcaaugaacauaguggaguauguguccuuauuacauguuggagcaucuucuggguauauacccaggagugguauaacugauuucaaauuucugaggaaccaucagacugauuuccagagugguucaaccagcuugcaaucccacuagcaauagaggaguguuccucuuucuccacauccuugccagugucugcugucaccugaguuuuugaucuuagccauucugacuggugugaaguggaauaucuuguuuugauuugcauuucccugaugacuaaggauguugaacauuucuuuagguauuucuauuaaggaguagagauuguugcuuccuauuauuuuuguucuuagagguggaauuauguuuguguggcuaucuucuuuuggguuuguugaaggaagauuacuuucuugcuuuuucugggguguaguuucccuucuuguguuuuccaucuguuauccuuucuagaguuggauuuguggagagauacuguguaaauuugguuuugucauggaauauccugguuucuccaucuaugguaauugagaguuuugcuggguauaguagccuuggcuggcauuuguguucucuuaaggacuguauaacauuugcccagaaucuucuagcuuucauagucucuggugaaaagucugguguaauucuuauaggucugccuuuauauguuacuugaccuuuuuccccuacugcuuuuaauauucuuucuuuauuuagugcauuugguguuuugauuauuuugugacuggaggaauuucuuuucugguucaaucaauuuggaguucuuuaggcuucuuguauguuuauggacaucucuuucuguagguuagggaugauuucuucuauaacauuguugaagauauuuacuggcccuuuaaguugggaaucuucucucucuucuauaccuauuauccuuagauuuggucuucucauuguguccuggauuucauggauguuuuggguugggguuuuuuuacuuuuugcauuuucuuugacuguugugucaauguuuucuaugguaucuucugcaccugagauucucuuuucuaucucuuguauucuguuggugaugcuugcaucuaugacucuucaucucuuuccuagguuuucuaacuccaggguugucucccuuugugauuuuuuuuauuguuucuauuuccauuuuuagauccuggaugguuuuguucaaucccuucaccuguuugguuguguuuuccuauaauucuuuaagggauuuuuguguuugcucuuuaagggcuucuagcuguuugccuguguacuccuguauuucuuuaagggaguuauuuaaguccuucuuaaagagaugugauuuuuaaaaucagagucuugcuuuucugauguguuggaguauccagggcuuugugguggguagguucugaugauuuuaaguggccuuauuuucuuuugcuuauguucuuaugcuugcuucuuaccaucugguuaucugugguguuagcuggucuugcuaucucuuacuguggcuugucccuaagccugugugucagcauuccugugagacuagcucuuuccagguggaauuuguauauggagaacuguggcacagggucagcucugggugcagauggaauccagaaagauucuauccucagcugcuucucaguuccuguguccucauuagggcuccaggcgggucccucuugggccagguauuugagcaaaagugguguucucaccugugcucucaggugugucugcacuccuggaagaccagcuuuuuccaggugggauuuggguaugaagagcuaaggcacaaaccggaagaccuuagucuccuguucuggugguguucugaccacauuuccagauuccagguuagcuuugauugaguuacugugaucuuccaguuacucacugucaugcuuuaguguccauucguaagaugauagaaaccaaagggaguguggugccuuuucuguguacauagaugauguagcaggaggguuagccucuuaaggaagugaggacaugaacaaagauuugggcuauauuaaauaaagcucauggcauuuuagcauugcaugggaccuugccagagcucauucagcuuucugaauggaugcuuauaauggaugacucaagguuuugaaaguuuucuccagaucuacauaaaucgugucacagcugugacuaaaacaugugauuccuauucugguguucuuucuacuuguuguugaacggguguggcauuuccauguauucaguuagaaauacagacuggcaucuugcccaccaauccuuuugucugcacuguauguucauucuugaaacugauauaugccaagauuauauuuucugucccucaacugaaacagaaaaccuguuugauuacuguuguuguuguuguuguuauuauuauuauuauuauuauuauuauuauuauuauuaaacaauugaaaauauucaccgugaagauacaccuuguagacaguucucaaguauucaggaaagucuucaaauaagucugagccaacaauaaguaguauuugguuaucugaaaagaauaagagguuagagagaacuuuccugaagacucagagggaugaaguaguuaaaagagaguucauuuuaggcuuuggaaagauagcguguguaggugaagugugcacuuuggagcacauuuaguuuaaaucccagcuguucagcuuucuguuuucuugggcuugguauuuaucagugugugccccuuucaucaucugaaaugcacaucaugcuccuucacaagaaagccuugaggacagauuuguuagcagauuuuuaggaaggcucuaaaucaagacuguuuggucuguaauuucugccuauccacugugcucccagaucuauugcugaagugcugcaggauggugcuguuagaggcacaggcgcaggugaagauggcaugugauagugaauuccagacucucaacauacacaacacucuugccugcauugcccauuuugcuuggauauuuuagggagauuuuacuuuuauaucaaagaaaacugucauauagagacaaaugacaguguauaagagcuuuugaaauaaaccuggacucuucaggaaaguuuuuuuuuuuuuuaauguagauucaggugcaaauagccauaucagccagggagauguugauugcuguuagguaacucuguugguaguacuguuuagaauuuucucauugguaggcaccucauauuaagagagaaacugggagacuguagucuuuagaaggaugaugacgaaugucagaauaugcaucuuagauguacaugccuugauucugcuaauaauggagauguuucgcugaaucucagucaguucccagcauuuugauuagguggcuuuugacuauauuggguagcuagugguauuguggcuuaugaugucuguuuccccaggcccgucugaauugcaagcauuguggcaagccugugaucgacguacggaucgggaugcaguacuucucugaguacagcaauguccagcaguguccacacugugggaaccuggacuaccauuucgugaagccauucucuuccuucaaaguucucgaagcuuauugaugaaagcuuugcuuuaguaauagcuauuuuauugauauuauuacuuuacuacauaucuuuuauaggggaacauucugugacauuaauuucuuuucuaauuugaagcagaguuuacuuuguauauuugugccacuaaaauggggacuuccucuugcccuuuccugauucccaaaugucaauguguggguaagacuggaggccagauggggaauugugcagguuugguaggguuuuagucucaugcagagugucugauggaguucuaagguaguaggaagaaugggugccauuuaggggugggaaucuggcuaaacuagaggugugguaggaguugggagggagcuuuuacuaaauguuagcuuucuugagacucacuguuaguucucugggccuuggggaaauaaaugacaagugaauguacaccugagccuggacagccaguacuguauuaggcugucuggacucuguuuuucagcacagguugaggugcaauuuucucccacugauagaugauuugagaguagaacugagugcucuuucuuugacuauuugucuaauuuaacaguuuucauacuggaaauaauauccaaauuauaugacacgugaaagcuguugcuguguaggugagcugaaucuagcaggucuugugaagcaaauuuggaaaugaugcacacugaaucaggcaggcagaaagacacacuuugguuauuugaacuguaucucuagagguggucagagagucuacagaaaaucuguauacucggugguuuugaugggcagcauuuacagguugcauugcugaagugcugccugguauccagagcuccuugcagguaaaccucuggccugccugcugugcugcagaaccaccugugccacacuuccuuuucaguauaucuagugccacauagucagagccaaucugaagaaggaaggcgacaguuagaaugaugaauaguuuuuauucuuuuaaaaguaaguucaguuuugggagcaguaaugcaaaagagcauaucugaaaauagaucauccuaaagauucccaugaucccucacuguugguuaaagcaaaaguagcauacagaccaaguauuccaaaccaaccucugugcaggagaauguggaaacuucaauaugcugaagacauggccuguacaguuagaauuagagacuuacuucuuaugaagcaauuugguauuuucaaguaugauauagaaguacauauuaaaagaauacuaaaucuuacccauuuaugacuaggcaaauuugaaguuuauguaaauauuuauaucauuuuuuugguuuaugcccccuacacauacaguggguguuucucuucaaaauugucuaagcauuauugccagugaguuuuaaauucuacugcuuggugauuugauggaaucagcauuaaggaacccaacuaaaacucuucaucuuuggaugaauauucuucaucaguugguuuguuacucauaguuugaugaucugaaguuucacaucuguaaaaacuugccuaggacaagcagaaaucauuauuggucaggugguguuuaaugcaauuacaugaggucuacauaacauaauacuuacaaauuugucuccgaagcacaaagcuguaauuaggaauuagcuguuucccuaugagucuguuguacacucaaguuuaaaauuuugguaaguuucuauucaaauucauauuugucuucguguuucugauucuuuuaaaauaaauaaaauacuuguaaugcaguucuuuaaccuggugacguuuucuaguaaaauuucacuguguuauuguuccgaagucaaucuauucacuguaccacgugaguucuuuagguuaaaagacacuguggagcuguaagccacauuccguucuuguuccuuagauugauuucugccccuaaaaggaagaggucuuauuucaguuggauaacauuugcauuugaugcuauguugaugauaaagugaggacuauguauauggucuuacaaaagaagcaugagcccugcauuccaauacuuaccuuuugccuuuuagugcauuaauuucacuuuugucuggaagggaaaauuuggcugguuggagaaaaaaaaaaauacaacuaagcauacaauacuugcuauaaagguaaauuuuacuuuggaaaucuucugaccuuaauguuuucaccagucuuugccugaacacguugauuagaauuggucuaugucaagaaggauuaucauuucuauuguaguugggacaguaaaggguaucagucaccuaggagaucuaacuucuguuucugaugaguaacucauagauucaguaacucauagauugacuaauaauuuaaagugauuuuuaucuacuuuaauaucuuuagucauuuauuuuuaaaguguuccauacuuugagcaaguaaaauugcuucaguuuugagacaagcuaauuucugaucguauuuucuucaggccaucucagcucucugcuguuucugauuaccugaucacaugggaagcccuuacagaggggcuucuccaacauccuuuaauuuccaguuuuugaaaaagggauucauuuuucuaaguaaaagaaauuuucauaccuuuuugggaaaaauuagcucaugaagaaagaguuuuauauguuuaaaugauaaaacuuaacagauugagucauaacaugcuagacuaccaagacuaccuuucugaguuccucgugucguccuacaauaccagugcuuuuucugugcagucugcuuugugccuguuuucuaaccuuguugauuuuuuuguucaaguccuugaagcaguuguugaauaauuuuaguugggagauuggggaagaggugaggaaaaagcacuuuucuuuagggugugguucccaugacaggaugcugccuaaccuaguucaucuucauaccuuguugacuuuauuauuuuuucagauaauugaaagagaauauaaugaauggacaccaugaaaaccagcucaaaaauauguuguugucuacaaagauuucuugucaagaugucuuggauugcacuuuuguugagggaagccaguguaaauacuuaaagaauguugauaaaaauugaagcauuuggguuauggaaucaugugugauguuagaggguuucuguaugugaaagguguguauuaagaauaauaaaauuuuagaaacaaauauuaaacuuugcauuuuagauuuuguuggaaguuuuugagaaacggggauguuugguaagaaaagauaguagagaaguagggauauucucagaguuuaaaaaaaucccagaaagccauuccaaaaguacuacugcaacuaauccaaagugaaaauuccagaguagcaagauggcucaguaaauaaagguacuuguugaguuugauccccagaccuuacaugguggaaggagagaagcagcucgagaaagccauccucugacagaacauguaugcucuggugcaugcacaugcaugauagauaaauauaaaaaaaagaaaaaacagggacaggacccacaauuagaaauucuucacugcuuacacacauguaucacauguaagcuucuuuugcagcaaaauaauagcaaaucagccuuccccuuguuuuguauguauauuauaaaauuauuguucugguuauacauaauucuaugguauagaaaguguuaaagaaaaauguaaaaagugugauuuugaaacacccaagcccccacuagacauugccuuaguuacuuuuguauugcugugaagagacaccaugaccaaggcaacacuuauacaggaaaguauuuaauuagggacuugaaaauaguuucagaggcuuaagccugcuggggagcaugguugcaaugcaagcaggcacuggagcaguuuugcaucccgauuugcaggcagagagauauacagggccuugcacgggcuuucaaaaccucaaagcucacccccagugauauacuuucuccaacaaggccucacccaauccuaauguuuucaaacaguuccauucucuggugacuaaacauucaauuaucugagcuuaggagacuauuuuuuucucaauuuauuuacuuugcauccuaaccgcagcccccccccccacauucccucuuuaaagccccucccucccccagucacccuuccuuucaccuuugagaaggggguggucaccucucaucuggguaucaaccaacccugacaccuccuguuacugcaggacuaggcacauccucuuccacugaagccagauaaggcaguccaguuagggaaacaggaucuacacacaggcaacagagugagggacacuccccacuccaguuguugggaaacuugcaugaagaucaaacuguacaucuacuacauaugugagguggccuaaagaccaccucuugguaagucccaccuuucagugucuuaauacauugauuuggagugauggauucacacagagcaaucauauuugaaaacaucuaagaguaguuuuuaguggggaggaaaggaaaaaaaauacuugaaauaauugugacagccagucccacaacauccagaggaagcucuacucuaagacacgcuuaacacacccaggaucauagcaucagaggugaggaggacacgacaucugugccaacaccaccggaaauaacugagaccagcgagaucaagggacacaggaaccuuacccaaccaguggcaagggacccuucuggucugggcucgugcccagaacagacguuggguaaaaacucugcagccagucccaaaacauccagagaaagcuccacucccaggcacucuaacacgaccaggaucacagaaucccaggaacuuggccacaccaggaucucaggggcccagagggaguuugauucccaggaacucugauacacccaggaaaucaggauccaagaaucacaggauuacaaagacagguguacucugaggagcucugacacaaccaagaucacaggaaggacaggcuccaaacauauauggagggcagguagcacuagagauaaccagauggcaggaggcaagcuuaagaacauaaaagaaaacaaggcuacuuggaaucaucagaacccaguucucccaugacagcaagcucuggauacucccaacacaccagaaaagcaagacugauuuaaaaucacaucucaugaugaugauagaagacuuuaagaaggacuuaaauaacucccuuaaagaaauacaggagaacacaggcaaacagcuagaagcccuugaagagcaaacaaaaaaucccuuaaagaauuacaggaaaacacaacaaacaggugaagggauugaucaaaaccauccaggaucuaaaaaugggaauagaaacaauaaaaaaaaaaaucacaaagggagacaacccuggaguuagaaaaccuaggaaagagaucaguauucauagacacaagcaucaccaacagaauacaagagauggaagagagaaucucaggugcagaagauaccauagaaaacauugacacaacagucaaagaaaaugcaaaaaguaaaaaaaaccccaacccaaaacauccaugaaauccaggacacaaugagaagaccaaaccuaaggauaauagguauagaagagagagaagauucccaacuuuaagagccaguaaauaucuucaacaaaguuauagaagaaaacuucccuaaccuaaagaaagagaugcccauaaacguacaagaagccuaaagaacuccaaauugauuggaccagaaaagaaauuccucccaucacauaggaaucaagcaccaauuaagagcaguacgggaaaaaggucaaguaacauauaaaggcagaccuaucagaauuacaccagacuucucaccagagacuaugaaagcuaaaagauccugggcagaugucauacagacccuaagagaacacaaaugccagcccaggcugcuauacccagcaaaacucaauuaccauagauggagaaaacaagauuuuccaugacaaaaccaaauuuacacaauaucuuuccauaaauccaacccgacaaaggauaauagauggaaaacaccaacacaaggagggaaacuacauacuagaaaaagcaagaaaguaaucuucuuucaacaaacccaaaaggagauagccacacaaacauaaaaauaacaucaaauauaacagagaucaacaaucacuuuuccuuaauaucuccuaacaucaauggaugcaacugcccaauaaaaagacauaaauuaacagacuggauacauaaacaggagccagcauuuugcugcauacaggaaacccaccucagugucaaagacaggcacuacuuuagaguaaaagguuggaaaacaauuuuccaagcaaauggucccaagaaaaaagcuggaguagccauucuaauaucgaauaaaaucgacuuucaaccaaaacuuaucaaaaaggauaaggaaggacacuucauacuggucaaaggaaaaauguaccaagaugaacucucaauucugaacaucuaggcuccaaaugcaacggcacccacacucauaaacuuuacuaaagcucaaagcacacauuguaucccacaaaauaauagcgggagacuucaacacuccacucucagcaauggacagaucaugucaacagaaacuaagcagagacacagugaaaguaagagaaguuaugaccaaauggaucuaacauauuuauagaacauuucauccuaaaucaaaagaauaugcugccuucucagcaccucaugguaccuucuccaaaacugaccauauaaucgaucacaaaacaggccucaacagauacaacaagauugaaggaaucucaugcacccuaucagaucucuacggucuaaggcuggucuucaacaccaacaaaaacaacagaaaguaugcauguacaugauaauuuggucaaggaagaaauaaagaaauuaaagacuuuagaauuuaaugaaaauguaggcacaacauacccaagcuuaugggacacaaugaaagcuguaauaagaggaauaccucuuaagugccuccaaaaagaaacuggagagaggauaaacuagcagcuugacagcacacuugaaaguuauagaaagaagcaaagguagccaagaggaguagaugccaggaaauaaucaaacucagggcuaaaaugaaccaaauagaaacaaaaagaacuguacaaagaaccaacaaaaccaggagcugguacuuugagaaaaucaacaagaaaacucuuagccagacaaaccagaggguagagagacaguauccaaauuaauaaaaucagaaaugaaaagggagagaugauaauggaaaccguggaaauucaaaaaaucaucagauccuaguacacaagcuuauauucaacaaaauuggaaaaucuggaugaaauggacaauuuuuuagacagauaacaggugccaaaguuaaaacaggaucagauaaaccaucuaaacacauaauuccuaaagaaauagaagcagacauuuuuggucucccaaccggaaaaaaaaaaaaaaaaaaaaaaaaaaaaagcccagguucagacggguuuaguggagaauucuauagaccuucaaagaagaccuaauacaaauacucuucaaacuauuccacaaaauagaaauagaaggaucacuacccaauugguucuaugaggccauaauuauguuuauaccuaaaccacacaaagacccaacaaagaaacagaacuuuagaccaauuucccuuaugaacauagaugcaaaaauacaaaaauucuugccaacugaaucuaagaacaaauugaaaggaucauuuaucacaaucaauuaggcuucaucccagggaugcagggauggcucaauauacugaaauucaucaacauaguccacuaaagaaacaaacucaaaaaacccacaugaucauuucauuagauacugagaaagcauuugaaaaaauucaacaucccuuuauguuaaaaggcuuggaaagaucaagaauucaaggcccauaccuaaacauaguaaaagcaauauacagcaaaccaauagucaacaucaaacuaaauggagagaaaccugaagcaaucucacuagaaucagggacuaaauaaggcugcccacucucuacccaucuauucaauauaguacucuaaguucuagcuagagcaauuagacaacaaacggaggucaagggauacaaauuggaaaggaagaaguaaaaauaucacuauuugcaaaugauaugauaguauacuuaagugaccccaaaaauuccaccagagaucuccuauagcugauaagcaacuucagcaaaguggcuggauauaaaauuaacucaaaucaguagcuuuucucuacucaaaggcuaaacaggcugaggaagaaauuagggaaaugacacccuucacaauaguuauaaauaguauuacauaccuugguaugacucuaaccaagcgagugaaagaucuguaugagaagaacuucaagucucugaagaaauaaaucaaagaucucagaagauggaaagaucucccaugcucauggauuggcaggauuauuauaguaaaaauggccaucuugcugaagcaaucuacagauucaaugcaauccccaucaaaauucuaacucaauucuucauagagucagaaagagcaauuuguaaauucacuuggaauaacaaaaaacucagaauagcaaaaacuauucucaacaaugaaagaacuucuggaggagucaucaucccugacaaacaagguguauuacagagcaacagugauaaaaacuauauaauauugguacauagucaggcaggcagaucagagguauagaauugaagacccagaaaugaacccacacaccuauggucacucgauauuugacaaaggagcuaaaaccauucaguggaaagaagacagcauuuucaacaaauggugcugguucaacuggagaucaguauguagaaaaaugcaaaucgacccauucuuaucuccuuguacaaaauucaaguccaaguggaucaaggaccuccacauaaaacuagauacugagacuuauagaggagaaaguggagaagagacuggagcacaugggcauaggggaaacauuucugaacagaacacuaauagcuugugcccuaagaucaagaauugacaaaugggacuucauuaaauugcaaggcuucuguaagguaaaagacagugucaguaggacaaaauggcaaccaacagauugggaaaagauuguuaccaauccuacagcugauagagggcuaauauccaaaacauacaaagaacgcaagguguuagacucugcugggcagugguggcucaagccuuucuuuaauccucacacuuguggggguggggggggggaagagguaggcagauuucugaguuggggccagccuagucuacagagugaguuccaggacagccagagcuacacagagaaaccuugucuugaaaaaccacuacuacuacuacuacuacuacuacuacuacuacuacuacuacuaccacuaaagauguuagacuccauggaauccaauaacccuauuaaaaaauagaguacagagcuaaacaaauaauuuucaacugaggaguaucaaauggcugagaaacaccuaaagaaauguucaacaucugucuuagucaggguuucuauuccugcauaaacaucaugaccaagaagcaaguuugggaggaaaggguuuauucagcuuacucuuccacauugcuguucaucaccaaaggaagucaggacuggaacucaaacaggucaguaagcaggagcugaugcagagaccauggagagguguuucuuacuggcuugcucagcuugcuuucuuauagaaugcaagacuaccagcccagacaugguacuacacacaaggggcccucccccuugaucacuaauugagaaaauaccuuacagauggaggcacuuccccaacugaagcuccuuucucugugauaacuccagccuaugucaaguugacacagaaaacaagccaguacaguauucuuagucagcaaggaaaugcaaauucaaacaacccugagauuccaccucacacuaggcagaacggcuaagauaaaaaaaaaacucaggugacagcagaggcuggcgaggaugugaagcaagaggaacacuccuccauuauuggugggauugcaagcugguacaaccacucuggaaaucugucuggugauucaucagaaaauuggacauaguacuaccugaggacccagcuauaccacuucugggcauauaugcaaaagauauaacaaggacacaugcuccacuauguucauagcagcccuauaauaauaauagccagaagcuggaaagaacccagauguccuucaacagaggaauggauacagaaauuuugguacauuuacacaauagagugcuucucagcuauuaagaacgaugaauucaugaaauucuuaggcaaauggauggaacuagaaaauaucauccugagugagguuacccaaucacaaaagaacacacaggguaugcauucacugauaaguggauauuaucccagaaacucugaaugcccaagauacaauucacagacuacaugaagcucaagaaggaagaccaaagugugggugcuuuaguuuuucuuaaaaaggggaacacccucauagaagaagagggaagggagaugggauagaggguuucugggacauggggaaacuuggaauggggauaacauuugaaauguaaauaaauauaauauccaauaaauauauauauauauauauauauauauauauauauauauauauauauaaaauaauugugucuuuuaccuauuuuuuucaacuauuaauuuguugacauuucuuccuauuugucaaaauagguuacugcuugaggaaauggagcaaaagaugacauuuuaacaaucuacucuuaaaaacucacacuuuauucucuuugggaucuuugaaucauuuuugaauuuguauaugucaagcuuucagguuugauaccauugggcaauugauauccaaucugggcaggauuuugcuuuuaauuaacuuuuaaaacaguuuuuauaucuuauguuccauuuucaguuucucuugaucuuguuggauggagauguugguauuucaguuuaguggucacuguaucugaucacuguauaugaguuucuuacagccuuauaaaaaaaugaacugauuacacaucucuaaccaauauuucucaugcuuuggggccuguaucaguuguccuuuccuguugcuguuauuaaaacaucaugacugaaagaacuuaaggaagaaaguuuauuucuugcuuauagcucuggagaccuaacaucuauaaugguggaaaaggugcugauaggagcauuuugguacacagacaggaagcaaagagugguuggaagguaggauggggguuagacccucaaagucuguacuuccugcaguaauguacuucgcacuauagguacauccccuaaagguuucauaaccaaauagugccacuguuugggaaccaauuguucaaauacaugugcuaugcugggcauuucucacuaaaaccgcuacagaguaauuaguaacugcaaaaucauggggugaugauaaauauuguacaucuuguucaucacauuaacuaguccaguuguccugaacguuuuauguuaaagcagguugauuaggaaaauaaggacagaggaaggccauagacuaaguguuucuaagauggcucagaacaccauaguuccaaaaagaauaacuuaggaaggaguccuugagaugacugauuauuuuagagaacuuaguagacaucauaagguuaccccaagcugcacagaaugucauaaaggucauuuaacuuugugcaaggauuauagaaauuauggguguuauagauugugcagaaacacuggcaguaguauguguuuucauggauaauaaauaagaauauaagcuauuuauaacuacugguaauuuuguagaugucuccuuuuaaaauaugaaagugauaguuuuagugaaaggacaguuuugguugaaggcagaguuggcaaauggcauuaaaaggucacccacuuuuucuaguccuuuuuaccauuguucugucaccugucaguucuccuuuauuuccuguugcaucagguuuccaaaucaucaggauacaauaaaaucuuccagauaaauaguuaugccacacuguuucuagagagguauagauaaauaacuucacuccagguagggaaccaaugacagaccaaaguacagaucccaucaaaaaaccaacuuagugaacaaaugaguuauuuggguuacuuacaggagcagaaaucauacaaagacaccuuuauuaccaaaaucccacccaagcacaaguagcaauucacaaaaguuagaaaucuggaguacauggcacaaccuucaggguuguaggguguccauuccaagcauuucauugaguuuugggcccuuucaaacagcucagcuggucuuuucuaggcagcuugcuuugucugagaauaucucccagcuguccuuacuuauauuggauuaggaaagagaaggguccaaugaaucuggucaguuucaggaacuuccugaagcuuuugagcuuuguaauguuugauccuaaggagcuucccuauaggguggaacuuuucaccucccuguagaacauuguuguuuaccucccuguaaauaucuuaagaaguuucuuccuuagauuaucuugcuguuuaaacauguaccccauuuuuaaauuauauuauuugguuuuuugauguuuagugucuugaguucuuuacauauuuuggauaucagccuucuaucagaugugggcuuggugaagauuuuuucccauucuauaggcugcuguuuuguccuauuuaugguguccuuugcuauacagaagauuuucaguuucaugagguaccauuuuuuaaaaugucagucuuaaugccugugcuauugguguucuauucaggaaguugucuccugugccaguacauucaaggcuacuccccaauuuaucuucuaucagauuuaguguaucuguuuuuauguugacaucagggauggugauuucucugcaaauucauucauuguacaggauaguuuuaguuauccugagaguuuuuguucauaggaaguucaguauuguucuuucaagauuauuuugaaauuuuguugaauuauguuggaaucuugaugguaauugcauugaaucuguacauugcuguugguaagauggcuauuuuuggauguacuuuuuauuagguuauuacauuucaaauguuaagguggcuguuuuuuuacuaugcuaauuauacagauccaugagugugggagaucuuuccaucuucugauaucuccuuccguuucuuucuucaaagacuugaaguucuugucauacagaucuuucacuuguuuggaguugcaccaagauauuuuauauuauuuguggcucuugugaaguguguuguuuccuuaauuuauuucuuagccuguuuauaguuugaauauaggaggaauacagguguuuuugaguuaaucuuguauccagccacuuuacugaagguguuuaucaguuguaaaaguccggugcuaaaacacaugaaacucaagaaggaagaccaaaguguggauacuucaauccuucuagaagggggaacaaaauacccauggaaggaguuacagagacaaaguguagagcagagacugaaggaaugaccauccagaaacugccccaccuggagaccaucccauaaacaacuaccaaacccagaaacuuugcagaugccaacaagagcuugcugauagaaccaugauauagcugucuccugagaggcucugccaagugccugacuaauacagaaguggaugcucacagucauccauuagauggagcacaggguucccaaugaaggagcuagagaaaggacccaaggagcugaagggguuugcagcccccuaggaggaacaacaauaugaacuaaccaguaaccccagagaucccugggacuaaaccaccaaucaaagaaaucacauggagggacucgugucucuagcugcauaugacuaggccagaggauggccuagucggucaucagugggaggagaggcccuugguccugugaagguucuaugccccaguauaaaggaaugucugggccaagagacaggagugagugaguuggaaaccagggcaaagggggagaggauaggggauuucccgaggggaaacuaggaaagggaauagcauuugaaauguaaauaaagaaaauaucuaauaauaaaaaaaguuccuugcuagaauuuuuguggucacguaccuguacuaucauauuaucugggaauagcaagacuuugaccucuucuuuuccaguuuguauccccauuaucuccuuuaguuguuauagcuagaacuucaaauacuauauuugaguaguuaugaagagaguggacagccuugcuuguuccugauuuuaguggaauuacuuugagguuuuuuuccauuuaauuugcuguugacuuggcuugcuauaaauugcuuuuauuauguacauugagauaugcaccuuguaucgaugaucucuccaagacuuuuaucauaaagggauguuggauuuugucaagauuuuuucaguaucuaaugagauuaucauguggaauuuccagaauucucaacugaggaaacucaaauggcugaaaagcacguaaagaaauguacaacauccuuagucaucagggaaaugcaaaucaaaacagcccugagauuccaccucacaccaggaagaauggcuaagaucaaaaacucaagugacagcagaugcuggcaaggauguggagaaagaggaaaacuccuccauuauuggugggauugcaagcuuguacaaccacucuggaaaucuggcuugugauucaucagaaaauuggacccagcuauaccacuccugggcauauacccagaagaugcuccaacauguaauaaggacacaugcuccacuauguucauagcagcccauaauaauaauagccagaagcuggaaacaacccagaugucccucaacagaggaauggauacagaaaaugugguauauuuacacaauggaauacuacucagcuauuaaaaacaacaacuucaugaaauucacaggcaaauagauggaaauugguuaaaaauuuuaaguaaauaucauuagcaagucauccugagcuguacaagaaagcucauucaaaauugcuuagcauucaaauuaaaaagugaaucuuuuuauuuaaaaagaauaauguuuaaaauacucaaauugacuuuuuuuuuuuugcauugccucaauuuugaaguuggagcaaguacuuuagcacuaaguuuuggguuacauacaauuuuuuaauuaacaaaaauaaaucugaagauuucaggacuuacuauuaagcaucaaagaaaagaaaucagaagucuuuaaauaaguggaauucucagcuuguagagauuugacucuugaaaauacagacuuuugggucaaauuucuguuuggcucaaagauguaauauuucaccucuucagagacaaugcaauuacaccucuguauuauagaggguugcuucuauaccuccauguggaugcucaaacccacaaacacucaaguccuuauaaaaccaguuaguaugugccugugcuccacuugcuccuucugcaugcuuuacauauuuauuuuauuaauuaaauuaugugcauguguguacgaguauguaacauauucagcaugguuugguccuggaaacagacugggaugaugaagaaauaaaagcuagacauacagauaucugcagaaaagcugggauugggugggcugugcauguucuuguguagacaccagcgugugaaccagaaucucagcauguuuaguauguacuacaugagaaggacuuagcuagacuugguagggcaucucugaggaggggcagucucagguugcagucauucuggaagaagaaucuguaguugcuagcuuuuggauacacugucaauauauacaaaccgacuagagaaggcuuuguuaauucuugaaccugacccaggggaggcguugcuguacccauggguaugaggcauugggguccuugucaauaguacacauuuucucagagcuuugguuacccacuaaggccagaaaagggucagaucccauggagcuggaguuacaaguggcugugagcuaucugguguguggucuggaaacuaauucuaguccucugcaggaacaaugacaccagguucuuucuguacaauugagaucauuucuugguuacuuaccaugcccaaggcaugugcuaugaaaauagaagucauucuuuaguacugagauaauaguaaauauuaaguggaaaaaaauuguacaaguucaguacagacacacucccccccccccacugaauauuuucaaaauaugguugguugaauccauggguauagaauguguggcuaacugugcugucuuuccagugggggcugaagccacuuaaauguaguguacagagaaguuguuccacuauuccauuccaaucuuucagucuggcuuccauaggccugccacauccagggcuaccugaggccuggaugguuaucugcaguugccugguggggauucacuaaaacccuucagcagcuccaguccucaagcauagcccccgcuagagcucaagaccuacccccaggagauggggaauccuuucuuaaaucagcucuccucuuucuggaggggaucagagcuccucugacggcagcucuuucccacuguccuauuucccacagcuguggcaaucagucccuuuagaaucuccuuuggggauuucuuuuagaaaauucacugccaaaauggcaacuaagaggaaaguaaauacguggcucauaagaccuaaccuauucuuggaggucgguaaggagccuuuuaucucuuacccaguucaaaugcaugauuaucuuggcauuagacaauguauuaaccaggauacuugguauuuugcuuuaauuuacgucuaagaguucuagccuguaugcacacaugugcacugugcacaugccugauguucaugagguccagaagaaggugucagaauccuuggaaccagaguuacagacaguugugagcugcaguguggaggcugggagcugaaugugcuugucuggaggaagagcaagugcuuuuaaccgcugacccauuucuuuauaccuacacuuugugauuuauaaacaaaagacaucguuuacauucuagagcuugggaaaccuaacgugagcugccgucaaaugugaugucugauagggaccaguucuucacagauggcaggagggguacacaaguuccucuggaccucauuauaaaggcccuaaguccacucaggaagguucugccucuauuuucuaauccuguccuaaaggugucuuccuuuaaugcagcaucauugagguuguguuccagcauaugaauccgaggagcacacaaacauuuaaaucauguaugggguuuucuuaguuaagauuaaaaaacuauugaaugucagauagaaagauuucuuucucaauccucuuacuauaauauauagaaaggaaaaaaaacacagauugugguuguucuagaaaacuuaugaagguguccaguuguuucagauuuuaauaauguccagugagcagucauaauacuaaauuucauauauaaugggaaauggcuuaacuugguccuuguguaugccaaguuaauuucagauguauuucaaucaaaagaaauucucucaugcuauaacuauagcauguuaaacauaaguguuuagccugcccuuuuucuacaaagauuugagcauaccaucaauccagcuuucgauaauauaauauaauuggauuuuuaaaguuguccucuuguaccuauugaacuuaaucaaggcuguuuuuccuuguugagugguucucuggggggggggggggcacgcaugcgcucgagagugugugcaugccaguaggucucacaugugcugggguugaagacacagguucuuccugugugugugugugugugugugugugugugugugugugugagggggauauucugucuauuaugcugccucagaauacuuacccuagcuuucugccaggaccacccugccucacugaucucuauacaacauuaugcccucuugaaggcauaaaccgaaaugucuaaugacuauugaacaaucacaaugacuaccuauccuccuuaccaacucuccauuuuuccuuucuuucuuugagaaaggacuucgagccgggcaugguggugcacgccuuuaaucccagcacuugggaggcagaggcaggcggauuucugaguucgaggccagccuggucuacaaagugaguuccaggacagccagggcuauacagagaaacccugucucgaaaaaccaaaaagaagagagagagagagagagggagagagagagagagagagaaaggacuucauaauuccaaggugaccucagguuagcagugugguugaggaugaccucaaauucuugauucuccagccuuccaggauuacagcuauacuuuaccgcacccaauuaaugucaugcgagggaucaaaccuaggauuucaugugugcuagguaauuaugcuaccaacugaauuacaucuccagaaccccauucuuuuuaagguacaugggaccaacuaccauacaauauauuguguuuauauguuguguuauugucuguuuucucuacuaaaauuagagcauugaaaaauagcaauuucugucuuuaaaaaggucauugcuguaugaccugauucuagaacaagauuugccacaaaagagaugcucaggauguauuugugagaaauauuaaucaucuuucauuaguugaagauaagaugcacugucaucaacuaagggaaggaguuaaucuugauugguaguucuuccuugagaaguauguaucuaagaagaucuaccacgagacagaaaggcuguuguaggguuagaagguuauacaaaggcaccccaggagccugggcaguguagauagacacuagguuggaauagcaaugucuugguccaucugugguguuauguuagaguacuugagacuaaguaacuuguaacaacagaaauuagcugagaguugugggccaggaaguuaccugccuguuuggucucuggugaagguagacaucuucuaagauguuuaacucugaaccaucuuacugacacucagcaucagcuuuuaaggagauaggcauucaaauuauagcagucagugugugagagaaaaaauuucccgagaaaaauggauggcaucuuucauugaaaccaucucuugucauaguucauucagcauuuguuucaggaaggcccacucaauauacauucuuaacuuucuuuagaguauaagcaagaccucuccaaccaugguuugacuguuaaauucuauuaccucuuuuauuauuaccugucucugaggcuguuaccuugcugucuggaauucaguuggguuuggucaaaugaggcacuugacagggauuggugugggaagggaacaugauucauuucucuacuuccucugagugcauuguuucuggccugucagaaguccuguuccucugguggccauaacgcuugcccagaggccccuccuccaagucuucaggucaugauggguuccaguaaaauuacccuuacuuccuucagccuggguaugggaggcaauggcuucccgcuagucaacuccagggagccucaccucgcugcugucuuuagcaucgucuacaucuauuaauaguggcuccuucauauuuguuccuuuugaccccuuugaaugcgucauguguuucaugcugggauccccuaccaauagagcuuuguaguuaggcucucuguucuaugugcuaaauuuaaucuuaacggugacagccuucgggagccaaguuugaaaaauaacuauauuuagacuuuagauuuacacauaguucacagaaugaucacuuugugagcaucaccuuugccuuaauuuuuucucugcaaacuaaaucaguagaguuuuuuuaaaggcccaauucucauaucuagguguuucucaggguuuccuuucuuaauuucuagucuuaauuuaauaacuuuuuuuuuugccagaaauccccuucuaucugauauuuuuuuacuucuuaaucaaaaugggcuauugagcuuuuagugagggcauuaaaaacacucauaauggugcauauuagcaguacagaguaaggcauaaugaguuuaauuccgauguuucuauacaugcaucugauagaauuugguaaaaauguaucccuucuguuacucucaucaccccgucuuaggccccagagugcagagaagaacagguucugcuguuagggcacuaaaucauuugauaggaaagucauccaucaggcaggcuucuacucgugugaccaguucugaaugaagaacugagcauaaugggggcuauaguccaaggugaagaauauacacaggagaauugggagaagcaucgaacaaaaacaugaguuaaaggcugaguuaagaaacaggcuaagaugaaauggggucugggugagguuuccuggcaggggaugcaacaugaagagccuugggcggagaaacugaacaugauauguuuuaguguuaaaagagcucugauacuuuuggaacagaaaaaaaauggcuacaauaaggcuggaguuguuuaguggaugccaaauaaauaagguuguuaagacuuuuuaaaggauuugagacuguagccaaaggguuuugagaacugaugugugauaaccauaggacuguaucauucugcuggugauaaggaaugacauuagucaucaaggcuugcauagaagcugcagcuagugacauuuaucaaagagaccuaacucugggaaacaagacaaagaacucauuggaagguaauuuuuauuucaagggucuccuuguagccucaucuccuuuuccuuugaucuugugaaucucaggagauuuuuauucaccuuccuuccuguggcccccgcccccccccccccccccaaggcuguuggccaccagccugagaggaggaagggagcagaggcaaaagucaggguccuuguagccaugagcauggcagaaugaccuccagagacugcugcagcgagacaaucuauuuuacuguuuuagggauagggaauuauggguggaaagggcuaauuggucaugcaucauguauguaagcaggaugugcugauugguuaaaauacaacaucuaauuaccaugggggcaggaagccagagcaggauguguguguucaguaaggcagccuugcagagagcucuguacaaggucccuuuucagacaaggccagccaccuguguccagggacacuuuccagaugacaggcagagacagagaaagggagcccccaucuugugccaaggucagaaagccaucaggucaugggagacuacaaccuuaauagcaccguuuccccaacaccuucccucucuccuucacuuagaaucagacuuaugccauuggcugacaacuuuccuaugcucugacuccuucucucucucucuucuucuccuucccccucccucccucccucccucccucccucccucccucccucugaucugagauuuuucuagcagugucuuugaauauuuaaccguguuuuggugucuaggaucuggcuaauacauuuuaagagagacauuuuaacuggagcacauuagauaagugguccuaaagaguacgagaaauaagaagcaugcacuauaaagcauauuugaaggauuucugugcucagcuaauauccugacacagcacggaaagauuuacagcaggcacaagcagcagagguuuagauguuaaagaaaagaugaaggaugugggaagauguguuagaagguaagguaugcugaugagcagacagagacauaaagguagaguauaaugaagagacacuucagaugugcgucacugaaggcucaggaaacagguuauugggguuucuauugaguuucuaguuucauauauucuuuaauuuccuguucaacgggauguauugagugacuucuaccuuagccucauauagaccacauggucuugguucuuuaauugcuauuuucagaaauauucuuuauaacacaagugccaauacucuauccccagcccacugucuuagagccuccuuagucaugacuagaggcugcagcagaaacaucuccaguuggaucuauuuucuugcacgccaugaucucaacuuuauuuauaacugaacagaauuccuuuguauauaaauguaccacauuuuccucuuuccaugcucuuucaaucaguuuucuuaccuccuucuucacagccugcuuugucuuugauuuuaauuuugauuugacuguucacuuuaagcauaagcugccaguucaaaggccucauccuuaaacuccaagugaccacauggaaacuguuagucuggcugcuaagaaaucaaaggaagcuaagagccaaguguccaaguagaccagcuuuaucgagcgggaagugaugucuucugugcuguuacccagacauggacagaaaccugccgucagccagucuggcuuuugugcaugcacacuugauuguacuuuguuuugugcauacuugauuguacuuugcucuaguuauuuugcaaguaccacagaguuuucuuucuuugaaauugaaggguaacucacaucuacuggcuucauuuuuccaacaguguauguuaacuuuauaucuuucucuaucacauccaguguuuuuuuaauuaaggcacauccacuuuuaauguacaaaguuauugcaccuuuacuagguuacagcacagaguaaauuuaacuauuguaucuauugggaaaccaagaaauccacgugacucacuucaucccacgcuucaccuuccugcaguugucuggaccugugguaccucagagggauguuucuagcgcucuguuuucuugaucacauucgagcuuuauaaaggcuaccgcucugucuucccuagcaccucucuaguuuuagaugagauacugccugacucauauguuguaauaucaaagcaaauugcuucauuuaacuaaguuuguuaaaauguuguguccuucugcugugucagguucuuuuugucuagauuguuccauaguucccccuacuggcuccauagagcuugcuuuuuguuuuuuuuguuuuguuuauuuguuuuuuugcuuacuuauuugcuucuuuaccuacuaauuaacuaguuaucuagugugcaagagaagaaauaaaaguccaaguuugacuuccugugggacuguaaaagguagcuugguuucugguugagcuaaggcuugaaaccccagagacccugaagggaagauaggagggucaccaguccccaggucccaggccccuguaacuagacacagccccccauggauuuguggccaucagucacacauggccaaugcccuaagucccuccacauguagaggaugugaccuguagucaccuaggcucaaggcagaucuccauuguaaugagguaccuacaggccuggagggcuuagccaguaagcucuccuucccagacacuccucugguauuuaaucucaggcccacccugaaaagugggauaugguuuuacucauacacuuuccccuaugacaauaaaugccuuaacaugauggacugccucuuuucaucaggauccucuguggggagccuuguagaaggccuuucugcacucccagccaucgacuccacaaacuuaggccugcugcugccagcaagccaaagacucuccccagcuggagcucccucuuugggcccccagccccgggcuaguuccugccccugacccccaccccccagcuuuuccacagcuuccagcagcgccuggaugucugagacccugagaaccagacggccccagccucaucucuggcccggggaccuccaaaccaucugugccucacuccuggauuaguguccuggggcuucccuagggcccaacggugacagcaguguggggcaagcuaggucaacuccucacgucugccuccccaagggccuugcccuguggaggaggggaugccgggccccacagcccuacaacucccuacuuacacuggcuggcuugaacacauugggauuauugcaggaaaagcauauuaaaaagaacugucagccugaccuuugaccugagacuauuaaagcaaaccauguuugucaauuagcgcccacaucauagccacuguuuuauauauuucuacagggccaugcuuuauuuguuucauuuuugguuaugaaaaugacaucauagaacauaaaauuucucuuugaaaauuucacaauuguagcuaguuuuauaguauaaaacuuggacaaggucaaguuccugggucaaacugcagauuacaagcuauuuguggaguggaguggugaauaaaagugaggauaacaaagagcaaacucuuccaaagagugaaagauucaaagaauauuuaaaucacaagaagagucauuggacagacaggcaaucgugagaaacccagcagcagcaccuagccccagccucuacuuccuugugcugggagaguaugacaaaguuuccuguaaaagguaagccacggggcccagugaaaagggaauggugagccuauccaugggguaagcucaccguucuuguaagguuugaauccuguugggaauucugguuagacaacgaguccuccaaagauggacagccagggcaggagguuuauucuggaacuuaccaugcauggcucagcccauuugggagggagccuguuguuuaagacugcuaaucugggggccugauggcaaggaacaaucauuaagucugagaugaauugacacaaccccugguugggaggugacuucauggugcauuuaccacuuggagggagggcuggaugccaauacuuagaaagcagggaagaacaauugcuuuggcaauggauagcugugggcuagagguuaguaaguuaagugguuugaauaauaucccauaguguguguuuguuuaaaugcucaguuuccaauugguggaacaguuuguuagaggagauaucucucucucucucucucugucagauuauucauuuuauuuuaugugugugaguacacuguugcucucucuuccgacacaccacaaguagacauaggaucccauuacagaugguugugagccaccaugugguugcugggaauugaacucaggaccucuggaagagcagucaauacucuuaacugcugagccauuucuccagucugcagagagcuuugagguuucaaaacacuccugccauucccaguaugcucucuugaccuccuucaugcugauuaccauuugagcucucagcugccauucauuugcucugccagcacagacucugaccuucugaaacguucuuuuauaaguugccuuagcuguggcauuuuauuacagcaauagaaaagucacuaagacauggcuugaaacuccucaguaagccaccugguuucuacuaacagcacugaaaacuuuaaaguguggauuuauuauauaauccccgcagcaaccuuucuccuaugggaaaaggaucagaaagcauugagacagauccuccaauaaaaaaucucagugcucuuucccacaccccacacuguugaagagagaacccuugucuuugacuucagccaugccacauuguagauucuggagagucucuggaaugacugcgagccugcuuaccccauaggcuacaaagcuaagguuagucagaaguggcuccugguauacuguaucaguugccuuucucaucccuaagaccuaauaccugaccagaagcaacuuaauggagaggguucuauuuugguucacgauuugaugucaugguccagcauggcagguacagggguuuaugugcaggagugagaggcugcguguuucaaucuggguagauaaugaugcaugacaaggaaaauguaggcacucagcugacguucccacuuuccuguuuuaauucaguccaagauauucgcaccaucaagguuacucucuucauaauucucuuuucaucacaugcaggcuaaaggugguuaacagacuucuaauagucaacugaggacacucaaaaaggccugugaagauguuguaacucugcucuuuaaaaugugggcucaauacauguggaacucagcuuugagacuauauuggaauuggggcaguacaaaauaaaauucucauuuguuauccuguuauacaaaugaaucuuuuauaaaauacucuuacuccaagucuugcuuucuuuuuauuaaagaccauucuuugcucggaugcuucucguucccugugugaagcagaguuuucguuaaugugucagcuuuuacauucuggaugagcauagaaaaguauccuugccugagugagcuacuaaaaagagucugaauauuugauaauuccaauagucaugaagaauucaagagagaauaaugaaaaauugaucucauucuauuuauuuaaaauuugauuuuuuaaaauuaugaauaaguuuguuugugucugugugugggcauggguaugagaguccucugcaagagcagaauacacucucuccagccugucauuacauuuaucuuauuauuuauauguuuauuuauuuauuguuggucuugggaauugaaccuagggacucauacaugcuggauaugcacucaagcacuacacuuuuuuuucauauuuuaguucaaagcagggucucuacguagaucugccuggcuucaaacucaaagauuucaaacuucaaaucuuccuaccucaacuucugagggcugggacuaaaggugugugucaccauaccuggcuuccugguuuuucaauaggugguuugguguaagguuaauagagauuuauuucuuucaacaagaaauuuggcaaaaaguauuggcaugaacacaaggaaaaauuaacgacagauguggaagaagaagaaaauuuagugcaguuuuguguggugggggaggaagagaaugagaaaaaacuagauggucugaacccugagugggcugcuuuggaguuaguagguuccaucaucuccagagaggagucaccaagguacagaguaagagguggagucagaguugugaaggaugcuuuuccuacuagaaucgauggcuguuuuuauuuaguuucauguugauuuuuuacaaagaccgaccucaagucuuccacauuuugguugccaaccaaaccauuuuuuuuuugagaaaagagacagaagggacaaaaguggagggaagaagauagauagaugaaagaugaguuucagcucaauucuuauuagguccucuucagcuuugagcacugcccccaaaagagaccaaaguaggcugugagagaacagaagauguucugaguaaaggcuauagcagcuucauacuuuucugauuugggguuuggagagacaccuagggguguguguguguguguguguauuucuuucccaggugcacagcuaaugcuuaaaauauuuuguguucuaaauucccccuucuuuaacugaaucacgagaauggauaaugcauguccgaaaagcuaucaagucagcagcugaaagauaagauaugaacauugucaaaauaacuuuacacagaagcuugcaagaagaguggagcgugaaugaguaggaaacaugaaggcucacaggcagaaaugagagcucccaaaaaauaguuaauacacaacucugaaauucuugacuaccuagcccauauuuguacgcugugauaaaacaccacgaccaagacaacucaaagaagaaagggacuuuaugugauuauagagggucaagagaccagcauggugaguaagcauggcagcaggcagcaggucacaaacaggaagucaagagagcaaacuagaaaagggaaauaguuaugaacucuuuaagucuauccucaguaacauaguuuguccugcaaaaccgcaccuccuagcccuccucaaacagugccucccacuggauuuaacauggcuuacaagauuaagauucuagauguccccagcgauugaguuauaauuguuucugaacuaaguuugugugguguuuuccuucacuuagcggcuuggcugggcuccagagagaaagguaugguggcaaaguguggguuugccugauguguaccccaaaaggacuugggaguuuugaaguauggggcuggugugguagcgaccugccaaugggcacuuagugagcaaguuggagagauuucagaguucugagucagagagucuccaugagaugagaacaggucagccauugccuguggcuugccugcaauagcauggauuuaaaaaaaaaaaaaaauuuccugcaacagguggcaaaccaaugaguugggcaagaauccacgagaaauguaagauuauuagccugagaaguagaguuuuauuuucuaagugagagaaagguggugcugggacuagucacauggacucaagcaugggaacuucaaaacaaagaaagagggcucugaggugcccugcuauagaaagagacaagauggcugcccuugucagagagcuagagaauggaagcugccuacaucuuggggcagauauugauuuaacuguaaauuuauaaaauugggauuauuugcuuuuaggauagauuuauauacagauuuuguccaaaucacauggggaauuucgccugcaguuuggaacuaggauagagaaaauuagucacugacuccaaguagagagggcagugauaauuaucugcuaugcacagguaguaguaaugucuguggcuccagguagagagcucaauagauagauggcguaacaggauggcugcucuaggcagagagcuuaacaaguaaaaacuaccugcuuccuauaggcagauauuagugaaaguuugaauuaauugcuuuaaagaugguauaaagauauauugcucuaauaagucuuacaggauacucaaauucugucuagugugggcuccacagaaauuuuggguuuaaauccugguuugacuaccugccugcuuauaagcagguauagauagaaguaugaaucaauuguuuuaaagaugguguaauaaggucugcaggauaacuaacucauauucucuaaugugggcuccauggaaauuuugggcuauuauccugcauggcaaaauagaaaaggcuuaagaauaggcacauacaauauuuuaauuuacuucauuuguuuugaauuguuuuaauuuucaaaaugggugugauguugaguuuugugguuacaauacucaucuuugagagaggucaaaauaaagggguuuuuuuuguuguuguuguuuuguuuuguuuuuugguuacuggcucaaggauaugcagauuugggagaaagguuuugucuuugcauauuuagaaaaggugauuagugucuauacaccuuccagaguaaaaaggucaaauaggaugaagggagaccuccugaagaacuagacuccagagaaucaaaccaaaaaaaguuaucuugaugauauuaaaguuuuguuuugaauagacggccuuggugagucucauagucagacaugcugaacugaguuacuugaacuccugaugucuuggacuuucaacuugaucaagucaggacacagacaucagagacuaauucaauccuugguguggccuucuuaaagccaaccaacccccccauuuucccuacccuuuccuccaccccuucaaaaauaucucaaugcccauauuccacuugaaaagagucgucgucccaguucccugagcuuuggggcuggaggugguuauucuaagguugucuuucuaaggaauuuagaaauggucauaauuggaacagggaagaaacagccagaauugauuauauagccauaaucucauuugguagaaaucuuuauaauuguuacuaaguugaagucauaauuuuuuguuuuuguauagaauuuauuuugaugcaaaaucaagguuuucauuaguauaaauuucuuauauugauacacaaauuuuagaaguacaaagcuuggacccaauccuucuguuacuguuauuauagacugaucugagauguuuaagccugugaguuaagggccaaauagcaaaugcauggcucuaaguguauuauuaggguguucucagauauuuuaauuagaaauagaugaggguaguuaacagacaauaguccagauuauuuuacauagauaguugguuuucaaaaacauuagaaauccacagaaugugacauuuaauguuauuuauucauuuguugagacaaaucugcuccuaaaagcuucccauucauagauucaaagaagcagcuaagcauuuauaccucccggugaggugauacauuguggcuagguggccacugggcagaaauugccuaccuguccugcagaccuguacuguccuugagaggaugaaagguauagguuaggacagcuuaguucugcuuggacagaauaagguaguccuuaauaauuccuguuuuucaagaucugucagcugauccugggccagaaggcugaagccugauguuccaacuuccugacuuucuggggcuguauagguaggcagcugccucuacaauuugucucaguucugaaagcuguguuagguuuccuauauuuucagauaauguuggucauuuucggauuucugaugggguugaaagacuaguuauagucucauggucauugcagacuauuuagcauugagugaauauauuugagagauaguuuucagauaauauacaagcuaaccaggaauaacauauggauuuauaaaccuuuuuaaaaguuagauaacagaguguucuauuaauuauggacuggguguuaggucuaucuuguauuuuauaaauuacaaagugguaauaguugugcacaauuuauauuugaaagaaaagguuugcuuauuuggacagaaaggguaaaauguagcagaauuuucccccaauuaauuuaaauguuaauacaauaagaagccugugauuggacagggaaaagggaggcagagcuaagauuuucagagacagagacagggauaggaagagagagagagagaaaaggaaggaagaggaaggaagaggaaggaagaggaagaugauccagauucugagugacuuuaaauagccacagguagcuaugaauaucauaaaaggacagaauaauuggaauaaccugucuaaucuaggugggcagcuuguaucaucaauuggcucugaaauuauugugugggcaucuggugaauugagaauuuaaugauauagaacucuaauuaauuauaaaaaagacaaaauauagcaaaauguugaggaacucauuacagcuuuuuaaucuaaacuugguaucaggaacaauacaauccaagaaaauguagaaaguccagacuuuccccauccauccuuugagucauauguuuggaccuaggauagcugcaaacuuacuuaaaacauugugcuguucucucucucucucucucucucucucucucucucucucucucucucucuccucuauugugcaguucuccaucauuaacucuauaugacauggucauauuacaaugucaaaaaucaggacaugucugcaugcagcugagcucugugagugcagucuguugucuagggaacagaugucugccuuccaacuuuccuuagccuuucugcuguaggcauuuacacuuguacuuuugugccucgcacagugccuagcacaggguaagaacuuaggaguccauucacuguuggaugcugcauuugcugaauugaccugggauacagcuuagguccuaacuacaaccgguuuucauuugcagaacagaauacacuuccugcgacccucuucaguguggcagcagcaaacaauuacuaacucuggcagaagagaagaccuacuuaguugcuguacaaaggugguuuucaguucuguugccauguacagcaguccugccagauuaagugacaaucugucugggacuggcugcaaagacaguucugccucuagugguucaguagguggcacugcugcucucugugugcuaaagguggcugccuugcagaggcugugucugggcaggcaggaaggcaagccagcaacucagaggaguguuuuuaggcaaguggcagcacaaacccacuaugaaugugagggaaaagccacugucaucugccccugcuugcaguuuggggggaugggccuuagaaucugacagugagguuggagaugucaaaacacgaagggaccugaggggacuaacauaagcaggcuacaaaucagaugucuguucccugcgggcacaggaggaggagaagcugggaagcugagcaagcacauaggccccucccuuggggggaaaaaugccaguuuauuuaacgucucaucuuucagacugucuugaauugguucagauuuuuaccuuguuggucacuuugauccguaguguuuuauuuucuugcugauagaagagcauuaggccuucuaugcaguaucucuguucgacauguagucacuuaaacccuuuauuucccgacagccacaucucaacugauguuacgcacugaaugcuugaugcccugcuaaguuucuauauggaaauucuuaccuccaacaugaugaugcagaaggguguggcguuugggaaggaaugagaucaugaagacaucggccucacaaagggaguuaagauccucauugaaggagaccucugugagcucccuaguuucuuucucuguguugcuacaauaugaagauggcugcgggugaggacaugagcccucuacagacaggaaaucuuucagaacaugacuaguggacuuccuggacuccagaauuagaaguaauaucuucuguuuguuuaucacccacacaaucacugguaucuuugucacaguagccccaaaggacaaagacaaucgacagcaugcuuucuuuuuucuaccugacucaaacuucuaucaaacucauaugcaaaguaauagaaaaguuugagucaaugggaugcauguuuugcuaauaauuuaguuaauggaagaauuaucugccuuauuaacaaguaugcuccuuuaaauguaagagagcacaaagcaacugcugggaugcucuacuugucaaucauuguggcugagcuuaacaaaugcuugucauguaugcugucaucaugucucuugcuagaauaggcacuauuaacuugguacauuuuucaccuaaaccaccuguggucucagagucauugucuggucucacaaaugacauuauuuccacuguacuaggucaugacaaaaaucuuagcaaaauuaaccaaauaauauuccacaauugauucuuagagaaauaagaacucaggccaauuuaguggggaaccauuuaacuugagcucaagggaaaugugaucaauuaucagaauuuuaggaugaagagauugauauucaaacagcaagcuugccaaugcucacauguaaucuuagcacuugggaggacaaaacugagaggcuaacuauaaauuugagggcagccuggucuccauaauagcaaggucccaaacagcuuauacuauacacaaagaaaaaaugaaaaagaaagaaga

SEQ ID NO: 5434 - RNA, 2068 nt, Mus musculus
cuuuuuuuuuuuuuuuuuuuuuaauucaagauucucuuuaauuuccugccuaaaggcuccucaaccauaaggccgcaucucuuguaauaaaaugaauucugauucgagcucugucuccagcagagcgucaucuccggacauggaugagauguaccuaagagaccaccaccaccgccaccaccaccaccaucaggagagucgucugaacucggucuccuccacacagggcgauaugguccagaagaugccaggggaaagccucucgagggcaggcgccaaggcugcaggagaaagcagcaaguacaaaaucaagaagcagcugucggagcaggaucuucagcaguugcggcugaagaucaacggacgcgaacgcaagaggaugcacgaccugaaccucgccauggauggucugcgcgaggucaugcccuacgcucacgggcccucggugcgcaagcucuccaagaucgccacucugcuucuggccagaaacuacauccucaugcucaccagcucccuggaggagaugaagagguugguuggagagaucuacgggggacaccacucggccuuccacugugggacuguggggcauucggccggccacccggcacacgcagccaacgcugugcacccggugcacccuauccugggcggcgcgcucuccucuggcaaugccucguccccucuguccgcgaccucccugccgaccauuggcaccauccguccuccccacucacugcucaaggcgcccuccacgccgcccgcgcuacaauugggcagcggcuuccagcacugggcggggcugcccugucccugcaccaucugccagaugccaccaccgccgcaccuguccgcucucuccaccgccaacauggcccggcuuucggcugaauccaaggacuugcucaagugagccacgggcuggcccggccgggaggaggaagggagagcugaggcaggggucgcagugccgggccaggagggaaagggagacugcucggccugcgggagggugggcgcgcggccccaggccucgccagcgcccuacagauccagauuccaguugacccaccccagcggggcgugccaaaaccaaacuggaauaccuagguguuagcgaaggggacuggaacccgaaguccuguuuugcaugcaugcuucuuucccucaugccacgccaguauuucucacugugguaugcucuugucaaaacugcauuuguuguuuaacgaugggaucaguggaguuuaaaacuugcaaaggaacuuuggaguuggcucuuucuggcuguguucuuaucuuggaggaaagauggcuaucccuuuugugcaaagcaaauguaaauauuucaucgagcuagauacacuuaugauugucucugcccuuauagauuuuucagagacaauggagagagagagagagagagagagagagagagagagagagagcuuguuucagaauccaaguuuugauucucagcccagggcaugaaccucuuauguggguuuuccuuuccacgcaaacauaggucaagaaaaugcaugcacgcuucuaaaugaaucuugucuaaacauguugugcgggcuauagcgccauuuuccuuguaacaaggauuuauuagugagcucuccaaaguacuccauauaucugucugugguuguauaaaaugaaaagggggccagagcacagagauucacacucaaugaacaugugauucuucccccaagcccaugucugucucugucccucaaaucucauuccaacguuagggcuguuccaaggggcccacuacaaaaccgggccuccucuagaaguucauccuacccccuugccaaauuauacugcaugcgggguugggucgguuaccccucagcuuugaaaacacacuggguuuuuggggagggggcugccacuuuuauuuuccugaacauuugcuugaauauuuuguuagggccucaaagacaauaccugucuuuauuuuuuauauauucuugauaaguaugauauauuuauuaauaccaguguuucuggaugagauuucaaauaaaagagaaccuuuaaauccggu

SEQ ID NO: 5435 - RNA, 18283 nt, Mus musculus
cucaagcuuugguuuuggccccacccagcuccccggcaggccgcuugcggacuuggcgacuagucugcggcggacgugacgccaaggccaggccacgggcagcgcggguccccugucagaggugucccucgcgcaggaaugggcccgcaggcggcagcuggcaggaugauucugcuggugguccugaugcugucugcgaaggucgggaguggagcuuugacgagcacugaggauccugagccucccucggguaaucucuccgagccgcugcgggcuggggcgggaggccaggccggaggcgccgggcugggaagucccugcguuccugcugcgccgcccugggcaaggcagccccaaggggccccgggggcuccgcgguuuacacgccgcuuucgccucuucuuugccgacacaacacaaaucuguggucuguuuuacaguuaguuuccacggcagcguuuggcauuguguguaugacuuacagacuuuauuuucaaucuguagucggaauccucugaaggaaaaggggugccaacggauacuaagagauucugauuuguuuguuagucuggcguuuaaguguugagaugcaaggguucuucucguagcuuaaauccucagagccuuugauuucaaaugauuauauauucccaggacauauaugcugggaauaguuccucuuuaugauuagagcucuagagacagcaauaaaacuuuucaugcccuuccagucccuaaucguaaguaucugagaaguucccaaucuccagcugcuggaaggcauggggagaccucuuuaacucucaggcgaguuccagcucugaaccccuccuaugguuuccaggagcuucaguuaggcgugcagauuccaauccugccuugaccugauuuucacaguagcuaggauguaaccaccuagaugucagaugaaggaaaugaggugcauguucaaacugaaguuccacugagcuauagagaaaaaugaaaucauaauugcagaacaguggaaucagaaaaaguguuaguuguguuacacagccagauuaaaaaagacaauuaccauguuuucuuaugauaaaucaaccccagagaaguguguguaggaaaucaugagaggggaggaagagaucuugaggaagaagaguuuaaaacaagcaaaagcaggguaauaaaacucaugggacauuaauguagaagagaggacucuugggggaggcaggugaccagaaacagagagccaggagcaacuaaggaaugaaucagaagcaauaaugguauguaugcaauauguaugaaaaugucuuauuaaaaucuugugcuuucauaauuuaaaauuuuaaauuaaauauaggaugcauguauggaaaaaaauuaagcaaacaaauccuuagacaucccuuaggauagacaugguaccaagggcuagguagaugaauuauaguuaugacuuacugaaugcugggcacugucuauuuucacauaacagaucuauuucuacagucaccucuacuaaaagugccaccgguaucugcauccauggugaggcacacggggcugcccaagugguaggagccacuuacuaggugguagaguacaaauucuuaaccaucccacugccagcaauuaccagggggagucgccugucccuguuguccauugaaguacacugugaucagagauugaauuuacuuucaggcugcuggaaaucaagacuggguaccuaaccucauucaggggacucugggaagacuuuuucagagagauguagcuuagaaccagaggcuuagagagaaugugcuugcagggauaugaagugguauguucaacuagugggagaguuuuaacagacuguguggcaggagagaaauaggaaaccacuggaauucuuguuguguauuaauaucaaggaauggaaauggggcuuuaauuggcuuaacccaaaacagaagguuauugguucagagaaugagauaccagcuuggcuucgggaaguuggaacacaagaaagcuaccacugaugagcagugguugugcacaccuuuaauaccagcacuuaggaggcaggggugguggaucucugaguucgaggccagccuggccuacagagugagucccaggacagccagggcuucacagggaaaccccaucucaaacaaacaaacaaaacugaagaagaaaggaggaggaaggaggaagaggaagaggaggagagaaggaagaggaggaggaagaggaggcagcagcuaccauguaccauuuuuuauuucuaguuguccugguuauugacagauucccuauuuggcaggaauggugugugcugguagccuuuggguuuuaaaaucuugcaacuucuucugucacaacaaaaaccccagaggaaggcucauuucccuagcuugguugggugccaaccaagugggaaggacauuguugaaaggugugguguggaggaauucucagaaggagaagcacacuguuccugaacaaaguucagggcccaagccaggaaucuaaugugcccagcaugguuggugucgcugaguggugugcaagguuagagaaugcuaguuagaagugccaggcaucaucauauugaguaguuuaagggagagaguccauuagggagcucaagugucaggagaugccaugaggaguggcuguguaauggaggagaggggaaagcuugcaggaauauugaggagguggggucaguuggacucugacuggguguggguggagagaggaacacagcugccuggcccagggcagagccuuaaaccuagugccagguacuucccucuacuuuagauccuccucugugugaccucauaguuugcacccgcuaugguaacaccuaugcccuucuguguuguaccccagcacuuuauaaugcauuuccuuagauuuuugucguguucccucugcuguuuuuauuuguuuguguauucugucuugaaguggaaucucauauguagcccaaacuugcuucaagcugagcucccuggugcagcucccugagugcugggauuauuauagccccaggccagaacaccaauuccuuuugcuuaaagugaagauuaaaguguaaacuucugauucacagucucuacagauuuugaaagaugacauuuugauucuaaaacaaacaacaucaacaaaaccucuuagagauugaaagcacauaaaaguuuuuaaaaacugauauccaaaacuuagcaacacacggcaacaguguaaauuuuuacaaacuagaugagcaauaaauggcuuugucauaauuguucgaauaaugagaaugagauuuuggucagaacaaaguaacugcuugagagcaaggaguuagucugugugcaauuuucuugugaaaggggaauuuuacuuuagcugucccagggauucauaaucaaaaugcacaguauccauuuuuuccuguccaaguuacagauguuucuuacuguaauuuauuauucuguuuuuguacuguauacaguugugauggagccuuaaaaucuagcauuauugcaugagauagauguuugugaaauuaucagaaaacaguuauuuccacuuguacuuuauauguugagcuuacaucccucauuuuauuaaacaguugcgaugcuguuuaauuaaaaugaacaaaacguugcacacugucaucuuuaccucccuucccuaaagcuuuguuuucuccuugauaaaauaugucccguaacuauaugucauucccaggaugugcucaaugugggugucaucugagaugugcucuguggagcuugcuauguaugaauuacugucacuuaacgcacaucauuacuucaacaaauaguuuuaaauauuagaauauuuuaguuauguaugaagaugugcauuggcuuuuugaaaaauuaucuagaucaauauaagaaauguaaaauucauucaagagcaaacacucauuuuucuacaagucacaugguuuuuuuucuuguuuugucuugucuuaaacuggggcuggcuuacagggucagagguuuagccuauuaucuucauggugggaaacauaacaaugugcaggcagacauggugcuggagaagaagcugagaguucuacaucuugauccacagguagcagaagugaaugccacauuaggccuagcuugaguaucugaaaccucagaaccuguccccacagugacacacuuccuccaucaaggucacaccuauucuaacaagaccacuccuccuaauagugucauuccuuauggggcaagcaugcaaacccaagccucuauggagaccauuccuauucugaccaccacauuucacuuccugagccccauaaugcagaaaugcauucaauccaacuugagagguccccacuagucuguaacagucucaacccuguguaaaagcucaaagacuucugauauugucggcagucucuuaacugugauccccugugaauaagacugaaaaagcagaucacauaccuccaacauacaguggcacaggagaggcaucccauuccgaaugggagaaaagagagcauagcgggaaauacugggccaaagcgagacugaaaaccagcaggcugaacuccacacccagcaucuccaugucugacgucaaagugcucuucacaucuccaauuccucucagcuuuguuggcuguaacacaccucucuuucuugggcuguuuccacucucugauagcucuccucagcaggaauacugaagcaaggaagacguguuuugucucacaaucucaggggugcaaucuaucacaguaaagaggguauggcagcagagagugggagucggguugccacagugagcucacagucagauccaugagacagggagaaugcucagucuuccuucuuccccuuucucauuuaguucacucugggaccccuuaaggcaguggcucucaaucuuccuaacacuacaacccuguaguacaguuccucauguuguggugauccuagccauaagaguguuuucuuugcuacuucauaacuguaauuuugcuaguguuauaagucacaguguaacuauuuuuggagacugaggguuaccacaggcgucacgacccagggguagagaacugcugacuuggagugacaccuccuacauccagggugggucuucccuccucagauaaacugucccagaaagcgcccucgcagacacaugcagaggugccuuuccugggugacucuaaauauauuagaggacaguagagauuaacuaacagcucauaucaugacuacauuugcauaauccaaagagaaucagaacucuccuguccauuuuccauaaaaacacauccuauacguuugcuuugauugaaauaauucaucaccugcugcaacugacuuccucuuuuaugcgcaugucugucuuucuaacgucaucugaucagguuuucuguuauugauguugguuucuuacugugguccauuuuguuucugaaucucuuacagugccuguaccgacgaauguucuaauuaagucuuauaacuugaacccugucguaugcugggaauaccagaacaugucacagacuccuauuuuuacuguacagguaaagguguauucguaaguaucauucauuuauuauuucucuucuguuuucaucugaauccuugcacauuccgucauccuuccuucugugaccgcuccucccacucgcugaacuugucagcugucuguagaugucacaaagaugcuaaggaugcuguuaauagugaaguggaguuuguuuguuuaauagugaaguggagaaacacgacuaacuuccaagguuucucucuagucucuuaguaaacuaggauuuauuaaggaacuaagauuuuuuuuuuauuauauguaaguacacuguagcugucuucagacacuccagaagagggcgucagaucuuguuacagaugguugugagccaucaugugguugcugggauuugaacuccagaccuuuggaagagcagucgggugcucuuacccacugagccaucucaccagcccaaggaacuaagauuuauuaccaaggaauagguauaucgggugauggcagugagggcagacaccacuugacaguaguuuagcagugucuuguguaagaaggaaccaaccugaagccauuuuugaauaaagcuuccauuuugaauaggggucaaauaaaguuuaagugucugagaccucccuggguaacugacgccugcucggcagggagagaucuguaaaugaauaacugacauccugguugagacacgaauguuaggcaagucaccccgccacuguugaauaaaccaaccaaugagacgaggagaagcauaccgcagagaaauguucugagaaagugcccuaucauuaaauccuuacugguggaaaauaugugacugacuugugcagauguuugugguuugcaagcuuaaaagcucaaacauucuggcauucucgagaucucaguucagcucccgagucugcgcugcaucccugaucgaucaguagcaccuugaucacaacacacuuuucuauucugcauugaccuggcguuugaguuguguuagacccaagcagaccccauaacacuagaaauaaauacuuacagcucaaguggacucagauggaaaacaagacuucaguguggauuugucuucucaugauuuaauugagguugcuaaaaggcagucuuuauaucuaucauauagaucauggucaaugacugucccagauuuggugucaugcagccuggucaugugacaaagguguuagcauucaaaucuguccauugcguuuucuucuaaguaaauaaucuguggacagaacuccaugaggucgugaauacccuguuccuacacaaguccacagauauuucaagaguuauuauagcucugucagaguuacccuugcugcaaugaagcaucaugaccaaagcaucaugggaaggaaaggguuuguucgacuuaacacuucuaaaucacuguuuaucagaggaauaggucaagacacgagcuuaaacagggcaggaaccaggaagcaggagcugaugcagagaccauggaggguacaguuuacugccuugcuccucacggucugcuuucuuagagacuucaagaccaccccagugaugacaccacccacaguggacugggcccucccccaucaaucucgaauuaagaaaacauuaaaacucugaacacugagguaggcagagacccucauacauaauuaaugugaaugcaaaauagauccuugcauggggaaagaauauguaucugacagaacuuaaucugcuugccuuggcacauuuuuguggugcugaauaucaaacccaaggcuugauagguacuaggcaagcugucuacuucugcgucacacccccagcucccacgucgcauuuguguuuguuguaugcaugaauguauguucauauguaugcaggaguguauguauguguaugcacauacauguggaaggugggaacgaccucaaauggauuccugaggcaccauuugccccagagauugccaaacaggcuaggugggcuguccagcaagccccaggcaucugucugucuuugcuuuauuagcgcugggacccugugagcaugccaaaccuggaggggggcgugguuuuguuuuguucuuuuguuuuacaugggcucuggggcuugaacucaggcccucaugcucuccauagcaagcacuugauuggcugaacugucucuccagccaguguuugccuuuggaucuguugauuccauauuaggagcuuaccggaaagauacacaacuugagacugaauaggagagugagcacacagcugcuacagaaagggauuaacgcaguagcuuuguaaacuaugaagggguguucuagggagcuagauguagugauuuccaggcuuuguuguaaauugaaguaaaaauuaaguucuguaagacauaaggcacaugcaguguauuccuuuggggaagaaaugaaugagaugagcuguugguguugucugaguguguaaacagcacaggaaaugaaaaccccgaagccagcacaugagaucagcuuccuaaagaaauggguaacaauguugugggaacugauaggaagaacaucuuguuuucuuuugagaaauccugauuucaggguuaagccaaggaacaaaaucaagauuuuuuuuuaauggagauuucagagaauuuggucuguuugguuugaaagauuuuuguucugucuuuuuugggcugagguccaacuuguucaaauaaauaggcauucuguguccaagcaacagcccccgccugcaaagacagaaaguuaauuagaaaguuucccaaguggcugacagaugcuggggacauguugaagagauccaauaggcaucuugaaguaggcucguauuggccaaaggaugggacagcguaagcagcaauaucaauaagaacauaauaauaagaaagaaacccauaucuauauuuucauuaauuaacaaugaaguugggauaaugaaaaguucuuguguggacagggaacuucuaaagcauuaacuguggcaagcgaagcugccaccccagcuaucgucuuccuguaauaccuguaacauuuacuaggaagauaauuuaaaaaagaaaacaaaacaaaaacugaccacagugaucuuuguaauguauuugauuuuguaauugaaucacaucuuuauuaauagaauccaucauggcuuuuuaagcagaguucaaaauuuaaauaugaaauauacuguauuaauccugucucuuauaaggaauuuacagcaaggguuaaguacaccuuaucucaaaugcuuaagacaggaauauuucauauuucuuggcuuuuucagaucuugaaaagcucucucucacacccacaccacaccccauauauauauacacauauauauauuauauuagaagugggaguuggguuauauauacuguaccuacauauagccugaaaguaacuuguaauuuuuauguuguuugauccauucuuuaaauugaauuuuuuguaaacaguaaacccagggcuuuguacaugacccacauaauuuaccauccagcuacuucccuagccuaugugauauuuugaauaacgaauuucauacaggaaacaaacaacuuuucaugauguagcauuuccugugacaucagauacauggucaaaaggcauggauuuuagagccauuugaauuucagaggcuggaaauguaccucuaauugaagaauaaggucucuuccuuucaucuggcgucuuuguccuguuuuaauccagcccuucaaagaagcuaacuggauggaaaucaagacauggguggauagccaaagucugugugauaauaugggacagcaugcaucucuucccuuuuguuuuagggguuccuggacugauuccugcaccaacauuucugaucauuguuguaauaucuaugaacaaauuauguauccugauguaucugccugggccagaguuaaagcuaagguuggacaaaaagaaucugacuaugcacggucaaaagaguuccuuaugugccuaaaggguaaguagauuguacacauaaguaacuuuucagugaguguguguguguguguguguguguguguguguguguguguguauuggugcuuuguccacauguguguaccacauucaugcaguacuuguguguguguguguguguguguguguguauuggugcuuuguccacauguguguaccacauucaugcaguaccuucagaggccagaagagggcgccaaauccugucacugccauuacugguaguuaccaacagacauauggaugcuguuaaccaaaccuggguccucuggaaaugcagccauugcucuuaaccacuaagccuucucucuagcuccuacauggauacauuuuaauuuugaaguacuuacacuucccuguaugcuugcuuuuauugguaguuguaacaagugucuaacagcauaugacaauuuaaggagccaaugucuuucuuccaggccuuagaaaacaucacugaacuggccuucaguuugccacuuuaaaacugcuuaucagccaguucauucagguccugaccagcgcugcucagugcuggaggacaucugccuuucucucccuaucuacugugaaauucauuucaacguuacuucacugaggacuuggccacugggcucauuccuucuaccuuccuuaaauccuuggagaccuuggaagcaaaaauaccaacauacuacaugaacacuuuuagaguuuaagcagacuguggugguccauacuuguguaagggagcaggcaggaggcucagguggggaccauuaggaguuugugaaguguuugaagccagccugucuaaggagaaacagauguguagaguucuuuaugucugaguccaaggcuuucagcucuuugcacucccagcagccuacccuauaauuuacuggucucagcucucacuuccaacugcagaauacugagucucagaucucugcuguggugggacaucccagcucaggcuaugcccuagccugcuggcccucauggcaucccuuccagcuucccuuccuaguucacccucuaugacucucacuucuuccauguuucgugccuguaggguccacugccuugguucuaccccagcuuuugggguaccccgggcuuuuccgugggcccuuccuuuacuuaauuuagguauuuuuuauucucuggauccaucugauaugugccaucaucaugucagaguugcccaccacagauuuaucaaggaccuacugugucucggagaguaugcuagggauacacugaagcgucaacaccagaccugaguggaagaguguaugugcgcagugcaucugagaagcauauaccaguguucaccaaacaaccaaacacaccagagacccagaauauguccagacuacuugagucugcaguucugguuuucagagcaaagaagugaaccauuagcaaucuuuuauagaaccaucccaccagacauccauggauguuaaagacguuggguuucagugagaaaaauaaccaaggaucguucuaggaguuguacagauggcucagugguuaagaccauuggcuguucuuccagaggaccugguucaaaucccagcagcaccuauauggcagcucacagccaucuguaacuucagguccagggaacccaaaacuuucuucugaccuccacaggcaccaggcacgugcaugguguguagauacacaugaaggcaaaauacucuuacacauagauagauagauacauagauagauagauagauagauagauagauagauagaagagggccuuuucagaaacaguuuuuagaaaacagguuucuuaagcuacaaaaauaaaggagaagguauuuccuugggugucuauuuuguauguuuaugugguagucagguccugcggaaugaaucuuggaccuuacguuacuuggcaagugcucuaccauugagcaacaucuccaucugcuguuuugauccugacacuaauuugccuaggcugcuuucgaaccguuuucagcugcucuucuacucuauccuggacaaccaguccugccuuucaucuucgaaaaagcaacauuuaucacuaaucauacuuuccuaaagacaaagucagaggugaaguucaaucaccgaggcagaguguagguaaagagcuucuugucugagauuuacuaagcuuuguauucuuagaaugucuuggagaucuuugcaguuguuuaaauguacccauugauuuggguagacuuuguagcugugcugggaggaguuacacucucccuuucucuccaggaaaggucgggcccccuggccuggagaucaggaggaagaaggaagaacagcucuccguccucguauuucacccugaagucguugugaauggagagagccagggaaccauguuuggugacgggagcaccuguuacacauucgacuauacuguguauguggagcauaaccggaguggggaggugagugcgucucugccaucuuccuuaaaaguaggaauuggucuauugcuugugcaagcuagucucauaaguuguagugaaagcaggccauucauguggaugcagauaagacucaugugucauagauucugauaagaaaaaaaccaacauaaguacuauugaagugacccaaaauggacuuaauugccaacacuggccagaugaaugcacuuacgguuuuucuuugccuguuuggucucagggcccucucuagaacauuacucucucuguauacccauuucuuuucugguaagaugaauaucaucuuaggguuuuuccuuucccuuacuuauaauuaauaugcagaauguaaaauaauauacaacugugauuucaguuauuuuugaaagauaagcugacaguacaucuacagugccacgacuauauuauucuggcagcaauauggaguccacacuuugauucaaacugugcucccuccauucugugcauugcuuuuuguaaguauaguauuuauuaaguccauacuaugggccuucuaaguaccuagaacuacggaagugaacaguacagacagacuggggaaaaucccagugccgcagccuauggggaugggaacccuccaggaaagcugggaaccggggucccugcuaggguuggaggcugaucccugcagcuaugucgaggggcaucauuugaagccuaggaccgaggaaagacagaggugcaguuggcauacaggggacagcagcacagggccagggguuuggggagagaggugccggggcagagggaggcagagcaggcauuggggagcuucacuaguguucuucucuccggaagugcugcucgcccggaagugcugcucgcccgcccgugacucacuggaagcaaccugcgcuuccccagaaugcccuuuaccguuuuccgucuguucuucgggucagggguugucaccuccucuucguagucuuuccacacugggcagguuacuucauuuccugugguccaguugguuuuccuaggauuccccgugcaguacuccucacuuucuguuacgcuguuucuuaccucuugucugcgcuagauuguuagacacuaaauuaaauggacgcuggaguacaggugucggucauccuuaauucaccugaacacucaaggugacaacgaggggacguuuauuuagcucaguuuuagagacacaaagugugcuguuugcaucugcucagcucuggagacagcagacagggcaucauagccagcaggacuuguacaaaccacggcugcuuuuucucccauucuucugcuggcagccaaggcaugcacaccaaauuauacaccauuuuucacaagagauuucaccucaaaccagagcagaaacaggagagguauccuuguggggugggggaggggucucaauacauccaagcacaugaccuaagggacuuguucaugauugacacaucccugugaccacagaucugacaaacaccauaacggaguaaagauuuauuuugacuuugaguuucuuagggcccaguccauggucaccuugcuacauauccuugggcaggacaccauggcggcagcaguguguggcaaaggaaaugagagaaugaggcaggcgaggccaggacaagacacccucaagggguaaacuucaagugacuuagaccagauugaaaccuccuaaaauauuacuaccaacugaagacccguaagggacauuuuacacucaaagcuuaacuucccacugagggacugucucuuaaagaccucagccaggugcacccucagacaccagcccuuuaauacacugcccuucccugcgaccuagccaagcuacaacacugucuuuguguguccgggccccagcacaggacugagcucugacuguacaagguacuacaccagccaugguuauguguuuacugcacagaaagccuguggccuucacagcugccuucaucugcuuccugugagaugcuucuccgaucuccucagcggcuucuaggacucuaggaacgagaaccaaguacgggcucauccacagccagcuaaaacuugcauucuucaaguuuuaagcaauccuguucccauacacgucgcuuuccagcugauguacuuucucagacuguguugaagucacagguugacugauuauaugcuaucaaagcugauuuuaauuucauauucacucucuacaugucuuccugcaguguuuaacuaggacagaugcaacgguuuccaccccccugggguuaaagaagccauacacuuucauauuguuguuuucccauuuagauccuacauacgaaacauacggucgaaaaagaagaguguaaugagacucugugugaguuaaacaucucaguauccacacuggauuccagauauuguauuucaguagacggaaucucaucuuucuggcaaguuagaacagaaaaaucgaaagacgucuguaucccuccuuuccaugaugacagaaaggguaaguucuugccuuuccccaacugaagacagugcugagguggggcaacuugaaaauaagaaaguugauuuauaacuuaagcacgugacuuuucuuuaaaagaauaucuaguagucccuuuccucggagaagcucaaaauuaaaacaagaugguuucucaagcauugacauauacuguguucuauagcagccaacuuacaaagcgccuagauggcugguagcaucuugaccgcaagaagaaaagauacacaacaaauagauacaauuaucuacauaaauauaucuauuccaagucauaauuuggaaauauguuaacuugagaagagucagaagaggaccauggaaaugucuguggguguaggaagcaugagcauuuagaauaguuugaagucccacugggaaaguggcagucccaggguccccucuggcucucagggccucaucagaugcgggugguuggccagauuuccagugccaggcguggcuucccuccugucagccuguguuccauaccaguucagcagcuguuaguuacccccaggauaucaauaccauggcuucagcuuuguggcugucucaccuggcugguuccugccguguuucauauaugucaugguuggcaggacugcugauggguuuucuuucuggaggccugcagcacugggaagagucugaccuagcuacgaggcacgcugaguucucacgcacacugcccaguuuguaccgcgguucugaugaucuugcugugaucacuugcugaagagcggcaguaagacuucugaugugcaaagcaguguccuugacuuguaacuuguggcuguuccuuuucuuuuuagauucaauuuggauucuggugguugcuccucuuaccgucuuuacaguaguuauccugguauuugcguauugguauacuaagaagaauucauucaagagaaaaagcauaauguuaccuaaguccuugguaaugcacuuaacuauuuauuuaauuauagaugcuaacguaucaauucaaccuuuguugacaaguccccucaccacucaguaucauuggaaauguacccuggcgaauagcacucuauuuaacuuuauuguaguucucuucgcuaaaacccaccaugcgccccaagccucauaucuugcugugcaccggguaccuuuguauaauuuucagggugaaaacugacaaguuuaguaaggagcuaacggucuccagggaagagaugacaauggcucagucaguguaagugugugagaaauagguucagagccagcggcagagaccuugcugcacucugaagcgugggguuagcuaugacucuccaggaggccacagugaagcucugguccuaggagcagcaugcgggagagccagggagagccagcccauggccccaaagcuuccaaugcacaaauaggucguugcaguuggaguuuggaagaaaagauggcccugaaggaaacugucacauuugauauuuaaguguagucacaguccagucucuugaaaugaucuaaagaaugcuuauagguaguguaaagaugacacauugaugcauacguaacaagaauggugucuaagaugcucaaggggugcaguggcauuugcugugacagaacugccucugagguggcuaugaacaaucaacagcaaguggacaguccaugugugacccuucucacuaggaggaggcuaccuuguaauacgccguccaucccauccccauuauagcaggcguguggacccgacccacagcaguggccagacagauguaacuguaugcaccuugccaggaaaugcaggcacagcacagcuuuuaaucacccuuccaaacacugauccugaggagauaauuccacaaauaaaaaugugugaaagccucaauguuuucuuugucuauuaaagaaaacauuacuguaaaggaaggcacacucgcugacaagaaauuuacacugcuguggcaucuccacaggcagcuagaagaugggguacagaagguggugugcaguuaugagauaguuaaugacuuuauuuuuuuuaauuuuauuuuuuugguuuuuugagacagaguuucucugcguagcccuggcuguccugaaacucacucuguauaccagacuggccuugaacucagaaauccgccugccucugccucccaagugcugggauuaaaggcaugcaacaccacugcccagcgacuuuauauuuuuaaccuuaaauaaauucuauuuuuuaaaaaaaggacaagcugggugugguagcucacaacuuuaaucccagcacucagaaaacagacaggcaggucucugaguuugagauggccugccuuacauaucaaauuucaggccaauaagagcuacauuguaagacuuugucuauagauaaauacacacacacacacacacacacacacacacacacacacacgguggcacaauaagagcuacauuguaagacuuugucuauagauaaauacacacacacacacacacacacacacaucaccaaggaguucagggucuucuaaugcuacauagaaacuuuaagaccagccuaggcuacaugagacccuguccgcaaaaaucaaaaucauuaagaaaagaaauguaaugagcuuauuuuaaucauguuuucugaaauauauuauuuuucccccgcacacuuuagacaggcauuaauuuuaguaauuuucucuuuauucacuuucauucuauuuagcucucugugguaaaaagugccacguuagagacaaaaccugaaucgaaguauucacuugucacaccgcaccagccagcuguccuagagagugagacggugaucugugaagagccccuguccacagugacagcuccagacagccccgaagcagcagaacaggaagaacuuucaaaagaaacaaaggcucuggaggcuggaggaagcacgucugccaugaccccagacagcccuccaacuccgacacaaagacgcagcuuuucccuguuaaguaguaaccagucaggcccuuguagccucaccgccuaucacucccgaaacggcucugacaguggccucgugggaucgggcagcuccauaucggacuuggaaucucucccaaacaacaacucagaaacaaagauggcagagcacgacccuccacccgugagaaaggcccccauggccuccgguuaugacaaaccgcacauguugguggacgugcuuguggauguuggggggaaggagucucucaugggguauagacucacaggagaggcccaggagcuguccuaaggucucccgaggccugcuggugguaaagaaacugaccuuuuaggcaguuuuucugcauugauuucaugaaagaagcuauacauuagcuaauacuaaccacauagaauaucagacuuagauacgugaauaaggauccugugggcacugcuggguccacucugcaaaugccaagacuaucaaaggaacguauugucgcuucuggcuccuucccaggugggcuagcaucugugaguuugccucggcuagccuugcuuccuacagccgccacugcuccuccacccugaucaucucacaggacaggguggaccggguuuuuuuuuuuuuucacacaccuuuguauauguaaguucauguauauaauauguuuacauguuucacuuugaacugaaagcuacucaaagccagccguaagucuaugguagaaugugauggaacauguugguggaagcuuguacaauagaacacauuggugggagcuuguacauacuuuuuuauggagcauuacuuacgauuuuuuaaguaaaauguuuugaaaccaaaac

SEQ ID NO: 5436 - RNA, 2228 nt, Mus musculus
caccccggccugcugcugagggaagaggguagcacagcuucuggggccguccaccuccugccuaguucugcagaguggaaguaccgcucuagcacaggcauucugcccuguuccccagaagaagagguagggcugccgccgucgcugcugcugcugcuguuccugcugcugcugcuguuguuguugcugcugcugcugccaccagaggggaauuucuucccgggcagcugcaggcaaacccgcgugaaauccucuccagccuuggaaagacaagccuccuccagccuggcacagccuuucuggcuuucccagccccugcacaaaacacuggcgacgagaugagagagacgagaccgcugcaccgccuaagguuccucacugcugagucucuggacuccuuccuuccuuagagauacagcgcauuuuccucuucucucccaggcaccgaauucacagcacuuaauuaaucccaggcuacagcuggaacgacagcgggaguggggaaagccauggaggaggcuucagccuucgccuucccucuucuuccucuuguuuuguuuucugggagcuuuuuucccuuuuuuuuuuucuuuuuuuuucuuuuuucuuuuugcugcuugucaaguuugucaaguggcuuagcagugaaagacuucaggcaaagacuuggggccccgcuuugcgugacucuuugagcgccccccccccccagacuaguuaucuggaagcgucaggugaggggucaaucuauggcacaggaagccuagaagcuucccagacucuggucuugcaaaucacaaggaacuuugagcaaaaaaccgggaagcugagcucuggcgugccuccgcagcagccuucccucaggagggccugguggggggccugccuugucuguucacagugcggcacaggauggggguggcuggaucccaaggaccacaguucaaacacucuccuuccuccuuccagaccccacccacucuacugucaaaguucucugcaaacuaaccggguuuugguccauuagucaaaucccuuuguaaccucagcugcccuucaaguuggaaggaaauaacauugaaucacauuccaaagcugacuggaaagaaguggauuagggaagugucagaguccuuaugcauaugcacagggugucuguuuagcuuggacacguggaucgggaugguuaaaaacccauuuucaaagggcagucaucauuuuaaaggguguuaguagggggucauaaauggccugaaaaagaaaguguggcugguucuuuucaaagagaccacacugugggcuuaauaucugggccacugacuacugcguuccccaccccagagcggagaauugaggacaacugugggccaggccucuuguuuccugagguucagagaugaaggcgcugacccuggaagucagagccaacacggcaacagagaugcccccugucgcuuaugugaaaggccuuggacauaaaggaaaguggggugguauuggcuuggcguuuuugccagcaaauuggguuuguaggaacaauuugaacuuguacauucacucagaaaggcccuguuuucuugaaagacauuguaacaauccugucuuccuccaggcucagugucucuguguugcaaaggccuuuguuuugcuuggcucuuuauuuuugcugauguacaaguuguugcucccgcucuacauuccuauggcugguugaucacacgauccuuugauguuucuuuaggggagcauggaggagauuuggggccaucucaggcuguuuuauucucacuguucugccuuccuuguguacucuguuuucaaaguugaaagcaguaaagcccaucacauuuuuucuuuguuacucuucuaaaacuaugcuuaguuaauaaguuugauuuuuaauaaugaauuauuuuuuucucuucucuuuucuuauggauaaaaaaguauauugugaacuugcuuucuuuccuaguagaugaaaaaggucaauaccucucucucucucucucuuucucucucucccucuccuccccucucccucucuuucucucuaucuaucuaucuauaugagugacuacuuuucugagaauuuuauauuaaaauauugcagcuuuucuauaacaacgacauauucauacaacccaauaggcagaaaucagugauccacucuaucugacagaugucuuucuuuaacucccucuguugagauaaaagcauuuauaaag

SEQ ID NO: 5437 - RNA, 1048 nt, Mus musculus
cucaguauccuugcuggggugggugguccaggguuucuugcuccuuggaggccauguaggccaugagguccaccacccugaugcuguagccauauucauugucauaccaggaaaugagcuugacaaaguugucauugagagcaaugccagccccagcaucaaagagugggaagagugggaguugcuguugaaguuggaggugacaaccugguccucaguguagcccaggaugcccuucagugggcccucagaugccugcuucaccaccuucuugaugucaucauacuuggcagguuucuccagauggcaugucagauccacaauggauacauuaggggguaggaacauggaaggccaugcuagugagcuuccuguucagcucugggaugaccuugcccacacccuugacagcaccaguggaugcagggaugauguucugggaagccccacggcauucacaccacagcuuuccagaggggccauccacagucuucugaguggcagugaugacauggaccguggucaugagcccuuucacaaugccaaaguugucauggaugaccuuggccaggggggcuaagcaguugguggugcgggaugcauugaugaaaaucuugagugaguugucauauuucucaugguucacacccaucacaaacauggggccaucagcagaaggggcagagaugaugacccuuuuggccccaccauucaagugggccccaaccuuuuccaugguggugaagacaccaguagacuccacgacauacucagcaccggccucaccccauuugauguuaguggggucuugcuccuggaagauggugaugggcuucccauugaugacaagcuucccauucucggccuugacugugccguugaauuugccauggguggagucagacuggaacauguagaccauguaguugaggucaaugaaggggucguugauggcagcagucuccacuuugcuuauacagagcagaaggcaguccuaguaaccaggcacccaauacagugaaaucuguucacaccgaccuucaccauc

SEQ ID NO: 5438 - RNA, 2831 nt, Mus musculus
aaaaguuuuuuuguaauaaauauuuuauuagauauuuucuuuauuuacauuucaaacacgaaagauuuuuuuuuuuaaguuagggauguaucugaagguuuaauuuaaguucuaaaaaccuaagugccuguauacccuagguaaauuaucuccaguuuuuagaacuagaaacucaagaaugaggugaauucaacaaaaccaaaaucucauuggccaauuaagauuuuuuuuaauguguuaguaauaacaucuucccuuaacaaauaaauaaauaaauaaaaauaagaagaauacacagaaagucaggugccaaaacacacgacuguaguccucacacagaguauagaaucaugcauuguuggccagucugggcuaccuaaagagacgcccuccaucagaaaagcaaaguacaauaagaauuuaagcugacagucuugagguggcaaguaauagcuaagugucagaugaugucauuucacgguuucgcaucugaaauuugacagcuuauuuuaguuugaacaucaucuuccucagccugcauuguaugguacugugaugaugugcacaugacggagcaaggaaagaccucugcagggagagucguguauagaccuuuuccugggucuguuuauccgccucuaagucauucaugagacuuugauuguguggaguauugaccuggacuugaagaugguaacuggcugaguagucaugucagcccugcguagcauguggggaagagcaugggcacauaggacagagaugugugucaggaccaaugcuuaucagaucauugauuuuucuuuuccagaaaguauuaaugaagcuuagaaaaccuagaauuacagcuacaauuugguccucaggaaaaauuauuugcacuggagcaacaaggugagugcugccuggcugaacuccgugugcccuccacucugcgccccagggaggacauuucccuagacugcagcgccucagcuuucagcauagaaugcauucucugugccacuaaucaucauuuuuuuuuuuuuacuucaacuacagugaagaagaagcuaaauuuggugccagacguuuagcccguagucugcagaaacuagguuuucagguaacauuuucuaaaacuaugcauacugcacauguucaaggauuuaauuuuauaaauuaagacguucaguagacuaaacaaaucacaggaauccuucucugcugaacuuuuucuagauucuucauauugcccuucacacacagugugaacauuugauaacaaaguauggcucuggagauuuggaaaaaaucgugcuuuccccauaauuuguuuccuuacauguuaauguucugcucuucgaacucaagcuuuccuaccucccucaccacacccgugcagucaucagaaaugucuuuugauugccucaagauaccagcucaggaugguuagagagcuauagagcccugcuaacagaccuauuaggcagcgcccucuccugucacucacugccuugucaacuuucaaguaccuugauacagucaaagcgugaauaaaaugaccacuuacaguggcuugguaggucacguucaguaagcuguccuugaaguguucuugaguagggcuguagguagaaauuaaguaaacaggagugcagugccagugaaggguggagaccacagugcauagugauguggcauaggcagccgugauguggugccgugacauuuguagcucugcugcuuugugcaggcacuggguuggaggguagcucucauuacaacugugguuuauggagaauguuuaacugggaguauauauuauauauagcacagugggagagacuugccuggaauguauacagcucugaguauaacccccauugccacagacagauauacaccacagaaacacaugggguauggggguagagaaugagaaaaaagggagaaauguuuuuagaagauguuaguaggaggcaccuguuaacguuuacaaaacuaccaaggcugcuuucccuagcucaagcuuacuagugucaagagcagccucugcgagugaacagccacagggaccacagaagugccucuaaagugaauuucagagcccagcauucacucugaguauuaauucuucaagugacagcuuuuccauucugacucuggaauuccuuuuaacucccuuccuuuucuagcucuugucucaguuuuaaauauuccauuuucaagauuaaaauuagucacauaaaauuuaaaagacaacaagcacaguuucaguuaugccaguaccacuucauaacaguguuccugggaaacgguauuugguacagauugccguaguagaacgcuucugugcuucacaauaccgugcggcguucuccuucucucccgcaggucaucuucacagauuuuaagguggugaauguuuuggcaguguguaacaugcccuuugagauccguuugccagaauuuacaaagaacaauagaccucaugccagguaggucuucugagaaucgagauaacauacaaaguuugaagcugccauucuguagaaaugacgaaacauaauuguguuuuuauauagcuaugaaccugaacuucauccugccgugugcuaucggauaaagucucuaagagcuacauuacagauauuuucaacaggaagcaucacagugacagguaacugcggcacgcguccucacuggggaucucugcucauagcuuguccugugucugcucucaaggucacccucacgaggcucauucuucacgcucacucaaauggcugugcuuaccucacguagucuccguuagcaccuggcacucgacuguacuuugcagacauuug

SEQ ID NO: 5439 - RNA, 1163 nt, Mus musculus
cgaagccgcuggcgaaguccuccuccugcccgcgggcugggcgaggcggaaguggccggagggcgcuggguacccgggcugcgcuucccugagcucgcccgcccgggguggauuugaagcccccgguuuauuuuccagcuccucguuggcgagcagcaugacacaaaugggcuuucauuuuccuguaaaccagaacugugccuggcacccaaccgccuguaccgacgagcucagcuagcagccacugggcccuuagucgugaccccggggugacggggaucccggccuuacucaucgagggcccccggcggcguggcgggagcaacagggcuagcaggacgcuggcgacgcacacucgcuggcuugaacggccgcaccgggcggagugcgcccucgggauggcuugggccgugcugcccgaggagcgaggcucauaacggccggagcgcagccgcccgcgcgacccagcucuugcccuugugggcucgcucuggccggugguggaggccagcggguuaaaggucacgugagccguuuccuuagguggcuuggccucugacuggagccacuuggccuuuugagaaugacuuagacugucaucacaggguuuagacgugcacaccuaguagggaaguuuaaguauuugagggauagccaaggaugccucuuuaucucuccucccuacucuuaaagugugaaaacgcgcgcacaacacacacacacacacacacacacacacacagcgcacucgaacguuuuaaagcccugaaggacagauuugcuucaguucucacuuuuauuuauuuauuuuuuugagcaauauuaaauagguguacuuugugugggauaggacgaacaagaagcugggugagaaagucaugccuauggugacugauuuugacagauuuagaagggauggcccugagaggagaggaaaagaggauguuguggucuggcuacacuggggcuggcuacacuggggcguggagguguuaauaggaauagggcauggcgaguauagcuaggagaaagugacaagauaaaguuggaggggaacgaagacccaaacucaucugcaccuugcagacaggaguuuggauucucucccaaauggagagcaacgggguaugguuuaaaaaacaacaacaaaaaaaaaaaaaaca

SEQ ID NO: 5440 - RNA, 1116 nt, Mus musculus
uugcucaacagccagagggaaagcccagccugugucuaguucucugcagugaugcaucuuugccacgcuaucacaaacauuucccacagaaacagcgacuggucaagagaaguccaagcuucccuguacagcuuaaugucacucauaauccuggccacucugguuggcaacuuaauaguaauaauuuccauaucccauuucaagcaacuucauacacccaccaacuggcuccuucacuccauggccauugucgacuuucugcugggcugucugauaaugcccugcagcauggugagaacuguugagcgcuguugguauuuuggggaaauccucuguaaaguucacaccagcaccgauaucaugcugagcuccgccuccauuuuccacuuagcuuucauuuccauugaccgcuacugugcugugugugacccuuugagauacaaagccaagaucaauaucuccacuauucuugugaugauccucguuaguuggagccuuccugcuguuuaugcauuugggaugaucuuccuggaacugaacuuaaaaggaguggaagagcuguaucgcagucaggucagcgaccugggcggcuguucucccuucuuuaguaaaguaucugggguacuggcguucaugacuuccuucuauauaccuggaucuguuauguuauuuguuuacuauaggauauauuucauagcuaaaggacaagcaaggucaaucaaucguacgaauguucaaguuggauuggaagggaaaagccaagcaccacaaagcaaggaaacaaaagccgcgaagaccuuagggaucauggugggcguuuuccucguaugcuggugcccguucuuucucugcacgguccuggacccuuuccugggcuauguuaucccacccucucugaaugacgcacuguauugguuuggguacuugaauucugcccucaauccgaugguuuaugccuuuuucuaucccugguucagaagagccuugaagaugguucuccuugguaaaauuuuccaaaaagauucaucuaggucuaagcuauuuuuguaacgcaauucaugaaacccauguauuuuacaguuuuuaaaagcaguuggugauugggggcugaagaga

SEQ ID NO: 5441 - RNA, 1034 nt, Mus musculus
cauggaucuaauauacauucccgaagacuuauccagcuguccaaaauuuggaaauaaauccugcccucccaccaaucgcucuuuccguguccgcaugauaauguaccuguuuaugacuggagccaugguuaucaccaucuuuggaaacuuagugauaaucauuuccauaucgcauuucaaacagcuacauucucccaccaacuuucugauccucuccauggcaaccacggacuuccugcuggguuuugucaucaugccuuacaguauggugagaucaguggagagcugcugguauuucggagacagcuuuugcaaauuccacgcgagcuucgacaugaugcuaagccugacguccauauuccaccugugcuccaucgcgaucgaccgguuuuaugcagugugugacccuuugcacuacaccaccaccaugacgguauccaugaucaagagacugcuggcuuuuugcugggcagccccagcucucuuuucguuugguuuaguucugucagaggccaauguuucugguaugcagagcuacgagauucuuguugcuugcuucaauuucugugcgcuuacguucaacaaguuuugggggaccauacuguucacuaccugcuucuucacuccuggcuccaucaugguugguauuuaugguaaaauuuuuauuguuucuagacgacaugcucgagcccucagcgauaugccugcgaacacaaaaggagcaguagggaaaaaccugucuaagaaaaaggacaggaaagcagcuaagacccugggcaucgucauggggguguuucuagcgugcuggcugccuugcuuccuggcuguuuugauugauccauauuuagacuacuccacgcccaucauagugcuggaucuucugguauggcucggguacuucaacucuacuugcaacccccucauccauggcuuuuuuuacccgugguuucggaaagcucuucaguuuauagugucaggaaaaauauuucgcucuaauucagacacugcaaaucuuuuuccugaagcacauuaag

SEQ ID NO: 5442 - RNA, 40936 nt, Mus musculus
ccccgagcaugcgcagugggcgugcuugugccgccgcccaucagcugagaccggcugcgccaggcagugggcccccgggugacagcggcuggagguggccgaggaagccggcgaggucaggguaagaggagacugcagaggcgggggagaggggggcgggagggacaccucagaacugcagcucgcuagugguugcuuuggggugcgcagagcggggcuccccagggcgcagggccggcgccucccucucgggcucccacgccccgcuccggacuccgggacgcgacgugcgagcaccggggcgcgcggcaauggagccuuggggaccggauacuaccgccagauccuggcaggcuacgaccguguucccauucucugucaacuucuccuccgaagaacagaaagggaaacgcgaugggcccuggucaucuggccacagguucguuccgcggcccagggccuuugcuuggcuguuggccuuacucacacaagcuaacuuucuuugaccuaccuugugcucguuucaauugauuuaugcaagacacauaacaagguaacaagguauuucgagaauucgcauauguguuuucuagguuaaauucagaccaaaaaaaaaaaaaaagcuuggacgagggugggaagaggaaggaagcuuuacagucaaaugcuaauuuuuccuuauagcuguuaaaauuuugcuugcauuuuauaugcauauaucaauuuuugauugcgucagaucucguauuuugucaggaauuauuauuuacaaguuuuccacaaucaggaaaauaaaaggaauuaacugugaaacacugguuugguccuguuggagguaggcauuucuuuuagguguacucugagccgcagugaacagagauugauaacacuguuaaauugugccuuguggugccgaugggucuucggcuuugcaagcugcuuucgaaguuggcccccaggcuugugacuaguuaagaacgaggcuguaguuucccagugucuggggaaguuaauagaacacaguauuaacucacugaccucuggguucuuuuccuucagcuagcucacuucuuaugcugcuccugauuaacagucguuucuaauucugauuauuaucccaaguucauccauacgcugcugguggaaaauuaugaauaauuauguugagcuauaugccacuaaauggugugugcacaaggcccugguucaguccccaguacugcagggaaauauuaccucuaugucuacuaguacugcuagauaaaacucccacaguuaagucuguguggauuuuucucugguucaguguaacuugaaauauuaaugugugaaacuguggaggaaaaaaaaucuugguuaauuaagcugaaaccaaacaguguagcguuuggauugaugaaggagcugggcaaagaugcacuuguggaccgaauacucauauggaagauugagcacccucaugauugauugucuccuaugauuccucuccuguuuguuuuaggaauugaaaacaaagagugugaaugcucccaucuucuaaguaugaugcaucgcuugaaguagaaguuacauugauagagacuucucauuucagaccuggcaucuuuagugugugauaacaccuuacugagacaaagagcuaguccucaaaggggcuggguguguaucauggaaagggccaucuacagauagaaagggacacugagaaaagcccagguagcaauaagccugaaacaguauuuuagaaauguuuauauuuacucuuaggcugggcauguguucauaggaaaucgguacacuuguucauucagacuuacaacauuuauucaggaucuacuuuguagccaaguacuuagagaauagacuaaguccaagauuuacacucccccacacaccacacauacacacacacacaaacacacacauacacacagcacacacacacaccauacacacacuccacacguacacaccacaccccacacacacauauacaccacacacgcaauacacugcacacacauaccacacacacucacacaccauacacacacaucauacacaccacacacacacacacacacacacacacacacacacacacacacaaaaauuaaaaccuggggaacaaaggaggaaacucauauuuuaugcugggcuucaugauuaagaaagugaaacugaccauuugauuugagcaggcuaaauuuuaagccagugucugcucagaggaagucuucaagauucuacaguauguccauuaguaacuacaggguaguguuuuacauucaagacucuguaucaaaauccccuuuguucauuuuuaaauugcccuuuccacacagucuugagacagcgcucacuauagguguuacuguuugacucucccgucuccucuuucaccuuaguguuuaucuucauaaaaagauaauuacugagcuguugaguugaacccugcccaguaguacuuucugugggggaugaagggaauaugugagcugucccagcugcuggccacuggccacauacaguuucuuagcacuugaaagguggccgagguggccuucuucuaccuuaguucauuuugauaguugugugcaggcagugcaggugcacaugaggagugauguaauuauuuugagcaaagacacuaggacacaaaugcuuugaguauugcagcucaagcuaggcaaugcagaugguuauagaguacaaacauuuuauaagcauagaguuaauuagcucacauguaaaaacagacuucagagccauuugucaauaacugucuauaaacauaaguguuuauuucuuuccaacaaagguaaccacuguccugguuguucuguguuuuaucugaagagccaacucuuaucuuuuaaacgucaucauagccuaacaggacagaaagggagagugccacucagaaguguuaccuccauccaggcuuguuuccuugaugugaagaaauuaccccugggccugcagcaagguagcaaguuugguuguguaguugcccagguccaccugugcuaaguuguucuacagaagcaaugggguuuagucuaguguuugugacaaugugagcuuccagauuuacuuucagaguuuaaauccucuguucaucucagcaaugccuccauuucuuugugaaaaacuacaguagcaguuaugccuccugcagagccuuucgacauugagggacacagccauaaaagucaccacauacaggaaauuccuuucucaaauuccuguucaccacucgagacagaaccgggguggucaucuccauaccccuucucuagguagguaagcuacacauagaugaaaaggggaagcucuuagaaugggugaagcccacaugucucaccaacagccgcauccucuaguuugcuuggguacagagaugagaacagcuggcugugcaugugacugucugacuuaaauuaugggaagaaaaaaaacccuuuaaaggaaaacacugagaagcuuuggacuauauguguaugaauuuugagaagagaaagcuggaauccuuugcaagaauuaacgguauucugacauuagucucugugugagggguguagguucagggcaguuuauggcugcaugccucugaugagagcccacaggugcaggagcacaucagaccuguccucuguguacaguaacaaagcacuuggucccauuaucuuauuuugaucuuggcaggaggcccagaugcuaaggaucuugcccaagguagagauuucugguugccaguuauccuggcaacugaacagucaggugaugaguucuaguaacuucaaagauauaggagagagggagggaggaagggaaggagagggagagggaggggaagggggagggggagggagagagggagggagagggaggggagagagagagagagagagagagagagagagagagagagagagagaaaacauuaaaggugucuuuuguagguagagaugugagacuuauucgugcccaugguuacaggagaaguuacucacaggguguugguguaaacugagagcacuuuuagaagccugaugaugccacugauccaagagaaaauugucuuuauccauuuaguauauuauuugucaauaaaaggcauugagauacucacagauccuacaaggaucuugaaaauacauagaagacaaacaagucagucacagagaaaacacacacacacacacacacacacacacacauacauauauaaaacauuccacucaugugaaacaucuagaauacaaaaacauaccaaguggauuaaugguucuaauggcugaaagguugggcacaaacaggagaugaaaaaugaugggaaagaacuuucuucucagaguaauaugcauuauaaaagucacacauugauuaucacagaccuuuguuaucacauuaaaaccauuggauuauaugaucugaaugguuacaguuguauaugaauuauaucuuaauaaagaccuguuuuaaaaggaugggauuagcaaaauggcucagcagguaagggcacuuguuccucagccugaugaccugagguuagucuccagggcacacauggugggaggggagaaacagcucuggaaaguuguucuuuggaugugauaggguguuucccagagggagggaaaccgggauaacauuugaaauguaaauaaagaaaauagccaagaaaaaaaaaaaaagaaauuguucuuuggucuugaugcacucacaguagcaugugugucacacacacacacacacacacacacacaauguaaagauauaauugauuuguagacugcauagaacguugccagggaaguugaugcugcaggcuaaagcuugaguuugagauugagcacaagcuaaguggcuccugugcugggauugcagguauagaacaugacaccuagcuuuucagaacugcccuacucaguuucgcccagcucuuuccauggcugcaguccuaacucaaugcuucccagaaggcagcuuauuccugcuacacugccaucgggggccagcuguuaguuacguuuuugacuuugcuuuuaaguugguugagucuauauccucgaccugguuuguguagagcaaggacggagaguggagaagacaccagagcuccugagacugucugauguccagggacaucccaugaugcgcagagccugcuguaccagcucggcuacucuguuuccucccagcacugucccccugugccuucccugcacucggguucuuuguagauucaacccagcauugcaucaaaaaugucauuuaauuguaucaugguagaacauucauacauguuucucuuuuuagcauauucccuaaacagugcauuauaacaacuauguacauagccugagacuugagcauagucagagguuaguaacucuauacccuuaucuguuggaaaucucgugguuuuuuuuuuauuggauuauggucaggcuagaccuggaaaccaagacaugugcuggagguguuuauucccaguguuagccagcauggguaacuugggcaucugaacccugggcugagaccucaccugcaucaguugauaguuuucuuccuugggaucauuguaagccacaguccgcucaaaagaacagaagagggggacuuuaaagaggagguugugagguuacguuauacagccagugugaaguauuuccauuucacuuccgcuuccuuugauaaauaauauuuaccuuuuccacauggucuagaucugucggauuugucuucccaucuaagccuuuguucuccaucuuaaucauaccuaaauauacaaaguguauguuuguuuuauaaaugcuuucuagaaaauagcaguaauaauuuuccuuuuucaaccguauaauaucccagguguacaauuugggaaauguacaugaauaacuuuuaagaauguaauuguacaacauuuauguucuuuuaggugacuccuagaaauccacauagccuaccugcaucugaugaaaucagccagccagccaaccagccaugucuuacacuccggggauugguggggacucugcgcagcuagcacaacgcaucuccucuaacauccaaaagaucacacaaugcugugaguucaguuucaaauugacuucauugcuguucucaauucuuacucgaaguuguugguaguugauaaaccucgagcaauuaagggaagagggaagggggagcauuauaagaacacaauugaaguagcuagaaggcgucagaguaaauauggagggaguuuaauagaaaugcagagugcuaccaaggccugaguugcacuguuuuuuagugagauaaagaucacaggucgguguuuacauuuccucuaaggccgucuggauauugauggugaggucugcuggcucagucucauagcuuaagaugcagugagcucugcucagagcucaaaagauugauaucuguuaggaauaaaaucggaauagauugugcucagauuaauuuuguacuuaugaauauacaguaugaaauuaaaagaggcaggaaagacagaagcagguguuuaagguuuugguuguuacuguuguugcuguaacaaaauacacacagauggauaggcuauaaaggaauacguuauuuagccacaguuuuggagacaggagcacagcucagcaucuuggcuuccggugaugaccucuggacacgaaauaucaccuggugggaagggaagcuggugaggggagguagcaacacucaccauaaugacugucaccuucaugaagaccagucuaguuccaagaccuagaaauguacugaugaccuuucaggggcauccuaacacccugacccugaccaacucuaacccuaacgcacuugggaaucaagccucagcauagcauucaaacuguggcaggaugagacacuuuaaucuguggagaaacguauucuagaagaugguguagauuccccaagacuuucccuuauuacagagacagccaaccaaaagagccaaugugacguuuaccccucagcacauacacaugugcauguguauucauaugcauacagauuuagguuuuuaauuccugaauuacagauaaacacacacucuagaauacuguagccaucuuuuuguuggugcuuugacuuuaaaacauugccagauucuauuuuuuuuucuuuuggagauagggucucacuaaguauaacugguccagaacuugcuaugcagaccaggcugaccucgaacucacagagaucuaccuguaucugccucuggagugcugggaauaaaggcaccacuguaugugccaccagaacuucuugacggcauguuaauucucuuuauucaucaucaaccuuaccaguacgcuaacacacuaccaaaaugcagaauguuuucaaaugaucuuaccauauuuuaaauuuaaucguuggccucucaaugauagucuacccaagugauuuaaaugagaugccacuguacauugaagguagaggaaauaaagcuacagcuuuauuucuaauauagaugguucuagaaggugcuggugucuacucugauuuggaguaguguuuucucuggcuacagucuggagagcccagaaaggguagcauugagcgucaugccguucauggccgacagcugagagugcuacaucaagacagugauuccggcaucuuguccucuuggaugcagauugcucucaucucuccauggcucccuugcugcugguugucuguguguugcugauuggccucggcugaguguggucacuuguguggaauauaaggaacuuauguucaguuuacacauguggaaauccaguuguuuuccaagaaaagaugccaaaguagacuaggucucuugguuucuauuuuuaaacagugccaggaguucaggaggcugaggagugacuguaccacugugagauuagagaugugguaagcagcagacacaauagacgagacaguggcagcguggaguggaagggccaguuuaaaucaagccgugcuuacuaagagagagauugguugauucagccagaaaagacgugauaaacugagccaggcuucaauacuacaguguggaugacagcuaaauaaacaaccuaauaaccuauauaaccuauagcaauauuggauuguguauagggcuucccccaacuaucccauguccaggauucuuaaaaugggaccaagcugagccucguuguucaggccuuuaauuccugauacucagaaggcuaaggcaagaagauuacaaguucaaggcuugccugggcuacugaggaacuuuaaggccagcuuguguaacuuagugagaucccugucucaaaauaaaaagcaaaaagagggcuagagauauaguucaguaauaggacccuuggcuaacaugugcauggcccuagcuucaauauaauuaaaauauuuuuuaaugaagacugaggucauuaaggaaagguccagucacugucuucagcuaugcaaaguacuguccauuggggccaccacacaaguucaaagcuacugggaguuaggccccaagcuaaaguggggaggggguauuguugacuagaaauaguggucagaugauucccaagucauuuauucagaaauuuacauauugugaggauaguucagacaaagugccuuuuaauugugguauucugugugcauguauuacauauuagauuccuuuucagaggauaugaacguagcccuaaauaaaucuauaggguccugucuucaugugguuuaccguugaaagugaaagaaaaugagauuuuuguaucuugugauucauguaaaagaguugucuaugagcuggaggccuggggccgagaacaaagcagaacagacagggcuguuguuaagacauuccuaagaacagcuugauuguacaagcagggcuaucuugucugggucaacaccaccuggccggaaccuccccucugucuacugccccuugacgccggguaaagucauacaucaacugguugcuaugugaacaagauaagcccccagcccacaggaacaaaguccugaugcccuuuugcuaacauauaaucuuucuguuaauguuuaaauaagccaauagugugucgcuaugcugaauuccacaccccuaagccccuuaccccauaaaaaccccuggcuuucgagccucguggccgacauccguuaucuccugugugggaugcauguugguccggagcuccgucauuaaauguccucauguaauuacaucaagagaugguccuucgugauuuuuugggugcacacugaaucgggaauuggguggggguuuccccacuaggucuaacaaaagcagugugugguaugacaguuaaaagcaacacagccucccgugaggagacagacugaaagugaugugggagcagcugggugcuuuguugcuuagaugggcccuggauacaggaggagaaaggccugguagagagagcuaccagggcaagucacaugaaggugaucgcagcaguaaacaccccaaagcagucuagagcuugaguugcucagaagaggagaacaaagaagccucaugucuaaugcacaguacuugagacuagaguagccagaggggaauucaggggggggggggggcuagagguuugucugugcuguggagaguucagauuucacuguacaaggcaguggaaaucaccgaacgcuuaagaagagacacagucagaucugcgcuuugagaggaucacucgguugcuauuuagagaacagacauuaggagagugaggggcauauguugcucuuggcagaggucuguugagagagacuuugucauguaucagugggaaagagagaugugacuagagccagagccaggaggacuugcaggugcaugugggugggccuggaagggaaggggcggagccugugcacacagugcgggagcaggugguugcaaguaugaacugggugagacagacuaugcccaggacuaguuggggaggauuuuguuuccuucagguaaauguuuuuauuuuuacaagaguuccagcguaaaguacaucaccccuggaucacuucaccuuuagucaaguaaaauuugaaaugucacuggggcaucuacauggagauaccaggcaguugagauacauggaagucgggauccguaucacaguuugggauuugggaucauagcacaacugguacuuagaaccuugaaucugaguuaagcccaaaagauuaguagacggggauugggauguagaaacucuggacaucaagaagaaagaagcauggagaguuugagugaccagagaaggaagaacaaaauccagagggagauaagauacauauuuaucuucaagacaggguuucuuuguauccugaaacuugcucuguagacuggguuugaacucacagagaucuuccugcuucugcaaccugagcacuaggauuaaaagugugcgccacccccaccagcagcagcccuggcucucucuuuucacuuucagugucugucugaccucggguccuucccuggauaaacaaaacaagucacuuucccugccuucuccuggcucauugcccaggauucaagacgugaguccccaccacuggcgaaagauuauguauggucucagaaggagcugcaauuuucuccucgaaaagggaaaacucuaaaauuguauaguuguaaaagaaaagucuuucaaggucagaggggacuggaaauguacaauuuagagcagcgguucucgacauguggcccgugacccuuugaggggucaaacaaaccuuucacaggaauugucuaagaguauugaaaaacgcagauauguggauucggauuuauaacaguagcaaaaauuccagcaaugaauuagcaaugaaauaauguuauagcugggaguuacccccacgaguguauuaaacguugcaguguuggggaaguugagaaccacugcucuagagaacagcuugccuuucaucuacucugcaaggcaaggcaaauguguuguggggacugggcugugugcagucugcuucugaguaugucugccuuuaagugcaauaugaaagaaacgcaucagauaaggaaagggagggaagagacucguggguauggcuugaacaguugauauagcaaugugccauccaggaggagguuuaguugguugaugcaagcuugacuuugugaccagcagugcugugcauguuuccugauucuagcguucagugucugaaugaaaagagguuuagagagaaaccaaguggcugguagaaauguagccuaccacucugauacgagcugcaucgaaaccuguggaaaugaaagacagaagugcgaaaucucacuucucuuuucccggucugaagaugcuauuaauauagaaggguggacagaauagggcucugcaccguagguaaguccuuccuuugaagucugugaucuagcagaagaccugguuuuauaaaugggucuagggaggguaaguaagguagcuacgugguaaggucuugaucaagcagaacucaaggcuuccugggacugcaaggagaaagguuugcauuccugcuagucuugaucagauaaauaaaggccugaaugaauauuaacucuugcaguuuauuuugugccaaaacagaaaacaacaguuugguuuuuuuguuuguuuguuuuauuuauuuauuuuuuaauuagaggaagucaagaauaacgaauagcaagaauauaaauuugucuucuuuuaccaguauucugacccuucuauugugcaaagccuaagagagaugaaacuuuuuuccccugagguaguggguguugaauugaggaccucauuccugugaggcaagugcccugccacugaacugugucuccagaacccuuggcucugaaacaguaguuuaaacuucaguggauuugcuguuaaaucacgucuuacugaaggggaucuacacuguuauaaaucugcuucaauaguaacuaucgucaaguauacuaugacaguuauagaauauuuagguaaguguuuacauacguguaacagguaugugcugcauauuguagaugcuuacuuuuaacaucgcagcagcaaucucacaagucaagauggagcaaacuagaacuugauggaucuccuugugaauccaauacggaacguuaaaacgacguagcugaucuuuuaaucccuugguguaagcugcugguuguuagcagagcugguacaacaucugugcugccagcccuccuuccugugccugugugcuaaggccaugcuuucugucccgggccugauagccugauagugucuaguccuucuuagcucaagcuuucugacugcuguucccagaaggucuccuaggacgaggucucagcaugcaucucagaaauaauauucucucaaagcuugaguucauguucaaaaguagcauuuuuauuaaaauaucuggaauugggcuauccagccauuaccuccugccguccuuagucaaguccuaccugugauacgggaggucaguguuuguggacugacuagagaaggacauuuuugcaugcacacacacacacacacacacacacacacacacacacacagagagagagagagagagagagagagagagagagagaacuuguauuuuugaagagccaaagaaacauacugagaucuucagcguaacguuuuguauccuuaaaagcuggcuuacguuuauuacuaaggagugcaugugaggagugugcagcccagccacaguccgccagauacugugcaggucacagagcgcauucugagcccagagcccuucaccagcuuaggcuuccuccaugcccaucacugugcauuuucaguaccacuaaucaauuuaccugauucuuaagcuucaucugaucgagucaauaacguggggguuuuguguguguugagcuauacucucgacucuguggacucaucuauguggaaauggugguucauuuuccuuugaaguaaguaguccuuauucagacauguauaccaguuuacuuuaacacuguuggcaaacauucaaagucuuuuccaguuuauuguuuuguuuuguuuuguuucugugcuuuucuguugaugcugcuucuguuccuggguugguggaucuuaggauuugugaguagucugcauugguagaaacaagaagagcuuccugaagugcuugcuuccuccagccagagcugaccuagcuccaaauccuugccaacaagaacagccuaaaguuuaauccauuucagccacauucuuaucucauaguggcuuaauuugcauuucuaauuugagucagguuuuugugaacauagcucuuaagaaauucagugaacauagaacauucuguaauucagcaagcucuguguguguguguguguguuugugugugugugugugugugcgcacacgcaugcacacuggauuaaucucuuccaacuuuauaaaguuaaaucucagccagaguuucaaggacuccugaaaacucuccuaucaugugcagguuuuaguguuaagaggccauuugucaugggacuuauacauuauuuacagauucucauaauggaagcagccauuuguaagagcuacuagagcagugaucgucaaccuuccgaacacugugacccuuuaauacaguuccucuuguuguggugaccccccagccauaaaaugacuucacugcuauuugauaacuguaauuuugcuacuguuaugaaucauaauguaaauaucugauaugcaggauaucugaucugucacccccacacaggggugacacccgcagguugagaagcacuaggcuagaguaccaccaggauuaggagguauuuucugauacuagaagaugggaguuauugacauaaauguuucaagagugagccaugcagugaauuaacugaauuaagaauugaagaaaauuaauaaauagaauuuagaacaguuaacugugaaacaguauuugacuaaaaaaaaaaaaaauccauacauaguuguucuagugaacucucugccauuaauggguaguuacaaacccagggucaaacagaugggccuaguuacauucugugggaccaaacaaaaaggaaugggugugggaagauuuguaaagaaguguggcuggcaaggcagagggaaggggaaggggaagagagagcagccauagucauuacauacaagugugagauugccaaagaauaacauuuccaauaagaaaauucuggcauuuaaguauucuuuguuuuuaaggagacucuaagguggcuaagaacuuucuguaaacaaacuaaucauauacauugguaacaaaaucuucuuguuguggggcuggagagguugcuugcagagagugggauuuaguccccagcaucuacaaggugacuuacaaacaucuguaacuccaguuccaagggaugugacacccucaucugcccacccugggcacaugguacacauacauaccugcauacauacauacauacauacauacauacauauauacacacacacauauaggcuaaacauucgugcacacaaaauaaacagcaaauaacuagaaaaagaaaaaaaaucuucccaucagaauuugaguguagacauuucugcuaaagcuuguauaauaauauuaaaugugcuuuucuguguauguuuucuggagcucucugggaagauacucgguaaaagcuugagccuuugcuauaaauguuagaagaagauaacagaagcauguuuuauguugaaucaucugucugucugucuaaaagacccacauugucuccaugcagugcaguaacuguucuuacuucacacucacugucccuguuuguuaauaagaaucucuguuuagcucugggccugcaagguucugaggggguucuuaaguugguucugggaggaacugagggagugagucuagucaaaauuuauugucugaaauccucaaaggaucaauaaaaauaguuuuuaaacuauaggucaucuuguuguucuggggggaagugcguucuggucuagugaagagacguccauuuuugccucugaacacaugagugcacaaaagggaagcgaguauuuggacuuuucucuuuggcaucacagcaggcuuuucuguaaaaaggacuccaguccccagaagugagcagaucugcugucacaucugaaaauagauggcugacauuauuuacccccuggaguacccacaguucugguauuauaauuuucucauguccaacuguugacgcaguccagauacagguaggagagagaguauuucuccugggggaaucucagugagaagggcaguucugguuucuauggugacuugcccuaugggguagagugucugcucuuggcggugggaguauacucuucucacuucauacaccagucuuaaucaguggccgaggugcuuccuggaacucucucucuugccugugugugaaucaucugccggcucaugcccugagcgugaacucucuucccuuugguuccuguccugccuugugaucugggaaacuccccugccuggauccagucgaagugcacagaagugcacagcccgcuggucccuucucuccuuuuguggccaccggguccacacuguucuuacuacuucagaugacagcagccuccacauuguccucucugcccccuuucuugcccucuuaucuucuccacagugacaacaaggcagauuuuuaaugcaugagcacacgucacacccagauuucaauucaucugugacucucuuggcccuugcaaggaagugugagccuugugcuguucacacccgcauccaaccugccucccccacugcccaccucagguucuuccugaggcuucuugggcugacccuuucacaccucagggccuuggaacccgcuucccaccugugccugcagaaagguaacacugaguucuccguaaacaggcucaguaggacuuuccgaauggcucucccacuccuaaggggagaacaaugguucaugggcugcaagcagccgcauguguauuacccuuuuguguauucaggugaccucaguacauuuaucuaagggaugucuuacuuggcuauucuuuauaaucauuuucucaucaucuugcuuucauuuuauaaugccuuuuaucagaaaaauaaaaauuuaauuacgauuuccgcccuguguucccccauuaaaauguuaaucuuugagagaaagguuugaaugccucagucaccaaaguauuaaaaaaaaaauuaagagcaugagguuauaauaugcaaaggguauuuuuuaugauuuaccuuuucuccugcaccugcuagcuucauguauuccauuaguggguguuaacaucaauauauucaccacccuuuauucaugaaaauuuuaucugaagacugaauguuuguuuaugagccggggaucuuggcaccuauccuguuuccagaaugcaugcuuagagaucuacauggauaaagugaugcaguccauaugccagcauccccaugugaacacagcaggcuacauucagauaaauaaucacaguuacuuuuagccuuauuuaccaugaacaaaaucuaugcacagggauugguuggaucacaguguugcuucccuuuuaugaaauuacaguuugugguuaguugggcaaugguccuacauguauuugguugcuugaagcugacuaguuuuuguuuccuggaauuauuuugacaauacaucucuuugaguucuuuaugaaaucccuugccuguuuguucuguagccauuccugagcagcacuuuucauuacagaguaacugcccugcauguguauaccagaguuccuuuuuuaaaaguaguugauacuuuuaguuacuuuggaagaauucacauaggacaugaacuguguucugcuuugguguguuuauugucuauagucuucccucaauauuacuguuaccaagaucggugaagaaaccacggcugagguaguaauguguuugugaucagaguugugaccauuuaacuucugcgggggaggguugucuucauccccuuugaagucaaagagaacacccacagacaucaccgagggcuggcuggcugcagcugcuugcagcccaugaaccauuguucuccgcuuaggagugagagagccauucggaaaguccuguuuacugagaacucaguguuaccuuucugcaggcacaggugggaagcagcucugcaggaaacauccccgugaucuuaguuacauugucuuucuggaagguaccuaaacucuuucgguguuugugauuccugcuguauggccuuuguuggucuugaauuuguaauccaucagccuccagagugcuaagagcacaugcaauuauagcacaugcaauugugacugcugucuuaaucgaguauuuuauuuuuuaauuuuuaaaauuuugugugugcaugauauguauaugauuguguguguaugugugugucuuuauuuauguauguauguacagucauaugucccauagcguagaagucaaaggacaacaaccucagaaaccaguccuugccaccuuccagcuaguucacuuaggacaguguuuaugcuguguuauguagcugcccagugaacuuguguggagccuccugucucagccucccacccuggcaugggagcaacgggaauauagaugcauggauacggugcuugcugugcaugcauguguucuagcgaucugaauucagggucucaagccuguguggcaaacauucuacccaccgagccaucucccuaacguuaaccuagaaaguuguagcucucucuuuaaaacugaauauucugguucuguaggaggaccagaagucucaauuaaucuggacccccgagaucucucaaacaguagaccgccaaacagacagcauacaccagcugauaugaggccccccaacacacauacaguagagaacugcagggucuguguccauucagagaugaugcaccgaacccucaagagacuggaggccccagggaguuuagaggucaggagggauggggguugggagcguccacguggagacgggguaggguugggaggaggugugggauguggagcagucaguguggauggggaggggcggggaauggaauauggaguguaaaaaaugaauuacacauaaaauuaaauuaaaauaaauaaauauaaaaacaaaaauaaauaaaauuguauauucucuaccuaaaauuaaccauuguguauuuuuuaaaauguucuuaucagauuuugucaucgagucuaucagaugaaaauuuaguuuuggaaugcuuaagucacuugcccaaguuuauacaguugggugagguuugugucagaucuccgaagacucugauucauauaauaguaugcauuuagauuaugucauauuguaugagaguguaacuugugugucugugcaacuugccccaauuuaugaaguaucuguggugugcuagagagucuggaugcuagaauccugccagugaguacaacacaacggcaauguuugcaucuguagagucaaccuuagagagaaaaggauauggugaaagugaguuaaaaggaaagacugaguugaccaaacaacaaaagcaugcugugagcuggagagggauggcccguacaaggggguaccugagggccagggaggcacgcugaggacuucguggcugagaugauaguugaacucaucacugaaaggauuuguagaaugagccuugcaguaucugggaauguuuugaauggggaaagccauagggugagcuguucagauggcagcucccuugaguuauuagagacgaggagggggccagucccaguauagacagcccuuuaccaugguuagaacaagguuuggggcagagguucacaguggcagugcagaggcagagggagcauggucggagaugugucagagauaguuaagcuggcggaugugugcaagagagagcagauacagugacagacgguggagugugcauuccgucagguggucacggaagaggaaggugagaagaggcagggcugaugccgaggaggcacaugaagucagcaugcuagggggagguggacgcacaggauggcuguaagugaggagccuggcacagcgcuggagcuauggaggaggcacaauggcacacuuguguguugaaaucaacaggaauuaagacaggagucugggcaagcaagauaagagucagccaagaaauauggauaucaaaagaggcgaguguggcagagacaccagaauaugccaagccacucuggauggaggagaugauuuuggcacuuccugcacauugguucuuucugguaccccagccgcccccagaccucauuuuagaauuugccgcuucccuuguucccccaguggcuaucaccuuaaccuuuuuaguguuuauuacuuggcuagcucuccuaguccucuugugaccuuccuuuucauguguaggaucuuauguguaaucaaagugcuucuucgacauucuguggggugaauuugauuuuccaggcagcagguuggccuguggaaaagaaagugaccauguccccacccugcucaagaacuuuguucuaguuugugccuaugucccggaugcuuaagucccuccuccuuugcuucucaggauuagaggauuuuccucagucuugaucacucugucauauauaagggucccaagauacuagacagcucuuuccaagcugccucucucccuuuagggaauacuuugccauccauuuauguucagaucuccucuacccuccugccuuggccacuugcccaggacuuuaacugcccagcaagauccagcaagucuggaucucccucuuucuuccucuuccucuuucagguugaaacuuaauuguguugcaugucuaccuugaaccugugggcuaaagacaguguauacaaugguuccagagugacuuuguacaggaaaaauucauagcaugcagcuuucugccgugucacuauguagaugcucaaaaguuuucaauuuggaacauuuuuuguuuuguuuuggauuauggauuacgagugcuccauucauagcaaaguucugugagugacauucacagcucugcuucccuuaccugacugggcauucucugugguugcccaccuggcuuauuccuguuucuuucauucacggcuacccaaucuuacaggauuuuuaauagcucugaaaauauaaucuauacaaaaucuccaagucucggccccaugccccgguucugugcaucacacauguggaggggagggaggaaaggacuccaagucaagcuucugcugccugcuuaaagaaaccacacgucuaucguuagugacucucaugagugguguuuuggcagugagcacagaucagaaguuggaacagagguaaaggaguguuuggaaaccauugccauaaauacuugaguucauauggcuuguccccugcuaccuucaagcagaaugacugguguguguguguguguguguguguauguauguauguguguguguguguuuguauguguguguguguguguuguggcagggggagguaaagaggagagagaagcuggagauaugauaucaugagcaaucagauaucaggagcucugggcuacuucaagguguaggacagccccgccccacuccagcccaguccaacucuguugauuugaaguuccacucugcagagaccaggaccucacagaacaacucagcaguccacccgagaacagagcagcccggcagugcauguauuaaaguggggacacagagugucuuagucaggguuucuauuccuguacaaacaucaugaccaaaaagcaaguuggggaggaaaggguuuauucagcuuacacuuccauacugcuguucaucaccaaggaagucaggacuggaacucaagcagaucaggaagcaggagcugaugcagauccauggagggauguucuuuacuggcuugcuuccccuggcuugcuuagccugcucucuuauagaacccaaaacuaccagccccgagauggucccauccacaaggggccuuucccccuugaucacuaauugagaaaaugccuuacaguuguaucucauggaggcauuuccucaacugaagcuccuuucucugugauaacuccagcugugucaaguugacacaaaacuagccaguacaauugaccccuugucaacuugacucacaaucacaucacugguaagcuucaacccuuaauuucuuauucauccccaagaucuaaauaacuuuaaaagucccacagucuuuacauauuaaaagucaaucccuuuaaaauguccaauaucuuuuaaaauccaaagucuuuuuacaauuaaaagucucuuaacugugggcuccacuaaaauaguuucuuccuucaagagggaaaauaucagggcacagucacaauuaaaagcaaaaaucaaucucuaaccauccaaugucugggacacaacucacaaucuucugggcuccuccaagggcuugggucacuucucuagccaugcccuuuguagcacauacgucgucuucuaggcuccagaugccuguacuccacugcugcuacucuugguggucaucuuaugguauuggcaucuccaaaacacugcaugaccccuucaguccuaggccaucaauugcaacugaggcugcaccuucaccaauggccuuccauagucucucacagugccgagccucagcugcucugcgugaauggccuuccauagucucucacagugccgagccucagcugcucugcaugaccccuucaugccuucaaaaccaguaccaccugggugacucuuacacauuaccaagucccgcugcagcaggaguacaaccuuggcuaucucuggaacacagccucuuugugcuuucagaaaacacuucccagaagaugucaccucaacgaugcuugucucuucuuaaucaccgcuaauuucuuagcuccagcuaaccagcaucaauagucccaguaaugcaaaaguuucacuuuaguaguucugguaucuuguuaaucacagcagauuccucaccccagcuaaccaaaaccacagaaucuucccaaucagaauagcaauggcccugaaaagagucuuuaauuuucccucugaaauuuacaagccagaccuccaucuucugcacuguucucaacauuaucuuccaagcuccuacacaacaucugacagagcucuuaacaauuaauggaucuucaagcccaaaguuccaaaguccuuccacaguccuccccaaaacauggucagguugucacaggaauaccccacuaugcugguaccaauuugucuuagucaggguuucuauuccugcacaaacaucaugaccaaaaagcaaguuggggaggaaaggguuuauucagcuuacacuuccauacugcuguucaucaccaaggaagucaggacuggaacucaagcagggcaggaagcaggagcugaugcagaggccauggagggauguucuuuacuggcuugcuuccccuggcuugcuuagccugcugucuuauagaacccaaaacuaccagccccgagauggucccacccacaaggggccuuucccccuugaucacuaauugagaaaaugccuuacaguuggaucucauggaggcauuuccucaacugaagcuccuuucucugugauaacuccagcugugucaaguugacacaaacuagccgguacacagagcaucccuaauaagaggcacugccugucuuguuccgcucaccuggaaauccagucgaagagggcacuuuucugugcguuaugguuaagaacagaacuacccucuauuauucuaguguagcaguaagcugcuacuuuggugacuuaaugcugaugagaaaccuagacauguucuagacccaauugcuuuacagacaaagggugaucugucugggcagcagagugcuggcagcuagggacugggccaucucucuccacucccccagaaaauggucucuauaguguacucagggcuugaauugucccagaagauaaacucuuuucugcugaagucacaagacaggacaagagauaaaacacuucaaaaagaggccacuguuuucagcagcugguuuuguggucuccagaagacuuuucuauuugaagccagaguacaguuuuauugauauuaaauaggccaaguucacuugacuuuuucccuuaaggcuaacaggacuuuaagugagcauucccuguucucugcaccucaugcuccacacugagucugcuuucggcucccaaacuuacuaguacuuguuaugcaucauucuagaggacccaggccacuuccagaguccuuucuuucaaauauucuaaacuacucuguaacucaggaaggaacugauaggugagggaagauucaagucuuuaaacauucaaccuuugucuccuccuguuucaaucuugucucuaguaugcagcugcaauguccaugccacugguaggcacuagccgagucuuggcucuucuaauuaagauguaacucucgugcuaucguuaucauuacugccgacucaggcaguacauuguagacuguugucuuaguuaagguaagcauugcugugacaaaacaccaugaccaaaggcagcucggagaagaaaggcuguauugauuuacauguccugggucaccguccauuuuggaaagccaagguagaaacucaaaccaggcgggaacccgcaggcuggagcugauggagaggccguggaggagcgcuguuuacuggcuuucuccucaugacuugcucagccugcuuucauauggagcacaggaccaacuagcacauuaaauacuguugcaccaugugcuugcauacagccugaacuuaugaaggcauuuucucaaucgagagucccucuucccaaguccuucuagguugugucaaauugauaugaaacuagcgaggacauugcuacuacugaauucuucuuaaacaugagucacaacaguuuauaaggauauucuuacuguuuacucguaagagaaaaaaacaaacugcuugcuucuguuugcccauuugauggcuuacacuguccccaguucaagccacuucccgcuaaguuaaugacaacugggaauuaggugguuucugugugagagacugucaggcagcuguggcuggagcagugcuguaaaugcagaguaagcagcaggaaguggaaucgaguuuccaagccuggcugacucagugcccuugcuggcguccuuuccugguaggcacugacuugcuuguccucugggagugaagccugagucggagcacuagcaucgcaccagggucucaccagucguuuuaucucugacacacugccacucuguuauugcagauucagugacagaaaauuuuucugcuaaaagaugguagcgaauucuuccuuuggcuguuugggaaguuaauugaaggugcuuuaugugggcuagggccgguucugugcuccccaacggccugaugcacucacuugucaaacauuugcaagaauuccacagucccugagcugcaacucuauauaggccccauccaguguaccugcaauccuaugacuaaaaaguacauacacuauucaugccccaguccacuagagggcagcauacacacacuuacuuagcaggaaaagacugcaaaaacuaacuuuuugauggaagagaaagcccuuugggguggauguguugaaaauacugucauauuuuuguuaaaaauuauauuucauaaauccccaucccugaaguuaaugaugcaacaguaaaaguuggccaaugauagcgaaagcagcuuauguauuucauucucauagaagucuugacuuacgcuuuccucuguguaguaaauuagaaauuucuagaauuccuuuugaaaguugaaaaguauuaguuaauauuuaugcaucauguuuuucuuuaguugaaguucuuccaguugaaauagaauaugacuguccugugagcucagaacaccuuccagacuauaaacugaaauggagcccagcagggauggggcagauuaucaaagagugacuguaauccagcuccuagcuuacaguaaggacuuagaauaaccugcucaagccugacuucucaagcccugguaacacacaccuucugaaacuacaggaacccagcuuggcgcucaggcagcaucuguggaaaggcagcagcacuguugaguauuuauuccaagcagacauaguuaccuaggaguucuuagcaccucagggcugagugggcuuucgaauucagaguuuaguaauauuuaauaauucacagcagggauaagucagcuuuuucauuaaagccucaaauagcaaauacuuuggaggcaaugcaggaguuccuguaaaccccucaccuugugguuuguguuuaaucuguauuuaauacccguaaugguacagcuccagauccuggccucaucaggccauggauggccuugguacagggugguagugauggugauacguaaagucaugucucuagaaguuuguuagguucacagcaccuuagggaacaauagcaggccaguuucaccugcauggagcgggcuucagcaccccguacucagagugcugggugcacacggccuccaccuagccucuuuccauagcuucuugacuuuugucccuguuggucacacacucaaaacaugaaaucaccuuuuucagugugcuaccacacugaaagaauaacuguuuugaaagccaggaaaucacucuuuuaguccuagcaccuuuauuaaauagaguuucuuagacuucaguuacucccuguggcugucaacaucuuuguaaaaugggguugacucaauuucgauagauggauggggagguggauggauggauggauagauagauagauagauggauagauagauagauagauagauagauagaaauggacuugguaauuucagauuuauguaucccuagcccuuuauccaauacucagugauuuauuugaucuucaaguacacaccuacucgaguaaaagaacauugcagaaaugauauucauguccaaaaccuccuacugugucuggcccucaguagauggccaguaauuacugaaugggugaauuaauuacaauugagcacuuagcuacuuuaaacucaccuucugcuuuggccuuauguuuuauaaaugcaugcaauuuauuauauaaauguuuuaucucucuagggcuuuaaaaaaaguuguugugcuauagagagaucuacugaaugucagcaauaacaguaugguaaaucuugugugcacaacaauggauacagaauaguucugguccuuggcugugaagggcuuacuuucugcuuguagugucuaguggguaaacuggucauuuaacucuguuucuaaguauggaauuagaaauccaagucuccaaagugacagcacacagccagacaaggccaguagcuuagcaaagcauaaaugagagauggucagaggggacuucaguaucuccuaaccagguggguagccaauggacagggcauggucaucaaucugguugggccaggggauacgcauaguguguucuggcucucaauugcuauugauagccucgagaagucaccagucucaacggguaccccagccuuugugcacucugccauagccacguaaaaacucuagaaaaggaggcucaaaggccuccuccucucuccgaagccucucuugcuuucuccuuaauuucuuacuugucuguuuucucuuuaauaaagugaguuuccauuucgcauacucccaggaguguauaucuucagucuacaucagaauaaggcaaggagcagucuuuggugaccacagugucugaaccccuggguccuuggucccacugggcugugaaaggucucaucacgugaagucaguguaucacugccaguuuuacaaguccagacugguugucuuguagauaaucccacugucuagauugguccaguucuuccucaugauuuuaaacucaggugaaacauuuuggaaguaaacuauguaaggacuguagggacuuuucauccacaccgugccauacacuuccuaaugccacuuugucccauguuggcgcugacuuugaguuuuuaaucaauggaaacauugucucuuaaacauugucucccaggaauaccuugagauuuugacauauuuuaauuaacugucccuugcaaauugaaucgggguuaauaacagaggcggaaaguaaauccucgaacuuggaggaaagguucuaacagcuuauuuauucauaacagcaauaaccaaguaaauggcgaaaugggaccucacucguguacacacacacacacacacacacacacacacgcaacaugcuuucuaugguuugguguucauaguuauccagggccgugggcacgguccggguccgcagcagcagguagcuuugcagcgccaggaaagugccuucuggggccauguguuccuuacaccgucucuugucgguucucucacagaugacugaacauaauuuuucuaauucugauaugcauuucucaucuaaagcuguaucgugugcuuuauauuaaaacaaaauauaugauuuccacagcuauuuauuguucaauaacuuuuaugccaguagacucaaguacauuuucuauguauuacuuauaucacaguccuuguagcauaggaaagagacggccauuuugggucaugagcgcaguuucacaggucaacuuuccacacgguuugcucuuggaaaaaucagucugucaauuagacauuaauaaaccauuuacuuuuucuuucuuuuuuuccagauauuguuauuauccccacaguuuuguuuuucuuucuuuuacucauguaauuaccuaauugauucuaguguagcauuuuauguggcuauagcuuuuauaacaguuauucguuaauuucuuauuaugauagccguggaaauacaaaggacucugaaucaacuuggaacaccucaagacucaccggaacugaggcaacagcuguaagucauuguuuccuacgacagagagaagagcagccaugcagacuucucugcugcauccguaguggcuuucuauuggaaacauugauggaaauguagugagcuuucucugguaccagugcccugcuauaugaaacuuggcugaucuaguguacacaggugguagguuucuccuuuaagaaucuggcucacucuaucaaggcaaaauuauguauuuuacauuccuauuaguuuuaaaauagauuuucgguggcuuuugaagauuuggacuuagagcuucauauauauauaugauuuauuucuugcuuuuuuguugguuucaacccaguauauguucaauguuaugaacuauccuccucaaacaaaacagaacuaaaccagaaaaugugcacagugagaacuucagaaagcaaguagcagcugcuuagcgugugugcaaagugaagcagugcacauauggcagcucaugacggcaacuccagggccguagcugagagguggaguaaguuccagaccagccugugcuacucggcaagacuuugucucacaauuuccagucaugcaugcauggucacauacacauguacacacucaugcauacacacacuaaacaucaugaacauauugcaauucacuaaaacaaaaguacaaaaagauaugaaaaguuaugccaaaacucacgguuuuuagaaguaccauuugaaguauuuguaguuaccugugguuuauauuuuauuuuucuauaauaaaagagaugcuuuuaaaucauaguuacuacaccgucacucauugaaauacaauucaaugcaaguucguaauaaguagcgacauuauuuugguagaauuaaugcuggaaguucugaauucgcagacaugaucaugcagguucccuuuugagaacuuugagaguuaggaaagccugucuaagcaggggcaugugcuguguagagcugugagcugguucuuaguuuccucacuagcucuauauagacaucuccaucugagcacuuuguuacugugagucccacugacuguccacgugugcaguaagaaguguacaggggaggccuggugucauuucuaagcauuccucuaauucaagauuauauuguugaauauucaguuuuuuauugaaauuuguauauuuuucucuguaucuaggaaaacucagguauagguuuaauuuacccccuuuuuuuguauucagaucuauuuauaaggaaguccuguuagguuucccacuucacguuuaacuacuggcuagucuguacuacuggccuucccuuccauauuuguaaguguuugagaguguaaguguucacauaaggaaauacggccugcauauauaccucaggccugaggacuggacaaagacaaauagucuuuccuucucggauguccucccagaggagacacagauaacagcuguccauacuuucagucccuuggauauaaaggaacagccagccagcgcuauccugagcacagcccuucucacuccagcccucuacauguauagcugaugacguugacugauagguaacaccaauucguauucauuucucuaggcuuggguacucugggugaaugaagacccuccuaugucauauuucuuaguaucuuccaaaaccuagaaccuaaagauuugguuuagcagaagaacuugacagccaguucaaaaaacuaugaguacuuuuacaguuuguuguugaaauaaauacuucgacgaaacuagcuuuucugcaaccauuuaccaggguugguacaggugguguagagcuuuucuuuggcuauacacaccuuugcuuucugauuuugcuuuauuauuauuauuauuauuauuauuauuauuauuauuauuauuuucccuuuucacuuuaggcagcagaagcagcaguauacuaaccaacuugcgaaagaaaccgauaaguacauuaaagaguuuggcucucugcccaccacccccagugagcagguaugcaguuucaggugugagucuugauguacuggaugugagagaaauuaaaugcauggucggaucuuugaacugggauucuacaaaggaagugaggcagccaaaaaaaugauuguauuugagauuaguuacaguacacaaaacuauauuuagugguucagguaguaucaugugcuuccauaaagcagaaauuauuuccaugucguugcccugacccauaauuaaguguacgcugagaaaaugccuccuguguaauugcuuccuggcuuugcaggacugcucccccacucuccuaccccucacccccaccuuccccacccucacccccaccuccgcacccccacccaagcaugcacacacucacgaugcuccugggaacacaguuaucugcuugcuuacuuacuacaaguuaugagguauagguuuuauuuuccuaaaaaugguauuacuuaaaauuaaccuuaacaccacaaccgacuuaucagcagcuaagaaagccuaaggcagagguccugcagaguuggccuucugucuuacgaucaaaauacaagugccaggaaaugugcgugagaggccauccgaggguuacuguggcuggagagugagugacaguuuucagggcccaauggagucagacagugaagcaagcacuguggguucuagcaagcuucucaggcugauuuacuuccgccacgcuucucucucguccgucuagcgucagagaaagauacagaaagaccgauuaguggcagaguucaccacaucgcugacaaacuuccagaaggcccagaggcaggcugcugagagagagaaagaguucguugcucgagugcgagccagcuccaggguaucgguagguacugagaauggcugaaagcacgguucucgcagcaucccgaugugugaugucguagagcccgguagcgcucuuaaaucugugacuguuuuuaaugaucucuccuuggguuuuaagaagcccauuguuguguauuaaguguauuguuguguauugcugucguuaccccucaugcaacaguagcagagcacagacuccauaaacacagaaaacccuggaacggaucagggaauggaugcucuaauguggacuugaguuaauccaguuuuaagucucucaggaguugccacuaguugauguuucauucuuuaaugcucaggucccacaaugacauuaaguaugagcugaaugguaauuauuauuuggggccuuguaaauagugaaucagugaauucccuccuugucagccuaagauauuauuuugacauugcauuugcaguugaccuugaaaauuagaacaaggacuuaguuuccccugcucccauugcacaugugugcauacacccauauguauucacacacacacauguauacccauauaugcauacacgugcacacacccauacauaugcucaaauacacacacccaaauauauguacauguacauacacaugcucacaugcacauauauacacccaaauguaugcacaugcacauagguaugcacacacuuguaugcacacacaccugaacacauauauaaaacacagauaggcugucuucagggaaaaugugaguguuuuguuacuuuuucuuauucuugcuuucuuucuguccuccaacuaaauuauucagggugguuuuccugaagacagcucaaaagaaaagaaucuuguauccugggaaagguaagaaauaagaaaacugccuuguaaaucaaacauaacuuuugagguuuuacauauuauaguccaugaugcagaaugaaaccuuuuauuauagcaugaguagucuauuauuuauaagugaaauaguagauuuguggaaauguaaauauuuauaaacuauuuauuauguaauauauaaauagauccuguuaauaaacuuauuuucuuacuuuuaagaacaaaauauucuuauaugaauuuaccaaguaugacuuuuaauaaguaaaucaaaagcaauauaagcugaaaccaugaguagaaugaaaauagaguaaauuuggauaaaaugucuauuuauaccuagaaguuuuucuuuauuuauugaggcuuuuuggagaugggaucucacuguguuaucccggcuagccugggauucaccauguagccaggacugguguuaaguuccuuacccaaugagaacugggauuauaggcacguaccaccauggcuacuuauuuuagcaccuuuauaaaugaacaauauucugaucuuaaagaucaaacuauccaguuuucguaagagugucuuuaguaaguaaguuuuauuucuguuuguuuuuauagccaaacacagccucaagugcagguccaagaugaagaaaucacagaggaugaccuccgacucauucaugagagagagucuucaaucaggcagcuggaaguaagccuuagaaggccgugccaguucacauaccuggagaacgcuagagaagaaaacucuauaaacaucuggcaguuuggugaaguuucuaguguagaauuuagaauaacuccuguguaagaaaugaugcuguugguacuagaaugagaagaagccauuccucccacauuguuaaucacccagaguucucuuuaguauugagaaagcuccacucuagaaauaaaugcccuccuaaagagccugggcagcauccugaaauauauccacaccaucccuccacgagggggacuuuggcaguagcauuaagagaacuguaauuuucuuagugugucuaccaccucacagagaugaaggauuaguuaaauuguaguucuguugaacugacccugcuccuaaaagugggcuagugauagcuaccagugacuauaguugaccgacggucuuccaugugacaaggcaccgugauaacugaauuuguuuauuccuuccucacaaaagcucuuuaaacuuacuaaauaugucauuaucauugacauuuuacagauggggaagcuaaggccaugauagauauacaaacauccuuacacacuugcaaaaaagagucuuuagucagggaauagguauauauugaggaaaauaaaguuacaauuucuuuauccaguaaauuuguaaucuguuuacacauuaaugauauuuauaguuucacuaugaucuacuagauauucaaauuuauuaauacaaggcuuuaaauuuauacagguuuuauucauuguaauugucaagcugauggguagauuuuuauugaaauacaggaauauacauauucuucuagccaaguauugauuaugacaagagaaauugucaggucgaccuuagcacugcauggccuuccucaguuucugucacuugagguaguggaugucacagauuuacuuuggacaacuagaagccauccagaggauguuagguuagaauuguuuacaguaguguauuuuucagauauuccuaaaauguauauauuacuucuaaaugcaugcuuauauaugugugaggguguaaauuuguuuguuucuuuucuuuugaauuuccccauuggaggaaugggggccauguuucuaacaauacauaauaauguguguguuuuuuugucuuaggcugauauuauggacauuaaugaaauauuuaaagacuuggggaugaugauucaugaacaaggcgauaugauugguauguacggcugcuguggccugugaggugggaguaagcgaccugcaguucaccugcagcagcuuucuccaucaagaguacccucuugcuuuccguuucuguagucugcagcuggcaggcugcuacccuugccucuguucgcauuccugcugauggaaggacgcucugcuugcuucagaagcucugaguguagucaguggcuccucaugguggaacauaaggccccacguggcaucgcaaccuacuuccagugcuggcuuuucauuuuuauccaaauaggacuggaggaucucaugauauuuguaauugugugugcacugucuuguuuugugggaaauagcuauuuuccuggucauuuguucuaccaauuaccaaauaguuuuugauagauuaauauagcucauuuaggugcuaaaggauugagaccuguggcauuaaagcuuuagguuuggaaugugacuguggaaguguguaauagaugagaucauuaaaaaguaaaaguaugggagcuggagggagagugcaguggguaagagcucuuguuguguaagcugaggcugagaucagacaccugggaaaagagagcuggccguggcaacacguguuccuaaccccagaacuaucaagugccaagacuagaucuuugagguuuguuccuugccuggcaucagguccacagagaccaugucucaaaggaauaaaguagagaguagugaaucaggacaccuggcauccuccuguggccucugugcacacagaugcagguacccaaauaacacaugugcacauacaccacacauacauaugccauagucauacauauuugcacauccacagugcauacaugugcauguacacaacuugcacacacacacacacacacacacacacacacacacacacacacacacacacacuaugguagggcuggagagaugccucaguuaauaaaacagguugauacacaagcuaugaggaccugaguucagaucucuagcaucuccauaaaaagacugagugugggcacaugcuacccucggccuaaucggagaacugaagaggcagaagcacagguaucccuggagcucacuagccgauuagucucgcugaauuaaugagcucuagauucagugagaggcucggugucaaaaaguagugaggaagacaucuaaggaagacaccugaugucaacuucaaccuccacacgcguguuuacaaguaugugcacaucagacauguguggucaguuuauagaaagaccaagguguaguuagaagguucugcuacugcagaaugcagacaccagcucugacaccuagagaaguguagaaaagaccaucgcugcgucaggagccaagauagccaagaaaugaagaagccaugagaucuuugagugucugcugcagaggaaggauugauuggcaacugugacacaguggccuuugagagucugcagggaggaggaagagaugagaucucugguccuguaaaccagugucaguucuacccucagguuagaacagaguggaaaggagggcugcaaaggccugugggcccugggugagguuuacaccucucuguagcuagaagaaggaagaaaccagaaugcuaccagauucuuacagugaaguugaccacugcaccacgcaaaguagguagcacacugcauguaugugaaugacuggagggaagcugcccuuacagaaauacacacaaagccgacagaccccuaggacuggcaggacauuuugauuaaaucaacauaggaaggaccaagguugagugggcucauccauugcucuuggggagacgccauuuuugagaagcugagguggguuuuuuucgaugugaugaugaaagccuuugggacugggcagaaggggcucaguuuguuuugcacuuugaucuugagacagugaaaccucugugguuagaaagcggcaggugcuugugcugccgcugauucaguagcugcaaagugacaggacuguguuguguccagguagaacuggagaaggucuauauauucguauauugguuggguugugucuuuuccuuaaaugucugcugcaugaaguuuagugauuuauuaccagagcaucaaauguguuuaacagugcugugugcgugcauuuuauuuuaaagacagcauagaagccaauguagaaagugcggaaguucacguucaacaggcaaaccagcagcugucaagagcggcagacuaucagguaacaugaacaguaauacaguuccuuaucacuuggaguuuugacuuaagauacaaguauauaaccaguuugaaguagcuguguaugcuacuguuagaauuauguggaaaguuaguaguggcaguggucagaaacaagccagucaauuugaacugccagucagucuguuuucucagggugauccacagagauagaaagucaugaagcuugcaagagauuacuacuacaggcuuuacuucuuguggggguuccugcaagcaucguagcugguaaggaagcuauauggauaagcuaaaaguggaacuugagucagcacgacauggccauggcugaugcugggucaaaaacuucugcagucugacaccaagcaauguguucuucauauauuuagauacaguaaaaauggacagcauuuggauaaaagugauuccuuggacaguuaucucaacagagcuuuaggcguggcuacacugaagagcaucucuuuagcaaagcacgugugaccuuuacaugaauaagcauggguucucuugacagaugagcagagcucaggacaagggccuagggagggaggguuuaaugagcauaaagauggauucuauggacugagguacaaugcucgggauucuggaggauucaaugagggcuggcuuuacagaauagcagagaucacuagguauugacacauacgaucccagauguauggauggcaaccagugcccgugucuuucauuggaaaacaaauccacgcguuuaagaauucuaguguuccucugcauccaugaugguuuaugaugugacagcacauggagagaccucuugaguggucuguuccccuccauuucccuuccuucccugugacuuuucuuuuuuaaaugguuuuucaaaacaguaucuacacagcccuggcucuccuggaacucaccauguagaccaugcuagcaucaaacucagaaaccuaucugccccgguugcccaagugcaggcauuaaaggggugccucaccaucacccagcccacuuucucuuuccucuugccaggcugacguaacaaagguccucacacuagaaaugucucuucaaagucucugaaacuacauuaucugggagugucauuaaucacugcauaguaugucaacauguagcagacccuucagucgauacaaauuuauuucucaagggaaugucauuaauguguggagacucuauauaucugugaaguaugagucaugcuucagguacuauacagauguuacggcugugaauuacuaaugauugcacggugugcagaccuuugcucaguaagagcaagguuagacucuuuugaagauucugaacaucauaacacaucauuugauuccccucuaaaaacaucggauuuuguuguccuucauaauuaccacugucuugaaucuugacuacaauccuguaacuucuuagauauuuuucagcugcuuuuuacuuucauguuagcgccauucaucaggugagccacugugcacuuggcagcuuguaacacugacacuuuauggggcuauucuuuguuucauuucuagguauucucagucuaccacauagcugguaacuuuuauuucuuucugucuuccuuugcauuauuggggauugagggagaacagggaaucuaacccaggaccuugcauaccagcaaaugcuuugccacugaacaauagauauaccuaacacaguuucuucuuucuuuucuaaacauuuuuauuuacuuauuuuaugugugugucugcucuaaagguaguuagaccuggaagaauagagcuuaagcaugagacagacucauaaaaucucaugcaguagccaacuuuauucagagcaucagacaauuuauacucaggguuaagaagagucacaugaguaaaguguacagucucaaggagaagccaaauguaaacaugcguuuuuccauaguagcacacaaacaaauaacaauaccuaguuguaaugaauaaucuaagguaaacucacuccuauccacucuaccugggaggggcacagaaacacauuccaagaacaacuaguugcguguuuuugaagcaacugagguucuuguuuucuuggcauuuucucgaaagcacuccgaguuccccugacauggcuccauuccugcaccaugucccgacaguguguauuggcguuugucuguguaccacaugcuugagcuacaggaaggugugagcugccauucggguacagggaauugagccuggguccucuggaagaguguagucagugcucucaaccacugagccaucucuccagccacugauuucuucuuucucaaguucaaccauacucccaggagaacuaccagcaauuaaaacauugccccuugaauuauagcauuacuucaagaaaaauauuuuuugaaaaaacaccaccguguguguuguaaagguuuuuuagaagaagaaucucagccccaaauaugaggucuccaaauuguuccccaaguucacugggugguguucagcugcuguggcauccccucacugacguacucaccgugucgucuucuugcuuccgcagcgcaaauccaggaaaacucucugcauuaucauuuuuauccucguggucggaaucgugaucaucugucucaucguauggggacugaaaggcugagccccgagggcguggacgacugcaugaugcugucugagcgaugcaggcagauucuugcgaucacuuucucuuaucguuaucuugaggcuguuguguaaaaugaugguuccauacuuugccauuuuuacuaggguggggggauucuuuuuggauucagucugauauuuucuaauacccaaggcuuuucuaaacacccuuacuggcacagcuucccugcuuuuuaguucaacaacuguuagguuuugcucacguuguauaugccuuucauuuguaauuuauuuauuguaacuuuuugacugaguuuugggaauuauuugauuggcguguauacucugccugcaccucuguaacuguguaacauguguaacaugauugcauuaucuuauuuaaaaagaaagcccaaguuuaaauuucauuuguccaguaaauguucucaauaggaaacccuuaacauaacuguuugugggauguuuuauccgcugugguccacagcagugcagaucguuauugcucuuucauuauuggauuguuguuuucgucucugaauaaaaucagugaaucuuuuccugauguguauguauauaugcauuugcuguggauuaccuaguaaagacaguaaggauagguuguuuuuaacauuauggacuguuuaauccaaugcauacuaaagaaagcuuaguuacuguauuguucagugaaaguuggaggaaguggcugaaagguccauaccugcaucuauucuguucagaugcuaaagauuccagucucuuacugcacugaaccacuuucaccauauggucuggcuuuguggccauuauaccuucccucgugcgccauggaacacuucuuaggccuguaucuuuggguccugucuucacaaaguaauguucccauaguuacagauuugggauuucauuuuauauuuaguuuuugacacuuaaguuuuagaguuuauuuagaugccauuuuuuuauuauucuucauucaaauaggaaucagacgucugccaaugaacacacuugucuuuuuugaaucaauguuuuaaugcacuaauaugaaugcuguaagagggguuaucuuaguuuaucauuuguguuuuauaauguucuuacacagcaguuugcuaaugauggcacuguuuaauguggcucugaaaccuuuaaaugggaacaagugaaauauuaacaaaauaauuguaucuuugcaagcagaauaaagaugauucuggagaugucugcuaauucugagucccaagaacucuuucccuggagcccaggcuucccagacauuugcugcugacuaugcaccauggugggacauuccacauauuucugcugggagguuuuguuuuuuguuuuuuuuguuuuuuuuuaaauauuauuucuuagaguuccucuuccuccuccucuucuucuucuucuuuuucuucuucucuuccuucuccuccuccuccuccuucuucuucuccuucuccuucuccuucuccuccuccuccuucuccuuuuucuccuccuucuccuucuucuccuccuucuccuucuccuucuucuccuccuccuccuucuccuccuccuccuccuucuucuucuccuucuccuucuccuccuccuccuucuccuuuuucuccuccuucuucuccuucuucuccuccuucuccuucuccuucuucuccuccuccuccuccuccuccuccuucuucuucuucuuuuaagauauauauacauauacacauuguagcugucuucagaccagaagaggacacuagaacccauuacagaugguugugagccaccaugugguugcugggaauugaacucagaaccucuggaagaguagucggugcucuugaccgccgagccaucucucuagcccccacauauuucuggaucacugguuaacauguuuaauuuuagagugacgaauggguuguucucacagaaaccauuuuugugggggucuggaacacugaaguuuucuggugcccggcuccuacuguuuucauggguggucaggagcaauguauacacaugcuuccagaugagugccagccugccaggccggcucccacaaggucuucucuuccaccugccccuguagcuugugugucaaacagugugcugccaucuccuagcuggaggagagucucaguggcaucuguuaaauggcucugugcucccaaggcaguuaauccucgugggaccacacccauuuguuccuguucucuucauaguggaugccccacaacagcagagcucuuucaaaaaucggggcguaacuuagcaacuuuacuuaaaauuggaacuuaaauuauuauuuugccugguccacuggccauugaucuaugacaggaacuuuaguugcuguauucuuuuaaaaagcuuuaauuugaggaaauguucacaaagauauuuagaacaugaaacugacuuuuauugacaauauuuaaauguaaaacaagggaauugcuaaaugagaaaaauaaagcuuaagcuuuuccucaauu

SEQ ID NO: 5443 - RNA, 3249 nt, Mus musculus
cauucaguucuuuggcgagccggcucccgggagcguauaaaagccagcgccgcccgccuagucucacacagcucuucucuccaagaagacucagccagauccacuccagcuccgaccccaggagaccgaccuccuccagacggcagcagccccagcccagccgacaaccccagacgccaccgccuggagcguccagacaccaaccuccgccccuguccgaauccaggcuccggccgcgccucucgucgccucugcacccugcugugcauccuccuaccgcgucccgaucaugcucgccuccgucgcaggucccaucagccucgccuuggugcuccucgcucucugcacccggguaagccccgggacugacggaagggacggagggagggcagagugagcugcgaucacagacugaccucccuccccuuccucuccgcagccugcuaugggccaggacugcagcgcgcaaugucagugcgcagccgaagcagcgccgcacugccccgccggcgugagccuggugcuggacggcugcggcugcugccgcgucugcgccaagcagcugggagaacuguguacggagcgugaccccugcgacccacacaagggccucuucugcgauuucggcucccccgccaaccgcaagaucggagugugcacugguaagacccucagccccauuccagcccccuuugcagaggccucaccuuuugguguuggaccaccaccucucucaaguccagcgugauacccucuagaaaaagaaaagccccuauccgcagcugcuuccaaccggcccccugcaguccugacccuagcucgucaccuugacauguacagugauauagcuagcuguucugaucccugugacccuacgccugaccuacaacuuugucuuccucucccgcagccaaagauggugcacccugugucuucggugggucgguguaccgcagcggugaguccuuccaaagcagcugcaaauaccaaugcacuugccuggauggggccgugggcugcgugccccugugcagcauggacgugcgccugcccagcccugacugccccuucccgagaagggucaagcugccugggaaaugcugcgaggagugggugugugacgagcccaaggaccgcacagcaguuggcccugcccuagcuggugaguugucaccuucaaaguuacuguuauucauucuccccaacuucagggccaaugcccaaguccaccaaauuaaggggaaauuguccuauccggauguuuuaccuuguguuuguguguucugcucucacagccuaccgacuggaagacacauuuggcccagacccaacuaugaugcgagccaacugccugguccagaccacagaguggagcgccuguucuaagaccugugggaugggcaucuccacccgaguuaccaaugacaauaccuucugcagacuggagaagcagagccgccucugcauggucaggcccugcgaagcugaccuggaggaaaacauuaagguacauccucugccccuagucacuccguuuuacagaaugacagggaagagaaccgagcuggcugucucaccucccauguuauuagaggccuguugucuccagaaauaucuaaccauggagcugucuggcuagaaugagagaugcuguaacaacagcugccaguuuuccacuacaaaauuccccguggugcuaguuaauucaagacacuccaaaugaggccauggcuauuuuuggaaaacuggcaaaugaaacucccagucucuccccucagaauauaaacacaagucagaugacauagggcuagucuacaaaggcuugaggaaggccacucccguuguaguaauugcuguuucuccuucugucuuccuuagaagggcaaaaagugcauccggacaccuaaaaucgccaagccugucaaguuugagcuuucuggcugcaccagugugaagacauacagggcuaaguucugcggggugugcacagacggccgcugcugcacaccgcacagaaccaccacucugccaguggaguucaaaugccccgauggcgagaucaugaaaaagaauaugauguucaucaagaccugugccugccauuacaacuguccuggggacaaugacaucuuugagucccuguacuacaggaagauguacggagacauggcguaaagccaggaaguaagggacacgaacucauuagacuauaacuugaacugaguugcaucucauuuucuucuguaaaaacaauuacaguagcacauuaauuuaaaucuguguuuuuaacuaccgugggaggaacuaucccaccaaagugagaacguuaugucauggccauacaaguagucugucaaccucagacacugguuucgagacaguuuacacuugacaguuguucauuagcgcacagugccagaaugcacacugaggugagucuccuggaacaguggagaugccaggagaaagaaagacagguacuagcugagguuauuuuaaaagcagcagugugccuacuuuuuggaguguaaccggggagggaaauuauagcaugcuugcagacagaccugcucuagcgagagcugagcauguguccuccacuagaugaggcugaguccagcuguucuuuaagaacagcaguuucagcucugaccauucugauuccagugacacuugucaggagucagagccuugucuguuagacuggacagcuuguggcaaguaaguuugccuguaacaagccagauuuuuauugauauuguaaauauuguggauauauauauauauauauauauauauauuuguacaguuaucuaaguuaauuuaaagucauuuguuuuuguuuuaagugcuuuugggauuuuaaacugauagccucaaacuccaaacaccauagguaggacacgaagcuuaucugugauucaaaacaaaggagauacugcagugggaauugugaccugagugacucucugucagaacaaaugcugugcaggugauaaagcuauguauuggaagucagauuucuaguaggaaauguggucaaaucccuguuggugaacaaauggccuuuauuaagaaauggcuggcucaggguaagguccgauuccuaccaggaagugcuugcugcuucuuugauuaugacugguuugggguggggggcaguuuauuuguugagagugugaccaaaaguuacauguuugcaccuuucuaguugaaaauaaaguauauauauauuuuuuauaugaaagg

SEQ ID NO: 5444 - RNA, 3375 nt, Mus musculus
ugugauugggucucuucagguuuaguggcuuuccaucaaaaaacuggacuuuugauggaaaauuugugaguugaggauaucuagcuuuuguaaaaaucugacucuauguuuauacacacacgcacacauacacauguacacacgcacacacaugugcacaugcauguaugcaugcacacacacauguaacacaugugcacacacauguacacacauacacauguaacacacccacacacgugcaugcucuugaauaugcacaugcacacacauaugcacaugcacaucccaguccucuuuacuagaaauaaaugaagacugaaaagagcccugagcaugguucucucaggccauuaaaauugggcuuuguuuggaugaaccccgagagaacucauuggcacuugcaaagugacuuuuuuuuccacugugaagaguguuuucucugcacaagagagccccccucccccacagugaugggagaagagcuuugccuggcuuaguucuucaguuugaagcuguguagaucugaagagaauucgucacucaucacuuaacaucuucacugugcacacgacaaaugacacagugauguaacuuccccucaccgacauugccacugacauugauguaauaacuuagaagguguuguuuuguguuacccauagccucuggcaugcauaucuuucagucuguucuuuccaaguuugcuacuuccugccagucugucuaagguuuuguuugguuuuuaugcuaccuuuuauccauucuguuguucccaguagguuuauauauaggcuacuguuuuauuuguaaaauguuauuuguguuuugcuucuuuaugucuucuauuugcugaaauuuuuuauugcuuccauugaguaucaauuucuucauuuguuucaugugcauuugcgguugcugguuggaacauuuuuacgaugcuguuguacagugcucguugguacauccucacuuccucugucaauguuuguuucuauguguaguggguuucucuugucuucaacauauuuuuuuugcuucucaugauuguuuuaaauuaaaaccuggauauuuuaggcauucuaucuuagcauucugcaucuucgguaaaucuccucugacaucaucccugcagaaauacuggggacucggccuccuucuuacucucugggagaugaaguauuucaccuccuccauugauauuaggaugagaggagguaagcggaguggggaauucagaucucuguucguucauugcugaugccucccgugcugggaugugaacaguaccacuuacugcuccuggcgggucuccagugaugcaggcauccuggagaaagcuucaucaccacuggauagagaugacccucucaggcuacucagccuccacuggcacugcccuggcagcggagcuggagagcuggguauggcuuuuacagcuugccagccguagaaguguaggcuccacccccuuggcuggugugggagggucuuuuuuguguuucacagaagcaaaguagauucuggugagcuccgcccuuuccugcccuuuggauggggagaguaagccguguuuuccacucccugcccugucauucuggcaucuucaugcuccuucaucaagucugagggaaaugagcuaaaaggaaaacuugggacacggaacguuacucuugaguucugagguacuuagccugccuaugugguacucaguccuccuggguuuguuuuuauguauaauauaaaggcuuugucacccaauuagcaguauaugugcuuaguuacacgacccacuuggccugaagcauccuaguggggcuucauuaaauggauaggcucccguucucugagcuagacacugaagucguaaagaggagcugguuacaauuccuauaaucccgaggaaacaggcagcgguggcagaagugugaguggguuccuaaggagcaggaaaugucacugaaccaugaaagauauacuggguacuuaauucagaguccauaguucuuagggucuaccuguaggugaugguggcuuuguccuacuuuuucugacaaggaccaauaugcaaaaagaacccccccccccacuuuaaauccuaaaucugacuucuguaccuugggaguccauacuucuuaaggaagguuccuuagaaaaugacccguguggucaguaccuucauugcugagaaagaaccaagcaggaguuuuuaaacaauguuuucaagaacaggaccacagugggaagaaggugaaggcucagagucuguagggaaaggauaucugaagcguuuaaggacuguuuaaauggaggcuguggggagccauguguucaggagaugugaugaggugaggcaggugacugcccgcagacguuugguccuccuugcccuuuccccuguuauuagccaggguaacuucuguccugugggcacauacuuaucugccagaggaacucacacuugaacuuugaaacaauuaagcugauuacccuucguguagaagcuuguagcaggaagagagugauguaaacgcauuccuaagcgaaaauuuuagcaugguuacaaagcagggacauuugggggccgguuuuggucagucuaaauauuguaagacaaccaaaaauuauucuacaggauguaggugugucuauauugagaaaugucaauuucuuaauaaaacucuauuauauugagucuuggcagcuugccuauguggcuguguguauguguguguuggggugggggagggguggagcuuccuacagaaaaaugauaccaaguccaggcauuguugacauuaaaccgcagcugcguuguuggagggagaaaaggaauuaaaguucacuucagguucgcagagcaaacagugccagccugcagccucuguccucuuuggggacaagggcaugugacugucauuucagagucagaaagagucugaaauuagaggaaaggugcuaacuugugacaacuauagacauuuucagugugaaguguuugacuguauuccuuccucuguaaguaaugguucuaggaaagugcugcuuucuagaaauuauaucuaucaucagaaucuacaaacacaugaaauaucaugaaaugugaugucuuaguuccguacaaauggcagaaucggccugaaugacacagaaauugacaaagcaaggcucagcuuuuuuucucuuguaacuuugcauaguauucucagcgucuuccuguuuugugaaaagaucucuuaccaguuuacaaugcaacugaccuguacuuuacugugcuucucaaugcucuuccagcuuaacucuauguugaagcauaaacuaucuggucaggggauaauuucaagguuuuaauaaaaauaaugcuuugacuuaaua

SEQ ID NO: 5445 - RNA, 43698 nt, Mus musculus
cagagcaagagagagcggcggcuuccugcugguggcuccgccccuccgcuccauucuuucccgacccuggcucucacccgucugucgccggguuccccgggagcccggggcucgaugguaccgauggagacgcaacugcagagcauuuucgaggaggugguggugagugccacuguccguaagccagagccauggcuccgggaagugcaggcugcgugcggcuccaggcugcgggccugggccagcuccuuucccgccccuauguugacauaggcgucugaaccgggguggcgguccccccauccccggacugcugccagaucuaagaaagugcuguuaguucccgccgcgguccccauaaaagugucgugcucuaucuguauugcccgggaauauuucucucggggacaucucccaccccgcccccuuuuaguagucagaucguuuacuaguuuuuguuuguuugcagaaaacagaaauuauagaagaggccuucccagggugaguauguggcaggcagaucuuuguguguguguguguguuuuuuuaauuguuguuuguagauuuaucuuuguuagauuccacuuaaguugguuuugaggaguuaaaaaaaaucuaccuugcaggauguguaccuguuuaaaacuagcagcagauaaugugauuuuuguuuuuucagaauguuuauggauacccccgaggaugaaaaaacaaaacuaauuagcugcuuggcggccuuccggcaguuuuggaguggacuuucucaggugagacauuucauguugaacauccacuuaaugacguuugacgccuuccuuuuuacuuuuuacaucuucuuugaucuuuuucuuaagaucguuuaggaaagggaaaaauaagacugcugucauuuuauguaaauguacuuacuggagaaccuguguuaaaaguucaagguaauaagauugcagugggaaauguuuuaaaaauuuccuucuauguuauauuauguaagguaguuuuuauccucuuuguauaaauuggcuuugaauggaaacagauaugcuaaacuuuucucguaaaagaaaaaugucacuauucaaaaaauggcccaguauuuauaaauauguccucauaaagacacugugauagaguccccacuagaguaguauuucucaugaugcacuguagacagagaagugagccgcugggcuuucugugccugugagcuaguauaaaauuugccacccaguuauggauccuaaaggcaauauguucauguuuuaaacuuucuauuuucaacaggucaugcuuugacgugaaccugaaauauauaaggcaagcgugaccaagcuccacacgcuggccgucuuccugaucuagcucagccaccugcccuuccugucugaagccagcauccuaguuuguguucccagaacuguuuagcuauaagacugucucucuguguccugaguucuaggauuauaaagccaucuucguucuuuucucuuuaaacagugcugggguguggggggugaacacagggccucacacacuggucuccgaacaugugaacauguguccacaugcuaggcacacagucgucucugaacuacauccucaggcucacaauuauuauuacuauuauuauuuucugcuuuuugaguucgagaccacgcuggccucgaacucagaaauccaccugccucugccucccaagugcugggauuaaaggcgugcgccaccaccgcccggcucagaauuauuuuuauagaaucaccauauaccauagguauuggucagcaguuagcucuguacuucucaccauuaauaauaaguucuaaagguauuucaaggaauuuuuugaguuacaguuucuuucuuacuucuuauagcgguguagcauauuguuauguguccuuaccaccuauauuuauuaacuaccuucuugcuuucaaauuuuucuuucuuuuuuuccagauagaguuuuguuauguagcccagguuagacuugaacuuuuagucugccuuccucugcuuccuggugucauaggauagaccaccaugcuuagcuagauguuucucuucacuuuuuacuuacuuugggugugaguguguguguguguguguguguguguguucaagacaggguuucucuauauagcccuggcuguccuggaacuuuguugaacaggcuggccucaaacucagaaauccgccugccucugccucucaagagcuggaauaaaaggugugcgucaccaccgccggcccacuacuuuuuuuuuuuuuuuucgagacaggcuuucucuguauagcccuggcuguccuggaacucacuuuauagaccaggcuggccuuaaagucagaaaucugccugucucugccucccaagugcugggauuaaaggcgugugccaccacugcccggccggcccacuacuuuuaaguaguguuacaguaaguaguacuauugaucaggcauaggauugaauauugggcauaauauugguauaaaucaaaagcuuuuuuuuuugucuuaguuauggaggggagguguauaacacacaugauauaaucucaguguaacgcagauuugccugggauuugaucuguaguccagauuggccgugaacucaugacccuccugucucuauguccucaguacugagauauacgcauucauaaucaccccagcaauuuauaauuuuaaggaaauuaccuaauuauuucuuauaaggguuaucuaguuuacauuaucaauaccaacaaccaauauaauuuccugaaggcauauaauaaaauaguaauacuuucuuauccuuguguaucaagcacugggaaauuuuaucuugguaaaauuuacuuuuuaucuuucaauauuuagcacauuuuaugcauuuuuaauuuuaaaauauuuguuggucuuuuuauuuuaacuuuguguguguguauguguguuuguguguguguguaugugugugacaguacuuguguacaggucagaggacaacuuacaagagagagucucuacuauacggacccugggaaucaaacucagcaagugccaugccugcugcaccccugucaggcacauggaauugcuaaagucauuuccuaaggauuuagugauuuaugcuguggccuuucaagauguuuauauagugagagagaaagauacaaauacaauuggcaauucuaaaucagaugauggguggugaucaucuggaggagcaagguguguagauccucccaggaugcucuggaaggcaggcuucagugugagcauggcuuugguaucaagaguuaacguagggaaacuagaaguucgauuuuucuuuggauuauggugggcucugauuuggguucauggggauuggagucauuuaaauauucacagugaaauauuucauuuacaguauugauagauuuucagguauaauauuagcauuuguguuacuuagaaauuaugacuucaggcccaaaauaaaagugucuucuaauuuuuaggagucucaugaacaguguguucaguggauuguuaaauuuauucauggccaacacagccccaaaagaauuucuuuccucuaugacugcuuagcaauggcaguugagacuggucuccuuccacccagguauguuuggguggggaugaacgguggaaagaccuuugguuauaaaguugcggacuugcuuugagguuguuauacagagacaagagaugggaaggggcauggagcucauaugucaguugacucaugaggcagggcuuuuguuuuaaauuuguuuuguuuuuauguauaugcacuguuagugauugccauguauguaguguuccugaggaggccaggagagggcgcuagacucccugaacuggggcugacaguacaacagcauugugagcugugaagugugggucgucuccagccuagugcuuguuuuguuuucauaguguuucauaauuauaguuaguguggcgaagacugaaauccuugcaaagcuucccacacucagucuacugggaaccuguauuggggcuuucauccaggugucuacuggugacuacacuggugacuacggugucauccugggaccuggcuugcucccaggcugguagaauucaaaaguuuguaauaagaaguauagucaaguagcuucgagucuuugccauagccuuaagccugcucagauaacacagcccaucccucuaccucucugaggcauguguaucagugccaugcuucacagaaguauaugggacugcacugcagucaucuugacaagaguacagucugccaccaccuaguagaugauaaacauuaccaacagcuuaugagagugcuuuuuuuuucccuaguaaauaucauuuaguucuacucaauguuugagcuuucuucuaaguaagaauuaggaaguauuucauauaccuggaauacuuuaacaguauagauuuagaaagcauguuuggcauggcacuuuaacaguauagauuuagaaagcauguuuggcauggcacuuauaauacucagcaucuacaggucauagccguagagaaucuuuaggauucucucuuguaacugaauguucuuccccucucucccccccaggaugguuugugaaucuuugauaaacucugacucucuugaaugggaaagaacacagcuuugggccuuaacauuuaagcugguucggaaaaucauuggaggaguggauuacaagguauuauuucuuaauuauaaaaagugauugcuuucugacaugaaucuuuuuaaaaauagggugugaaucuuacuucacagaaagaaagcagagaguauucauaacuugacuuuuugcauaugugcugaagggauuuaaaacuauucaacuggcuuacuguuuuuucccucccaacauuuuaaaagacacacaggacuaauauauuuuuaugaugaaaugggaagucacaggcagaauccauguuugaugccagaguucuuugucuugugagaugaagaacacagagugggguuuguuuucuacguuggucucuuuggaauuguguccuuccuuacuggaugucuucaggguucugcagcugaccgagcacagcagcagugcugugucuccuuguacuucaagguccggucaggagugucacagcaacagcugagagcaguuuucuucauguacuuuuguuacugucaaggaauugccaguguguggccuuaugcuuuaugucugcauguucuucaaucugaaaugauccaguagugaccccagaucagucacagcagacuucucagguccccagagugcuacucaacacacaucucugcacagagcaaagcugugcuuucuuacaaagaaagaguagaaacccuuguaagaguuggaacccuucaucuauuuuugccagaauauaggaaguuccauuuuacuuuuaagugauuuucauuguucaugcagaauuuuguccuauuauagagcauuauuauucucagguuaguauuaguaaugaauuggaaaagucuaaaagugugaccuagaagcaguguauacuucugacaccuggcuguugugucucacauagagacuucacacuuaccuuuuggcuugacucaacaucuucuugucuucuuuauacucaucaggguguucgagaccuucucaaagcgauuuuggagaaaaucuugacaaucccaaauacagugagcucugcuguuguccagcagcuucuggcagcaagagagguaaucagaauguaaacaugccacccacgucuggguuuguuuaugugugugcuuuuaaagcauacaguggcuggagcuggggagauggcucaguggggaagaacacuugcugugaaccaggagaaauaagaguucaguaaagaagccaggcaugcacccugcugcccaaugccauagcccuguguuguggcacagagacaggcuggucagugagccuggcagaaaccauuaggaugacacuugauauuuaccccucuccucugcaugcacacacugugcauauaacucacacagcacacacuaguaacuugcaauaguuguagaauauuuaguuccuucuacugaaauaaaaucaguucuguuuuuuaaucaagucaucugcugcugagcuauaucucagcccaagucauuuuuguuuucagagauuuuugcuucauugcuccuggauugcaaaaggaaauuuuaaaaauuuaauuucugcucaauaguuaugaaaggaguauaaaguauuuuaaaucauuauaagauaguggccauguuuaucuuuuaaacuauuaauaauacuguaauaguuauucuuuuuucuguuaccaucuuaaaucuaugacuauuuaaagcauuuuaagguauuacuacccaaaaugcauucuguuguuaauacccuucauucucuaagagaauuucucugcuaauauuauauuuuaaaauaauaauucugcuuuguaaaagaaugugcacacauguacauaugugugcauauaccuuguggaaugguuaagucaggcaguuucccauaguuuaccucagucuucugucuuguuuuuugagguaggguaucauguaacccagcuggcucugaacgaauuugcagcuuaggugaagaucggccugagcuccagauucuccugucuccaucucccaagcauugcgaucucagacacaaguuccuuacauacauuuaagaucuugguagccguuuucaaguucauaauguauucugauuaacugcagucgugauguauaacagaccuugaauuuauuccuccugauuuccagaagugagucuuuuuuaaucagcauguugagggcucccucccacacagauacaagcacacuuugccaacuaagcuauugucccagccccauuuagucauuuguaaauauacuuuuuuguuguugccgucguuguauuuauagguuguuugugugagccuagucaagaauaaugcuuuuugcuuguuuuagguuauagcuuauaucuuagaacgaaaugccugccuauugccggccuacuuugcagucacagagaucagaaaacuauauccugagggaaaacuuccacacuggguaaaauuuucauuuucuaaaauuuuaaauuccuaucaagauguuauauaauuguauugcuuguauguacacauacugugugugugucugucugucugucugucugucuuugugucugucugccuaucuuaguuagguuuauauugauaugaaauaaacaccaugaccaaagcagcuaaggaggaaaggguuuauuuggcuuaaacuuccauaucauuuugugcuaucaaaggaaaucaagauaggaacucaagcagggaaggaaccuggaggcaggcgcuucggcagaggccaaggaggccguggagggugcugcucacugaccugcuuucgugguuugcuuggccugcuauuuuacagaacccaggaccaccaguccaggaagggccucacccacaguggguuaugugaucacugagaaaaugacuugcagccucaccuauaaucuaauccuauggaggcaguuucucaccgggggcucccuccucucagaugacucuagccugugucauccuuacauaaaacaagcaaacacgaaccguaugucugcacaugccgcagugugaguguggaguugggacgcuuugaaaguugguuuucuccugugucggagggacucagcauuauguuagcagguuuucuccugugucggagggacucagcauuauguuagcagguuuucuccugugucggagggaaucagcauuauguuagcagguuugcacagcgaaugauuucaccugcugagccuuuucaucucacagccccuuugagaagguaauuacguauuagagugaacagagaacucgagacugggaggguuccaaaggaagacucaggucaugugcacauuuucacauggucagguauccuuaggcucuacauaguuuacuuaauguuuauuugggguaggggcagucuguguaccccguguaugugguuagaggucaguuuucuugucucccugugcuccggaucacugauauuucaggcuuggugccaagcaccuuucccucuugaaccacggcgcugacccaggaaaugcauucucuuuuuagcguaacauauucguuuuguaucucuauuaacccauugagacaguucuuaugugcuuaaaaacuacaguuucauugacuggguaaggaugcaguggugugacuuggcucaacuuagggacacauggagacaaguguuuggaagaaaaagaaagagcacucgucucuaaguaacugccugugccaggcuuuguacugauucuguguaguaucugaacuuccauagaugaugcacggagaugcaggauaaccuuguuuguguauugauuuauuuauuuucuuuuucuuuuaguuacuaggaaacuugguaucagacuuuguggauaccuucaggcccacagcaaggauuaacuccauuugugguaagauccauuuaaaggacacuuaguguauuacauaguaccuguaucguuagugggcauagcugaagggcggccucuuagggugacucgccacuuugacacucuaggagucuaauaaugacguuuacuuuuaggugcuuugauuaaggcaaagacagcacucauagacuugggcaucucucacauacgaccauuccaacaguuggguuucaucugacuagaaacacguuuuauuuuauuuuguauaucuuaguuagccgggcacccuaucguuauauuuugguuuuggcuuuuuuagacaagguccuuaaaaucaaggcuagccugagauuauguaagcaagggugaacucgaacauuugauucuccucuguccaacucagugcagggguugcaaacaugagcugccacacucaguguaugugguuguggggagagaacccaggacugcgugccugcugaagaaucuaccaccugacccuauuccuggccccugaaaaugcuuccuaaacucaggaccacuggaaaugucagcuagguucuucuguagccauaguaaugagaauucgagacucuccagucuauuguaacccaggcacuguaaccuaggcacuguaaccaggcacuguagcccaugaacuguagcccaggcacuguagcccaggcacuguagcccaggcacuguagcccaggcacuguaacccaggcacuguagcccaggcacuguagcccaggcacuguagcccaggcacuguagcccaggcacuguagcccaggcacuguagcccaggcacuguagcccaggcacuguagcccaggcacuguagcccaggcacuguagcccaggcacuguaacccaggcacuguagcccaggcacuguaacccaggcacuguagcccaggcacuguagcccaggcacuguaacccaggcacuguagcccaggcacuguagcccaggcacuguagcccaggcacuguagcccaggcacuguagcccaggcacuguagcccaggcacuguagcccaggcacuguagcccaggcacuguaacccaggcacuguagcccaggcacuguagcccacgcacuguagccuaggcauuguaauccaggcacuguagcccaggcacuguaaccaggcacuguagcccaggaugaaggaccugccauggccuugagcacauuuacauggaaauauuuuuguaaugcaugcaggccgaugcagucuucugccaguugugaacaacucgggagccaucuguaacucauggaaacuggacccugcaacucugcgauuuccuuugaaaggccuuuugccauaugauaagguauguuuuaaauccaguguaggauuggccaucuaagaauaucuauccuguuuuuucaaguauucgaugccagauugccucucucucucuucuuuuuuuuuaaagauuuauuuauuuuauuuuaugaguacacuguagcugucuuuagacacaccagaagaaggcauuggaucccauuacagaugguugugagucaccaugugguuucugggaauugaacucaggaucucuggaagagcagccagugcacuuaaccacugagccaucucuccagcccccaucagauugccuauuaauagucuagagaaguaaauggugugugcuucuguugugucuuugguuucugugucuuugcuagggucuugcuguguagccuuggcuggccuagacgccauagucagccuugagcugguauggucccuuugccuuugcuguuaaguguuggcacggcagcugugccaccagcccugggcuuaggccaguccacuaccccaguguacucuguagaguugcuucagucguacaccucugguuaacucucuuuacguagaguucuugucuaaggcucuacauuuaaaaaccuaaugacuccggauuugaacucaggacacacacacacacacacacauuacuauucuguuggccuuuuaccguugucauguuuggaaagaguaauuaccuugaagagaacauuuggaaccauauccauucgcuuugguuagauuucuaagcagaaaauucuccuucuagugauguuuauagcaaauguggucaaggcaaagagggugcguuucuguaaucacugaaauuggggcauuuuccugcugaggagccgcagucccuaacuacauuccugagcagcuugcagacugugcuggcuccagucuaguugucguuaggacuguaccuacaaagcuaguugcugugguucauaucccuagaacucagagcgaugaggcaagaggucacugugaggcccaggccauccuaggucucaaaguaaguuuuagaccagagcaauccugucucagaaaagcacaucaacacuugcuauacagcuucuaugugaagcagacucugcuuauucggucuguaaaugauccauguauguuuauaugccacaugaaugcagugcccguaggggucacacagaggugucagauccuccacagugagaguuuuaagugguugcgagcugcccaguugguacuagaauugaauccuggcccucuggaagaucagccauuccuccagcuucacaaggaauccuuuaaaaugauuacuugaagggcauguguguaucucccuguuacuaagcacaaguggaggacagagcauuaagcacauagagagcugggugagcugagggaugggggucuauugaaaaggaaaaaucauuuaugaaagcaauaauuguucuuuaguuuuacuucacaguuccacuaguacagguuuuaaaagcauaucuguaaaaucaguuuaaagccaggugugguggcacacgccuuuaaucccagcugaugcagaggcaggcagaccucugaguuugaggccagccuggucuacaaagugaguccaggguagccagggcuacacaaagacaccuuaucuuaaaaaacuacacauagacacacacaaaaaaaucaguuuaaauugcucuccccugaccccauuucuucuagaauuccaucuaagagaucuauaaaaaauugcaaucaagugaccauuauacagauagaugguuucugaaguaaacuuugcagugacuauccaagugacggcucuggcagcacauacagaaguaaggauggggcauguguuaggagacugauggcggcucagacacugcagcuaauaagcagauucagaguaagccucaacagaaucucucuacacuuguaucaugucccagcucuguuagagugagcugacacaggcauagcacugcucucccaaacuggguuuaaauaugacauuggccacuuuggcacaggacccagcagcuuauacugagggaguccaagauacuuauaccacaccuguaaccucagaaaaggguucuaaguuuggauguaccuuuauagugguaguucuguaaacuagauuuaauuuaagaaauucugugggccuugggauauauauggcucaguaguuaaguaaacugacuguucuuccagaguccugaguucaauucccagccaccacaugguggcccauaacuaucuguaaugggauuugaugcccucuucuggugugcagguguauaugcagauacagagcacucauacauaaagauaaauaagaauauuuauaaaaaaaauuguguguuuaguuacguagaaacuucuggaaaauugucauuuugcacagaaaggaaauaaagaugcuucauuaugucuaauaaauauggccaaggacaaaaacuuaccuaaacugacaacuacagacuugacauuguaaggacagucucugaaggggaaacuaaauguuuugucuucaggaagaggggaaauggaaagguccgacucaaguguugucuucacuuguaacccuuaagaggccuugccaaaggcuuccaccuugauuuggaaaugagagagccaagguagaaaccuagccugcaagcaauaaaugucauuuucccacuagauuuggccuacuaugggaagguaaaaagugcacgaggagagucuccucuuaauuccaaacaguuugaauucaccuuuguuaaucuugaagcaauaauuucuuuuuuauuuccuuugaaggaucuguuugaaccgcagacugcuuuguugagauauguacuggagcaaccuuauuccagggauauggucugcaauaugcuagguuuaaauaagcagguacuguaccacgcugggagccgugaaucuagacccgcacucugcuguuuccuuugcuguagcucaccgggcaagacaguuaaggacgcucugacgaccuuugcaguacacagguuacucagcaguguauucuauaugguuuauauauauauauauauaguacauuaagaauguguacauuuaaagggagguauuuuuaaaauugguuuguuuugcauugcuuuuuuccuauaaggccaguuucaaguucccuuuugccagagaaaccuacacaugacuuaaccauauuuuuugaccuuuuguuguuguuguuugguguauuuuuauaacccugauauccucagaguggccgccuugcugacuuuuccuuuuuuuuuuuucuuuuuuuuuccccucucuuuccuuuuggcgugucggugguugacgugugggcggguuugugcugacugggguuccuugaggcuggccucauagucaccguuuugucucuucuuuuuuucuuccuuuauuuuuguucuguccugucuuguccugcccauccuccaaugcucuagaccuugaacauugcucagguauguucacaaccuuacuguuguauugugacuaacgauacgcuggccgcuuuguagccgcugauucauuuagacaguacguguauggucggggcuugaaauuggcgggaccaugcugagaccaaggccacugaaaaccuucuugggaugugagaguucuuuuugguggaugguuuuugguuuuuugugguuuuuugaaauauauauauauauauuugaaauauauauauauguauauauauauauugguuucuuguuuuuuuaaagaaagagacaacacuuggcacucaguaagccugucaguuuuugaucguuuuuaccccccaacuccauuuuacuguuuucauuuuagggcuaaaguuagccugauggaauuuucagaguuggaaagauuggugguagccucaugucuuuccaggcuauuaacaaaaacaaauaacaacaacaaaaauacuuguguugauuugccuuaaaaaccaaaacaauuuaaaaaaggaaugaaaaauagaacauuuucauagagauacgcugccuucaaaagucggagugguaagcucuaaagagggaaggcuuuuuggaaacauggggauugacuaagaaaugucacacucuuaggugaccccacaccucuuugucagucuuugccagaugugcccuucucuuagagcgggcuuuucaggaguggccugccuguggcaggagacaaccacugugcuacauccaguaagcugaacucugcugcagcccaggccauucugggcuucgcaccugugagaguuuaagcacaauagugguccuaguuaauuuuuguuaaccguuuuugagcccagcauauuaaaauugagcagcuuuuugguuuuaagaagaggcucuuucuaggcucuguaaaguggcguugcuguuugcaauaccauagugaagguugugccagugcuuccauugauaaagcccuauuuuuacggacauacggcuuggccauaaaccuugcucaguguugaaacugcaugccaaacucaccacaguagcaauaccuuuuuuuauuuucaguuuuuuuuuccuucuaaaaaauuaccaaguuuccuuguuuagaagagccuuuguaaagcgaaacugaaauucccugaccaccaaagucccugacaguuaccuucuguaaccugucacauuaacucugacccgcuuucacuugaguuagagguaaguauuagcuaacuuugcaagaaugcuucacucuuugucugaagauuaaguuugaguaagcauuacaccauacuugacucauuccucuuauaauuugguggcuaucggucauugaagcugcaaguacaucccccagauagccuuagcuaccuaugacucccuccucccccagauagccuuagccaccuauggcccacuccucccccagauagccuuagucaccuauggcuuccuuccucauuggaggaaggaggcagcuguccucaaaauagaaacugacaaaauaauuugagaagaguuuuuaugaucugaucauuuuaauaacaaguuucaaccuauaaaaaguuuaugacuaagacauaaauccauaaaaaauaaaguuuauaauggaaaugcugacagaacauuauuaguauuggucccaccauagugucaacauugucgaaacuucacgauucaucaguaacuguugucuuaggcagcucuguagugaggggucuacagaugcaagguaauaugccgaagugccuugguggauuauuuuacauguggaaaggaggguauggaaggaaaaccagcaguauaaauccauaugacuaaaaugaauccagccaucuuauugcaucucuuaucaucacagaacuguauacccuaugcuguacuuucuuguccuuucucuaacagugcaauaauuaaagcuuagagacuuuaugaccuguccacauuacauuuuccaguaggaauugggcuaugguuaauccuaaaauuggucacaggucauaacagcccaguucuacagccacagcaguauagcguguugagcuugaacagcaguggaaaaagaggaacguuguguucuggguugacauagaauuucuaguguuuuuuucuuaggaauaaacgcguucuaagucauguauacuuccccagcuugucugugcugggcauaggagcgaguacuaacuggcucugguuagcagccuccuugguuaaaguagggauuaauaaaauugagagauuuaguccucccaacuuguucugaagacaguauuaaaauucauuuaaguuacuauuuagaauuaacacuuuguaaguaaaauuuaugaaauguuuaaugcaaaagugagcuguuauuucaaaaguuucccauaccacuuaguaguggguuugagugggcacagaggagcucugucaugugcaguuggccaggggugggaaggaagcagggcacaguggaguugaggguaaaauaggguuuaguacacauuaaacuauuauguagaaaaaugauuuuuaaauacugaauuggauauucucauuauuaaaacagguuuaagcuaaauauacauguagauauaauuuaaauguucgguauuuauguuaaucuauucauaaguaaaauuauugaaguaccucucauguuuaugcuuccugcuuuguaagauaaucugaaguaugauggaaacccuucguuuuagcauacuuauuuuauagugguugaaaacuaaagcagacuggguguggugucauaccccuggaauccgaggcugaggugggaagacagccucaagugugaguucagccugggcuucauagugaguaccagguucuccagagcuacagagcaaaaccucggcuuaaaaaagagauuaaagcagaaaaugaaagcaaauuuacuuuuugcuuuuugagaugggucuugcugaggcgcccuagguugagaacacugcacgacaggcugcccguacagcauacauacagcccccacccccuaguggcggcugugugcuagaccagcagacuuuacugugaaguacaaguguagcucauuguaugucccaggccuucccucgcugaugcugccccauggucagacagagcagugugagucaccccgucuuuauguuugcuucuagggaaugucccuggcuuuauccaaaauaguuagcccaguacguauuugcuuacguuagacaccagggccuuacuaccagagauuacuuacuggaguauuugaccucagcugaaaagcuaggguguccuuaggagauguggcauaugucaaaaccaucaacuuuaacuguacauuucccaguugcuuuuaucuugucaaaguuuuucauauuucuggcauucuuccuuaaaccauugagugaccauggaaacaugccugaaaacauggaggagguaaaaaucuagcccuuagaaaccaaaaaacaaauagcuaauauaagaaagggaaacuccagagugaccaggugcucuuucuccuaauagauugaugggcggccaccauggauggagggacaguugacaaaucagcuagucuacaguagaagcaaauucacuaguuuuaaaaaaaaaaauuccuacuggaaauccuggcuuuccuucuuuucacagauuuuucuuacucuugcauccuuugagugaucucgcuguaaacguguguugucugacaccuuucugagguuguuggugguuggcagaacuaguaaauuucaagcccuguacacaguagcugcaugcugacuugagagcuagucuguaguguugucuguugcaccuugcucugcuucguccggauaauuauguuuggaggagaagugcuggagucuaaacugguggcguuaauacugcuauuuguaaacuuguaacgugauucaaccgugaucaauggccuuguaguuuuggggaaacauaauaugaaacaaccaucgaugcuuaauugugggguagaugucuguuuucuuugcaugcaucaggaaagugcagcuacaauggagcuuuacaacguggggcuggcgaagcaugcagaggggagggaggcaggggggcauuuuguuuccuuccaaauuuguccccauuuugcauuuuucuauaaauucaagaaaucauaucccuuuuucauggcaaaagacaucaauaauuaaaucuaaauaaaguguaggggaaaaucaucuauauuuuaguaauuguguucauuagaaaggcuugcaacugccugcuacugaguaauauagcauuuauuauuuuuuuuuaaaaguaaagaugcuuuuaaaauauggcuuaacucuuuugguaaagcauauuauacaucauuuucacaagcacagaucuuuuugccucuagaaagggaaguugcauuuucauuguuaguguuuaaaccgacucuucuuguuuuagauuuuaaaaugaucuaauuuaaaguuaaagcugcauuauguuuggccugcagaggagggaagagcagauggugcucugggaucaguuucuuuuugguuauggaaaaggcuuccaucucaauacaacauuauugucacacaugaagagcagagucaccucccucggcaagggaacuguaaacuuggagucuucacuuuaaaacacacagguuuacauuauugccucauuuucuuugucuaaaucuuuaaucuguggaaauucaggccuuucaauuuuugaguuugcaaaaguaacagcaucucccuauaacguccggacccucuaaccugcuguccugagaaaggaaucuacagugcuuugauggccuuuugucaaauugaaauaauucuguaucacaauuaaaaauuaugccgggcagugguggcgcacgccuuuaaucccagcacuugggaggcaggggccggcagauuucugaguucgaggccagccuggucuacagagugaguucuaggacagccaagggaacacagagaaacucugucucaaaaaaccaaaaaaaaaaaaaaacaaaaaccaaauggaaguggaagacaaguaaaaaaauguuuccauggaccccuccucugugcuaacaggacaggaugcagcuuuaauagacuagaucuaaccauaacgucagucaacuccaucccaugcuucuuggccucuuguuaugauuaaugccuguuagcuggugacuugugugacuaaucaggaggcuuuuggaauacuguauguaaucucugccuacagcacaagcagcgcugcccugugcuggaggaccaguugguggaccuggugguguacgccauggagaggucagagaccgaggagaaguuugacgaugggggaaccagccagcuccuguggcagcaccuuuccagccagcucauuuucuuugugcuuuuccaguuugccaguuucccacauaugguccucucucuccaccagaagguaugaccaaagggcgccuccucagagccaauccugcugcuccuuaguguggcuuaguuggcuuugagcacucccggcuccuggcuuccgagggggcagaaggcagaucccuaauguugcuuuuguuuaguuuuguuuguuuguuuguuuguuuguuuguuuuaaggcagggucucacauguugucugacuugucuagaauucacuguuuagaccaggcuagccucaagcuuauagagacccaacugccucuagcucccaaggacuaggauuaaaggugugugccucuguacaugguuucuguagagccuuuaugguuuuuuaacauuuuacuuucugacuauaaacucuaguuugucacucauucuacauauacccacaaugccaggacacaugauacaaaaugaaaagacacuguaguaccacuaaggagucuuccacuagaggggaauguacacgcacacacacacucacucucucuggcucucucucucucccccccucauccauugcugugauaaaacaccaugcaccaugagcaaaagcagucugggaaggaaagggucgaucucaucuuacaguuacaguuuacagucuaccaugaagggaacucaaggcaggaaaccagaaccagagauggaugcagaggucauggaggaaugcagcuagcaggauggcuuucucagccugcuuucuuacccagcccaggaccauuugcccagggugcugcccacaucagucauuaacuaagacaauaucccucagagguaccuacaggcugggcucaugaaggcacuuugucacuugaaauuccaucuucccagaugaauguggcuugugucaggugaccagaaacccagccagcacaccauggaggcagguuucccacagaaugaguaaaaagggcguagacgcuaaaugaagacauagaacuaagcuuuaucaaagagaugcuuaaugcuucaacaauaaauagacguuucccaagaggaaaacauagcaaaguacuuugcuaacaguaguauuaauauuuggaaagauacaaaguugaaugaaaacugggaagaaaaauagauucaggaugauaugaggaagcuggguaagcaaagucaggcacggacaacuucauguggcuacaggagcuuagauuuucuuuugacagcagugaagagacagaaaaauaagcagaauggaaaaacugcagcuauugucaacauggaguaacuuugcaguauagagauaggugggcgugaccaaaacaguaggaaaacaaaacagcuagacgaaggcugcugauggcauguuccaacagugcaggaagagccagagacuagagagauagacugacuggcagguagcagaaggcuuagcaggaagcugccuccauugcuggcucacugguuucuacuuggugaugagcaggacaggacagcgaguucaauaaagggaaaacaagugggacaguaagugugggguaagcuggugucagcugugaggccuuaggcacaucaaguggguguggccaaguguuacacccauaacaucacacuagcguggaucccuuuacacgcacgcaugcacgcacguugcuuaaguaagucugcuuugaugauuucauacucacauauaguguauucuauuuguucucagccccaacgcccucccucuuguaguaaaccagagucuguaugugugugugugcaugugugugcacgcacgucauuuuuuuccaauggcugugucagaagaaagggaauuauagcauagcucggaggugcagagacgucuaccuuuccugguuggaaugagugaaguuuuucucugcagguaggagguagaccugccugccugggcuugagagaagcaggcaccaggcugggagguccaccaggcugggagguccaggagccucuugccuacagaguauugggcuugauucucauguuuaauuuuuuucuuuuuuuuuuuuuuuggauauguguaguuuaaaggagcacggaaaaacauaauguagccuggugugcauuuuaugcccugcauggagacucaguaguuacugaacacccaagcuaagauacugacuuccaagcacacacaccaagugugucagucccuguuguagaccagugagugugacgauggaagcuaaggagcucaugaggaagugaggaaggaaggcuugcauaccagcgaggcuuguuugccguuuuugacuuuucuaucccuggucuuucagccaaguugcuuuugagcuugcgguaagacagacagagcaucauggugaggggaugugugaaugagggugcuuguuaccucaucacagccaggaagccuccucagcacuccaccccaucuugcaucaucaccauuaggugauggccagacugaguauaugagccuuuguagaucauuugagauccagacuagaacaugaaggcgcucuguuaaaaaugacccgcaccuuucuacacguguuguuaguugcugaguguacauuugugcucuaacauuucuuacaguuagcagggcgaggacugauuaaagggcgagaccaucugaugugggugcugcugcaguucauuucuggaaguauucagaaaaaugcccucgcugacuuccucccugucaugaagcucuuugaccugcuguacccggagaaggagguaaguguccccgaguccuuagcagagcccuggagcuuguccagugugugugcaagaggacuggaucaccgugugugcccucucaugcuaguccauggcucgcucugaucaguggucugggcauucagucucuuuugucguugguuuucuugugugugaaaucaagaaauugaaccagguuguuucuagcaucugucugaggucacaauuugaguauuuguggaaaacucuucuuguguguucuaaguagcuguauagcuuuaaaaugucauaaugcccuugaucuguacgugucaccgaguggucacguaauaaguguguguuagugcauagguuuuguuuguugacugggucucauggugcuccaacccaguuuucuguuauauaacaugguugagaaaagcauaauuuauuuugaugguuaccauuuucuacaagaaccacuuuauggaaaaguugcuuuuuugggguuuuuuuuuuuuuuuuuuuggcuuuucgagacaggguuucucugcagcccuggcuguccuggaacucacucugaagaccaggcuggccucgaacucagagauccaccagccucugccucccaagugcugggauuaaaggcaugagccaucaugcccggaacccaggagugugaauagaacacuaaccacuccugucccugccaccaggacacucuuguuucaugcugcauuguucuuuauuauuuuuuguugucauuuuuaaugcuggauaauuguaguuuuaaaguagauuccagcuaucuauaguucauaauucucauauuuuccuaguguuucugucuucaagauuuuauuuuacuuuuaaaguuaaaucacaguguguacauuagguggaccacauuaacaugcccaguuguguuuuuauuugaguguuaaaaguugaaauacauuugugagaauuacagaauuuaucacaauuuguuacgcuuuuggaauauguucaauuuuucaaaauuaaacuuuaaacaacuuuuguucauuaguucugugauagggaaaccuugguuaagcgucuuucauuuuguuaagaaguagaaacuugccaacaagaaccucuuuuugaaacuuuuaugcuguaaggccucucguaauguugacuggucaaagagcuauuggggcuaagcuaagauaggaguucuaacgcgcuacaccguaaaggauuucugagcugcgcaugacuauuugauccucauucauauggcagcuaacuacucuuuuccaguguaucccaguuccugauauuaacaaaccccagucaacgcacgccuuugcaaugacuuguauuuggauucaucuuaauagaaaagcucaaaauggcgacuccacgcuccagaucccaauaccccauucccugaagcugcaccaugaguaaguuauuuguuauguggagcuuaacugucuuguugcguuaauaguggcuuguagacugguauugaucuuaguauuugcgugguguuugaugucucccacacggcccaguaggcugauaguuaacccugauaguuaauauauauguuacaguaaggaacuggccaauggcaacgucagaaaacaacuugaccgagccuucucaugugcuuggguaucuuucuacacauuuucaagacuaguucugguuuuuauguguuacacuuuuaaauuacaacuuaagguaucuuaucucuuaccgacgugagacuauuucaggguuucccaagugcuggugauuuggacaugaucuaauuuaggcaucuuucacucccugggauggccagaagagagggagccgauguggcuggcaggcaccuucugugugucccaaagcugugaugacgcagagaugaugccccuuagagagaacugcucuucagucaugguguuaggaaguagcugggcuuccuuucugggacuaucagaucucuucauagagccuguccguggugagggccauguugggggcuuuuauuuuaugaaauaccuguaaucaucuuuucauugagaaaccaauuaugaaggcauuuguuauuuaagcagauaauaaauagaaaucuuuuucauuaauuugugaguuauuucuucauucuauggaacuuagccuaaaauagugugcauuguguauaguguauaauacacacuugacaaauauccaguggcuguuaacuuaggaugaagcgccaucugcaauauuacccaagcuuuaauagguacagccacuguauauuucaucagaaacuguagugucuguaagaauaaacauaguacuagcaacugcauaugauugaaauuacuaaacugcaauuaacuucauggguaucauuugaguuuuucuguugaaauguuacagguuccuccagcagagucugagaaauaaaagcuuacagaugaaugacuauaagauugcccugcuauguaacgcguauuccacaaacucagaguguuuuacguuaccuaugggagcucugguagaaacuauuuauggaaauggaauuaugagagugccucucccuggaacgagcuguuuggccucagcaucagugacucccuuaccgaugaaccuccuggauucacugacggugcaugccaagaugaggugugugcuuauucucuaucugggaauugauuuaaagaaaucugguaauuuuuuuguaauuacagguaugugcguguacauguguguauggucugugcauuuaagaaugauuuccucacgugcucgcuucggcagcacauauacuaaaauugggacaauacagagaagauuagcguggccccugcgcaaggaugacacgcaaauucgugaagcguuccauauuuuuguaccgaaggagcugaaggggucugcaacccuauagguggaacaacaauaugaacuaaccaguaccccggagcucuugacucuagcugcauauguaucagaagauggccuagucggccaucacugggaagagaggcccaucagacuugcaaacuuuauaugccccaguacaggggaaccccagggccaagaagugggaguggguggguaggggagcagggcggggggaggggauagggaacuuucgggauagcauuugaaauguaaauaaagaaaauaucuaaaaaaaaaaugauuucuucaaaaaauugaauguuguuaacuauagaaacuauagacuauguagaggaguguaaggcagauggugacuuuauccuuuucacaagaaaauggaaaaucauuuuugcaucuuuuuuuucaaugaguaaauuuaugauuuuauauauuguggagaaaagugugcuauuguaucucgguuuucuccuguaauaaacaucuuuucaugugguuuuucauccagaacaguuuuggauugcuacaacaaaguuucuuaugaagccugaguggccacucuauguugcugggugucgaggguuugguggcuccuauguaguagggagauguugaugaagguuuccuucacagcagucacuguggcgucuguaguugaguuugacugugucuuuuucuuagaguuuuuacuaaacagcuuucugaaaggagaauugcuguguccuggaauuuaagauguuauugaauuacacacugggacacuuuuagaguuguguuuguuuccuggaaggcagaaaagcuuguguuggcacuagaccuccagugcccaggguagccaggcuggagcuguagugaggccuggcacagcaugcugagaagugggugucaguucacacggaggccggcguguggaggcgcgugggacagcaguagggucucaucuugggcugacaguucccucggcguggggaguggaacgcugccugguaacgcugcucacagucaguccucgagaaggacugugcucucaaguuuuaaguacugacgcagaguuaagacagcacugugauuaggccagauacagugucagcccugcaaaagcugugcuuuuuccucucagaugguacccauugugacagacugugugcuacuucacuuguauaugugacaaauuugagcaaagcccugcuagaagcgaacaugugggucuuagcgauaauuuauuaaauaauuuugugcuaaauguuuugugaugaaugugguaaauguugcuccucuaagguacuucuuacuguuugagaggagaagcuggcuaaaagcccucagucaugcuccuauuuaugguuuauauggagagcuugcuuugcccugagcaggaucccuguguguauuccagcuacuacacccccagcccuaaaguccuguggaaaccgcaguuuguuuccaguuguccagaugccacuaccaagagucugauacagcuuaagcuuguuaagugagccagguccacuggaacuauugcauuucagguuccuacgucucugccucugagaagaacaacuguguucauagacacggguucucauuuucuucuucuuuccucgucagccuuauucacagcauugcaaccagagugauaaaacuggcucauacgaaauccaguguugcgcuggcuccagcccuaguggaaacuuacagccguuuacuggucuacauggaaauugagucuuugggcaucaaaggauuuaucaguaagagaaacuuugcugcuguuucuaaugauuaacaagucaguaugagaaugaagcagggagcaagugucugacgugaggccagccugcugagacaggacagggaugaagcaggcaacgacagaugcaugcuuuggggcagagaugggugcugugggagucaaagggcagaacaggccucccuuagugucugaggugggagggagcauggcaagaaauaugcugcucauaagccccaaguaggacugggccucuccugcacauucguucuuagaugaagcacugcugccgccaugaggcgaggcggggcaaggugaggcugaguguggccaugggaaggaguugucauccagugcagcgacagcguguuuaguguuuagcaguucugaauaauagguacucuccgacugcaggcacuuuucugauucauuucaccugcaguaugaguuuuaaccauaguaacuuuuucccagaagugaacccagcuuucuuuuggauggaagaaagaaugaacaaggaaagacauuagguuuuuuguuuuggucuagguuuugacuuuuuugagauagugucuccuguuguccaggcuaggcuggccucccgacuccuuauguaagugagucuggcucugaacucuugccucuugccucugcuucccgagugcuggaauugugugcccccauggcuggcuugucuugucuuagcuuucuuccuuucccucccucccucccuucuccuucccucccucccuuccuuccuuccuucuuuccuuuuuuucuuucuuugguguuacaaaagugauucuguuugaauuacacuaguugcaaugguguacaccugaagucucagcugaggaaguucacugccagucuggguaauggagcccuuggcuucaauugccagcaguauuaaaacacacacacacacacacacacacacacacacacacauggaaaugaaucucauacucagaagugggaaaccuugacucuauaaaaauacccaaaagguaacugugaugugcggcagaccagaagggcucuuuugguuuugguugguugguuuuuguuuuauuuuugugugguugcuuucauuuuauuuuuccauauuaaccugaggcuggcaugucaaacucuagaaaggaaagauaaacucagaguguauuuaggcucuggauuuuuuaccccuacaauuguaguggaaauauguaaauacuuguguguguguguguaugucuguguuuauagucauuuucacauacauccugagcgacauucuucugauauauacagggauguccuuuugcuaacuggucccuggaauucugcccugguaggucagcuccugcccacugucuucaagucccacgccuggggcauccugcacacacugcuggagauguucagccaccgaaugcaccacauucagccccacuaccgaguucagcuccugagccaucuccacacacuggcugcagucgcacagaccaaccagaaccagcuccaucuguggugagugagcagccugcaggcugccuccccuaggguuuaguccacccaugcuuggaagugggggucuuaaucccccugcccccagguccuuuuuuuuucuuauuugcuguaaaauuaaaauucugcuuauaagacaaaagagugaaacccaaguuuuuaaaagaauuuggauuuacauguuucaagucaugauuaaaguaccauuuuauggaaggcagagacaaacagaucuaucugugaauucaaggccagccuggucuacacaaugagcuccagaacaaccagggcagagaaaccauguuuugaauaccaaaaaaagguaucauuucaauuuugauuuaagugaaaacauauuucggauggaaaucuguaacuuaauggaggaggggacacagucucguguagcauaagcggaccuugaauucauuuuuguagccaacacaagaucuaaaaucugauccccgugccucugccuccuaaaugcugauucucuuagaguuguauucugugaagagagacaccaugaccauggcagcucuuauaagggaaaagcauugaauuggggcuggcuuacagcuccgaguuucaguccauuaucaucaugaagggaagcaugguggcaugcaggcagacauggugcugaagaaggagcugagaguccagcuucugaggccucaaagcccaccucuuaaucacaucucucuuccagggaagccaccuggacuccagguccccaccuccuaacagugccacucccuaugcaccuauggaggccaucuuuauucaaaccacugugcugacugcgcaggugugugcugccuaccuaguagugaggugccaucucucuaggagaaggguuuucuucuagucuauguguacaaggucagcuguuuugcauuguaaaauuuagcaucaaaaagggaagguuauuucuaugaacgaguauaaaugaaugaagcauaaagaauguaaucuuugugcuaucacauguucacaacucugcaauugggucugccgacauacaugugaacugugcguuccugcuuucaguguggagagcacugcacugaggcucaucacagcccugggaagcucagagguccagccgcaguucacgcguuuccucaaugaucccaaaacagugcuguccgccgaaucugaagagcugaaccgagccuugauccugaccuuagccagagcaacccacgucacagguagagauccugcaagggauguuagcauacacugugcagcuccucucacaccgugagagcacaugcgagggaggugccuuucaggaaagcaagcccguggcucuggucucuccucagaaucggcuaaaggcgggaggagcucauggcacugccauucuaaggaaauucccaaagguuuucuuuuuauggauuuccaucuguauauaaauaagaauauuaguaauuaaaauagagaaguuuaaaaagaacuuauucauuuaaaaauacuguagcauguaaccuuagcguaaguaacauguaaaaaguaguuucuauagcacaacucugacaggaggggaguggagccuuuguuuuaguuuauuguuuaaugguuguccuuuaaugucugcguaagcaaacguagguuuucauagguggucugucucacagcaucuaucugcuucaguguaugaugcuggggugguuagagcacaugaggagagcauggcguuucagacgccucaggcuuuucagauaacugcguguccucugucuguuuuugaaaguuccuucaagaugagcuguaugugaaacccuggcccugcccauggacuuucgcacuuugcugccccaugguccgcuggccuauuuuuuagauugaguacauuuuuaauguaugugucuuuuaucaguucguccuuuggaaaacauucccuguagcaaaugugaacacaccuuauuauaauuccauaacauuguguguguugauaccacuauaaauuuuguaagaauaucuuuacaucugggaaaacacucacacucguggacaggagccuuuccaguuucuaauuuccaccugaaacaucagccucagcaucuggagaagacgcuguccuucugucuuucguuucucuuaaaacaacagggugaauuaauuuuugagagagugucugccagauguuuacaucugcauaauuacuggcuuuucugucagauauucuucuaccuaaaauugaaauucugugcagaaaggcagcuguugcaccugaguccugucauuucccucacacuccuugcacuguggcacaccaugcacauuccacacacagugggagugggucuguaugugcucauuuguacagcaucauugacaguauuuucauucauuuuuaauugacacauaaaaagaaucuuacuauuuaugggauaucacaugauauuuccacacauauguguacauugaguaauguccaaggcaagguaauuuaccugcuuaaaauuuuucuucuguuuguaguaacauucaaagucccuccugauaacuuuaauauuuuuaauuuauaggacauuagccgugaucuuaacugagacggguaccuuuuguccuuguugaaaucaggugguguauaauaguguagucuggugccuucuuugaagugugcagagagccaggcauuucacuguaccauugagaaaugcuaaggauagccgagaauuauuaucugaguaucucugaacacaucaaauucuugaaaagacaguaggacuagcuauagcagcaaaggcuuguaaucuuagcacauggagaguuugaggcaggaggauugcacaguugagguaaaccuagacuuuauugcaaaaccuuaucucaaaaaaugaaaagaaggauggaaaggacaccugcaacugcuagaaaccaucagaccacacuuugagagguguuuguuuaagaaaggaaagggaagauaccagauuuaccaguuccagcuacggcguuguaaacuguuauuuccuguaaguaaacaucuggauuuagagauuugcauuugacagggcguguguaguccgacaucugcuuuuucaguuccauucccuuggcccaggaaagacuauuaaaaauaaaaaggacucuaaaguccuuuguugucucuucacuaauggugcuccuauuuucucacaaaaaguccuggucacuccuaguuauucuccaaguaagagguguagauccuaaguacaauguagguccccagagagcgagcguccugcacugagacaucucagugagacaucucagggugcuuuggcuugcuuugacaguacguaguuugggucauggagaucugacuccugucuguuuguuuagauuuuuuuacaggaucugauucaauacagggaacuugguguaaagauauccuucagaccaucaugaacuuuacuccucauaacugggcuucacauacccuuagcuguuuuccagccccucugcagguaauuugguucggaauuacguauuaaauacaugguaaucucuucuuccagucacuguggcuuucuagggagugcuugaccugguaauagcugaagaaaauuggcuguuuccuuuuugaaaauucuucuucuuacuuccaaagucucuugaauuccuucccauccucucgaggauuaaaugugcuccugagaaagcaauugugauggcuucaguuucuaaaugaacaccuuuagaaucucacaggaguuagcacaacaccugaaaacuuguguccuaacacuaagacggaggagaauaagcuucagugaaaccccuuagagcauaaaggagcuacguuugacuguguugauuuuuuuuaacuguacaacagaauuauaacuguggcugcauaaggaggaggaaggcaaaccugguaugucugucugcucagagaagcucagagaaguccacagcacgguggacuugagugaagcuaaagugucgcuugucacagaucacagauucuggaucccagccucagagcugcuggcugagcagaucugggcagggccugaagacuggcugagcgugcgccucagggaccagaauccgagccacuggccugccauagccgauucuccuuguggagacacugcauauauaaccuauguaaccucacacuucuuuuccuuccucucuuccuucucucaaagauuagcauaaaaugauugaagagacuuugaauuuaaacuugcuuagaauuucuguuuaggacuuagaaaaaaggaacuuagaguugcuaggccagccuguaacguucaggcuuucuuucuuucuuuuuuuuuaauauuuauuuauuuauuuauuauauguaagcacacuguagcuaucuucagacacuccagaagagggcaucagauuuuuguuacagaugguugugagccaccaugugguugcugggauuugaacucaggaccuuuggaagagcagucggcgcucuuaaccacucagccaucucgccagcccacauucaggcuuucauuacugccugacucaaggacacuuaguuuuauaagacacauaaacacagaaggagguauuuguucugccagaaccaaaugcacaccaaguuccucgccuccgauuguccaguguuccuuuuuucuguauccagugacaugaacuucgaaucuuccuuuuaggcuuucuucaagcaaaauaacgugccccaggaaagccguuuuaaucugaagaagaauguggaagaagaguacaggaaguggaagucaaugacugaugaaaacgagaucaucacccaguucucugugcagggcuucccuccacucuuccucugucuccucuggaagaugcuccuggagacggaucauauuagucagaucggcuacaaguaagccagaagccccggguuucagucugcuuggcagucagcguuguccaugccagagcucaguucucacucuuugccuuguaggguccuggagaggauuggggccagggcccugguggcccaugugagaacauuugcagauuuccugguguaugaguucucuacgucagcaggaggucagcaacucaauaagugcauugaaauucucaacgacaugguguggaaguacaacauugucacgcuggacagacucauucucugccugguaagaauacguuucuaagccuuuuuaccaugcagugaugggauugugugagugggaggccgcgugcugacuuccucuguuuggccucagagaauuucaccgacuuaugcugugcuuaagcuuccuuaaagaagaaggacuuucuggauucccuuuuucagugcauuuucagugauuaguauuauauucacagaagauacaaaaguaaauagauuuuucuggucuuguuaugcuuugaaauacaaaugguuuauucucagaggcugcaggucaggaaauagugaaaagcuauugcuugucuuugcuagcugauguaaucauucccuucagucgucaggagucugacuguuguguguacccagcauccuccacguguucccuuggcuucugccuguuaguguaucucaaagguagcugguucgucuguucgucuguuuguuuuaggguuuguuuuguuuucaugugcaugaguguuuugcuugcacgugacguugacagugugucugggggccagcagagggugucagaccaucuagaacuugagauacagagaguucugaggagcccugucgugcugagaaucaaacccacaucaccugcaagagcagccagcgcuccagacucugagccugcaaacacuucaacccuucaagccaaguuuuacgaaaagacugaauuacacuaggaaauuaaauacuuuuaaaaaauuauuaguguuuggguauguuggcauaucccuguaaucccagcagaugcagggggauuguccuaaguucaaggccaggcugguccacauugagagcccaaggccagccagggcauucugguuguacuuguagugacuucguucauuaauacugaccucuucucugugaagcauaaacguacagguaguuguaguguaguagggggacuaagacaguguaccuggcaaagguaaugcagugaugcggggaaagagcaucagaaaacaggccgucacgugacaucaucaaagaaagcuuuaccuuaagguaaacauuccuagcaggaggaguagugaaccacaaauaggccaaaagggucaaaucaucuuuaggagcgaugaaagauugguuugggguagacuagacaucuaaggaaauuguaauaauauaauuuuaugcagauacgacuaguucucuuaauuuuucuguuuauuuccaaaggcuaugcguagucaugaaggaaaugaagcccagguuuguuauuucauaauucaguugcuguugcucaaaccaaaugacuucagaaaccgaguaagugacuuugugaaggagaauuccccagagcacuggcuccagagugacuggcacaccaagcacaugagcuaccacaagguacccacucugagagagagcagcagcggggauggcuguucaauugauugggcuguuugcauugugggccugugguuuccuuuauggccucuguacagacccacagcgaguuagcuguaggcuaugcuaaugaauaagaguaaaauguaacuguacuucaagucggcaugauucugaaucaaaugaagauagcaguaauaaaauuaguauugcaugacuuuuggggagcugggguguugcugauuuaaggaggcaugugcuuuaaaaaauauuuuuuuguagauuucuucuuucucucucccuuccuuccuuccuucuuuccuuccuuccuuccuuucuuuuuuuuuuuuuuuuuuuuuuuuuuuuguagcucuuuugugcucgcuuuuuuggagcuacucuaacacaugucugucuccucaccuacagaaauaucccgagaagcuguauuuugaaggccuggcagagcagguugacccuccuguaccaauccaguccccuuaucugcccaucuacuuuggaaaugugugucuccgguuccuuccaguauuugauauaguaauccacagguuuuuagaguugcuuccaguguccaaaucacuagagacucuccuggaucaccuagggggcuuauauaaauuccauggugaguuuguucagcuuguaauuccaucugacaccuuuaugaacagauaggcugagcacgccauguaguaaaagugguucugcagguuugaagcacugcagggugaagucauacaggugucacaagaugcacagcacagagccaugagguuucucuauaaagaaagugggugucaggaggucugggaggugcaguuugaacuuuugcuaugcacaguuuguaugagcaggagggccguaagcauacaugagucauggggucuuuugggaaaacugcggugguggaagauaaaggccuauuugaaggaagauggcuuuauugaacugaauuaagaauguuuaccugugaguuuuaaaauaaggccaggaaaggaaaacacgccugacugcaggcucacauuaaaugccaguuucaguuuuauaaccuaaagauggugguucuggaagucacggaguaagaugggugggugggagucauuguuuuagaaugaugagguuagguguggcucacagcccaucucagaacuacaccacagccucucaaaaagccgugggccaugcaguggauacaccggaaccaggaacacgauuuugcugggcuguguuuacuuagaagaccauugaaacucuggucuuaagacuggaaacuagagcaugauacagcccaugacaaaaaugugaaagcagaaguauauuacugaacagaguaagugucaggcucaagggagaauggaugccuuuaaaaguagugcucuggauuaggugacaugggaacacugucuccaaugggugugcagugacaagucccacugugugugcagcuggccauagugucugagccggcacuaugacaguugucugggugaccuuccuuagaugccacugugacaguugccuggguggccgucaggugccacucuggguucucacucuuugccuucuuuuguuugguuaaaaauacauugcagcauucugcaccugguucuuucucccaucugcugugcugagguugguuauuaacgucaguaugugaagaccucuaccucucugugauaauuucucagcccuuuguuugugacuguacuugacauuugcugcuuuccaucguuuuugugcaguaaauguacagaaguaaaagugucugcucaggacaaccacaaauuauguguguuguuaggaaucuucugccugauuuaggauuaaagugcucccugugugugaugguccagcgugugaaguaaugucaguucucugagcuguguuuagguagucauggaagcacgggauucgcuuucauacuuaucaguaaccugauaaacacgcugagcuguuuucuucuugacagaccggccagugacuuaucuguauaauacuuugcacuauuaugaaaugugccugagaaaccgugaccaucucaaacgaaaacuuguccaugcaaucauuggcucccucaaagauaaccggccacagggcuggugucucagugauaccuaccugaagcaugcuaugaaugcacgggaggacaaccccuggguuccggaggacuccuacuacugcaagcugauuggccgacugguagacaauauccuuucuucugucauguuucuuccagacucuccauaaauagcaguauuuuagcuuguaagagcgguuuuuaagguaauguucuuuguauuucaaaaccucauuuuuaauuuugaguugcuuaggccaaccuuagccucauugccuuggacaguccucugccucagcuccucaggaacugaggcugugagcgcaugcuauacucacccucaggccuccaguggcaggcuaacuguggagucauaacuggcccagaacuugcuguauaggccaggcuggccuuagacucacagaucuuccucccauaugaugggauuaaaaguggccuuuaugauuauuuuaucuguguaaaaguuuugaaacuuuaaauugcaucaucauaccagacguauaggaguuuucucuguugcgacucaaauuuuuuguuuguuuguuuguuucgagacaggguuucucuguguguagcccuggcuguccugaaacucacucuguagaccaggcuggccucaaaacucagaaaucugccugccucugccucccaaaugcugggauuaaaggugugugccacuacugcccggcuagcuuuugcuuuuuauuuuuuauguauguuuuuauuucuugaguuugauuucauguguacaguuaucagcagucuacauaacaugucuguauaccaugccuaaauaaaagaauguauuuccugugguagcagacuuacucauuuuuaaagaaauguuuacaugaaauugcccugcgacuauaaaagaaaucggauaaagaggccugaggccacauuguucugucuccuccugguauagcaucuguucugagaguccauguguaaguacaaccacuuguuucguggguauugcucagugugcuuaagucacgcaacacuuaucucaugauagcuuaucucauguuugcuuuguauuuauuguuuauccuuuuauauuuuaauuucaguuaaaucacuucuugacagccuauaaucagaucaguugauaaucaaaugagaugcuuaugucuggaacuuuaugaaaccuguaaacacuguauuauguaagugugaaccauucaucuuagaauagucaaauuguuauugccuuaaucuuuugcacccauggcgggcaagucuccaggacccuucccaaacugugacuggagauucaaugaguuucccaaccccgcugcccacgcucugcaugugacguguguggaacucauggccuuggcgguuccaggcaaagauguggggaaugcccuucucaaugucguccugaaaaggucuguguccuuuguccuggaguuggagucuguuuacuucugccgggguugcugucaggcagaccugugccccaaagugagcgcuguggguaacagucuucucgucccacucucacugcugaggugcagggauaagagaaugaccaguggucacauucacuagaccaagguuugcucacauucuaccucuaaccugcuugaugaugaagugagucauaauguuagcuugucacuguaagucucuguacagaugagcaggagcagggguagagcuuguuagagcgucuccucagcaagugcuagauagaggguaaguccccaggugcauccuccacuccaaacauguccucuuaaaagaucagcagaaaguagggagcagguauaaaguccaaucguuuuucagccuuaagacuguuguuaaaggacacgcaaacaaaggauuuauuuuguguauauuuuuuuucucaaaaaaaauaacauuauuauuuggaguugauuggugagucauccauacaaaacaagauccuuagucaaguguagagaauguuuucaaaaugucaccuuuuuuuuuuccuguccucuugcagccagcccuuagugccaagggagaacauuacagcguggaugaaugcaauuggucugaucaucacggcccucccagugaguugcuaacuguggguuguacguaaugaugcagugucaaccagagaaaugcauacagaguaagcuugcccaggaagcucaugccaguuaaugaaccggcuccuucuucagucuuucauaccauugcuuuuuaaaaaguuccagcgaggcuggagaugcagcucagucaguagagugccugcuagcgugcgcagagcccuggcugugagugcacagaacacacccauaaucccagcccuugggagguagcgacaggaagauugaagcuucuaauucgucuucagcuacaucaccaguuugagacuagccugggcuucaugagaccgugucaacacauacacauaguuacagucacugucacuguccuuuugcuguucccugucacuuaugaauguaucugcuagacauaucuaucucugccaguagcagcuuccccauccauucuucauuuccgucucauagucuggucugguuugggccaguaaacaugcuguccauugcacacacaagccagacaaguggaaaacuucaguggaugcaagagcagcggggcggcagauaggcuuugagguccauugcuggguacgugguaucuuuuuaagcagacuuuucugauuuaaaggagccguacuggauugugcuucaugaccgaauugugaaugugaucagcaguucuagccugacgucagagacagagugggucgguuacccguuccgccucuucgacuucaccgcuugucaccaguccuacucggagaugagcugcagcuauacguuagcucuagcccaugccguguggcaccacuccagcaucgggcagcucucgcuuaucccaaaguaagcaggguucccuaacgagauugggcaucccaguuccuaagucugacuuacaaggaaguggcucucacucaugaggacugcagagugcguuucagacagcgggggcccugguuagucagaagccucuuauuucagaauugcuuaauuucuuagguaugcaaauagugauagcucauuuuuccacuguacuuuugggaggcuuacucagaucucugccccagaguguaucacagaaauggccuuuugaacugaaaacuggacuucaucuauuugcacauuacuuuuguugacuguaaaaagcugucaauuagaucuaaauuucaugagaauggcauuuccguaaauucucuuuuccauuuagguaagucaccugucauuuaacaccuguacuuuauauaggaauuacuuuuaaguccgaaguaauuuauuucagugaucagucaguugaaaaugagaccaggugagauaugcaagaucuacaggguaccauuguuaccaggagagggagaugcuuggacagagagugugcugugcagauggacagagaaugugugccaucagacacaaagagagugugccucaaagauggacagagugugcuguguggacgugaagaccucaguucaaaucccaggagcgcacauagaaagucagacauggcugcaccucaccugcaaccucaguacuguggggaggaguggagacagucggauugcugggugccagcccggcuccagggccacuggacagguccuccgcacacacaggccugugugccagacaugcacacugcacccacauacauguacccagagggaaagaauauuguuaccaaagucacagguaaagcagcgcuucccgucuucuuacacacuugcgagcagugugcugacauucagaggauugggcggcucggacuucauguagguuuuaucucugacccucagguuucucacugaggcgcuucucccgguggugaagacugaguuccaguugcucuacguguaccaucuuguggggccauuucuacagagguuccaacaggagagaacccggugcaugauugagguaaggugucaucugccuuagugcaagucgcaaagagcuguuucucgacaaguguuuucggucagccggaaguuguaagguguguuuugugggggcugggauccacuugggggcuccgugugccugcagggaguuuaguguaugaugcgcugagcuugagacgcaggggaaaguagcugugcucaaggagguaggcaggguugugggcacagaagugugugugggaaauuacaguaagggggcuggaggaaggcaagcauuucuaagaaaaugggcaacaguagaacagggcuggagagaugacucagugguuaaaagcacuggcugcucuugccaaggaucuggacuuaguucccagcgacuacauggcaggucacaaucaccuauaauugcagcuucagggccuccagguuuucucuuguggcaucuugggaacugggcaugcacaugguccacacacacacagagaauaaacuagaagacaagucuuuauuucuguuaacuagcuagcagacggagcucggaggugcacuaaaccuaagcaccccuggagugaguuacugugaggugaugucuggaaggggaucuuguaucuuaccaagagagacuuggcuguggagagggauucuaguuaggccauugcauagcucugugaucccacucugagugcagacuguguccuaugugcauagcgaugcaugggcugugacugucccucugcacaagugccaucccgugucagugugggagacugggcagguuggguugaaugauuugaucauguagucacuuaaauaaccuuaucugcccgauagauuggcguggcauuuuaugacaugcuguugaauguagaccagugcagcacgcacuuaaauuacauggaccccaucugcgacuuccuguaucauaugaaguauauguuuacuggugacagugugaaagagcaaguaaguucgucuuuuuacuuuuuagugauguuuuaaccuagcaaacuuaauacauggugauaaacauuuuuguuugggguuuuuggcuuuguuuuguuuuguuuuguuuguaaagugucuaguaucuaaccucuuaaggccacaggagaacauaauucuagauacagugauaaagaaacgaucucuuagcuuucccugugguguuugaaacagaacaucagaaaacccccuaaggcaucagugaguaggcgccucuuugaauagucugcuccccugggaaagcuggugguauggcuaggaagaccucucagggaaggaggcucccccccccaccccauuggcuagggcacauuaugggauguugaacacacaguggugcaaguacaagucacgccaugcuacucaagaggcaggcuacugagaguuucugaagagcgugaggguucuuagccugaagaacagagucccaggaagauguccucaucgccacugcucagaagguuuucuucccaggcgucagauuuguucugucaugugacacagcaagccccguugcgaaacugaagggaugcacccuaaaucaggaagaggcauuuccuacuacaaguggcaggaagugggaagaccuuaguguguguugcauguguaggaagcugugagcuguucugggggugucaguaaggcacauggcugcagugagccucucuccucggugccuggccgcuguuuccucucugccagguuggauuucugucugaacagcacugaacagugggcuucauuguaacguuuccacacuggcgugugcucuuuaaccauauucaccgcuccaucauagaaacuuaauugcugugucagcauggauacuggcguauggagcugaugacaggaagaccaagcuccuucacaccuucacagcagugucagacuuaacacuuccccuccugaaagcuuuucuuuuuguuucuguuaccacacauaaaaaugggcagaacugaugaagauuuuuuuuuuaaaaagauuuauuuauuauauguauauggguacacuguaucugucuucagacacaccagaagagggcgucagaucucauuauagaugguugugagccaccaugugguugcugggauuugaacucaggaccuccagaagaguagucagugcucuuaaccgcugaucugucccuucaacccacugaugaagauuuuuaaacccaaaauguauucuuuguauuuggaccuaaacuuugacauaggaauaaaacaaaaagaaacguugcugacauuccaguccuuccccugagaucaaagagcauuagagcugagaaagccaggacgcuggugcgucugucuccuuaucguguucugagugcuggcccugcagacauuccugcugcucgggucuaacaguaugacgaguccaacuguaaaaucaagaagacagcuuuggggagaacuauugcaaaugcuuucugcuucugcuaacauugcauucagauuggcucagaaggaugaccaaguugguagauguccaucuccucaugggagcaauuguaguuguggauagcaggguagcuaagcagguagaugggucauaaguucuugaagugcauguguagacagagacaggcacguacacacagaauguauauacacaaugugugugggaguacacaugugcuugccuguguaagaaaagaauugugugccagcuccccacuguggcguacuguugacagcugaugucacuccguaaauguggacucugcuuuuccguaauugugcucucgcuucuuagguagagaagauuaucuguaauuuaaagccggcuuuaaagcuucgucuucgauucaucacgcacauuagcaagauggagccggcagugccaccccaggcccucaacagcgggucuccagcaccucagucuaaccaggugccagcaucucugccggugacucagugaagccagaggcacugugacugaugcagaggaguggacucacgucuaaaucugaacaccgugcuaguaaaacgagagcagccaccauguucagauugguuuauucugauucaaauacugaaucccucuccuugucuauguuuugucucuaagagauaaguaaguuacauguuguucauauucauaucacuuuauucaaaucccuaggaaugugggcguuucuauacucaaguggcuuuuacuaggcacucucagacuuccugucuuagccauuuuuaaauuauuguaaguaacaucuuuacaucuuguauaccuuaccuugaagaugcgacacaugugaaauggccauuacaaacccuuuuguacauaaauguccuuccaaauagagccuuuuuauuaauaaagggccuuguacuucacuuggaacaaaggacguuucauacucuugucuuugguuuuuuuuaauugccuauaaaauuuuuauuguaaauuuuaaauuuccaagugguuccaaguaagggaugccaaguuucuaccaacguagguuaugggaguuuugcuucgcucugagcucucuguaugaaaugaaaccaucagaaaguuagaaaugaaauaaagccgugcucagacgucugauugccugacugcuuuguaacugaaucauucgccucucuggggccaugcucaccugagucuucaagucucagaauuuuccuaacuucacaaauuuuaaauguacauauuuuaguucuuuaaggcuugauuuugaggugcuaauuugaagggaaauggcacuuaaaaauucuaaagccagcaaaguugaacaaauaaacuguuucuuuaaagagcuacuaugau

SEQ ID NO: 5446 - RNA, 163724 nt, Mus musculus
agggcggggcuuccgccaggagggggcggggcuugcgcggagaguucucugacggccccagucagggaauuucaauuugaaacccagaggaggguggaggcggcgggugcggagggccggcggcguccgaggcuggaacgggacgcguucccggggcgagcaagcucgagaggggcgguguccggguaaggaggcgagcgggcugcggaguggcgggcgggguccugacacgcugcaggcgggaagcggaccccggcaggaagcccggacggccaucccgggcgggggagggggcggccgcgggcccgucucucuccuucccgggcggggaccgcggcggcguccccgggcucucgcgccccggcccugccgaggcgugcggcuccauccugggugccgggggcucgccgcgcccucucucccgagggucgccagacgcgggcccgcggcgcgcgugggcucugcgggagucggggagggagcgcgccccgccagccacccagccccacgcgcgccgcaggucgggccaacgcgggcgacccucuguccccgccgcccacugugcggucuggagcugaggacagacacccucgcacguuuucugcggcgagccuuccagcucggacaccaggccauccgcccccgauggcuucuuuuucucggcgcuggcagcugaggggugggagcaguuuaggugagcugcaggucaggggcuacgaggaggaaauaaccgagucgguggcguugagguuggcaucucgggaucccccauccucaaccccagacgucugcgguggacguuagucauuaaauguccccagacgccagccucaggcggggccaaguuuuauuuauuuauuuggggugaaguuagaagagcgcccucuucccccggugucuuauuuuggggaguggucuccguggagcuuccuuacaaaaugaggaagcccuucagaaaaucugucaccugaacagcugucccugauuuuuaagguuccugggagagugguaggcacgguggcaucuaggggaguuguacuuacauuuccuccuuugggaaucaagauucucucuguuucuugaacuuuguugcaugugaaauguggggugugcagggcaguauguucuuguuucugugauuagcuacaaaacaaaacaaaaacggucucaguuuucuccacucauuuuucuucaguccuuccugucugucuuucuucuuuucuuuucuuuucuucucucucucucucucucucucucucucuuucuuucuuucuuucuuucuuucuuucuuucuuucuuucuuucuuucuuucuuucuuucugggaguucauuaucucuguauucuucauugccuuaucacgcugcauuagcaacauuuuagucuacccugucagacauucccguggauuugaggaaaacucgauccguuucuuggcugugggagaugaaguuuagaaguugcagugcuuguacagguuuuccugugcuauucaguuuguuugcaggcuccugcugugagaaaucugguuugucuugcagccccuggugggcugccuugcaauguuauccuggaucuugguaggcaccagcagcccccucagguugcuaguuugacauaacuuugagagagagaaaggcuaugucaccuguuagggcuagggcgaucauuucaauaauuugguuugagagccaccaucaaaccucagaggucuuuguacccuuuggagagcuggaggaguugaaguaguggugugaaguuugcccaguuuaauccuauucuguguucuccacuucugaggcagaauucccauugaagucagcaguggucuugcuugcaaacugccuauugagaacaagaggcugcucauuaacaggagaggacgguccccucuccuuuaaaacaauccccuguaagaaggaucuaguccuaacaguucuucacucauuuaccucuaguagaaguaggacacugugugcaagaaaaaaaaaaaguguggcuggauugagccaucagcucucuugaagucuaaugagagggagacuguuaaaaggaauccaaagcucagcuguuauuuaacgccgugcaauagauuuucagugauacguuucuguguaagaaauguaagcugcugugggauguuuuacgguaacugauuauggaucuuuaaaauccgaauucuuagguccaauuagaaagaagcccauuuggagcuuuccaggaacggaugcccacccccaccccaaaauaacugcagacagaaaaauaagggaccucggaaguuugcuauaccuggagacacggcuuuaggacauuuuguuugugugcauuucauguaacgugugagucugggcgagagggaccguguuuagguuugugaggacucagcugaccugaguuggugagccuggcaucuucugcuuuuuaauguaauguucuugggguuuacuucuuucaaauuaccaguucuaaagaaucgaguuuagaaaaccuagccagugaccagaauguaaaaaauagacauuaaaaaaaucagaaccauauccacaugggcuuacccaaccacauacuuucaacuaaaaauagucacgacgagaaggcagcccucaacuaaaauaguuauugguaaauuuucuccauaacuagcaguucuguguaguuccccuuagcauuuaguugugcucugaaucgucacccuguaaugcuguggccggugaccugcagaggcuguaucuuugccauauuauuuaggaaugcggggcucauauuuuacauagugggagguuugauuuuuguuuccuuuccacaguaaagcaagggcuuuuucuuuccuuggacugagauagcuguggguaaacauucuugaaaaauaugaauugcuaguugauuuuuuucuuuuuucaauaaggcagcagaaguuuguggagcucguucucaccgagcgcacggcacgggcacguugcuucucugaaguguuuauuggaggagacagaggaaaugugccucuucccuccgccccaccuuuauuuagaaacauuugcuuuugcuuguuuguuuuuuguuuuguuuuguuuucucuccagauuagaguugcuguaucuaaccacuggguacucucacagauuuaaaagccucaagucaauguuuauucuggcuuccauagucagcaaauacuagccaaacccuaauucacugcucuuuuauagaaucuuggaaucucagggcugaacuuuuaagagucagcaaaucuacucuuagcucuguuccuuuccccuucccacacaaacaucucuagcuucuuuggaagaccugaauaaauaggggcuuguaugauuccuucacagauuguagacagagcauccuuggggaguacuauguuuuagcaguaacuuaauauucauaagauuucuaucauuugucucucugggcagugucccaaacuaaaaucuaagauugaaugacugcuguguaucauuaacuaacggacauggccacuauagcaccuauuaguaguguaguugcugagaggucacaaguaagcuagaaaugaaauaggaaaacuaucuaauaaaucuugaaaaaauuaauaguuauaacuuuuugaggguaguuuuuuuuuacaaaguacauguauuuuguaugagauagaagggaauacacauacacaccacauauuuacaguauaucugauagauggugaaucaguaguagaaaauuaauucacggaaccuuuuuuguauauuuuuaaagguugacuuuuuaugugugugauuauguugccugcacguauguauguguaccaugugggugccugauguccacacagaccaaacgagggugcugcuucuguuggaacuggaguuacgggcaguuguaagcucuguagguaauggaaaucaaaucuggauucucugcaagaucagcaagugcucuuuaacugccgagcagucuuuccaaccuucuugaguauauuuuuaauuccuuuaauuccagcacuugggaagcaggggccagcagauuacugugaguucaaggucagcuuggucuauguugugaauuucgggacaaucagggcuauguagaaaggucuugucuucaaaacaaaacaaagcaaacaauaaacaacaacaacaacaaaacaaaacaaaaauaaaacccccaaccagcuaaccaaauaaaauuccaaaaaaccaaaacaacaacaaagcccagaguuucauauaguuuagaauggugcauauccuucuguguagcugagguuggcuuugaacuucugguccucuaguuucuaguugcuaggauuccaguugugugcuuugaaaacuugagacaacuuuauagagguugguuguagcucauguagaaacaucauguaaauaauaaagaggacugacuuuugaaacagcgcuggacacaguucccccuuguucuuaucauugggucugggauggguguaggggcuuagaugggcguuuuucauguuuacgauuguaaaucaucuguacaugguuuuccugguuugaauagcauuuauuauaacuagaauuuuuguaaaaaaugagagguuuucugaguuuucuuuuuuuaacaaaaaagaaaacuuuuuauuugaguuuucaucucaaaucccaagucagaucuuuauagacucucagugccuucauacuucuucuggguuucccucucaaaugggccuugaguuaauuuuacaugcuuagugacguuaaguaugcuucguucagauaacugauuuuuuuuuuuuacauuuuaacauuuuuuuuucauuuagcacccuuuaagaugaacuaaaaaauggcacguagguucaucuaccauccaggcauguuggguguccaggucucuggaugagcuuugcagcugacuccaucaggguuuuacagcagugucuaguucacccauuguuccacagugugugugccuacaucucagcagugugaagguaugcagaugugaguuauauuugcuacuguucuuugcccuccaucccccauuauccaaagaggcuacuuuuuaagaauagacacacacacacacacacacacacacacacacacacacccuccacucuugggggacuuggucagaagugcuuagacaauuuaauuuauacucuugaugugaggcucgagagcuuagugagaauguguugcuuggggugugccuuggacugugguaagaagagcgcuucuguuuguguuugagugagugcagggaagagguugagagguaagggggacauagagaaagacaaaauaggaauaugagaauauuugggugaugagaagaggcuucaaauugcugaucuaauucagcaguuauuuuuaaguaauaauuacuguuguaugaaacaagcuuucguguagacgaggaggcugaccuugaaugugguguguggccaaggaggaccuugagcauccaguuuauguggugcuggggucugacccagagcgcacacucuauagcugaguugcaucccagaccuaaccuuaaauguuggcgaugaggaagucagagucugcagagacacuauuuccuuaucucuccuuuuguuguaagguuguacuuugucacuguuguuuuuuuccccucugcccgcuguacuuacuuccuuuccauuggauucuccaguccgaucccucuaugcuguugucaagaugaaaccgaguucugauauucaaucuuauccacuuguauuguuaccugugaguuuaaugccugcuuuuguuuccucagaaguuucuugaaguagaacuguaauuagagaaggccacuaacauguccaugcugggugcuguuggcuaggcugacauuuugccagggacuuugggcaaaauauuuuacaaagccauuucuuuaauggugugugugugugugugugugugugugagugugcaugagugaaaaucguaccuauuucauagaaugauacgagaauuaaaugagccaguguuuauagaaugcuucacguagugccuggcaucugugagaguuguuugcucgguuaugaaaagagcuaguguguugcuugugguaagcacauuuucugcaguugucaggaaccaguuaucuguguggaagcagagucugauauggggcugggauuuuuuauacuuugaaugccuuuuaaaaacuauuuuuaguacaguaucuuuagaauuuucauucuguucugugaccccuguucucgccuauuuuuaaaaaauaaugcaggacgugcccuguauauggugguucucuugggaccugguuucaacaagacgggaagaauguagucuuuuugugguguugcuagagguaacggguccugagucugaagggcccuguguugucucucaaguucucuucucuguaguugaaguaguuguugaaauaaggcucuuaguaaguggguguuuuacugguuguuuaagcucuggcaaacaacacacuaaaaccuaaccuuuauagauccaguaccuuguauuauaugugaaauaaaccugcaggcguauauucccccaguguaguguuuaauuuuaaaggaucugccaguauuaugagaccagaagucuaauauaaaugcuuuuauuuugggugggaaacuuggaggacagugauuaauacugguuccauuugccucuacugggaggaccaucagcccgacagagcuugcguuauuuuuuuaugauaacucuuuugacucaguuucccuauuuccuuuucauguuaccuuuagagcagugguucuuagccuuccuaaugcugugacccacauguugaggugaccccaaccauuaaauuauuuuguugcuacuucauaucuauaacuuugcuacuguuaugaaucggacuguaaauaucugaugugcaggcucugggaaucucuacccacaggcuaagaaacucuucucuagacugcuucauuuguaucgugugaaccaacuauuggauugauuccuuuauuaaacagugguugaacugacgauagaugaggcugugugaccuuacagcgaauguugcuuacaguagggcuuuccuuccuauugggccucucccucugugaagugucacuugugagucacuaucagggucaugguugaucagcguccccugugcaguaagcccucagacaugguguugaaugguuccuuuucugguuugguucuagacuuccucauuuacuguucaacaauuugcucauccucuaaagcuuacuuuuagacuuccuuagcccacgacugagccugauuuaucuguuguuuagcuuuuuaaagugaugcuuuucauuucauccuuugcaccagcccaucaguucagacuguaaagcagucuguaaaacaguuugucauguggucuuaggaagugcagaguucgugagaaaagagaggagguggagaccagcagugcugauuuaccuucaaaugccgagaaagaacaggggucacaugacuuacaaaggauagagaagacaguguguauaccauacaggaaugcucacaaaacagggcugacaaccucuuguaucucuggacacagugagcuaauuaucugguuauuuggucauuuugaucauuaccagaugucauagucaaagaccggagcaaccaaaguucacccuuugaggcagcagcuugauaugggguuaagucuuauuuucuguaucuucuacauuuucaaaaacaacuuuuccugagacaaggucuccugcaucccaggaccaccaugcagccugacaugaacuugagucucucuuccuccugcuuccaccuuucaaguguugaggacacagggcuucaggagcuaccagcccugauuuacgugggccacccugggaaaaccucaguguuguuuugugauuuuuuuuuuuuuuuaauuuugagacagggucucucuguguagcccaagcuguccuggaacucacucuguagaccagguuggccucgaacucagaaaucugccugccucugccucccaaaugcugggauucaaggcaugcgccaccacggcccggcguuuugugauuuuuguuucauugucaguuuuagaugacaauacucuuuuauaauguucauuggaaugccaucauuacacugaacguuucuuaaagcuaccaaguugucugucagcauugaagucuugauucccaauuucuuucuuuuuaaaauugguuuguauuuaagcgcauguuugugugugugccugcaugcuagugugugcacagugcuuguggggucucuggaggucagaagauguuguaaaauuucccuggagcuggaguuacaggugacuguguacugccuaauauagucucucugauccaaacugaggugcuguguaagagcaggaaguucugcuaacugcugagccaucucuucagccccauggucuuuaacgcucuuaagugucaauuuuuaaagugggaggcuuugagacaggggcucacuauguagcccacauuggcuucaaauuccuuuuguaguucagucuggucucacauucuuuuauguagcccaagauggccuugaacuugugauuuuccugcuucccaaaucaacuuugagauuauagguauauacccaccauacccaagugucaauuuaaucaaugucauuuuaaaaacguguauuuuauguguaugaguguuuuaccugcauugucugugccucaugcguucuugguccuuguggaggcuggaagaggauguugguuucccuggaacuagaguuacagacaguagucacccacugugugaacugggaauagaaccucgcuucucugcacgaguagcacgugcucuuaaccauuaaucuuuccaaucuuucaagugccaguuauugaaaaaacuuucuuuguaugaagaugcaguuaagauuuguacaugcaguuagucuuuguagcccuuaagauuuaguuaucucuuuauuucuuauuuuuccuuucaguauauuuuguugaagaaacauaauugauugucccauguacuaaacacagugugaauuuugcucuuuucaucccuguggugugcuuaaccuauuccuguacccuguauucucauugaucucgaaacaugacccaguucccucccucuuuccuauuucugugagauuauuccauagguguaggcuuguauucaauaucuuuuauugaauuuugacuuuaccuuuauuuuguguguggguguaccacagggcauuguggagguucgaggacagcucaugggaguuaaguccugaggguuuuagggaugaacccagacccuuaggcuugguugcaagcaccuuuacccacugagccauauuccucgucuguggccaucaggcuuuugaugcugucacagcacagauggguucauucagucuuaggggcugccuucuuuugauuauguacauaauggaggugucagccacaaucaguaacgguguguuagaaaagaaagagaagcaagccuuagaaaaccaaacccaaaagaaggaaggcuguuuggacuguauuuauacauguuagugugguaugcaguucacuuuacagaugaaggucacggcacccaguggacguguuggcugaauguuaguuuugcccacgggggaauguuaguuuugcccacgggggccgguaguuauguaaguuauuugaugcugcgccuaagaacuggacuucauuuuggaggucguuggcaucuugagcaucuggcuuuuguaggagauaggcuugcuuuccuggcuugcuuugggcccccucguuucuacucuacugugugaucuccccccccccccccccccccccacugaguuucucuguguagcccuggcuguccuggaacucacucuguagaccaggcuggccucgaacucagaaaucuaccugccucugccucccaagugcugcaguuaaaggcaugcgccaccacugcccggcuuacugugcgaucuugaagcacugaguaacaagucuaccaugacugagcacugcuuuggguugugcgauucuugugauugaaacagggccucaugcucugccagggccccacagagcuaagcuccugcucaaguggagaaugaccucuugccugucaggcaccgcuccucaucugcuccuccgacaucagcgagacgugccagaguagaaagccuaaggaucaaguguggcuuucucccucucccaaccagcuucuuccuucaugugguuuuacacgugugcuauuuaauuuacaguggaaauggcacucccuggaggacuuuggcaugcuguagggauacaggggaaacagugggcaggccagugcccaaacucugauauccgucagcuucccaguggccgcuacuuucaauauuucugguuuuguuuuugguguguuuggucucuaagaaacauaacuaucuuguuucuugaguugaagaaaaugaugaaauaguuuucauuuuauuauuuguuaaagucuuuuguauuuucuaagggaacaggacaugcugggagucaagaacuuggucccacagacauuuaacagccacugucugguugcuuggguucauguggaggguuuuugugcaucaaaaguuguuuuaguugauguuucaucgugggaacacuugagaagccuaugcagucuugcuaaugucucuucccuccaguuucuuguacauauaaaugauauagcuacuuacuuuacguuuugauuagaguuagcuuauuuuaaucgcuucucauaagacgcauacucucuuucccagucuuuaacuagagaggagccauguaaagugcguugguuaggccugcaaagauaguguuaaacagucuuauguuucauccugaagacgguuuugcuuuugucucaucugccugguguuugugguaucagccuuuaguucagcuguguuagaagcuauaaaguuccugccguuaggcucaaacauaaaaccauuucucaguuccaucuuacgcucgugugugugugugugugugugugugugugugugugugcgcacaugugagugugcacaugugugcaggucuauaucuauguacauagaagcagagcuagugugacgccuggcguagggguggcaguauggccaggcugccuaggaagagccaauggcuacaagucugugcuuuauuuuaacuugcccaguggguuucagaaguuuauaaauuccaacucucuauuuuuuuuucugugagaagauagugcagguucuaaauaguacagugucucccugaacuauaacaaugacugaggcguuguguagacuccuuuuaacccuuugacugcauaugcagauguagaauuguuucuaacucuuauuucauuucuauuacuuagccaaacuuggaagcagauacacauuuuaaagugauuuagagacagacauuaaauuuaauacaggauuuggaaaaauuauaacaugggugcacaaauuacugaagcuaaaagagaugcaugccuauaauucgagauggaggcagaauucaaagucauuuuucugcuucguagcauguucuaaguuagcuuuggcuacaggagguccugucucaaaucaaaacaagaccuggagcuggagagaugucuuagauguuuagaggacuggcugcuuuaagaagaccgggguuugauucccagcugcucaaauggcagcuuacaaaugucuguaacuccaguuauagaagaucugacacccucacgugggcaaaauaucaacacaccuaaauaaaagaaagaauccaacaaaaccaaacccuucaaagagucccacuggguagguuccaaggaagaugucucugccagugcuuuuuuaugcaguccuuuuuccucuugguaacauauaaagcuauguggugacuguggugggcuucucuuucccuucucuucuuccacaggcucucccuggcaguucagcucuucuggcucagucuucuuagugcugggauuauguguguaccuagcaugcugcuugcuugcuuucuuucuugcuuucuuucuuucuuaaaaauauauauguauacauauauaucuguuaaaguuauuuuuuuccaacaaaaaucucuagaacauuuugucauucuacuuuuaagauuuuuuuuuuuuuuuaaaguucuguucguagcucugacaacuaagaaaggcaagccaggaagagguuaaauggaagcacucagcaguuuaguaauggcagccagccuggccaggcuccuguguuccgugguuucuucucuauucuacuccucugcucguaauaaaguagcuaauuggaguuuucuuggagacccaggaagccugccaaguuuuguagguaaagggauguccuguagcuuuuaaauauuugcaucaugagcccugaagguagacagacuuccaaauauagcucaauaaaugugucaagguuuugaaauacugcuaaaaaaaacccaaggaagucugguacuguggggguuauuggaaaaugaugccaagugcuuucagaaguguuugcaaagcagauguggcccuggugguaucuagacauacagugugcagagucagcggaggcuuugggagacucuauuuguuaugauaauccuuugugucuuccugguacucucuuguugaaagcagcuaacugaaaaucuuccuggagacguuuccuuucauucacuucucuuaaugaagaaaagaaaaacuuucucccuccauaaaauaaauaaaaaaaauauauaggaaaacuuaaagagugucaaguaaugaguugagccugucuaaaaaagaagucaagauuuuccucugcacuuguagccggaacugucuuuggaucauggccauuaaaauuaacaucaguaaagcucguggcuucacuuuccuagugccaagcgugucuguuuuaaauuaggcgcauaugggauugugaaaacacugguuucucucccagggccccacccuaacacuggaagcaggacgaggucuguggagggcauuuccuaacgucugcagcccugaaaaggacuauggauugguacauguuugguguagguguggcagcugcuuucgugaugccaguucacuuuuaucuuggugcugugagcuuaggauaaaagacuguaguguggauucuagaccguucuauagcuugggaccugugugucaauugcuuuguguaacauacagggcagcaguggaagaugguuguauuuaagacuuuucuuuguauauguguauguaauuuauugaagccaugugugugugugugugugcauguguaucugcugcucuuuuuuauuuugaaauucguuccuaccauaccauuauucguuacagaaaacagaagucuuucuacagagacagacccucaugucaugcaggcuggccuguagcugaggcuggcuuugaaccucuuguucuguguucaguucuccagugcugggauuuaagaccugagcugacauggccuccucugccucccuuuguacuugguuugcagaguuuauaggaugcuccucaguagaacaguaguaaagaguaacgugcgcacgcgugcuaugcggaaagcgagccccucauguguauuucgccucuauuccuugaugcucacugcacccacccauaauauuuugaagcagauccuaaacaguauauaauuuccuguguaaguaaugugagagcccuguuauguacuacacggugucugagguucguguuuccaacugauugguuuuuguguaagucguucauuuauaucauacuuaguugucauguauuugagauaaauauugaguaguguuuugucacugcgagcagauuugugugaauguagcauugugugugcugucgccaguacuagcaaugaaacacacuacaguacaucaguaagcugugacagaaaaauucugaaugaucacuaaguuagagcagaagagaucuaauuguaguauauuuuuaucuuugagagagggucucaguguagcucuggcuguccuugaaguuacuacguagaucuggcugaccuuaaacuuacagaaguccuuuugcuuaugcccccugaguacugagaucauaccuggccguuaguguauuuuuaagguaauguuuauguauaugcauauuuuuccugucuccaacuugaguuuauuuuagauuuuuccuuuuucuuccuuucuuccauucugcccuuuguuauuuuaugguuuuuuugugagaacuaaaacaagugagauauuuuucuuucuguugggaaaguuguuaggcuucuguuugaacugcaguguggggacaguguaccacuucaaacauugaccaugcucuggcuuagaagcagcagagccgugguagagucucuaaugcugcagugcuuuccuuaccugguaagugggauuuuuauauuggaacuaguuuacauuuaaguuacaugagguuauaaccucuuaguaaaggugucagauuauaaagcaucgauaauacaugugugccuggcuuugaacuuugacuuagguuuacugcugaauccugguaguagcucagcuugguagaaacugguuuuuauaggagcaauccuacaguugaggcccuucaaguuucaggaacuuacuuuaauuaacagaauaacguuauauucucaaaucuucuauucuaaacacugcccuguauauugauaagaauauggaaacuccuucagaccuguuuguaucugcacucuuugccccucccuccccccagccaggacugcuuuacugcauuugggaguaauuugcucaccagaggaguuucacucaguaacuugaaagcaguugcuaagauugugcuccaguuuugugccuagucugaauuauggcuggcaaggaacucuggaagccuguggaggguuguuggugacaugucugcaucuaucuuuucugaagggagggucuuauuagcacucaguucuccugccucagcucauaagugcugggauuacaagcauccaaagucuaccuuuaaaguagauuuuuaaaaaagguucgcauacaagguaaugcauuucauugugucuuuucaugcaaacauauaaugguacuuuguucuuauucucacucccuucugcuucuuagaaaauaauuagcuguuuucacugugaagcguaauggcuuuguagacaauuuuauuuaagcaccuugacuacauacugucuucauucaaugugucaugaacucacccuacucucuuccucauuccagccucuucucccuuuucucuguauguguguguguguguguguaaaauccugacucacuuauaguaaaauucuguauucaagagaaacaugauaaaucauuuuugucccucacuuauaguaaaauucuguauucaagagaaacaugauaaaucauuuuugucaccccccccccuuugagcccaccccugccucugagauggaguggggauuccauuuggaaugcugagaugucacagaggcccuggugaaggcgauaguugaaggaaggcagcaguggauggagagauccugucuuggacugagggcuucggcaaguguauugcuggagcgcagggugcuuggccagugcuggagucauucacagaaguucguccugaguccuuagaguuuucacagaacagguaauuagacacugucucucaccacuuucuucugcaaggagaagguaaacccaugacuguagccccauguuccagucccagggcagcgauuauggaggacagugcugggcgagggcauugcuuuaaugucuguuuucucuucgguggcucaggguggugaaaauaguccuaauucauacgguugggacucauuaauuuaucucuguagugaaagugauuuuaaaauguccuuauuaaaaauaggugaaagauuuugguaaaauauuugaugauaucauuauagcaacuuuggaagaaugagcggaaagcaguuuggugguagcugaaaucuuaguguugaccaucucugauucaauauaauuuucccacuaauggauuuguuuguuuguuuguuuguuuguuuguuuauuuggaguuuuuugagaaaggguuucccaguguguagcccuggcugucacagaacucacuauauagaccugggaggccuugaaaucagagauccaacugccucugccucugggauuaaaugcauguaccaguacugccuggcucccacuaggauuuuuauuuuacauuuuauuauuguaccuacuuuugagauaaagucucacuguauaccccaguagcuugcuguguagagcaugcugguuuugaaguguuagagauccucuugucucucccccuagugcugacauuaaacguacacgccaccaugcccagcauuaacgucuauuuuuuaacugauacauaacauaaaaauugggcuguguauguaucucugcgaguagugcuugcccaauguggggaugguauucuggauucaguccucagcaucaugugaacaagugagguggggcagguugcuauuccacagagguggaggcacgagacucaugaguucaaggccagacuacacgagguucugucuccuugaaguaaaacaaccccagaaagagguugaauugugauuuuucaugugauauuuagauacauguguauguuuuguaauaaguuguauucaguauaucucaaacauuucuuuauggugaaacauuuaaauucuguucuuuaagcuuuugaaaauaauacagcauguuauuaugaccucacugcuucuuugcuguuaugaauagugaucuugccccacccuucccuccaguguguguguguuuuccccuaccaucugggcuccagggacuggcugcaguuuguuaggcucggcagcaggugccuauaccugcugagccaucucccuacuggcccacggaugucaauuugaaauacugauucagucuccucuggauuguagaaguuuauagggaaacuucagaaguuguguacauugcuguguuucaaaguagaugaacaacacaaacuuugcuagaagugaguuguuguuuccccaguuauaaauuccgugaagacacuuuaguaugaagugagaauuauccugguacaacuuccauaccuuauucuuccuaccccauuccuuuucuggucuagaauuaucacugugaucaucauuauuauugagagagagagaguuuggacacucgugugugucacagccuggacuugaagaucagaggacaacuuuugcagucuuccccuuccacccuuggucccaggauuugaauguguauuaucaggcucacauagaaagggcuccacccacaggccaccucacuggcucuacucuccuugguuuuauuucaguuuaguuuuuuacaagauuaugccuguuccuuccaaacuucuauaaaaaauuauuuucauuuuauuguauguguaugaauguuuugccugcauauaugucuguguaccacauacauaccugguaucuguggaagucagaaggcagcaccagaucccaugacugccuugggucaccaugugagcugguacugggaaucuaauguggguccucuggaagagcagccaauaccauuuacaauucuuuauuuuaagaaagggaagguacauuuuggcuccuaguucacguauacagucgucauggcagcaggagcauuucauccuuagucaggaagcaaagaggauggaugcuuguggucagcuugcuaagcacgucaugguuuguauuaggcuuggaguagggcguagcaccauuaggggguguggccuuguuggagugggugugucacugugggcgugggcuuuaagacccucguucuaguugccuggaaaccaguauucugcuagcagaaagaagaugaagauguagaaccucagcuccuccuccaccaugucugccuggaugcugccaugauccugccuugaugauaacggacugaaccucugaaccuguaagccagccucaaguaaauguugucuuuauaagaguugccuuggucauggugucugaucacaggaguaaaacccuaacuaagacacucuguuuuaugcaguuuaggaucccagccuauaacaugaugaugcccacaucucucggaacuuccuuuauacacauguucaucuuuucagugacgccagaucuuguugacagucagcauuaacucaucaguauacaggcuuuuuguccauaggcuggcaagcaaacaaggcuucuucaacuuccaagugcuacauacauggcgugcauugugcuuuaccugcugacgaccuucugaagaaggaaggaaaugcagccagugucucaucguugcugugaauuacggagaaaaaccucguuuauuauugccaguggaauuuucccaguuguccagcaauccccaggaaagacaaaagaaugugcucuccugguugugcuagcuaguuuuuaacuugacacuggauauucauuugggggaagagagaauuaucucuugagaaaaugccuccaccagauuggccugagggcaagccuguggggcauuuucuuaauuagugauugaugugggaaagccugcucuuuguggguagugccaccucugggcaggugcuccuggaaguguauaagcaagcagguggagcaaggcagcaguaguguucuccuuguccucuguguacguuccugccuugaggacuucugcccugacuugcuuagauaauggacuacauacagguugugagaugaaauaaauucuuuccucuccaacuugauuugggcguucuaucaaagcaacagcccuaagauagcaauugguaccaugaguggguuuuauuaugguaggugugacuauguguuuuuugggaggauugcuaugacaguagaauuaugggcuacgaaagccauugagugcucagaggucagugggcuguuuuguuggcgcuuggaagagaccggagagcagacgaaguuucagaaggaagcgaggacucuaguggugcccuuucugugauauucugaauuaagaaucugugguuccgguuagcuggugcugaagaaucagcugggauuagcaggaggcuggcaccacucacugaagugaaagcuugguuuuacggggacaguuggugcugguuaguggagcugagaaaguagcagugguuaagagaccagcuucaccgagaaucaugaaucugggaguguguccucauagugagcccagcagaagcugugccucggaagagaccgagacugcaucucaugcuggccgccgaacucuguauuauacgaaucaccaggugcugcugguugaaggccauagacauugugggcagcagcugagcuuuggcacugagaggcagggcuguuugaaucggaauccaaguucagcccacauacugugauuggagacacuucuccucacucucuuuaacuuagguucugcuuccucacagauacuuguaugaagugauagauacauguucugaacgaucuccacaguuuuuggggugccacuuaucucuguuccucucucccuuuuacgucaguaaaacuggaaacuuuuauuuuuccucauuaacaucuuguuuuguaaugucuuugaaaaauuuugagguauuauuauuguguaugaauguuuugccuacauguauguuucugcaucaugcacaugguuggugccugaggaagccagaagagggugucagauccucugagcuguagcuacagcagguuacaagcugccuuaugggagcuggggacugaacccagguccugugaggaagagccucuuggucacugagcugguuuuuucuugucuuucuucuauguguauguguguugugacuguauguguguauguucacaugugagcagucaggagugaguucccugggaccagcauuacagacaguugugaaguccaguguggggcugugaauaaaucugggcucacuagaagagcagccaguccucuuaaugcagagcauucucugcagaacucugguuuuguuuguuuguuucuuucuuuuuuguuuguuuguuuguuuguuuuccgagacaggguuucucuguguagcucuggcuguccuggaacucacuuuguagaccaggcuggccucgaacucagaaauccgccugccucugccucccaagugcugggauuaaaggcgugcgccaccacgcccggcugguuuuguuucuuaauaccacuacaggaggguuccagaaccagcuguaaggaugcugagaguccuucauuuucugaaaucagccgaacccaaacuccccaugaaaacaaauggaaccacuuacagacuugagaaaggugauggccugcaaacaccacacccagauacauacuagaaagaaggccuggcuuucauuuggagaaagaugcuuugcaguuaagccaggcuugguuucgcucacauuacaugacagggaugggccaguuguugccuagguuucccauccaguaagcaaguguccuuaaguacuuuuuccuccucuuuucuagacaguuggauauaaggauuaaagugggaagaugacaaguuagagaugacaccaagaugugugaggagaucaaauaaaccuucucugcagggagccucugaaggccucuuguaacccccaucucccucgccuucuuccucccugcccucauuccagcccagcuuugauucuuucaauggaacuuuucagcugcggacacagagaagacaguagagaaauggacaccagccgucugucucugauggcagugggcagucuuacacugcuguccauuagaaucuucgccuuuuccauggcuuuucagacguguggcacacaguggguccuuugucuuuccuucaucaaugcugauguuuuugcuaguuuugucuauguguuuugguugguucucauuauugguagcagguggagggacuuggaugauaaacuaagaugauguaacaugccuucuuacugucugccuuuuuaaaugaauggcuuuuacccaugguuuuuagguuacuaguugccuggaagcauugugauuacauuccuuucauauguauuuuuuacccagauaauuuaaguuauggagcucagagacuuucaucucuacaucuauauuauguauuugugaaaaagggaauucaacauuuaaucagagcacugcuauuuuuauaacuguuaauuggcagaacucucgaacauuaucuuguuuuugguguauuaucugcagucauucccacgguaucuucuacagugugcuuauuuaacuggucuugcaaaggaaccuuuccucacuuacccaugccuuugcuacuuggugucuuuuauuuugaaauucucauuucauuauguuuucauaauggcgacuuguuaaaaagacaugaugccaccucaugucuucuaagaccuuuccuuucucugacuggguuuuacuguuucugugguguauuuagcucaucuuucuguaucccuuauuucugucaaaguaaaagucugucugaagaauucaaaccagaguaaacauuuuaguagaguguuuaacagccagacccauugcaucaucgcaggaaccauacaagucaguaguaaugaaggugaugauuuuucgauugugaaaucaugauuuccccuuuuauaucaucuaggaggagugaaauuuuggcaauacauauacgucuaguucuucauccaacuucuaccuaauauaguauccauuggugguuuuuaccaguuaucuuccuggaauuagcaaaaguuauaaaaaggauuuuuaaagaauuggagucaaaauauacaaacuuuuuaucuugaucuuuuuacagcauauaguucaguauuacaauuuuuuuugugaugugccgaucuuaacugcacugaaacuguauauucuaaaaugguauuugaugcuuuaaaaaaaaagauuuauuuuuaugugugaguguuuugacuguguguguauagugcacccaccauguguauguauccugggaagccaggagcugucggguccccuggaacuugggugacaggaguugugaacuccuauuuuggugcugggaacugaaccccaguccuaagcaagagcagcaagugcuguucagcugagccaacuuuccagccaccuuaguuaaacagcucuaacucucuuugcuaaguggcuuuccuuuaucaaugcgggcucguuguuuaccauaaaauaguuuuaaaauaggaaacacuggguaaauguuuuaauuuuuuuugcuuuauugcauuucggaagggggcuuaauaguuagacccguuucuuuuuuucuguacuaauagaaaaaguuuugggcuuuaaauguugccagauguucaagcgauuucuacagccugcggccugugggaggaggggggaguggucaggcugugggaccugcggaagcaaguugcguccugggagggguuacucuugcaggcaugcugggaaucucggccuccucugugccccuggcugccugggguaagcagccuugcuggacuucacucugucaacuaccaugagcucuauugugggcguaggaaugguggcgcagacucacuguggaccgaaaccuuugauugaaccugugugccaaaauuaagcuuucauccuuacaaguuaguuugucucagguauugucacagcaguggaaagcuaaccagaagcagucugcuuccuucuugaguauugucacugauuuaagauuuuuuuuuugggggggggggugcuuuuuuuuuuuuuuuuuuuugguuuuugagauaggguuucucuguguagcccuggcuguccuggaacucacucuguagaccaggcugaccucaaacucagaaauccgccugccucugccucccgaguguugggauuaaaggcgugcaccaccacauccggccgauuuaagaauguuuauauauucuguggauuucaagcaguuacgcagacauuuuuuuuaaccuucugaaucagggucuugcuguuugcuggauuacacugugauuggccagucauuguuuuuguaugauguccagguuuccuaaguccuuuuauuuuuuucuuuuuuaaauuuaauuuuauuuacauucuagacguugccccucuucuugguccccuccccguguuuuucaacccucccccccagagggugcucccccacugcccaccaggaucccccuucccuggagcaucaagucucuacaggauuaaacucauccucuccuaccgaggccagacaaggcaauccucugcugcauaccugccuggggggucacuggguggcuuuucuuucagucucugcuccauuuuuauuccugaguuucauuuaggcuggaacaaaucugggucaaaaaaauugaaaaugggaggguguuccccugccucaacagggggucaugucuaucuacuggagguggucucuuccaucuccccacuguugggcauuuuggcuaaugucaucuccauugaguccugguagucuacauccaaggacucugggacacucuagagguuccccacccccacucccaguccccaccgcuguauauuuugauucauucuccuggcccccuggguuucuuucuugucucuccccauaccuaaucuuguuccuuccuuccccuuucugaguccuuuuacacuggcucuuuucuuuuuuuuuaauuuagaauaccaucaaauccccauuagcuuucacacaaaacagucugugauguaaagaagugugaagcugagugcuuacacugugauguugcgguaaaucucccaaauaugcccggcaaugaaaacccaacccaguucauaugauuacaugcugugcgccuagaucgggcagauuggguagcuacacuaccaucuuccacaucucugagaccccuuagaacuugcgguuucuccaggccaugugcuucugcucugcuuuucuucuucuuccuccuccucugcauccucuccaccuucccuuuuaucugcccaaucaucagcucuccuuuauuuuacaaacuaaggugggaagcagguuuagaggaaaucaccugagugcugacucauuccuuguucacaaccacucacaggagaacggaauuaacaucaaauauaauuagccccaggguuagccacaacacugauaccaacuuaucagcacuuaggaacugggugaaaguccuggacuucuuguuguaugguuugugguccuuuaaugcuuacaauguuguuuuacuauuuagucaugaagaguuuguuuauugguuuuuugagcuagaugucauaauuuguucuucccaggccacugauucaguuuggagccaugagagucccagcauccuucagagucacaagccuguccucagaggaagcuaggagggcuuugcaugcuaaccucugccucuaacucauccuaaagcuagcucagcgcucugccugcacggucaccucgucaugcuggauugauuaauaauuaauuaauuauuaauuaacugcugagagucucugcgggcagcucuguuuccucugguuggcguaaacaggucauauuuggaguugaaauguaugaguuuguacaggacugcucaguaauugaauagagucuucaugagcacaucauguuucuacaccucuggguagacagugucugaccuuuuaaagcacacauuggcuuaugacuuccuuucuuuuccugcaguggaguuuaagguacguuuuguucauuguguaggcaaaaguucuuucuagcuuuguaggcuuucuucucugaguaaauguggcuugguuuauccauguccucacccaccggucgccaucaugacucucucggugcgcauuacauaggaaccuccaucgucggaguccuuugagcgcguacugcauggugggcagcagugcaaauaauacagcugcaugccaugcuaauacaaaccaaaugcugugcuuugaaaagccauuucuuuuccaagaauagaaacuaguauaacggaauucugugcuuauucuacagggaguuaaguuuuaaaguaaauaaaaagaagccauacuauacuuuaguuagaaauacucuucuuuauauguuuaagcuaugucagguuuguaaacuauaacauuuuuguaacuauaagaaacuuauuuuguagagacccagcacuuuaaaaaauaucuaaaauugcauaaacugcagaaacugaauacugucauuucuagcagauaaagcuuuucuguggcuaguccagauguggcagcaacaggauaauaugaauacuugguuauuucuuucacauucauaauacuacugaauugugaaugaguucaguuuaaguugugcaggguuguccuuuguaaggacaggcucuuccuuacaggaaaacacaagugucugaagguugaauggcaguuacuuuguauauuaccauacaaugauuuuaagccaucuuacaguuaguacuuacgauaaaauuucuuuuuuuccuuuuuuaaaggaguuuuuauuuaauguacgaguaucugcauguacaccugcaugccagaagagggcccaagauuucacuauagaugguugugagccaccauaugguugccaggaauugaacucgggaccucuggaugggcagcgaguucucuuaaccacugaaccaucucuccagcccugugauaaaauuucuuaaaaagcaauuagggucggguaaauuaagacuuaaacgaaaacauacaagagagugucugcaugcaacuguaacugcggccuagcauauguguugaagauauucuguuuauuucauugcuuuguuauuuuauuuuuguauaaagaauacuaugcaguuaaugacuuauaacccuccaaaaguauuuguucuauaaaaaauagcaaaacagcuauacacauaaauagacuaucugauuuauuccugauuuaacuguuauucuuuggaaaugcuuguugaagguuauugaagacauuuuccuccuuaaauccugaaauucuguguguguauguuugaguaugugaugcauguaccugcacaugucccuggagggcuugggugguguuccucaaguauuaucuauucuuuuuuuaaugagauaggcucucucacuguccugcaaguugugcuggcugaccaggaaacuuuagcaaugcaggguuuaccuccccagugcagagguuacgagagaaccccgugacugccuuuucccucuaaaauguagcuucugggggcuggacuccauucagcuccgucagcuuggaaugcagacauuuuacuagcgaguuuccugauccuuagaguuuuuacagcauaagacaaagccauuguguaagagggcagucacuguuauuaaggcuggaagcucguaaucuuagcccuccagaugcugaggccugaggaguucugcaagucugaggccagcuugaacuauucugugagacccguuucaacagaaagauuaguagcugagacuuuucugaguucgaucuaucucuugagugacuuauauacuucagagccaauucuucccuaauucuucccuaauucuugguccuuuuaaaacgaauaguuucugauucccaccagucggcuuagcugccaucucuuugucacucuuggaugugcacagcaucuaccagguuccauuuuaacagccgacugugcaggcuuuuccagcuacugucuuuucucagagcagcagccaugcuuuagccugcuccuagugauuggcauguguuagagcacucucugcguauuuauggaaugaauaaaaacuaguaaaugaaacacaagucuuaaugaaguucagauuauguuaugguuugaauggaaaugucgccgacagguuuaugaguugaaugcuuggagccucagcuggaggcacaguucugagaagcaguggagacuuuaggagaugauggggccugucugaagcaguaggucacugggaugugcuggccucuuccucacuccauuucuuuucugcuuccugggugccuuggcgugagcuucuugccauggaugcuuuccuggucauaguggaccaaaugccaagaccugagcuggaguaugcugugcuuuugguugaguguggugcuugucacagugaguccaacacacacuguuacuuuucuuuccucgcuaggaaugagagugcauuaccugacuuggaugcuccuuuugccauguagaaauuguaggugcugguggugaugugguaugucuuagaguugaaugagauagguucuuagcggagcuggguauaggugcuuuucuccagagggcuuacucagcugccuucuccuguaucccuuccugcagaggcggccuccuguauugucuccuccccucuuggcugcucucaguggcauuccagaauccucuccuaucacuuccugccuaaucagauguccuguuaguugauugcaacuauuuaguauucccugucugcuguaagcacugguucucaauccuggcaauguuagaaccaucugggggauuugaaaagaggaaaaaggaugagaaucuuagaccuaccggauaguaccauggcaagggaggaaagcgcugaggggaaagugagaucuggggcccuuuccaagagaaugaaccauuuacccuaaaaacuuggcaacagcuuggacccuuagaacuccucuucacaaaucccgucccuauucuucacauucuucacgcugagguaucaagccugucuuagccauuugguuuccacuuucuagcuccuuucuguucccuuugauguucuuuucuccccaccacuucucaagcugcccuuugugcuugaugaugucacuucccuacuguggagcaguuaagagcucccuuuuaagugucagaauucaaagucaacaguugguauccuucucacgggaugcccuauucuagccauaggacuuuccguggcugcuggacagcuuuguuuuuccagauuugaagacauccuuuucauuuuauuuuaaagaaaggcuuaauuucuauauuugauuacuuguacauguguggggaucuuucuugugugaguguguggguuacccucaggguccagaacaguuuauuagauccccuggagcuggaguuagaggcgguugugaacuaccugaugugggagcugggacuugaacuugaguccucuuauagacuagcaaaugcucuuagcuucugagagaucuugcuggccuccucugugaguuguaucuuaauugcucucuuuuagaguuccuacaccaguuacugaauuuugaguggucaagaacuauagccauucuuuaguugaaccuuuaacuuacaaaugcaaccccaggauguugacauuuuaagugacuccaagcagcccuaaccuaugccaaaaaaguagccacggacccugauacggcugccucugcagccacagccccuaauacaacugcagccucggcacucuucucacuucuuuuccgucuuagcuggcuccacuugucucucauaccuucucuaucagcucagcacaggcugugguggaacaccuaauucuagugucauuuagguuccaugacagcaucagacagaccuuuuguuacuguaguaauuaacagugcugcuguugcugaugaugcuucaagagguucccucucuguuccuuacaaaccucucugcagggcacugauacccccauuuuaggaauaaggaaaaaaagguaugaaggucugagaggcgaaguccuuaaauaucaggguuagguuugagugcaggucuggucagagccaggcuuauuuagaugguuuuguaauuguuuacuguaggugucuuguuuuucacugaccauaaggcucuaaauaacaaggucuaggucauggaugucucuuucagcagcuuucacccaagagugcauuacacguuuucuuccuuaguuggaagggugucuaauucggaucacacuugaguguagugucagagcauugguaaagaggcagagagagcagaaggugagagaugaagcguaagccuaggaccucauuagguccuucaucucagacauacagugcacagcacaguucucugacuuuuauuguuuaguguuugaaaccagguuuucauuuaguuaccuggagaguuugugcuagcaucccauaugacauugucaccucuggccuuguucauuguugcauaugauguuccuugguuaagagggacugaggcugucuccugcaagaauauuaaugaguagcuuccauggaaggaugcaucuucaaucagcaucuucagcuugucuaaggcacugagggcuuccaacuuggugagcagcugaaccaggcaagagccuucugugauaguguggggcauguggacaguucagcaucuauugucaugcaguuauggguaaagaaucuugucuuuugcuucuugggauggugaaccauuuuagcugauuaagcugauuuccugggguuuuucuuuuccccugagauuuguacucaguguucuuuguucuucugaaauaacucucacagaauauugugauagccuaagucuuuacggguuagagucugagagugcacagaggagauucaggagcauacuuggagggugaucuuccaaguuuauuuuucaacacauuugaauggccauuuugaaaugaaugcaguguguggcuugagagggaagcuccaagaugcacucgggcuaaagcaaguguguggagaagccuauggaggagagcagagacuugcuuuguucuuguccuucguuuaccuucagcuagugaguugauggucuuggaaaacugaggugaacucucugcucugcauucgcaccuuuuaaggaguuggaguuuguuacucuugcucaccuuucagugugguuacuagugucagagcucacacucacaucuuauuugugguggaauaaaaccacucccucuuggaggaaaaacaggucucuaguuuaucaaguguuucuggaacacagcugauuuguaguuccuaucuuuauuagggaaagcuuuaauggucauaaacacuuucucugcuauagauuuuagcccuugaauuaauauuaucuuuauuuuaguauauaugaaagauacauuaaaacucuauaaaauuuacauaagauuuaucauuuugccugcgcaugguggcacaaaccuguaauucuagcacugaggaggcugaaguagggaauugcaaauugagauaagccugggguacauggccuagugagauucuucuguagaaaacaaauauguuuccauuuuaacuguuauucacugggaguaaggauauccaguguuguguagcuauuacugcuauuuccagaacuuuuaaaaaaccucuuauauccuuuuuguuguaguauauguacauggcucugucuauguauuuucauguuugugugccuaugugcauauauaugggcaugcagucaagugugugcacauuuguguggaggggcagaggccacugucagcugaucuccucuguuacucucagguuuuuuuuuuuuuugagacaggguuucucuguauagcccuggcuguccuggaacucacucuguagaccaggcuggccucaaacucagaaauccgccugccucugccucccgagugcugggauuaaaggcaugugccaccacgcccagcacucucaguucuugaagcagggucucucacugaacuugaaacugacugauuggcgagaguggcggccagccuaucaucugccccccuugcccuagaccacagugcuucuauauuggucuugggaacagagcucgugucuucaccaacugagcaucuuccugaauucucaguguagacucuguacccauuaaauaaucacuccuccuuucucacccccgguagcccugcggaaccuaccucauacaaucauacacguggcucuuucuuucaucuacuuuaccagugaaugguguccagguucaucuguuuuguagcaugugcuugaaccuccuuccuauuugagacaagacaguauuucauuaugcauguacacacaguagguagucuguauguuguuuacacauguaucuguuggguccucuccugucuuuaugcuucugcuuuuguggauaaugcugggugaagcuugaacacaggugaacacguuuuggagggcuugcuuuuaggcuucggcuagaaguggaauggccgauucacaguaacuuuuauguuugugaggaacccuggacgauggucugugcugggcucugcuguuucuaugugcauuugaguagggcuccauuugcaucagugccuagucucacuuacaucccucuccccagguaauaugcauccugauggguaggaaguaucuuaacugcgggguugauuuacauuuccuaauaauuugaagauguugaucagcuuuucuuaaauuucuuuuuagauuuauuauuuuauguguauaagugucuuguuugcaugcaaguguauggaccacauguaugccugguauucauaaaggucagaagaagguguggguccugggaacuguuugugaaccacuguguaggugcugggaacugaacuuggcuucucagcaagugugacaagugcucuuagcugcagagccauccucaccugucagcuuuucuuuugagacauggucuugcugugugguccuggcuggacuuggcccuguuguuacacuugaguagauuccauuauggcuuaaaaaaaucauuuuauauuuuuucguacuugucuaucuggcuuacuaugcaaaugaacauuuagggauuuagggaauguguucguguuuucucugucugucugucugucugucugucacagguucagucauuuugccuuuuuugagggcaccucauuuaauauauggcuacauuuguuuuaucaauuuauucuuugucguacugggaguugaauauagggucuugcacaugguagagauuucaguacugaacuacaucuguaacccuauuuuuauuuuuuuguuugaagaaaguaguuucauuaaguguuuaagcugcccuugaacacgcaaacccccacaccucaauugucagagcaguuuggagccugugcuacugggaccaaccuaaacuguaucuuaauauucuuuacuuuauuuuuuuggauauuuuuuguaugcguuuauaaguuagaaccuuuggaauuccuagggagaggaucuuaauuuaucgaucauuugaauacuaugcaauucuguuugacugcagauagauuuuuauauaauggcuuugguggaguuguuaaauaaaugaaaugauucaguuaagaauaguuuaguagugagauaagugauagagaaauugccugcuuagggauggaguguuugcuggccacguuuugucaaccugacacaaaguagaguaaccggggagaggugacucuucucaacugaggaauugucuccaucagauuggucugugaguauaccuguauugauggcugacgugcgagugaugccaccccgguugguacucuggguuuuaugagaaagcuagcugagccaaccacggugggugagacagugagcagcacucaucuucucucuuccugucugcuucagcuccugcuccagguuccugacuugaguucuugucuuagcgccugcugaugaugggcuacacaaugcgaggugaaagaaacccuuuccuccucagguuggaauuggucaugguguuuaucgcagaagcaggcacacuaagauagugcguguuauagagauauguuuggaucugaaguguguagggaggcagcaugguuuagggaucuuacugccauccaaaggaaagcuuauguaaagauguggcaaaccaguagccauuuagucaauugagaaauaacguucagaaaguuuauuaauaaaauccagguacuuuauggagugcuuguguaagccauuacuuuaaacuguuuuaaaggucagagaggcuguugugagaacaggagauacagacugcagagagggccacagagcauaucugggacuuacucgcaucugguuaaggaggggccggugcugcagguuguacaaccuuugcugcuuacuguaaacauagagaccucaggacuuagaaggucacccuuagcagagcccugaaccuuucauuaaaguaguuaacagaaucaagaaagggcuccagcgcuguaacggaguccguaagccucugaaggugacugcagcucucuuguuauccucauccacaagucccucccuuggacccaaucccagugcuuuauggagcaacacagcagccccuaaacccaaguccaaccuugugguuuuauugaugauuauguugcucagaauaaucagaucuuggcucagauguggagcuguugugucaccaguggcugugaacuacuaaacguccuuuuugugcugugugguagccacuaaguguccuggaauguucaggcaguugcuucguaacuugguaggugucucuuaaguuuccaaguguccaugucuaagccguucucgggcaucugaacccuguucagagguccgcagaggccaaauggacuuucagguucugaaguuaaguuggcaacuuuuaaaaauagagaaguaauggcgcaguccuugauuguguauguaugcuuugauuaugugugucuuaaaggcucgcucagcguccacagaaugugaccgugagacauaaacuuagccuuugauagccugugacugauguauuugcccacaugauucgucagaauuucacuaguagaauuuacugugauugauuuuuuucauaacugcuuagguggaugggcaaugcuauucuuaaguuuuuaguaaccaaacaaacaccagacuuuuauguguaguccuaacaagcugaauaaagucuucucauugugcuagauacuaaaggaggauauuagugaaacagucuccuguucccagaauucuaggaacaagaaagguauaagggaggagaauccugugugggugugcagugauuuagaaaggggguuguuucuccauugggaucaugggcauucuagacugacugggagaugggaagcugaaauguuugcuaaccagagccugaaguacaucagauuccgguacaacacaccaaggagcacugcuuuaaguagcuguuagcagcauuugagucaugagcauaaguagaggaguucaguggugaagaauaucuauguguaguuguaguaacuggcugcaguaccuugaguggcugcccaugcaaaagcuucagagagcugggaccuuuucuuggaaacaugagaugugaaggcuagugagaaguguguauuuaagcauuacagcacaugaugcuuugaagucugagccagcuuaaugauuugauucuguauuaaugauuugauuaugaugauugguauuagcauuucccccuuuaaaauauugaaccaguuagagucagcuguuaacagaguguuguguguccagaacaucagacgguuucuucauucguuuauucuuagggaaugaagcucccacuccaaaggaugauuguuagugaccuggcacuuagucucaagggcaaaguuauuccuguauauaggaacaaaauggguaccuguuugggguguauuuuuuaaagggaccuaaggauugguguguuccucccagacuuaaguaacuauuaguucuuggaugauguagcagcucugauguuucaggugacugguaauguuaacuggguuauccucagccuuuuuguacagagcaguaguggagcucacaucugguucauggauuagaugugcuaacucuugucagcuucuaacuuuaaacugccacacuuucuucacugcugaauggaaaugcucuugcagcugucaaauaaggauacugugugucaguuacuugacuucucaguaggcacuuaacuguugaaguuaggaagaaaaaaauuagugaauuuuucuacagaauguucuguacagaaguauuucuuuuuuauuuauuuuuuauuagauauuuucuuuauauacauuucaaaugcuaucccgaauguucccuauuaccccccccccccacuccccuacccacccacucccgcuucuuggcccuggcauuccccuguauuggggcauauaaaguuugcaauaccaaggggccucucuucccagugauggccgacuaggccauuguacagaaguauuucuaaucauggaaguuuuuaauaaauuuuaaaauuaauuaucagcagaaaguaaauugacauugacuuuagaauauuguaagaacaacucuuggcaacuugagucaguuuuaaaugauuuauaaaacuuuggagaaaccacacucauuaacuguuuguauuuagauagaguucaggacucuguuguugaaugaacaaaucuuuuuuucccucaguaaaucgaaguuuuuccaguuugggaguuaucuuaaggcauuacuaauucuuggcauacuuaucuaagaaauuauauacuacaguguuuguagauguaaaauaaaugaucagaauuguuuuaaauggucucuguugugaggcaggaaggguuggucaguguuggaccuuaaaguugaauaaggauacuccuuuggauuauauuucauuuuaucucagagauaagcaggcugcugucucuaaauauuagguuacaauaaauauagaccacaggcuggagagauggcucggugguuaagagcacugacugcucuucugcagguccugaguucaguucucagcaaccaucuguaaugggagcugaugcccucuucugguguuugaagacagcuacaguguacucacagacuuuaaauaaauaaauacaugaauaagcaagcaaaacugccagagcaggaacacaaaccauauaagaauuucacuuuuuugaugauguaauaauguccucuuaacuuuucagaguugaugcuagugcuguugcugacuggcucacagagccauuacauaaucaauuguuggcuguguuuucaguauuggccuuguugccuuuggcaaacauugcaggcguaugaaguaaugcucagugguuugacuuccuaggcgacggucugcugagaccuagucacuugugucccagggggaucuaagcagaucuauagggacauggccccauggagagaaagcuguggccugaccaucuuuuguaguuaaaaauacaugcugugcaugagugaugcgccuucaguaugggacuaacuuauagccuuccugucaugacugaguguauugcaaauuugaagcuagugauuguaucuagugaaucuggcuugcaaguaguggugagaguaagccuugaagcaacugugaguccaacuugagacagauagaaaacaucaugguauacacacacacacacacacacacacacacacacacacacacacauauuuaccugcuuagucccuuucauaaaugguuggcaugagggaguacaggagaauucuuguaacuaaguuguuuauagaguacugagcauaguagauuaacaaugcuagucacuauacagccugcgauguguaucauugaggcuauaaggguauguaagggaagaagguggacagugagcgcggggaauuggaaagggaagggaagagaggaaggggugugagaugugccuagagugggacaggucucagggccgugcugcauucacagggcugacuggcugcaggggacuuccugcauagccagaacagcuagcauuuuaucagaaagacaacagggaucccuuguagcugccaaacacuuugugucugucagaccagacacagaaaagguagccaaaggguuauagcuuguggagcucucuagucauuaggaaaagcagguuagcacagcaaccugcucaugaccgucauggaucuacgccugccagguaagcacugagggaggccuagagauggagcagcuguacaucauggcugagaaggugaauuggcaccucuguacugcccuguuggagaacaguuugggacuacgggguaaaaccagaccugcgguucuaggggaggacuuucaaaaaguccuguguuaagaagacauuggagaagugguccugagggaucuguaggagaaaaguguuggggacaaccuaucuuccaauuuggagaaggaaagaauacuuuauuuaugauagaguacuauauaggaguuaaaaaaagaacauuggccugaauagagcuauaugggaacacagaaauccauagucuugaacuaaaaucgaguaugaauauagugauaauuauaaacauacaagagcaacacugaccuaugaaaaguagugccugagaaguguguugaccuaggagaugccuucuucugcucagugacuucugagagccugguccugaguucggagcacagcagggugaccucacuggcuguuuaugcaugauaugguuuuaucugcuuaugaaaacagcugacagacugcuaaguuauaaagccuuugguaaagccaugucuucgucuaugaggcauccccauuugugugaaugaagugguccuguuuuggcucucaguucacuagcagacuuauuccuuaauaaacuguguacacuuuagaaguggugugcuaggcuuccuauggaagagcuccgagaugaggcuuggcacuagugauagcucauuggaaggucuccaucucucuacugauccuuaguaugcauucacaaaacuggggugagccuaggguugcccucagaaucccuuucugccugcuuuucccucacuuaauguguuucuuuaagaguauuguuaccccuccccuuucuuuagccagaaaggucacacugugaguccagguuagccuggacuugacuauauagaccagacagguacuucucaucagugaauaaccaucugcugugcacauuuaauuuugguuucaguuuucucccccccccccuuacuaagugcuuuaauauuuucaggaggaaugugcccuaccugaauuaauagcuaugcccugaauuaauugcuaauggauaacacuggaaaaaaaaucaaaugcucagaaguuacacauuugcugagacaggcuucaggcgugucagccgucagccuuggggucacuuagaaacacaacuguauaauugcauggacgacuauagaauugcaaggacuuucugaaggaacuauaguaggaaggaugagugagugaagaaggaaaagcucacguuauuuuguagcagcuacagagagcagccugggaacugcaguuuucuuuaccgggagcucuguagcacaagcuacugcagaugguucugcugccccuuucagccuuuccagcacucaacuguagaugauucauacauagcuggaaccuaccuucaagacagcacugucucuacugaagccaaauuguuccuagcuuucuuucuagguacaugacaggcacucggcacuacugcuguuaaaaaguaaccuagacagagguucuuaauaagcacggcacacagauaggcacacagcaccuugaacugagcccagccucuguccugcuugucacugugagcugugcacaugcuaaugccagaguccgugggagcugcauguaggcacaaguaggcuggaucuuacuuaccaacuagugacucagucuacuguucagaaaacaccguuaaugggaaagauugaaaaacaguccccaguuguccaguuagcucacaucugagguaccgguuucccaggcugaaguuucuaacaugggccagaaaacccaugcauuugacaauugaacuuggagcuuuguuuuugugugccagaccucugugugaccucggcagucgcucuucagcugguccccuccuuggaaguagaugugugagaacaugggcagccagcggagaaaggcaugcugagcuucuuuagugauuaucuuuaauuauguuggugucgaccggcuccuguuuagagcaggcugagcaacuccagugcagggagacucguccuuuccacauaagcuuucuuguagauaacaaggacauagauguccuuugaagaccccgauaagcuacugacaguaaaguuaccuggacugcauuguucauggagaugauaguccauuaccaucauuaguauuaauaacagugaaagcaaguaguggauucaaacguguugauuacuagccuuugcuccacugugaacuuuaucuuuaaacuuagaaaaaguauuuaaaauaccagguaagccuuuaagccuuuuucacuugcuugcugucuauuuuccuuggaguuucuaguuggagugccuuggucugcuucuagaucuuuuucuuauaucaucuguauugcuguguguguguguguuuuaaaugauugaaaguucugcacaggaguuuugaaugucagccuaauuucuauucaguccccauucaaacucugacugacaguagucuuuugauaucaugucuuggacaagggauguagcucaguugguagaaugcuugccuccuauccuugaaacuguggcugcugucuccaguacuucuuaaaacuggguguggaaagcuagucuuggagcccagugcuuggaagguggaggcaggaggaucagguguuaaggucaucauugacuacguagugaggccagagucagucguaaaagguacagugggucucgcagagucaaaucaguuacuacuaagagggacagagcuaguucauguguguguguguguguguguguguguacguguguacauuguguuauuauuggaacuuguuuucaguuuuaagucaucuuuggacacagaaaaugucgcuugaaagacacugccagauacuugucuuucuuuaagaaucaugaauuuuguucacagcuaggauuuuggcucucggucccccccccccccccccaguacaaggcacuauugagcuuuauuuuuuuaccaccuuuuuauuacuuuggcuucuuuuuauuuuuaauaaaugaucagugugugaaauuuuaagccaaaugaggaacaaaggaauugcugguuuucaaaaguuugucuuuaauuuuauauuaaggaggcaauguuggcuuuauuuuuagaaauuaaauauuuuauaguuuuuggguaauuuaacaccugcuuucaccucuucuuaaauaacuggagaaaucuccaaguuguuuguauccuuggauaaagagcugacagggacugucaguuccauucugugacuugcccaaaugccuuuacuugaugugucagauuguagcaaaacugagauuaaaaucacaauuaaagugagugaguugcuugacuuaagacaagcaaaccccuuacuccacuuauucaaauaauauaaaauaugacagguugggaacaguggggaaccuaaggguaauuaagugcaggaaguggcuucgcacacugccugucauaccuuggugauuuguauaaaauacaaacagcugcgauuccaaaugccccauccacuucagaugcucaccuuugugagcugauucaguaaagcuuuguccauaugucuuuggugacuugcuuucaguuuucuucacaaaaaugcaaaauauuuggggccuauugcucaauggagaguugcguacauuugccuuuacacagcauaguacccucgggagaaggguuuguauggagggagacugcaguuuuugugagggaacgggugaaaagggcaguuuccugagcugcugccaaaaggucugaacaauuuguaguagcucgugguuagaaaauagugugaggcaggggagacgcugcagacgggcuaugggugagagagagaguccuuuccguggucacuacagacaggcugugggugagagagaguccgucccauggucacuaaaccuuugugacaauuuaguuuauaaaagugaauuuuaagucucaauuacuagaaaugaugccuugguugguuuuggacagaaaucuggagagauaguugcuuuagcagaaguuggacagcggugcacuguuagaaguaauauuucugcuuugcuuauacucugauauugaucgagauaacccauuuucccuuuaccuuauaugaagguaaacaugcauuuuacaggcagagggggugucuucccgggaagcuaacuagaaagcccccccuuccacaagcucacauguugcauuucauuugguauuagauucacacguagacaguucuguaacuacuggaacuugccaccugccugugcugacaguaucaagcacgaugcugauauccguacacgggcgaugucaccugaauggcuccugacaagagaagcagguuagagaggguagggugucuuguaccgaacagcucucggagcugggauguggagcccaucugcaugguucuaacuuuuuuaggaaguuacuauuccagauccuuagccuuuagaauaaaagucuugagggauuauucuuguggaaugugcuuggacauguggagugaagguaguauugguuggguucgugucucgccgaacucugacuuaaguuagcuuuugccacacauaagcauccagucauacaguaagcuucccuggugaggaggagggcuccagaugcugcugugcucccugccugacuuuuggcuuuuguugcgggcaccuaagcuuuucacuaaugcacggaagaagcagauuagggcaaaaccucucucuuaauguuuugugauacucagcaauguugauuuuaauaauuguauuuguguuaagcagguuuugcuccucaucuagcacagugguuuucagucccacuggaaggcagauccauugguagacagagcagagaggcuacauccugucagagcagugcugguccucauagcaggauguuaaaacuggggagguugaacaguccaguucaagcaagcagaggccacaggcuguguaccagguucuuuagagacucugacucaugaagcuuucuaauagcaagaugguccaguuacuguggacguggaggaagaggcugucuauccaucugcucccccgcuccaagcuaaauaacagaaguugacccuuugaggguucuguuuccugccuucaccugauaacucuaucauauguuaguagaaauggauguuuuuguguguuuuauugucaccucgugguguugcaguauaacauuuaugauuuuuguuacauuuaagaugaaaggagcaguguauaggugauugugaauuuuauauuuuacuuuugagauuauaugaguacauauuuucucccuucccuuuucucauuccaaauccuccuauauaccccuccuugcucucuuucauauuuaugaccuuuuaaaauuguuguuaaauauguauauguauguguauuuguauuuaacugcauauuccuaaauauaacuggcuccgucuguauaauguuacuuguauguauauuuucagggcugaccguuugguauuggauaacuagucagcaugcuauucccuggagaagacuauuaugucugauacucucacauagcuauguuccauaguugacuguacuacuuaguguaggguugagggcugugggcuuuccugugucauuuuggcaugucuguuguuguccuucuucgguuguguuuaggcagccacgcacguuggugagagugugugugcagccacuggcauuacuaggagaaacaggcuugcagaagagauccucuggcucgcccagucuuuucugacccucuucaccaggguuccccuagccuuaggugugcaaguuguuuuguagacguguuccuugacugggcuucacaugcugcguuuugauugguugugguaaaguuuccuugaguaauuuuuguucuuccaguuuuucuugcccccuguuucuccuguuuacagcccugguuuuggcccacucuucuuucuacuuuggcagcuuugcacgcaucuuuuuguaguggcaauuuuucagaguggaugcuaauccuggguuuacccuuccucccuccccuucucuccucccucuccaucuuuaccugucaggaggagcugggucugagagugacggaaaugauccuugaggccagaagagauccagucuuggagcuugagcgcccuugagcucugagcugggugguuccuugugcugugcgcagguagacugacugccucagccugcacuuguacugacuugaauuucagagagacaacuuaauuuuuucucggguuuaaucuuuuauguguauaaauauuacauguuagaguaacuaacaaguguguguuguuauuuugauuguuuuggaauaugugaaagcauagacaguuggauucaaaugagagauaaauugugggaaaguuauuccuucauugagaggcccauuaguagggcauuggacuugacucuugcaaauugaccaugccugauugcccaaguguuugcaugguuagacagauuauaguuaaacaauaagcuguuauacccagcagugauuggacaagcaaggcauggcugcacacgaacuacuuugaaagagaauacaacaaauauuaccaucauuuagggaagaaaauagagccacuguuugagaguaaagguuccucucuugcuaagcagcuaugcacccuugagcuugguguuaugagaguucagccuucaguugaugggcaaauaaauccuucugugcccuucacacucucccuucccucuuccucuccucaagugucuggcauuguauagaguuugcuagagaugauaucagauucucuuccauugaaggauggcuuaguuugacauuuuuuuuuuuuuuaaaguauguacagauagaaaguugaugucugugauuguggaaaugaguaugacucaagaacuugguaggacuuucugggaucagcaaagguccuguuaagguuuguaacugucagauaauuuauuuucuuugucuuugagauagggcuucccucucuagcucaagcuugccuugaacuuaugacaguccugccucagccuccugaguguuuugaguaaagaguugccuugccugaauaccgagacugagaacaguuucuaugaugguuuaacaaaaaauauacuuuucauucguugaggcuuucauacaugaaauagguggguuagaugaccugggugugggcagcucuaaaccuggguggugcaagagugggcaaggaguuaaggugccacgcugaugacguuugggauccaagcugcuucaggaggggaguaggggcauagacuccuuauggucggucaagcaaguguuggaauugguguuugagguuugcauugaaaagauagggagaaccagaagcugagguuguggugagguugcagcuguggacuggguuuucaagagaguuauuuugagggucuuaaaggggaacaguaaauaauaugagacucacgaccacauggugcuuauaaaacccuuaugugaaugagggagaggaaggagagggaaggccguucauuugaaaacacgguuuccgguaaagcgguggcguuugcuaugcuuuugugaguugcaucagacaguaaauauuucugggucacaguuggggaagcuuggaagguggggugacugugggaacaggaaaugggaauggugagaagaggaaaaccgucagagguugauuuccaaguaggaacacaugguuguccuggcccguggggaaagcaggaguguggguagugagugcagguguuugcguuuagaacgcuucauuugcauggggaagucaggggcucugccacacaucucuggaacacugucacagacaguugaguugaugauggagauaagccauuggagacagacagauuuccuuagccuacguugauaggcaaggcccauagccggcguguucucuaagaugcuuacugucugguuuuggugagauaaggauuaacgaugugcugugcuguccuuuuuuuuuuuuuuuuuuuuuuuaaaucccaaaggcccccaaaucaguuuuuagucucaggaacugccuguaaauagaaguacaaaacccagucccucugagaccugcuacccaauaaagagagcugagaaugguugguccuucuaagauuguccuagcaggauuugaugcuguguucugugaaaaguugaaagcggagcgcaguucacugagugaggcucuuagggcuuggagaagagccauuuccuugguaggcagccuugggugggcuguucagagccagggcugauagugacaucacccccacagccaccagaucaucugucuuuucccuauguggucugcccuugucuaaaggaagcgguguggugagguacugcugggagaugcugcacggagucaguucugggugugagcaggggaugacagugcagcaggcuuugaaaacugcaugggauagaacuccagcuauagguuccgugagcugugagccgugucacuugcaagacaguuugggagaagacacuaggugaggcagggauuucagacucuucagagacaagaaguugagaaaacaguuggugcucgcucucacucugugugugugugugucucccucccucccuucuucucucccucccuccuuuucuucuuucucucccuuucuccuucucuucucccucccucaccugaagaccacauuuucaguuuuucugagagagcuauugauaaccagccuauuuucuaaagguugaagaacuuuguuaaaugucaaguguggacuugagagauuggaucugcuuaccggagguguauuagauagacuuugcaaugcagagagucuuaaauaaugugccagucuuauuccucccuuuacauguaauuguuauuaauauguuguuuuuauccuugugcuaugcagucauagcuuauggaguaaaugcucuauaaacacauucguguacgcuuuggaaagugggucuuagcuguguguuuggcuuagauaucuuucuucacucacucugucuuugucuguagcuugccaugccagacucuuuugaaaauacuuacaccuuuaagguacacuaaguaacgaguaguugucaguugucuucccucuagaugaagaagguaaagcaagaucagugcauugcuggugauggcaguuacucucagaggcaggcuagacucagcccgugcaguccggacaccuguaaguacacacggugcgcugcguggccucacugagcgggagaguuuggcaagugugagugugcucuagaguaaauuagagaucauugaccgcagagagguaagucccucugucacucugaguaugaaaaaauaaacaauugagaccccccagacacagcuacucugggauuucaccugaggggcagguuugagaagugcuaugauucggcugcuuuguugccccuuugaguuauugguagagacuugaaaggaguuggaguuaaagcguguuuuaccuuuagcaugugaaucuuggauauuuuucuuuucuacucuguuagaguccuggaagcuuuaugugcacacugugcucccccuccucccccucccccuccccccaguguggagcuggggauccaacucggucuuuucacagcaagcacuuuacuggccaccaccucuccagcauacuugagagcuuuaaaaaaauguuuugaugaaguaacucacaucucaccuauguuuuauucuggaauguauuugccuauauauuaccgaauuccuauaagaauuuguagcuuucuaauuccauuggcuguuguucacacauauucuucugccauuuacucugcucuuaaauuuggcucagcauuguuaaccaugccagguuuuccacacaggaacaagguuguuguucucuuguuccauccccuucucuuuauuccucucccuucuuccuagagggggcugucaagggcucuuuucaugucuuacugaagauguucugacccuuggggagcacguggggaaacaggaucucuuggguuuaggcuggccuugcugaucuaaggaguaucucugaggaaugagcaagucuggcauauuuggcacuuguguuuugguuaaagguauaguuuuauuauggcuucaaacucacggacaucucugcagucguuguaaaucuucaggacuguauaugagcugagacaaacguuggugagagguggaggaguaccaagaagcagguggggaagcacccaguuucuugcuuuauuuucugagucuguaucuguggccuggaacuggugcaggcuacccugaccccgucauucacccugucuuagccucccugguacugguccuguaggaaggacucagccagcacggcugcccuucucugagagcuauugcagcgaggagggagguuggagauucuuagucuugaaacucuucaucagcagggagugaggagggcugaaucacugcaucuauuuguagguagggagagagcaagaauagaaagauggaaaaacagacagccagauaucgaggugagucuaagucuaguugucacuuggcaaaguugauauguaauuuccuacaagauuuaaaaagugauugggauggguauggaaaguucucuagagaugacaucuuagguauuagagaaauauaacaaauugguuuauguugugguaauuucuuaccccccauaagcccauguaaaaaaccacaaccaguuauuauguuuauaguauaauauauaauaauauagauugggacgaucuaucacuauacuaauuuauuucccagcuaugagaccccuugcuacuuguggcuucuccagaccaugugguucugcuccaucuuccaaccaucuucucuucuuccaucucucugagaccuccuguacuccccccugcccugcccagccaucugccuuagcuuuaugugaccagucaggauggggagaagguucagugagaaggaucaccugagggcaucaucugcuccuccuuggggcagccccucuugaggaagcagaguuaacaucaagauacaagcagcaccugggcaacuacagcaggccaggugguuaguuaugauagggaaaacaacuaaaaaauuguuuuuccccuguggcagcacucaguguuucuuauaaugaaccuaaguucuuucauuucccuugaauaguuuuugcuuacuaauucacuauauguagcugaugguagauguguauguccucuaugccaaacuuuguuuuuucccacuguaaagagucuuccuuuugauugacugugacagcccuacauugcuucuuguuagaguagcuguuggaggcauccguaccccacuucuugaccaugauguguagcagguaugacugauugcauaagcagcuguggcacgucauggucgugcccaugugugagaugugucuucaguacacaagcacgauuucuuccuuuaaaaaaggaaagggaauaguaauguuuuuguuuuaacuuuguuuuuggugcuaaacucuguugccagagugaucucaucucuugauuaucuuuugcuuguugauuuaucauacuuaguaguuguguaugcucucacauuugggaauauuuucuguuuggcuggagaaacagguaaacuaccucaggaauuaauuuugugacuggaaggaaacacugcuucuuagagaugcuuguguuuaucuuuggguccuaguguuaguggcacuauuccuggccuggccugugccgccucugacuuaagcgcugggacugaauugugucagcacugcugcuuaaggguuuaucguaauccaggcguccuuggauuguucagggcuggcaggcgagcaaggugguggcagacgacggcaggugugggcucccagcacucuuagggcuccaccacggauacugugaguugugcucucccugggaugcugcgauugauggcgugauggguagugagugaguagcauuuguucuugagggcguuauucuucuagagcagagugcacaucugcacucggucuucaagggcucuguuguguugcagcaugagaagguaucuagccagugaggagccagcugcaagcggccgaggcacuguuccaguuggguuuucuggugguuaggcugacuggauuuucuagacgacaaauuguauuuuauuuagcaauguccuaaaugcucuguguggccauugcauguuauauuugagggauccagaagagucuaaugguggcucaguugugauauaacugcuuuccagaaugcguacccccacuuucgaggcaccuuuuuaccuuugauaagauuuuuuuauuagggaaauuugggucccuucuuuggguccauaguugaagaacagacuaugaaguuugaggacaguuuuaauaggaucuuaaagagaaacugcaggucagcaaacuaaaguuuggcagcugcugugagcggaagaugaagaagaggaagccaugcuguuugaguuaggaugguauggaggucaguuacauggcagacaaguagcucaaggcagggagggcagcuuagagaaggacagaaggaagccauugugaggaacacauacucagagagagcuagcagaagagugugaggcugacauucugugauguggagaugcagcuagcuugccuggcugcauggcuguggcucgcuaagcacccugggaaagccaggaguggggaugcugggaaggaagauacauugucuaacaaagagcuacuuauuccuccaucucuagaguggccuaagguaaaaccugcucucuugauguagcccgauguccagcugauugguaggcccaaagggauugauucuguuuuauauuuggggagcuggcccacaccagccaggaacacagccuucccugaggcgcuugugcagaacaaaccucccuguccugcucugacaaccagugcugcacacugagagagccucagcacuccuguaguuggaaaaguaccugccaucuuuuauccauccaucuagccauccauccauuuuaaaagguccuacuauguagcuuagguuggccuguccugccugcagcuuccugagugcugguauuacaguaguguagccauaccaggcacuguccuguaugcaggaaaggaaugagcuucaucugagaugagagggagugaggguaaguuuauucagaaacacaguucagcacuaccuucuagcauuucaugcaaagagggacaaauggcaacucucuguugccuuugggugggggcauucugccuuucuuagaacguuuaaaagcugaccucucauguacuuacaucaaagucucucagauucuuuaauaguuauaaaauaaguguuuugggaugguuuuguuuguuuuuguuacucagagggucuauacucugguccauucgaggguucauuucagagacugccucuuuccucuugccuuccuuagaguuaacaccugcucccuucauuccucccccaacugcuguuuuuuugagagggggucucuccauagucuacgcugguuuugauugcccugccuauaccuccagagugcuuaccuuacaccugcaaaccaucaucuguaccugccauuccucaucuguccuaaugcacaguuaagagaugacagaauuucuuauuaaaaugagacaaaauguacaugccaugaaagugcuaguuaauuuaauauagcuaugggaucauuacaugacuaucguggauaucagaaaaauaagaucauaauugacagaauuacuugaauauggaggucuacugaauuuccuccauuuguccccacuuuaaaaaaaaucuaacuuuaagcauaacuuguacauagaagcucugagagguagagggcacaguuggcaucccagaggaggggaagggugggguaaaagauggguggcagggacuccacucagugaugauggugauggcuggugcucagcucugcugucugccucugagucuugccuagggugugagccuuggggcuaaguggcuuucaccugcucaacuauagcauucagccugggagaaacgaggucagaaaggauugucaagccagcaucuuacaggccucugcauucugggugaagaacuccacuugcugucugugacuagucacugaggcuuucuggacacaaauauuuccaucagaacuggaauuggggaaggcuggugagaagcaauauucuagaaagacuggaaguagggcuaaccaguaaguuguaugaaacagaggcagaacaguuuacuugugggugacuuuuguacguuagucuauucauaguugugauagaaguuuuucucucaggccguggaagagcuuuugggggcacugucuggggcacugucuggaugaucucuagcacacacaggagagugaucgaaucuccccgcugugcuauuuccccauacuaugaguacagacauuuccucauucggguucccaccucugacacucuugguuuuuuucccaacccauuucuuaguuugcuuuugcuuuuuuguuguugggagaugcaccccagaagcccugugcuuggugugggaggugugugcuuuaccacuaagggccuaccagcccuccugauucauuucuaaagggacucucuuaauaggauuuugaaaauauuacucgguugacugaguuaguauaucuugauuucucuuuuccagaggcauuaaucuagcuacauuuuuagugcuguuuuagggaugcucuugugccauuuugaaaauggguugucucuaaacuacucaaauguuccuccuuguucauagucuugaaaagucaguguucuaacugguaagugaaggauuuggaaauuaaaacuuggucuucuugacaccuaguguccuuagcuguagaaggaagcauugacuggguucucaugaagugguccugagggaggaaguguccugggaggcugcuguagcugccucagcagcaccggacucucacacacugugguggaugagaaaaaaauauuucugcugauaacuuuuguuuuuaaguuguuguuaguuuuucuuuguaaguuucacauuugcagauaaaaaguguuuuuuguucuuuuuuuuuuuuuaaauuaaacucuguuccauguugaaaugagggaaauuugugcccuaguaguuuuaguuuuucucaguagacuguuauucugcauuuuuaguucugcuuuguaaauuuuuacugguuuuucccuccaaaagucaacagcccuguuuuuaguggaaacagugcucuuugucaggcuaaagaagugccuuuguuauucccuugagacauucuacagaugccauuuugcaguucugaaaaguaaguucuuauaucguacaugcauugugguugguaucguaauggagacauagagaaaacuaaacaauagcacuugucauaugauaacaaaacaaagacuuucuccauccuuggacauguguguuauguguucuuggguggucccaaagcagaugauuucuucagcacuuggaugugaccacagaugacugacuccgcggccaacuucacagaaugacuccugagaaggacucucaguucaucauguugauauguauugcucuuuaaauaucuuuggauuuauuugccaagugguuuuaacccauguauucaaaagaauuggaagcaaaaaucuucugggaaauugccuugaauaaaaugcaggaaauuccuuucauucuuuugaauccagcugagaugagugagacuuuugaaagucccucugcguaacaguguccagaagccuuguucguuuagaguccagcaguuugugugccugugcucagagaacacaugaauacaccucuguguucagauaaaucuccugcacacggaacagugccauuugguaaaaggauggagccuuagucuucuuuuuacugccucuaaaacucucagugggaggaaaacaaagggagaagacuccguguaucuccaaggauuguguauuauauauaaauuguuauuacauuuauuuuaucuauuuguguguaugucuguguauaucaggauagcuugugggaguuguaucucuuuuaccagguuuaucacuacaucagauuuaguggcaggcacccucaccugcuaagccaucaugaugacccuaccuuuuuucuuauuacagcaucagcacauauuauguacagaaaacuugguaauagaaaaauacaauagaacaagaucucccagugcccauauuucuggaauuagcagcucgcauuuugguuaaacauuccuagucuuugguuuguagguaugcauguguguauuaacacagcagcauucucuuuuuaaacuuaccuaccuuugacagaacagggcaauuaaaaaaaaaaucuguguucuacagguagaguuaguguuuggaaacauuaacuucauuugaaagcuuguauuugguaacaggugucuauguuaauugauuacaguuauggcacagaaagggcuaggcuaccauucuggaaguuuucugagaucauagacauagagcagguccuuucuguuaaggaaccauugaaauagagaucagaucacauagccuuaacuuggccuggagagaugauuugcagauuuucaagggcugguucaaaugugaucugacgcuuguuauuuggacauggggguuaacaguguuugugucuaucugggcaucagcugugccagguuguccugauuucaagccccaugucaugauauuccaucaguuucuuuaaaaaguaaauaaaagauuguauaggcagauccuguucaaaucaacuccgugacaaaauuagaauuucuuuuuuauggguguucuuguauaacuugggguccaaguugauccacuagucacugaagggcacuuaaagauucuggggccaauggucuauggaagagaaaaguaaccugaauuuccuuauuuccuuacuugggauagagcaaggaugcuuagcuuucuauagaaacagaaccgaaaaaagcagauuccuuauugaguuaaaacuuugccguuuaguuuagucuaguuggucaaacugaaauuaccaaggagaauaggaaaggauuguuagggaagaucugguaugguucccaguuauuuccauaccauaccucuugaauauguaaucaucagauuaguguugaccaugagggaggaaagguuuauacaaguagggcaaaggggagguuaccucuguguguguguguguguguguguguacacguguacaccucagaacacacauacaagcccuuacuucuccagggcaaaucuuugcacacugguugugugguucauaggguguggauggcagagagagagggggcagagaaagagggggugcagagagaguggugcuagugguggauuuagcuggugguguuugucaucuagauuucuguuucauggcuuuuguuauuuguauauguaccaucaauucacaaucaacuauugggguccacucaggcccaagugucauucuacauauuuuguaacugaaaaaucaguaguagauucauugcugcauuuguucacuuagugccuauuuucagucuuggaucuggaagaucauguuguauuuuuuguucguuuguuuguuuuuaaauguagucaugagaacuggacaguguagaccuaagauaaagguuugcauuaaugcacaugggagcauggagaugcauuucuuguugcagaaguugguguguggcuggaguugaagggcgugagggcuguggaggggcaguggaaggcaguggggaggaacuauuaauugcuuccucccuuggcagccugcauagaauuaucuucaggugccaaggaagucagacuucagaaggaggauuuaggucagaucuagcugaagucuuguacccuaacugugugugaucuucaguuauaggugucacucucaaccccugggaggcaaccaagaccauauucauaauccacaauacuguggggguccuguggacuucccugaucaaccacuggaaaggaguugucucaugcugguuuuuuuuuguuuuuuuuuuuuuuuuuuuuuuuuuuugucugucgggagcauuaucaguucaaguagcuuaauuuccuuuaacacacacauguacacauauacaaccacacacaugugaacaugaacacacacacacacacacacaaucuuguguauaauuuuagguaaauauaaaaauaauccuugaaguuuuaucaauagucuuggcauuacugcaaugucauuaguucuuuguuuuuuauguuacuuacuuuaaagacaacuucaagcugucuaucaguaaagucucuagcagugaauuccuggagagaaacaaugggaaguugggaugccauuugaggagcugacuuugguaauugcugcuguucaguacaaagcacuuuuauguccauucuuuccauguggugggcugagaugcaaccucaagaagacagagcugcugaguucucaagacacugguaguaagacuuaagaaaugacaauguaaucagugguagaaauacaagaggguguacagcaguuagccuggauggagaggcaggaacgcauugagucuuggugugcuuucuuuagaauggggagcuaguaguagccuuuacuccaugauuauaugccguugcuuauaaauucaucaaauguucuuuuacucacccauuacauaucaggcaugauaugacuuccuaugacuagcgugacauuuucugucuacauugaagacagccacaguggagccauguuacuaaugugguagaugaaggaggugggaaaggacuaaagcagugguagacggccuguucacaugcuggcccucuguacauccgcuugcuugccuaggacaccccugucuggcugcugcgggaauugcaccuucauuucuacuugcagguguuugguaauucucaguagaaaggaagaagaagccgcucuggguguuuucugagauaaggaauucuguacagaacugaggucuugaucagugagaccaucagguucugauggaauaucuaucccauccucagagggugccaccucccucagagguuucguuguugacauuuuugcuccuaugaauuuggagaagcccuggaauuccuuuuuucaggucuagugcuagaaaugggaaggggaaggaccauagcugugucucuccuguccccgugaagacuuguagcugucagcggugcugcucucagaagguuucggacuagagcagucaggaaggaucucuacaguuccucgugcugugcugacucccaaccacagcauuauuuuuguugcuacuucauaacuguaauuuugcugcaguuacaaaucuugauguaaauauuugaugugggaccccugugaaaggguugcucaacucccaaaaugggucacagcccacagguugagaaccacuggacuagcacauuccuuuguagcagagcugaguuuaucuaauaacuaugaaggcaaaugguaaacugaacuguauuguucuuagaaacaguuuuuuugucauuugcuucaguccaguuuuuggacuaccaucuccauaauguaaucagacaguuuugccuugaaguaaccuguuugugcagcuuccccuucacggcacucugggucuugaggcugaucuugguacugauuucccuggcucaguggauggcagccuccguuaccuggggacauggcuucugcuuugccugagccagcuaagccuuggcuuuuguuugcaguacauaacauaaaguuggcucuugccuucucguucaccauaacacuuucugucuuuucauuggugccuuuagaugauugcauguaguucuuaaugugggugggcacugucuugccguuuguuuucuauuucaucgguuuuccccucuucuccugucuugcagguuaauugaauaauugucugauuucaguuuaccuccacguaugguugucucuguuucauugauacccaauccaaaguugaauguauucccucacauccccacuguuccuccugugauaaugguuuccgugaaaggcucugcugcucagcuauuuaaaugccucccccucccgcccucugucaccccccaccccuguucccaaucucuuuggccacauucuucucaccauucuguuaguuggauauuugcugaguuuaucuauuucacagaucucacauaggugaguuuguucauggcugacuuuaauguugauguccaacauugggacgugcuuguguuuuuaauucuguguuuuaaacaacaaaggagcggguucauuagaacagugcaacacugagcagauuucuuuauuacuuccuucucuaguucuucagaaacuauagauuagaccuuauuuucuuaucuaaccucaguuccuccuccaaaggcaguacuaacaagcuuaagcuugcguagaucuugucuucuuuuucauuauaauuuuuaaaaacguuuagauuauaucauuuccccauucccuuuccucucuccagauccucccuuguaccuccucucuguuucagauucauagcgguuuucucuauugcugauguacacacacacagccugccuaguccauaaaauaauguuuuuauauauguuuacagggcuaacuguuuggugugggauacucaguugcuguguucuucgcuggggaagacugugucucccacucucagcguucugucguugccuguagaucugaguuuaggguugaggcuuaaagaacuuuccugcuucaacauuagcacaucuguggguguugucccugcucagguuauguuuagacugccauguuggugagacauggaggguauaacuuccugagagacaaucucaaagcaaaauucccauuccccugccuuuuuagaaucuuuucccuuauuuucuucagugagcccugagccuucagugcacacaacugagcaaggaucuguccaguaggaugccccuuacuuuucugcuuuugccuauugcacagcuuucuauuugguccuugcuucuacuguguguccuugcccauccuggguucuuuacauggauuucuacauuguuuguauacuacagccaaagauguuguggaaccugaaacccuuuccucuugcauagaagaaaccuugcacauccugaacuccuacccccucccugagccugcaccgccauuucccauugccaucagcagagcauucaggcucuagguuucccagauccgcaugaacaccguguguauguaugugcguucucgugcacacacacaggcaugugcauauucgcuuuauuuuucagguaugguuuugcuuuguacuccagacuugucuuuagcgccugguccaccuuccaagugcugggauuacacacuaacacuguucaaauaacuuuucaucuucauuuuucuuaaaacagcuaucccagugggugugaagaacuauuacaaagugaauuugauuuuauaaugaguaaucucaaacuuuuuucguguugugauuggccuuuaguaaauacugugagaaaugucuuucaacacuuguccagauuuugaguuugguuucauguuccuucacauguucugugugguagacauuugucacauacaugcucauucagguuguggcuuuguuuucccccauauuuuauaauguauugcauauaucuaaaaaugcuuuugagaaaauuuauuagagcaguccuguuuguggaaaugucuguauccaaaugugaaugguagggagguggggccgugcuugguuagagaguugggguuuaagguguguggacuuaugcaagaaccacagugcaauauuaaaaggccucacauaaaauaggcuaagguucuacuccacauucaguggucaggauucugaagcagaauuccacagccgacuuguggaaacccaagucugacgguuagcuaccaugggaucuacauuccgugccacgaagggaaguuauugaauuucucugagccuuauguaguaugaagugaguuguuaagugcuugcuugcagagacuuggaaaucaaagugaggacgcuugugauuugggagaguugcuccugaagcaggcagggucaccgugcugagucaaacgcuuuguugacuuuaaacaguggcaccagcacaggucugcaggcgugggaccagggucagagucacucagcuuuuugguuuagcucagggaugauuguguguguaggcacaggcuggccuucaggguuucagguaacauugcaagcuccuccuuugacaguugccuauuuccuucuguuguggaggugguuguucaggaugaguauugucagaggaguuuauguucuucguccauaacuccugcaguuacacacucacaccgugcuuaacugcaccugcgcuuaucuaaauaguaggguuugaaaguuguguaguagagaaccugacagcuucuggaacaggcggaagcacagaggcgcugaggcagcacccuuugugggccggggacagccagccaccguccggaccggaggacaggugcccgcccggcuggggaggcggccuaagccacagcagcagcggucgccauccgagacccgccgaacuuaggaaauuagucugaacaggugagagggugcgccagagaaccugacagcuucuggaacaggcagaagcacagaggggcugaggcagcacccugugugggccggggacagccagccaccguccggaccggaggacaggugcccgcccggcuggggaggcggccuaagccacagcagcagcggucgccaucuugguccgagacccgccgaacuuaggaaauuagucugaacaggugagagggugcgccagagaaccugacagcuucuggaacaggcagaagcacagaggcgcugaggcagcacccugugugggccggggacagccggccaccuuccggaccggaggacaggugcccacccggcuggggaggcggccuaagccacagcagcagcggucgccaucuuggucccgggacuccaaggaacuuaggaauuuagucugcuuaggugagagucuguaccaccugggaacugccaaagcaacacagugucugagaaagguccuguuuugggccuucuucuucggccaggaggagguccaaauacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagcuuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcccuucaaaggauaauaacagaaaaaaaccaauacaagaacaggaacaacgcccuagaaaaaacaagaagguaaucccucaacaaaccuaaaagaagacagccacaagaacagaaugccaccuucaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagauggcaggaaauaaucaaacucaggggugaaaucaaccaaguggaaacaagaagaacuauucaaagaauuaaccaaacgaggaguugguucuuugagaaaaucaacaagauagauaaacccuuagcuacacucacuaaagggcacaggaacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauccuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguuuggagcugagaugaaaggauggaccauguagagacugccauauccagggauccaccccauaaucagcauccaaacgcugacaccauugcauauacuagcaagauuuuaucgaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaagaaaauaucgaauaaaaaauaaauauaaaaaaaaaaaaaaagaauuacauaaauguaaaaaaaaaaaaaaaaaaaaaagaaaguuguguagugaaauuuggggaggccuauuucuuuguguuuucauuuuuauuuauuuuuuuuugguuguugagaaguagguguugauuuuucucuggucugcagaugauguauuugaauaggagagucuguuguugccuugggagugacagugucaggaggugcccauugagcugccagaguaugccuugguauuacuucagugguuuuaagauagcuuuuucuuaguuuuagcugucaugaaauagccacaugccauaaauaugaaguucaaauaaauauucuuaauaugaauacaaauuauuuaauuuuuuuuuuuuuuuuuuuuuuuacuacuacuacuacucagaaguuugaaaaagaaauuucugccacuguagauccaaauuuccuguuugagaugaugguggcaggcuguaacuugcagauguauguuuaucuacuuaaguuuugguucaaauggggauuuuucucaaguuuuuauguuuuccauucuaaauuaaagcaacuauuauguauauuaguuuuaaaguuuggaucaggagagugcaguuccacuaagcaguuuguaggggaaacuaguccugcuucuggcuuuuauagacucucucugaaagggaggggcugugaucaaguggcuuccaacagcaggggaagauggcuugcagcugugcuguuuugguuccccuccagauaguguuugugugcaccgucagaacaucuuaaagcccacccuggacaggguucaacucuauaaaaggagcacugucucauaaccucacaugcucuuagggguccuguuggugcugguggucuucacugguuauucucugaacugagcuuuuauuagacucaggccucacaguuucagaguaggaaucacaguuguaguuuuucuaucuuguaaaauaaauguaguugggcccuugguaaacacucugaugagaacugaccacccuuccuuaagcucuuccgcuuuaguggugaguuuuucaguucucugccuucauacauccuauagguacacugacacucauuggguuguguuccucgugguaguuuacuaaguucugcuuuacagaucaaguuuauauaucagaagaugaaagauuauacaggaaauuccaaacaccgagaaguuaaaaagcagaagggaacaaucgcuucucuuugaaauuguuuagcccaaggguucuugugugcuuccuguuuguuuacauggauuguguguguguguguguguguguguggugccccucauuagaagcgauuuccccucucuucuaagauauuggugccuuagguuacauacguggagcaugugucauccugcccucugugaggugugguaguuacugcuuccugccuucccagugccagccaggcagagcuucuguggccugcuugccucucccuccugcaccacacucucuuagcaccccuuaaucuuugugagucccuacagcugccuuccugugugugucuggaugccucccggcauucacauucaacggcuggcucccuucuugucaucucacacuguuucuugaaguuccuugaaaauucauugggaaugucuuccuuacucccuuugccccagggcucuauccccucugacacuaccugaccuagcaguucgagccucugucauucugucacuacccagccuuucauucuucagucuaguguuguauagacaccucagucaaguaccauccaaguagcuuugauuccuuuguucuuauuccuggucucuuuggaagguucuuuaggccaguuguauuccucuuugucuuuugacuuuaaggaauucuguucuccuuuccuccaccaccuagcuuccuaucagucaugucuguuugcucacuaaacaguuccgcaccccaccucuuuguacuucaguugccccaucaggaauccuccggaaucguuggggcaaucguguuaucagcuuccuuucauuguaucacuuguucucagacugccagagcagucauccagagacacaaaguuaauauuaguuuccaucgccuagaggcuccagugagaacuucugaguucaguacugaccaggcauuguuuggcugugacuuccguuuuuccaccucuacuccccacccuuuguuccaggcagaugaggcacuccccguucucugcagcacauuuaucuuuaauggucgcaggcccuuccccacuguucccacagucuggaauguacuuaugccuucuuaucaucugccaggaagcucccccuauccuucaaggucacuuugggagccuucuccccucaucagucacuuacuuacuguugaauugucugcgcuucccuuaucgugcuuacgguuaaugagaggaggguuauuccagcccuccucucaugcugccaggagccacuuuccuuagaggucgguagccucagaaccaaaaucaagaucucauaggcaaaagcaaugaugauguacaggcuugcuggcgcguaguuguguauugugcugaaccgagggcacuuguguugagaguguguuuuuacucagggguacgauugucuucuucaauucaaguuugagugcugaagucacagaagcacaugcagaagucuaguuccagguaggaugcuguagagcugcaguugggaggcugcugaucuccagaaggaacgucagcagaagugccgggagguagacuggcucaggcuguaccccccaggcugugcccaucagcuagcaccuucauguuuucuaguagaagcaaucuguguucagcuucauacaacuugcuuuuugucuuauaacuuuucuacauuguguguggacaggagugaguucaaaggucugcggacaguuuuugggagcugguccaucccuagccugugaauccaaggcauugaauuuagguugucaggcuuggcagcaagcacucuuacccacuggaccauauggccucuuuauguuaaugauagcauuauuuuuuuuuuuuuucccuuuuuuauuagguauuuagcucauuuacauuuccaaugcuauaccaaaagucccccuuacccacccacccccacuccccuacccacccacucccccccgcauuauuuuuuuuuaaaaagaaaaaaaaaaugggugaggaauauccaugugcuuugugugaauugggugaacauguguaugggcguguguccacgugugugccagaccuugugccauuggacgucuuucucaguugcucucuacauuauuugucagucucucugaagcuggggcuuauugauggguuaggcuggcuugucagugagcuucaaggaggugccuauccuccccuuggcccuaccccacauugcuaggcuuacagaugcacugcacugaggccagcucuguguggaugcugugggcccaaaccuagguccuccucucuuuacggcaucuuccauccccagugauggcucuuuuaaaagccagaugaggacagauuugaagggaaacuacuggagguggguagguuggagaaauuguuuucauuuugcauauugagaaaaaaauaaacaaaucacguugucuagucagauuauuauauuuuaauaucuuuuuaaaaauaaaauuaauauaggacacauucagucagcaaaaagcugaucauugaagguuuuuguuuaauagucuccugcauucugguaguguuggcacuucacuggcagguucuauggucauuuuuuuauugauccuaacaccuauccuguuaaagacuuuaguggcugauaccuucauucuauagacuuagguaaagggcagcgugagaauauuauuuaaaugggucaaguguaaguuuaaugcccucccaggugaaguaaguagauaguugugaguguuucgccugcauauaugcaagugccggaggaaaagcugcuggcccccugaacuggaguuacaacugugagcugcccuguaggcugggaauggaccccaguccuguaugggugugguaagugcuccuggccaccagccaccucuuuagccugaagagagauguuuuuagcaguuguccuuugguagcuguccuuaggaguuaacuggcuuuuucuugagaacagaagauggggcaggcugcgaaguacuuuagaucugcacuucuuguacuggagcuggugggucucucuuuuguuuguuuguuucuuucuuggcauuaggauauagaaaagagccucguuucuguuuucguuccuuucauuuugucuuccuuuuccuucuucagcugggcagggcaugcuguaguauagguuuugcaggugauggguguucacuuuuuaaaggaagaugcacagaguagagaugcuccuaaagagcucugcuguccccuuguccuuucaugauacccagaaccuuuuuugcacugcguuugcacacuucaggguuuggaguuuugagcugacugcuggguuauugaguccucugcgugcucaucucucugucucucucugucucucucucucucugucucugucucucucucugucucugucucucucucugucucugucugucugucugucucucucugucucucucugucucucugucucucucucucucucugucucucugucucucucucucucuccuugcuuguuguaaccuuggcucaucucagauucccagcaguccugcacagccucaggacuucagggacuaggcaugcgcucacuccugugugcucuccugccucccuucccaguccuauuuuuuuuuuuuuuuuuugguggaaaacaguuuuuaaaaaaucaaguuacccugggguuuaauauuaaaaucacuauagacucuuguccacaaauaaaggauaauguuuuccacccuagcaaacaauucucuugaccagugauacaaaccacauuuuaaagauaaacuuucuuuuuucaguuuuaugauagugaugauacagcauuaaaaauagaguauaaaaauauuuuuccaaagauacaugaaacauauacaagugucugucaacaaaaggcaagccguguuucagcuuguauacucugaauuguuuaaaaccuuuucagaaacaauagcuuacauggaaaugaacauuuguagaauucucugcuggcaauauaguggcuaagcuuuauaacuggauucaguuaauaaucuagaaaccaaagguauuaaaauugauaagagagauggaaagucgccugcuuuggagcagacuggaguaauuuucgcuuuccucuguaccgacgccugagugcaggaacacauuuaauauuuuuggguuguauuugcaaauccuagugccacaaaguugcccugcuacuuagcucucuuggucucuccagcuaugagguucaugugucucaugaauggggucuucaguuugaaacuucagcagcugaggugacucccauggcugugaggagucaggcugauggaacaaaccaccacagacuggccuggccggcugagacgucagauaucgcuucucacaguucuggagguugcacauuggaauuggcagggcauucugaguucguuaggugggugugguguaagcucucugcuguucucacaggcuuuuagcagaggaccugugcuccacaagcacauucuacauuugcuauacccugaagccuccacguacucagugcagaucuuaguggggacacguuucugaccuuacagcuaggcuaaagaaaagaaaggcacgcuggugugguagaggucugagcuagagcucugagacuugcuggcugaugccuggggcacugguguuugugcuguaggucaguagcugcuagguuucuuuguuccacagaagaagucuggaacuguguauguaauauauucguaugaccaguauuuauucaaaauguguuuuaaaggcgugugagaugcucaguggguaaggugcuuuuuggcaagucugaagaccucaguuuagcaugugagacuaagacaguggagagagggaccuagcuccuguaagguuccucagagcuuuacacauucaguaugcugugcauacuuguauacacuucuaauguacagaauaaguaaguguaaguacauuuaaaauagguuuacaguucaaaauuaugcauacaggauuauacuuugaauuaacuaaaaugaauucuccugagaaucucagcaaauugcucauucguggugcagugaaaacugggaacagucugcuuucauuauauagaacaacacgaaaguuuacauuguguaguucgacaggaaucuuuuuggagcuacuauaaaaacuuaaccuugaguaugucuucucaugaagaaaacauuauuuuuucuugaccauaugguacaaguggaaucuuauuuauugaaauaucuaaaauguuucccuuaugaugggaaaauacuguuuuuaaccuuugaagaccauuuacuuccaccuuuggugggggguggggggacaaccaaaggcaacggcaguaacuuaagauguuuggggaguuucuuggacagccuuaacagcucaaaacaguuucucaugccugauguuagagucuuuggcucuugaggggaacaaaaauuacuaccauaaaacugaaggcucaguagguaaagaugccaguugccaggccugaugaccugagcugauuuccggauucaugugagagaagggcugacuugcagaaguuguuuuuugucucuccaucucucugucucucugucucuccccucuuccccucucuccucuaaguaaauaaauaaaauguaaaaaacccaacuaaaugagaaaggcauucuuaguaaugguugaaucauggaaauugcaguuacagaacugcaguuuuaucaccgcggcagucuucauggaguuaacugcauaggagaggcagcaggaagugcguugggccacuugacuuuuccagcugaggaaugaagugacuuggaagcaagcugagcuuuucuagggagcaugccuucuccaucccgcaggguccacuuggguggggccacucacuaagcucgggaacuggauuuccaucggcuuuccaggcuuccaauggcaggaagcaggagagcuggcuggcugugcuuggaugcugcuugcucgcguguaugagcaggagaguucuguuggagcgguuggguuaugguacuugcuuacuuguuucuacuugggaaaggaaguuuguuguugaccgugugauuaaaguccagguugaaaauguagaguacgacaaacacugugccgaguaggugagacacugugccgaguaggugagacacugugccgagaaggugagacacugugccgagaaggugagacacugugccgagaaggugagaugugguugugcauacucugggaauagaauguugugcuaaauuugcuguaagcccuuuuaaaaaugugugugugugugugugugugugugugugugugugugugugugacugcaugcaugcauauguguauuuuaguggcccaaguuuuguuuaguuauuugcauuuuucuaggcaaaugcugaguuguguggguuaucuaacacaaguagcuguuucagaugcagcggugagucacggugaggcugguuuaugucaucccccuguccuccugccuuacccuuggcucacaccuccugccugaggaaccgcaugagguucaagucuuuuuuaaugcacugugaaggccguggccugcugcauaguuguuggguuuuuccccccacauuaagggugaaaaucucaguguaguacuaauuuauagaauuucccuauaggaucugacgaaagggaauuguucuuuagcucuuagagaugggaauucccacagcuucagcaucuacaguuucugucgucaagaacuguaugcuguuuucauaauguuguucucugucuuuuguuucuaaauaccuaauuuugccuuacugaggaaauucacucauuugcuuagauucugacauuuauaugggauuaaguaaguuuuguuuuaucuuuauauaauuuacucaucuaggacucuuuaaaaaugaagagaaacuccaacugguucuauugcuacucccuaacaauagaaagugguaugcggugacugacuggugaucucugugguucuguuaacaccacagggauugcccugcuguaaugagggagucccccucccccagccgguguguuuacauugcagcauuccugggcuuacacagaagaggauuugaaagcaggccccagcuugguggacuugucauagucuggggcauugauugacuuugacaagcuuuugucuuaugaccuauuaaaaugcagcgucugcagccuguguguuuaucccaugcaguuaaccuugguggauuugucuguagcuuauuugggaagagccucuagaaacagaguuguuauuuuguugccauaggaguaaguuuauuuacacagaaauagguaacugguuauugauuaccacuugauaccgagaaguggauaccaaguguuccaguuggaugagcauacuaugaagaggguagcugcagugagcucauaaaaaguacauuuuaugguauccguuaaaaucaugagagaugggggcuggagagauagcucagugguuagagcacugacugcucuucugaagguccuggguucaaaucccagcaaccacaugguggcucacaaccauccauaaugagaucugacucccucuucuggugugucugaagacagcuacaguguacuuacauuaauaaauaaauaaaucuuuuuuaaaaaaaucaugagagaugauggguuugauccugcucugaaaacccguuaguauauuuuucuuuuccauaaaguauuacuugaugagcaucuaauaaauguucccuagaugcuaggaacaacauaaaaguauuauugggaagccaccggauguaugacauugcacuggggacauggaguuuuacucaucucacaaaaaugucccucuuuaugggcacaugguagcagauguggccggcgaggagguguggacaggaagugugacaucucugugcuuaugagaccggcuggcugcugcuuuccugaagaggaagccgcugaaagcgaccaggagcauuuauaugugauugucuggccuucccugucugucuucucuucccuuucaaaacagcucucuacuuugagacaaguggugcgugcaguguuuuccuucccucagcacagaguagccgcggcuguuugcaucccugcacgguaguguucuguuggacauguuucugcucuguccugagguugggaggggaaaggaacaagcaagugcauuuaccuaagugcauuuaccuaagugcauagaaggugugugcagcgugccaaggggugggugggagcuuagagacauuucuuucaccgcaugaguccaagggucaaaugcguagugcaggcuugcuggcaucuugaaggcccaugaaaagacuucuguaaaggaaguuuuaagcacauagguuuuuaagcagucugugugggaugagguugaucuguagaauauuucagauagauuugaaaaaaucaguuacuuugagcauuagagggauuaaacuccgugcgcuaggaaaugaguuucaugcuuccgaguuggaguagccuggcaguugucuguguccaugcuguuucuguguuggagcuguguggcacggcaagauggcucugcugcucucucagagugggaaucuauucucaugcagugcgaaaguccuucaucucauggaacuugggcuccgugagaacuccuuucuccuguacugcaucucacucucucucacuucucacauucuguuucucuuggagagucucccguucggccccuaguacacaaguagcuacccgugugcacaugaccauuuauuguuuguuccuaauauacgaguagcuacaugugugcacagaacauuuauucuuugucucuaguauacaaguagauacaugugugcacaugagcauuuuuuuuucacauacuaugcuuucaaacugaaauguaggauagugagacuguugguuugaaauacauacuugggacugugauacgcuuucugcuuuguuuuguuuuuuuaauauuuuuauuuauuguauguauaugaguacacugucauugucuucagacacaccagaagagggcauuagaucccuuuauagaugguugugagccaccaugugguugcugggaauugaacucaggaccucuggaagagcagucagugcucuuaacugcugagccaucucuccagcucccaaacuuucuguuuuuuaagauagggucucagugguagcucuggcuggccuggaacucaguguagagcaggcuggccucaaacucacaaagacaugccugugucuaccucccaagugcuuugauccaagguguucaucacagauguucaucgaguucuucccugggguauaguuauugacaaauugauuucuguaucauaugugguaguacaucuguauuugaaugcaccuguaacaguagccaugcucagugaucaugugacuaaggggugcuguuguggauagcccugggguuaauuauauuugauguuaauuccguucuccugugagggguugugaacaaggaaugagucagcacucaggugauuuccuguaaaccugcuucccaccuuaacuuguaaaauaaagaagagcugaugauugggcagauaaaagggaagguggaguggaaggagggagagagaaggagaaaauggaagagggagaggacgcagaggaggaggaggaggaagaggaggaggaggaagaggaagaggaagaagaagaagaagaagaagaagaagaagaagaagaagaagaagaagaaggaaagaaagaaaagcagaguagaagcauauggccuggagaaacugcaaguucuaaggggucucauaagcuauggaagaugguagugcagcgguaggucugcccuaucuagacgcgcagcauguauuuauauuaacugacucguguuuucauugccggggcauaugugggauggagaguuacugcaacaggguaccuccauuguacauuuguagguauauuccccuuucuuuuuuaaauacagagucgccccccccccccccaccuuagcuuccugucuauugaggucauagaugaguaucuaccuggccuuugggaacauuuuuuucacuaggacugcaagugacugccuuuuuaaucucagcuccaugaucaccuuuagccaagucaacuucugagugccuuuugaauuuggcaaucauuucagccacaggagugcauguuaugucacagaaaauggaaccugauuggucuggcaugaugggguugguccucauuucuguaauuucccucagugcucuguauccugagcugacuccuccuuaggcuuucuucccaguggauuggagaugauuacaacauucauuccucaguguucugagccaggaaagcuggcuacccguguagagggccgaaucuuguccugcaaacaugguacuggaugaaugccugucuucuugacaaaaaaagggaaaccucaggaccgcucuagaccaacagagucuacacugggaccugucugaguugugcauacccgaguaaggugagagagacugaacaaaaugugguuuuuguuaaaaaggagacaaagcagaggaacucggugcucugggugaaacccaaucuagccuaugcuggaacuagcaaagggcaguuuguaguucauaucuuuucaguguguggucuuaauuucaagcagauguuaguuuauauuuuuauaguaacaguaugaauguaaaauugaugccauuucauagaugccacgcacugaccaaucauuucuuucaguauauuugcacuuaguggauaucgggcauugcauuucuagaccaucuccugcuaagagaaacaaagcuacaaagacucucccuccucccuccugguuagcauacucucuaacagugagcuguguccaucaaucuuugcagccauguuguuugccuguuuuuauuacucuucccucgucuucauguuuuuuauuuucccuuuccccuuugcucucugucuuucuuccucuuugcuguuuuguauuugugagaagcaucacucucugcuuucucaguagaauuagguagcuucugacucaucucggcuugcuuuucucacauacgcuguuuuaauggaagacggugguauuagcuggaccucccuuuggcugugggcagugggagcgaugaaagugagcaguuguggguguuagucagguuccuuacucaucucuuaugcugucauagcauggcagaugaauacuaauucuguuagcucuagggacagcuaaauuagaacuguccacacauugucaauauauuuuuauauucauggcuauuuguagaacaguuuuguuuccugaaacaaaaaucucuuagcuuguuaccucuagcuuugaaguuuaaaaaugcauauguucccccuuuguuaaucuuggcucuuugaauacuucuuuauguuuugguaggagaaauggguugcuucugaucuuagcacagaaagaaagccacgccccccagagcccuacuuacccagaaccuuaugguuuggaggaagcaccuggagcugccauuagcgcagacacuugacauuuuuuccaaaguuguguggcugucuguuuuguguaguacuaaugauuuaauagccuuuguuuuaaacagcagauguauaguagaugguuuaagcuagaauagcaauaacaccucgguguaaauguguuuaaccacgaggacauaaagagugguuuuuuaaaauauacuuuucuacugaacauuauuggucucuguugauaguuuucugcuugauugcguguucaaugccgcaugcuuuuucuccuggagcugucacaauaacaaacacuuucaucggccccaguuggagaaugccaacauggugauugugucaaaccacaugcuuaucuaaugggcugguuguucacguccuuggucuuuugguuguugauaaguagaaaaaucuuuacuucguauauuauauaacuauacuacuaaugauggaguugggaaguucuaauuaaagauuaaugagcacuauaucguuugagaaaaaaaauagucugguuuugucuuugcuccuuaaacuuuguugccuugggcacauuuugcuugcucaauguuuuaacccuugcugauaaaaucaggauauaggaccagauuuuguuuuuuuuuuuuuuuuuuuuuuuuuugagacagaguuucucuggguagcccugguuguccugguugucacucuguagcuagccucaaauucagauaucaacaaaguugugagcaaccaccucccaguuuagacuagauacuuagaauucacaaugcccagacaauaguauuuacugaauaguguuccccacuuucugaagacaagucuagaugcuccugcuauacauuaaagaaagagcccugccuucaaggauuuuagugggaacuacaacccugacuuauauuuuuggaagcacccagcguggcacuggguuuccacucuccuggguggggcaguuagagucccauguacaucugaaaugcugaguguuacaagcaugguaauuauggugagcucgugugcuauaaucauguucucuugaugggagugauuuguuuaagaaaucauuuuacaaacaaagugguguuggguuugagcucuuggagcuguuuuaagaacauggcuauuuacauagaguuucaccuaccuucacuguugacuccuggcgggcucaguaagcuuuguccauuguguucugucucauccaucaguuugaaugaguaaugugggucagcucugggguguguacagaggucaccgaugcagugugugaggcucugccugcucucccugugcucuggauuuccauaguaucuguuuguagugucuucaacuuggacucuuuagcuuuugaucacacggccaagcaaugacuuucaaauaauauguucuauaauauguuuuugugggguagaacuacuucugagaacacauuuuauaccauguucuauaaucauuuccacaaacugacauggaucuuuucucaggaguaaagcaggagcuuugugauccacucauggauguuugaaagaacagaaauugcacacuguuggacacagugagcuguuaaugguuguuuuaguuaggguuucauugcugugaagagacaccaugaccauggcaauucuuauaaaggaaaacauuugaggcuggcuuacaguuucugaggcuuauuuuauuuuugucacggcaagaagcauggagacacacaggcaagacauggugcuggagaaggaacuaagaguucuucauauagauccgcagggagcaaggagagacuuuguguuacucuggaccuagcuucaggaagagaccccaaagccugcccccacagcgacaaacuaccaccaacaaagucacaccuccuaguagugccacccucuauggccaagcacccccagcguucacacucugugguggcuguucccauucaggccagcacaguggcuucuccugugauuacagugugcacagcuauugguuccuuaauacuacaguggugguaacuucaguacaccugucacaggaaauugaaagucaaguucugugucuuggcuagaccagucuuccuggauauccuguuuccauggauaacuuccccagcuucccauaacuucccuagauucuuuuucucucuuuccauggucuggauagcuuuugucuuucauugugagauccauuucuuacccucuucucgauugcuuuggccuuaauaacaaaccaugccuggauuuuugcaaccaucugcccgcuguucuucugcuucagucccauuuuagacccugcagucaggcugggcuguugaaacaagagucuuaccacauugguacuuaaagccccagagcucucuaagcaccuaauuucagcauguacccaugugagagcauauauuacagcuuucuucuuaggauuaaacaacuuucuaguauauugauguaguauguuuuaaaagggucacgugugugguuugugacucugcuuuaaauaauuguacuuuagguuuuuuuuuguuuuuuuuuaaaccguugauauuuguacccuuuuaagaagcuagcugugacauuacccaguggcuaggguaccagcacucagagcauuaugggagaacuaccgugagggagggagucagggagcuugagcuggcucuaccugccugcugucugcuaugcuggaggagucccucucugcuuguguacaauuuaggcugccaguuauuuuuagauugaaucaauuuugugucauuaguugugauagaauaagugauuagguauauuguucccauucuaugugaccuuuacucuucuuacacacacacacacacacacacacacacugagagagagagagagagaaagagagaaagagagagagaaaaggguagagguuuggaguucugauuuugguuuuaauuuuuucagaaguuugacuuuucgaauagugcaggugaaucaggauauaaagcuggaaagcaaaauaauaguacaauuuguuucaguaagguuuuauugcuguuaagcacccagcauuucaaagugcuuuuucuaauacuugcuaauauuacugacaguguuucuuuaauaacgaauaaaggccagaaguaaaagagaaacauaaggauuagacuuucuguguaguuuuguaacuaguugggaucaaauaacgguaguugcucucucuugagucugggugacuguuccagcugugcagagugcacaccauugugaugccgugggguucugagaguucuaauagagcaaguggucuugaguuggcugugccuuccuccuuaccagcgccuguuccagcuucucugcugauccucuucccacccugcuuugcccuuuccaucaccucaccaccagacugaaagugggaaagucuaaaauauuaucuugugguuguuuuuuuuuguugcaguguaagcgguaaccaugacuacugaaguuggcucugcaucugaagugaagaagggcucugaccaggcuggagcagaugccuccaaggagaaagcuaaagaaguagaaaaugagcagacuccaguaucugagccagaggaagaaaaggguucccagccagguccuccgguugagaggcaaagcacuccccgccugcggaaacgagggaaggauccgucugagaacaggggcaucucucgauucauacccccguggcuuaagaagcagaggucuuacaauuuaguaguagccaaagauggaggagauaaaaaagagccuacucaagcugacguggaagaccagaucuuaggcaaagaggaaucccuuccugaagaagagagucgggccaagggugacgcagaagaaauggcucagaggaagcaccuggagguucagguggaggucagggaagcaaaaccagccuugaaaagcagcguggagacccagguaggucgggaagaccagaaugagggcauacguaacgggcuagggcagggaugagggcacagcacacagggaaagggacuggcugguuugggauaauuucccccuuauguaccgagauaccaccucagccuagugugucuggaauacaaaucuuggauuauuaagcuuuagucuucccugugaaucuuaaaaacuauucccaaaccacaaaaaucaaaucaaagagccacuaccacagcaggaaaacccacacagcccugucuuaacgugccuguuucugagaggguugaccuugccaggcccuuuaauucaccuuugccuuauucaaguaaguaguggucucucccucucccucucccucucccucucccucucccucucccucucccucucccucucccucucccucucccucucccucucccucucccucucccucucccucucccucucccucucccucucccucccgacccccuccugugugugugguuugcuuguggaagucuagguuuucuugugguuuaagauuuuagaaacuuuguuauuuugaugcuauuaaaguacagcugcugggauuccuaggcaaauggauggaccuggagggcaucauccugagugaaguaacccaaucacaaaggaacucacacaauauguacucacugauaaguggauauuagcccagaaacuuaggauacccaagauauaagauacaacuugccaaacgcaugaaauucaagaagaacgaagaccaaaguguggacacuuuacccuuucuuagaaaugggaacaaaacacccauggaaggaguuacagagacaaaauuuggagcugugacgaaaggauggaccaucuagugauuaccauaugcagggauccaucccauuaucagcauccaaacgcugccaucauugcauacacuagcaagauuuugcugaaaggacccagauauagcugucucuugugagacuaugccagggccuagcaaacacagaaguggaugcucacagucagcuauuggaugggucacauggcccccaauggaggagcuagagaaauuacccaaggagcuaaagggaacugcaacccuauagguggaacaacaauaugaacuaaccaguacccgggagcucuugacucuagcugcauauguaucaaaagauggccuagucagccaucacugcaaagagaggcccauuggacuugcaaacuuuauaugccccaguacagggggacgccagggccaaaaagggggaguggguggguaggggaacggggggguggguaugggggaccuuugggauagcauugaaaauguaaacgaggaaaauaccuaauaauaaaaaaaaaguuaaaaaaaaaguacagcugcuggaauauagcuucuuuuauucauuuaaugcuuacaucacuaaccuggaaaaauaauggguaauaaaaaaugauacaagaaaggguaaaaagcuuaaaacccuuaaguuuaaagguguuauacugaaaaucauaauucucauuaaagauucuucuuggggcugaggguauggcuggagcgcgugguacuauguucauaacugggauaaguuaccagucugcuuagaaaaguggggucugaucuuuuuuucucuuguuaauguugucuacagguugguuaacuuuaacguggauucacuuuuuguuuuggcagccugcugaagaagugaggaaggacaaggaggaaacgauacaagacacacaggaagagaaacuggaaggaggugcagccaaaagggagacaaaggaaguacagacaagugagcugaaggcagagguggccucucagaaagcuaccaagaagaccaagacuguccuggccaaagugacccuucuagauggcacggaauacagcugugaccuugaggugaggcagagaguucuccucgugacagaauaaaugcaggcugcggucucggaggcacaauugcucugugccccuuucaccaaguuccuacaggccagguugucguaauugugcuuuuaaaguguuaacugcauguagaaggagcgccauuguucccaugucacacagcaccuucugccucccuguuaagcaggggcgaugcucugccauggccguucagucucguaugguuugugucuggucugaaagaucugcuuugauaccaccucuauaggauaucuuacaugagaaaugcagcuauagcuuuaaguugacuuuuagaguaaugagauuucagcaguuaaacucuugagaaagagaaugauguaaaccuaggccaucagcuuuguuucguuuggcgagaaaaugccugugcguuguaagaggugucauucccggcacugaaguugagaggcccagguggugccuuagaguagcagcucagggcuuucugucaccucaguucuucacagugacuucuuuucacaugacaugcauuaauaguuaguguccucugaacuguguugaaguucuuugaguggcuccucauguuucauguaagacuccauucucaguucacagugggagguaaaggcuuagacucaguaacugccaggugguggcagagccagguggcagcuuggcacuagagcuugugagagcauguccuuggaauuacagccaucccgccagugagcugacuaaaaauuagccaaauuccugacagccuuuuuuuuuucuuuuuuucuucauuuugguuuuuagagacaggguuucucugcaaguggcccuggcuguccaggaacuugauguguagauuagccuggccuugaacccacagagaucuuccugccucugucugccaagugagugcugggauuaaaggcaugugccaucuccaguggcauucauauuuaacagcuugcuaaaacaccuguggcuaucuaguagaacagugcuuuuauuauauuugaagauacucgauugccaggcaaggauacucagggagcacuuauaauugauuuucuuaucuuuuuauaaauccucuugacccaugcguauauaauaguucuggcacugaggcauuucaaaacuagaguaacagagaauuaagaaucuuuaucuuaguugguacuugauguuauaacaaaauacuuuagaagagguagcuuuuaaagaauagaguccagugauuuucagucuguggguucagaccccuuugggguucacauaucaugcauaucaugugcagggucagagaaggcuagcagcuccuuuaccaucuugucugagugcgcuaaggaggcuccaccuccuaauacaugguuaagcccauggccaacagacaaggcaaggguccacuuucuccauaccuauucaguaucaugcuugaucuuagcaggagcagugagacaacugaaagacaagauacaacuaggaaaggaagaagucaaagcaucuuuaguugcugaagucaugauuguauccauaaaggacccuaggucaccaggaaacucuauagcagaugagcaccuucaucaaaguaucaggauacagaacaaucaacaccacgaauaaauacuccuuuucuuuuuccuuacuuacauuuuuguugcaaauuuacuguguuauuuuccuuccaaaaccaacaacuaaguuuuguuuacugauuauuuuuuacuuuguaauauuucccccuuugcuuacccugcccccacccccauuccuguguuuucugauuuuuugaguuuaauacuuagaaauacugcuuuucugggucuucauuucaucuucuaguauuuuccauagcauuacaguuuaguuugacuuuggaauuuaugcaucugauuuaggauuuucaguguguguauauaccaugggcgugcugugggagagguuauuuauuuauuuuuuuuccgaauccaaauuuuuuuauugcauugugcucagaauguggucuaaaguagauucuguuguguuuaagaccucacaccaggauaucucguuagcauaguucucguagaguuccauaaacaugcauucuuuucuuuauacagagguuuggauuuguccuugauccaauuaauuaugucuguuucaugacuguccuguuuaacugcauuggcgauugauuucuaaguguguuaaaauggcuguauucauuucauaacuuaccuuaguauuccuguaaauuuauauuuucuaaaaucucuaaaaucucuagaaucaaucucucucucucucucucucucuuucucucucucucucucucucagguuggccucgagcucagaaauccuccugccucugccucccaagugcuggaauuaaagcccggcuauuuucuaaaaucuuaggcuagauuauuaacuucagaauuauauauuguuggcuguuucccugauuguuguauuauaccugaauccauuuuacuagauacuaauauuacuacuauaguagcauuuuacuagauacuaauauugcuacuauaguagcauuuuacuagauaauaauauuacuacuauaguggcauuuuacuagauacuaauauuacuacuauaguagcauuuuaacuagugaauuuacagagguuuucucacagcccagaugccugugacuguauuuugcugccugaguuugggguaucucuuugcuuacuugcuccccacuuucauuguucuuuuuugggaauugucuguauuuuauagacacugauuugaaguuugcuccuccugugcuuguguuaauguguguuuauuagaucucugaucuaauuuuagaauacuacaaagucaaaguguagcuagucuucuaugauugauucuguugcuugcagagaaucuguuuguuguguuccccaaaggacuuagauaauacccagggcuaaaagcugccacuuaguccuuuaauuugucaagaauuaagcuguauuauaagagucucgugauuuuaugagaguaugcacuuaaauucuuuuucuuuaauaugggauuguuuaacagucuacuuuaagaagaaacuuuugaagacaguagaucauaaaucagcauuauagcaacugugcugagugaaugucuuauucuuuucaggcacaaagcaaaauaaaaucugguacccuccuccuaguagguguuggcguagugcagaagucaugugcugugucucccguuguaaugaauguuucuuucaucuaaauuuucuucucacugugguugcuugguaacauuaguuuggaucucugucuucucagcccugcugcaugugcuccucaggaguggagugccgagguugugagccaugguuggguacccucaugcuuccugucccgugcuggccuaaacuccuggcugaugugcucaugcugcugucugggcuccagcagaucuacaccggaaauuagugucugaguucuaguugaggaaguauauguuggaaacuggcuauuaaugcauuucugagcagucaagaaaggcacauacaguguaaggcacauagggguuuuugguggcuugggagaacugccaguaaguguuguauuucucguuguuuuccauuucuguaugugccgugccuguugaggcucucuauuucuguaugugcugugucugauuuucaguuggucuuagguucuauacgacaugucaguaaggagggccuagucauuucucacccacauugauagaggaaaccauuagauaacuggcaccagccaggagcggugcugcacaccuuuaucccagcacucugggaggcagaggcagaggcagaccugcucuacagagugaguuucagcauagccagggcuauacagagaaacuccaucuugaaaaacaaauaaaagaaaauugaccacuguaggaagucuauauagaauguccauucacagggucuuuauugaauagacaggauuuggaagacgucaaaugccaguauaagauuaaaacugaccccuagagcaaaggggccaggaauagugggacugaaaaggccaagcugccaguuaagauuuggaaaguguuggcuguguuguugcaguagcugaggggugggguguuaacaguucacugcacuguuagcauacgcaugcgugguccacugcacuguuagcauacgcaugcgugguccacguaggcgacgggcuuuaugugacuugucaguguggcaaacugcuguuuguauuaccuaccuaucaggguuuugucagugaaggguccgucuuugacuaucugauguaauauugaaugucuuuaaugcuaggaaacauaacucuguaagauuggcuuguccuaucuaaucgucaucacucgacagauagaauuaacauucaggauauguguaagguacucauauacauauuauuuuuacugcuuuguaaaucuauguaauauguucauuucuguauacccauguaugcguguagaggaggaauggauauugacaagaacauauuugacauggguguaacuaaguuacuaaggauggccucgaacaccugaacugagagugcucuccccucagccuccuccaggaucugcgacaguagaauucaugggacuugccuuacugguuuggguuuuuuuuuuuuuuuuuuuuuuuugaggggggguggaguuccuguuucaaaauuuuuuuucucucagggacccccugaaaccuguuuauuuugcucuagagccccaggauaaagacagcugccaaauaaacugguuucaaacacuucugucaccuucgaaguugaaguucuuuugagaaaggagcugcagguuaaaauuaacacguuaaagaaugucacacacauuugccagagucccagaagguggaagugacaagcagugauuggacacaguacauuagacauggauuguuuaagcucagaggaccccauggaaaugguuugacagugugcacucaguugugugcgcucaggcuuaggaagugauaguucacugugacuuaaugcuuuuccuuuuauccaaagccuacuauaucuuuaugcauuuguuucagauuguuaaguaccuuuucauuauuguccaugaaaauugcuguuuauauauuauucuagaauaucguuugauaaauugaauugcacacaauuuuaauacuuuugaggauuauuauuuuuacuacuacuuucgagaaaaaaaauuucaaaauauaucuagcccugaauagccuagaacuguccauguaguccagcuuacagagaucucccugccucugccuccugagugccgagauuaaagguguguaccaccuaggcaaugaggaguauuauauuuuuaaaugaaggccauaucaacuuucaucccauucuguuauuuaagugauacauggcaaccuaauuugguaccagagcuugaguugugcagaauuuuagggucuuuggauucugcaugcuggcugcagacacucgacugugggagucucuaugucgcugcagcagaagucacuuacccacucggugugcuaaagcagcagggcucuuccuguaaggagcgauccagugagguugaugugaagccguggggcagcaggaugcuuauguuuacuuccuauugacucucccuaggucuugggcaagugacuuccugccuuuucuucuggccucagauucagcaagaaugaaaacauuggcuuccugucuuucuaggauugagcuggacuuucucgggcuuguaaaucugugugcaguuuugaaaguuggaauaagucuggacuggggaggcuugagaagugugauugugugugcgcccugaguaaaagcucacauuuuccucuggcaugugugcguuuucccucguguuaguuuugucugugaauugaaggcauuguuuuagcccacacagaaaugucacaaccauuuguccugauuaaugaauaaggcagucagaaaacaggcugucagcagagaacggagugcagcgaggucugcagugcuucucuggacuaauucugacacccagaauccaguuucuuauccuugccuuugggugugcuaugucuuugugucuacuuuugucaaccaggcuuguuuucaagcuacaguugugacccuuaaguuaucugcauacucuagaucauacuucuagaucuuaguggaucuagaaguuguaauacucuaaaaucccacagagauggguauguguguacaugugugcguguauuuggaacugggaauaacuuaugugcaaauuuaaaauuacagugacuagauccaaacauagugucucugaccagcucucaguuuauuccuuagguuauuaaaaagguuuaagguuguaauuguguugaaggacuuaaaaaaaaaaaguggcaaagggugucaugccauggaagucguagaaccuuuugguuucacuugaaaaauucaaagaaccuacauuuguggcagcuggacggacucuuauuuaagccacaaauagcuggucacuagggacuguuaggugugaccccaggcuaucuucccuccccuguucauacaaaaugaccuuauccucaacauccugaguuguaaaguuucuggucacaugaucucuccuuguguuccucagcuacacgauucuucucuggucucuagcaucugauucauauccagcucacaugcuguuaguguguucaguuaucacacaaugacaugugaaggagucuuuguuguugagcagcugcuaaguucuuguuggauuuucuuuaauacuuucauugcuucuuuaccuacaacuuuacuuucucccugcagagcauucguguaagacuuugucuaaguuacuucuccugaagaguaauuauucccauuuacuuucuuguacagaaacagggcuuuucucuguagcucugggugucuuggaaccugcucuggcucuguggacuaggcuagccuugacugcaagagauccuacuucuuuuacuagagugaugggauuaaaggugugcaccaccacguccugcugcuuuguacgcuucuuauccuuuuuuccuaagauagcuugauagcauuuguguuacucauuucaucuuucucugauccucacugcacugacuuguagaaauucuuccaggccuuagugagugaaaauaauucauuauaguucugcagaagguuguucaggcccaggaguaagagcauucuacauaagagaccccucaggaguuggcagacugcagggaucuaugagacuucuuggcuuuucuugaaguagugaaucugacuggguugggcuugaaaaggugaaucagcaaugccuuauuccaaagucuuuucuuuaauaaugccuccucuugaaaggauggauucgaauuuugaguagucaucaagucucuaauauucuuuccacuuuugguuuuaaaaugccagaauuguuuuucugacaaacaaugaacuugccauuugaaaguaacucaaagugugagugaucaucuuugacucuuucuucuagagauccuuucuccugggcacuguguugagccugugguagcuuugccugugcccgccuauugguagugaaugacaaaaagaaauacaggaggaggauaggacuguucuagguguggagggaggcuuauuguagauaugaaggagagcagaggcagaggcagaggcagaggcagaggcagaggcagaggcagaggcagaggcagaggcagaggcagaggcagaggcagaggcagaggcagaggcagaggcagagauaucugggacaguccagagugagccugagccugagccuggccaggggucaggagaguaaggauagauagaagggcugaguuaccaaagcagcuagagggggagggggagggggagggggagggggaggggaggggaggggagaggagagaagagaaggagacucugagagagaauaaauauguuugugcauucacuaaacuagauauauaccuugucuagagaucagaacuaaguguauguuuucaguucuaaaucuuaguuuauguaacagauuuucuauaauuguuucaucgcaggauuaaaauaaacuuguggauucuuaccuuaaauguaacacauauuaaaguuagguuuuaaaaauucuuuuaagaauuuuaauuaguucuagcagucuuacaacuucuauuuugacacuguugauaguuuucuuagagaugauuuuauaaguguugacauucuuucauuuuuuuacacauuucuagauaaguacguuauuuugcaugcuuauuuaauuggcuagaauggaaguuuuuuuuuauuuuuuuauuuauuuuugcuauucuguuuaaaauauauauauuuuuuuuugcaaauuugguuguuacugguuuucuaaaggggugcggggguugguucccagaaccaccacaaauacccagagccacacaacauaaguucuuuucuguaaaauaguaaaacagccuaguauuuuuuauauguauauucuccuguauacuugaacuuauugcuagaucacuuagaguuuauaacacuguugauacaguguaaguagauauuaauuuguaccgcuuugagaaugaggacaaaggaaaauguguguguucagucaguuguaguuuuuuuuuuuuuuuuccccuucaaauaggaauuucuguaggugucuuuccacuuuugguuuuaaaaugccagaauuguuuuucugacaaacaaugaacuugccauuugaaaguaacucaaagugugagugaucaucuuugacucuuucuucuagagauccuuucuccugggcacuguguugagccugugguagcuuugccugugcccgccuauugguagugaaugacaaaaagaaauacaggaggaggauaggacuguucuagguguggagggaggcuuauuguagauaugaaggagagcagaggcagaggcagaggcagaggcagaggcagaggcagaggcagaggcagaggcagaggcagaggcagaggcagaggcagaggcagaggcagaggcagaggcagagauaucugggacaguccagagugagccugagccugagccugggaggaauuuuuugaguucuugaaauaaccuuuucaauuuuuugaauuuuuaucaaugaucagagaaacauaaaugacuuauuuacuuguagaauuauguuuugaacauauuaaagaaaaaaaaaggucauuggcuccgguuuccuuuugcuagaaguugaaugaacuuuaggaacaggugcgggacaggugacucacuggcgggaaaagaacugacagucaugcccuccggcugaggcucuuuccuccuuugcacagccuuaguugacuuccucggccccaccacgguaaaugaguuauguuggcucugugcauaccguuguucuugcccuuuuauauuugcacaguguaguuuugagcgaguguagaaugcauagcucuggggaguaauguauggauugcauugugugguucccgucacugccuucuuggcacacaauaagggcacuguggaggggccuacacggagacagugaugguguuuuagaaacugccaugauguguggcacccucugcaauaugcuggguaagcaguugcccagauuccuccaaguugaggggccuccagaaauguucuguuuuggcuucaguuacgaaugccacaaauaacggagcagacccagagccugagcugaggcucacaucucagucugccuuccguuagcugggggcugcugguugguugguuuguuuaaagagaaauuucucauaagcuagucugcuaguccucgaguaaaauauuuuugaaaacacaucuuaacuaucuuauuuucucuaucuccuuugcacgucucuaauauauuauguagcuucuaccgaaacaaacaaacaaaaccaaaaaagaugugggcuggugagaguuucagcccacagagugucagcacaaagaccuggagugaauccccagcguccacacaggaagcccugugaggcaggcgcagaccggcuacagcugggcacacaggcacaggaucccuuggacuggcuaaccagaaguugagcugaacccagugagcuguggaucccgagaccucuucuccagaacugaggaugagggagaccgcacacgcaugcauguguaccccuugccguaugggcacacgugugaacuucuacagaucagcccuacauacagacacauaaaaugucuguccaugccuggaguuagagcagucuccccacugcacccuucuuuucccugguugugcaaugcugagauguaaguuggguuaucgaguggcacaugggggauauaaacugucaagcuuguugaaauuugguauaaaaaaaaauuaguuuuucagaaugugguugguaaguuuugugaacuuuuugugacaguacugaggauuggacggagggccucauggaugcucuacaagguuccaccacugcgauggugccccauuccugauuaugggguuucacugacugaugggcuagugugcuacaucaucaggacagagacugacaguuuauauaaguuaccacauaagaacagauacaaagcaaagaaaugccucaacuggcaauaugaaacagcuugggaaccccaguggacaugcauauaaauguggcacagccuauucuaggacaaaugcagagcagcuuucugccugagucguucuccagagguccgcucuugcuuaccgaggaaaagcguauguagguucucccuagcucuuacuucagcguguucuugcuuuauugcuuugaaugucugugggucgguauugaugaaugaggacucaugggacugugugugucugcuaaccagaaaagacugaacucugcacucgagacugcuggacuuccagccugcauuaauaauaugagccauuccacuauugcccuacugguuuuuaacucagugaaguauaccacuuuagaagacauugaggcaagauaugccuuuucuuaaauaaccuagucacugaaauccaucaguaugggagggagucagagugccgaggaagaaagucuacacuugaucuuagccaaaaggccgagaagcgaugaggaagaaagucuaaauauuaggaaacuggaauacgcuuuguaguagaugacaauuuagagauuugccuagaagcagagugcacuuugaccuuuggagguaaguaggagagacuggugaacugguuagggagcggcuugcaagccuugccuaccucaagcccacuccuacaaguucuucuuugaccucuguguguguuuuguggcacacacaaaacccacacaaauaauuuuuuuuuuuuaaaucuagagaaaggcuuugaaugucuuccuuaucugggcccaaauccccgcauuauaauaauagcccaugaacuaacugauguguuuauaaaaugauaaagagagagaggggauauauauguuuuauggagguguagucagguaugagggaagggaaggguuugccucaguggucccaugcugagguaccccccucccccagggaccagccacauuauucuauaguauagaauagaguuuauucagggcauggggaggggaguuaagaggguaggggagagagagagagagagggagaaggacagggagagggagagagggaaagagacuggcuaugagcacauagagagagacggaggaagggaaugggcagagagugggggcagaaaggcaagagcaagagaggagggggcaagcaaccccuuuauagugagucaggcacaccuggcuguugccagguaacugugagguggagcuuagacaaaaugcuaacacuaacuauauacuuuuaaaauauauuuuucaaaaaauuaaaguguaacuaucauuuucucacuucauuuccuucccacagugccucccauguuguuguccuccaaccuuccugugcccuucauauccacugacagccccucuuaaaugcauguucuccuuuucuuugauugcuauuuugauuguuauugguauauguguggaaggaauaauuagucuuuccuaaggauaggcccccuaauugcuuauccaguaccaaguagucagccauguaccugaaaucaugucuguacaagcaacacauaaauggaguuggacaugcugacuuacaggcauauagauacaaacugcuaauuuugauacaaguuguaagcagaugucuuucauuuugcuugguuggcaaaugcucauuuguaaucuuuccaccuaacagaauuguaguuguuuauaagaaaaaacuuaauggcuggacauaguuuugcaugucuauaaucuagcacucaggaaacugagacaagaggauuucaaauuugaggccaacugaucuacauucuaauacccuagcacaaacacagaagaaaccugccuuucuagacagaaguuuaaguguuacacuuacagagaucuaccauuaauuuuacaaaagaaauucagaaaagcagaugggaaaacgggaucgcuucaacuuccuguaauuucaaaggagguugaauucaauaacggaaacuuuugaauuauauuuaacacuaauuuauuuuuuacagcagcucaauuccucuauaggacuucugugaauucaugaaauagcucauauauuuuauuaaacauguuauacaccuaaaugaauucucucugcuccauaggcagcauuuuacugucuauugaguucauugucugucuuuccuaguugaauaaacauuucuugagaccauuuguuuuauucaucauuguuucuccacuggcuaacaugggagcugacaucuauugcugggccagcguauuuagccuucuagccuggcaaacucagccaugugugaaugggacaggaccuaccaccauagugacugccugugcaguguacgguggcuuucccaauucaucuuacggauccugcagugucucugaggagaaauucauuccaccaggcuucgugagcaccaaaagugagaaguugggccucucagaaaccugcgcucucugccuccagaaucacugccuccucugagacucacaugcgaugucaugcucaugauuucuugcuuucuucuuagauacaguugcugguccuuggcauuucuauagcacuggagaguggagauuccgaguggaaguuuagaagcagcugugcauagucagcuucuccuuggcugcuaaaauauccauguuuuggagagggggaaaccuaacaggaagaacggcccgagcaucaagacaguguuucagguuuugugagaugugggcccagucaaagagcagcgcagaguagaaacccagcugugguugcccuagaugcuuugcaucuccugucucauucccuugauuguuagagcugagaggugguucuugcuucuggguuacaggcaggaggcuaagugguuuccuguugucacacugccuaguaacagaaaaguuccugagaugcugagugauguugaacagcggggucugacuguagcucccguguuaggguuugauguauugcucagcauaggaacgccugacuguggguggcucuguggauguguccuacuagucuuauaggguaaaguguccaguagagcugugucugagauagaaacuauuggaaagacacgaguuuacagaaauugacuguaagcuggaguguauuuucucuaugaugucaucuuagaugucucuuaacuaucccuauuuucaaggacuguagccaguaguuacacauuuuaauucauuucaugcuugccauauaccuuguaucaaauucuauuauucucauagcuguggaaacuggugguggaguaagguaaaugucuugccuucagucacuuauuuuauuaagagguagugauguguuuaguuucuguauacuauaaacauguaaauaauagaaccacaugucuaucuuaguaacuuaacuaucaacugcugaccauuaauccucaaugauagacauagcacauugcuuaugguaauauaauuugugugaacuucuuucauuuacuacugaaauaguaaucauaguuuugaaacauuuaguagaaguaccagauucuacuccaaaaggucugugucugucugucugucugucugucugucuaucucuguguguguguauguauaauuucuauguauugcaugaacaaauaggugcauauuuuaacaauggggcauccgcugagcccucuuuuucuugguccugcucugauuucacugguaacuaguugugcugccuguaagcguguggggaggaaacgccugucugacucagcuuacaguuaggacauuccaggguucugcaucuuaacuggaaaugaguaugcuuugucacuggauaaauggcaaucacuuuuucuaugucuuccuggggcuuuuaagucucuuuuaaguuuccuaaagaguggauauuuuccagaaaguuagaaauaaaaacguaauuuaaguggaaaaagcugguguuguauaaauaucuuggaauagcagcaacaaggaaauaaagccucagugcugaccagcaugacuugugcgaggucacaucagucagggucggggcggaguucauaugacuugugccaggucacaucagucagggucaggggcggaguucauaugacuugugcgaggucacgucagucagggucaggggcggaguucauaugacuugugcgaggucacaucagucagggucgggggcggaguucauaugacuugugcgaggucacgucagucagggucgggggcggaguucauaugacuugugcgaggucacgucagucagggucggggacggaguucauaugacuugugcgaggucacgucagucagggucgggggcggaguucauaugacuugugcgaggucacgucagucagggucgggggcggaguucauaugacuugugcgaggucacaucagucagggucgggggcggaguucauaugacuugugcgaggucacaucagucagggucgggggcggaguucauaugacuugugcgaggucacaucagucagggucgggggcggaguucauaugacuugugcgaggucacgucagucagggucgggggcggaguucauaugacuugugcgaggucacgucagucagggucgggggcggaguucauaugacuugugcgaggucacgucagucagggucggggacggaguucauaugacuugugcgaggucacgucagucagggucgggggcggaguucauaugacuugugcgaggucacaucagucagggucgggggcggaguucauaugacuugugcgaggucacgucaggcagggucacagggcagaauucauaugacuugugcaagguuacaucagucagggucagggggcggaguucauaugacuugugagaggucacaucagucagggucacaggguggccuucaugaguugugauaggucagucacaucagaugguuuuguagggcaguguucuuaaaaaaaagugaaucauauucagguuuugaggggaaacuugaaauacaauguuuuacuguucacaugaguagaugaauacuuagcauuuugcuuuuuuuuaaauuagguauuuuccucguuuacauuuccaaugcuaucccaaaagucccccauaccuacccccccaauccccuacccacccacucccccuuuuugacccuggcguuccccuguacugggacauauaaaguuugcaaguccaaagggccucucuuuccagugauggccgacuaggccaucuuuugauacauaugcagcuagagucaagagcuucgggguacugguuaguucauauuguuguuccacauauaggguugcagaucccuuuagcuccuuggguacuuucucuagcuucuccauuggggguccugugauccauccaauagcugacugugagcauccacuucuguguuugcuaggccccgucaucuggguccuuucagcaaaaucuugcuaguguaugcaauggugucagcguuuggaggcugauuaugggguggaucccugaguauggcagucucuagaugguccauccuuucgucacagcuccaaacuuugucucuguaacuccuuccauggguguuuuguucccauuucuaggaaggggcaaaguguccacacuuuggucuuuguucuucuugaguuucuuguguuuugcaaauuguaucuuauaucuuguguauccuaaguuucugggcuaauauccacuuaucagugaguacauauugugugaguuccuuugugauuggguuaccucacucaggaugaugcccuccagguccauccauuugccuaagaauuucauaaauucauucuuuuuaauagcugaguaguacuccauuguguaaauguaccacauuuucuguauccaucccucuguugaggggcaucuggguucuuuccagcuucuggcuauuauaaauaaggcugcuaugaacauaguggagcauguguccuucuuaccgguugggacaucuucuggauauaugcccaggagcauuuugcuuuuuaaaugucaaugagaauagcaguaaagcagaaugcauuuaguuauggcuuuuagaacgauacuuaucauuaggacauuagaaaauaaauacuuaacauuaauuuguaauaaaugacugaugcuuuuaaaauaauauuuuaaaauuuauuaguauauaaaauuuuauuaugacuuuuuucauacaaaauuugucuuguuguuuuucuucucccccauuuucaccucguuugcuccugcccuaguccucucugucuccuuuccugucccaugccucuuucccacuaagcuccucuuucucuuucuucaucuccuuuagaaaaguaaagacuugcuguguuuuucuacagaaacgugccaagggacaaguguuguuugaccgagugugcgagcaccugaaccucuuggagaaggacuacuuuggacuucuauuucaggaucauccugagcagaaaguaagcgauuacaacucuauguccuuuauguguauuuuuuguaaacaguuuaauuucacaauaaauuuaacuuucauuuacaugauuaugaagagauuuuuggcaaauauuuaaaagugauuaugugagagacucacuaaagcuuuuuggcauuuuggguguguacagugcaguacaucagcagcagacggaauggaauguuuuccugucuuauuugagauugaaaaacugauuuuacaauuaugggaaagcuuuagcucuugaauucacaguggaaucaacuucuguaauaaguuguugaggggaaagcacuucaaaacauauacauuaaaagauucaauagugggaaaauugaugauguaccaugaagaauaucuuuuuaaauaauacugucucagccaugcccuguuuuugccucaugcucuaaauacagcggccaagugggcuccuguuagcaacauacagcugugcagugaccgguguaguaguaguuauugaaugagccugaaccacagagagcugggugccagaggcuugggaagaaggguuugucuugcuuagaggacuugagugacuuugugugggaaagauacuggugucuuuguggcugagcuguuggggcagaagagguggccgggccagcuccccucaggugaugucugaccaaccagugcuggacuggcccugggaguagugcugcugcugucacgagugugcugagacacuaagcaagagaacagggugggcggucugauauuaguacuaauuuuauagagcuucaaagauucucaguuucacagguaaaguaaggauagaaacauuggcccuuucuggcaggaccagggcuaaccuguagccaucaacauuauuuggaaaagugcuuuuugagugucaagguuuggugugggugagauguugacugaaagagggaagaaugugaguuuguccagagucgcacccuacagaggaagcccauuuagucuguuaaauugcugcuguggacaggcucucugugagcauucuguugggauguauagagccuucagugauagugaaagaggguucuguguaaugucagccuccauaucucagccaacagaacaguagucaugggaggaagcauaguguguguguuguuguuugcccagacagugccauuguuuguguuuacagagcccaggaaugggaugauaauuauaugcaaauuaaguguucucaacuuguucagcuuuaaaucucagaucuguaauuagugguuuaauucuaccuuuagauuaaagacaaauugcaagccugccuuuugaauagcauguauuuuuauuagaguuguuuaagaguacucuccuuagaaauagaaacacacuccacuaaauaaacuaagugccuuguaaagcaauaaauuacaaguugguaauggcuccaaucaagugcucuuuguuauuccucaaagcuccaaaggagaguuacuugccagucuauccauccguccuuccuuccuuccuuccuuccuuccuuacuuacuuuuuuuugagauugucuauugguagauucauaggaacguuuacuuuuuguaaaauauaaaacgauucaauauguugugaaugcuuuuguuaguacaaacaaaauagacagucugaauaaguacuccggcaauagaauuuacuguuugaaauuuaaacuuuuaguauacaugucuaguccauaugguacaccagagccucugauccccguucucaguugucugcugaacacuccugguuuaaaagcaaacuuuauccucccauuaaauguugucuguuccagaaggauaguucuggacuccucaccucugugaauagucaggugccugugaucuaaguaaaguuagaaaccuuuagugcacacaguuuaauccccugcaguuggcaugagcuuucuccucagcaccaucucacagaagcugauagugagugugugacggauucugcuugccaaggaagccuggcggguguaucuaucugcucaugcauacuaugccucaguggcagcuucuuucucuuaguaucucaaugccugccuuuccuaaagagugagaaaugcuucccucauccacggccugccuucuaccauccucuccccagcccaaggaggugacuuagcaguuucuucugucaucagcauauuaguauuaauacaaaccuuauuuguguguugcuuuucgccucauuacccugguuguaucuagaaacaggaugcugaaguguaaggagguggggaguugugugaugaggagacccaggguuuggcuuaagaugauaagaucagaagggagcugggaguauagcucagagguggguaaaucugcaucuccucaaagacaguguaaggcugauguucucagugacagaaagaugccacuugcugaagaggagccaagcauuccuuaccuaacuuuguggucaguguuucuuacaugucacauaacaugaugguaaagugggaugggcacuuuaguacuuacacuuugcaucuguguccucugggagacuuacuuuucagaaagugaguacucaaauauaguuugaauguguuaaguuacauaauuaugugacuauaaugcucauuuuuagauacaauguguuuauauauaaaaauauguauaggcaaaauccaggucucaaauacauuuaggcaaaacaacuuucauucuucucaauauagauguguacagucuuccuuuuuuuuuuuccccagaaaauuguuacugucaaaguuagcuucacaguccuucuuugaaguucuugagguucccacuguaggagauggggugugucccuguguuguguguaugccagacccaggcuuuaccaccgugucagacuccuggcugugcugcuuccccacacuaaauacuaugcauuuaaagaagccguggguacuuacuucagccucuuguaaagugggauuuagacagagcuauaaguauuuuguguagcaauuugucaugugggaaaaugugugcuaucuugguuuuaguauagcauugugucucuuaguugugacacggaguuggaagcauuucaguuuauugugauuauaaaaauguaaguuagugucaaacuuuucaccaucuguuaaagucucauguaaacugugcuauagaaaauguuaaaaguuuauagacuaaagcaacaugcuuuucuuugauacagaauuguaaguugauauaguuuugguguucauuaauaaaugaauucaucauuaaagauauuggacucuucaagaggaaagucuugaauuuuuguuguuaacagagucuaacauuugacucgacucagacauuauauaagucaguuuccuauaagcaguacuauaagaggugcuuuuuagaaguauaguugauauccaugcugucuuucugaaguuuaaaggaguugacuacuagccacccauccuccccagaagcagaacuaaaggcgcauaguaauuaacuuuagcaagauccuacguguaguucauuuaaacuuuauuauuuucuguucuccagaugggcuauaaguuucacugugaugcagaaaaccuggaacuucccucuuguguuggugucaugugguucaguucauagugaagggagcuggugaaacagugcguguucuuguggaaggggaggguuaagacaagacuacucucauccuuucagcauuugccuaacacacgagaacuugggugaauuuguuaaauucucauagccaaucugagacucuccaaaacaaagaagacaugggcacacuuuugcugggggugagcaguucaaacucugaaauccuaagauccagccugaagaguagugggcgacuccaggguggaagauggucacuucaguuggguagauguugugaauucuauuuugcuguugaggaaauugaggcuuagucggggugaaaaauguaaugaagucauagaacuggugggaaguaagugguaguuugacuccauauauuucuaagcccaaagucuguauuugugguuacaguagccaguucuuuaccauaguaaggaacauccuaguauucccugaggggcugcugugugugcucacacguguguacuuauguguccacucaccaccaucuuuaaucucaacaucuucuuuauucacugaugcugguuuucauuucuuaugugucuaaugcuuuauucauuuuuuucuuuaagugucaacccagagaaguuaauuuccauuuuauuuuuuuguuugugaaguaugguaguauauauauauauauauacaauuuccuagcacuuggaaaagugagguggagggucaggaguuccaagagcaaccugacuauagaggagucagaacagagcagcacaaauaguuuaugcuugguuuuguguaauugguaauccaacgaauauacuuaaguuccucuauaauguuacauuaaauauuuuaaacuuuugcuugauuauuuauaacacuagucaagaaauuauauaccaaccauaaccuacauacucaaagauaacuauucaauaaaaguaaauuuaauaaaauaauguguagucauuuaagaagacugcaggggaggaggaagcagaaauggacagauaacacucaacacguauuggauuuuaauauuuaauguuagguucccuaaaaaugccaagcacccuagagagcauggauacagucuauccaugccuguguacaacuguacucucagagaguggacaagaccuccugccuccaugggaggaauggagcuuacauaguggaagccagugugguaggaaacagugguuucugcugcucaguccugucauguagacacagccucugguaucucuggguaaggauccuguacuggauaguuucuguugucaguuugauacaaccuagaguccccugggaaggcggaaccucgauugaauugcccagaucuaguuagcccauggccauguuuguuagagaucaucuugauugaugguagaugaaggaaggcccaaaccuauucugggcagcuccauccauaggcagguaggugugagcuauuuaagaaaccucacugagaaugaagcagugagagaggcagaagggcauggccuaggcugcauugcucucugguuucugcuucgggucuugguugaguucuugcucuaacccacagugauggcaggugacuuacaaguguaacgccuagaaacacuucccucccccagguugcuuuugucaguguuucucguaggcacaggaaagcaacccagaacagagccauacaauacaagaugccacagcagccuucagugugucugacaggcagucaguguugugacaaguggccuaagggugacagucucaauuuaacuugccaacuugucacucgugaauauuuagaucuuuagaccccuuagucccucccuguuaucagguaauugggagaguugguccugaggauagaaagugugguagcugggaccucgggcccaugugcggguuccauuguucuucccuggaacacagaaaccauuugcuucucucuggcaggcaucugugucagcuuauccuuaaggaaacugggaucugggaggucugucugugagacgagcaguauuucugugucagggauagaaggggucuugucacugagguuuguaccaguugucccugagucccuucccuuugugaucauuacucucuugguuucagugccacacauuuaacccucuuuccccucugccuagccucagugcagccugauuaaaagcugaacgaugugcuuuucuuguucuuguguucuuaucauaguuacccauuuguggccagcuguguguaggacagcagcugcaggguaaggaaacugaaugcuacuuuuuuuuuuuuuuagugaaaaaauagagcuguuuccuaacacagcacucgagguuccauuauggggucucacuggucccucacaucagugccccaugcagcuggaacaucaguaauaguggaccaugcucugguggcucauuaaugagagcguugacuaucugucaccaguguuagggcagagacacauauaccuuguugauuauggucuggauucuugcugccagaguucaugguauaguaaaaucugaggacuacuuugaaaagaugcugcugucauuacuuuuuaauggugggucaugugcuguuaaaguucaguagauugacagcaguugugucacaacaaacauuuuguucucucuucgugggaauaagauuguguuuaaauacagggguuguaauacauugggugggagacuuaacaucagacuuucuugcuauauauaaagucaguuguuugaaucaauguguuguuuuucaaaaaauguacuuguucuacauuaggaaggugaauggcuuucuuaugacuuaacaauagggugggaaaacacaaagugcaaaauuuuugauaauuuguaggaacuguuuguuuuacaguuugaaagauucacuauucuuaugugguucagagacuggaauuuauuucuuuucuuccuuuucuucucucuucuuuuacuuuuuuuucuuuguuucuuucuuccuuucuuuuuguugcuuuaagauguuuuguuuuauuuuugguugacuuucucaaagaauagaaaugagaggcaaacggaaggauauugcauuccaaggauguuagaauuguguuuucuaaauucaaaugagaaacagagcggggcggauggcauuaucucuucgaggucugaguuguagagacaagaggcugaaggaugugaagagguuagcuuuagaguuugaugugauuguuuggaucagggcaugcguauuucugagccagugguuuacaauucacauuuuaucuuuaaguaagaagaaacuaggaacaacuuauuucaaugucugcggggugauuugugaagcaggucuauguaauaaaguuauauauagauaaguugcccuuuaucauuauuguaucaaagauuuaacauuucauaugcacacgagagcacaugcauacacauggguacacacacauguacacacauguacacucaggagaaugcuaacaagugaaagcuauauaacuagauaugagauguaagguauggacuauaaauuguuccacuuuauuuuggggaugugggauaguucuuaugcaaaacugaguuuuuguuuuuguuuuuuuuuuuuuguuuuuuuguuuuuuucccuccuacagaacuggcuagauccugcaaaggaaauaaagagacagcugaaaagugaguauuuaagacccauacuuaaauuaguucauauuauuucugccuuuaauaaaaacccaugggauagcuacuacaauugucacauagaauagggugcugguccuguuuugcaugcagagauaacaauacuguaagauacuugugaaagugacuuuagcuggacauggugucaggagcuugcaguccuaacacccaagaggcugaggcagggauccugagcuccaggccgcacagugcaacccaaccuuaaacaacaacaaaaccacgaguaugacuguggguggcuuugagccuucccuuugaggaggcaauagacuuauucuuacaugucugugaaaucgacuugucugagauuauagccuggcguuuaaaaaauacauugaacuuuuuuugggugacauuuauguuguauguauauguuguauauaucugaaugugugcaugagugugcuuuguguguguguguaugcgugugugugugugugugcgcgcgcgcgugcgcacguguccaugcucgugccagaggucaaccuuuggugucuuccuugauuacuccccauccuguuuucugagauaacaguuucucacugaaccuggagcccaucaaguugacuagacugccaauccauugaacgugccuugcucuacaguguccaccuccccagucuggaguucaagugcaugccucucuguacccugcaaagauggaguccaggcuucaugcugugcagacugagccaucuccgcagccucacguuccaccuuuuguuugagaugauuugcuuugugauaccuaauauaauuguaguauucauuuucauuuggaacuguacauuuuuuuuguuuugauguauguuuguuuuuuaguuuagaguuuuuuguuuguuuguuuguuuguuugagacagagauucuuuguaaaacaguucuggcuauccuggcacuuaauuuguagaucaagcuuauuuauguuaauugaggugauaacaaauuacucaaaacaaaaaccacucaaaccugguauuugguaaauaacugagauuuuauaauuucagaucuucccuggcuguucacuuucaaugugaaauuuuauccuccagauccuucucagcugacugaagauaucaccagguaccuuguauuuacauuuugaaauaaucuuugcuuauuacuauuauuuauuucuguguucugugaguaugguuguaacuguaggacugaaagagcaauaaaagaaagugugguauaaaauuuugccugcauaucuauauguguaccaccugcauggcuaguacauacagggagaagagggagauggguuacaggcagaucucagucaguguguagguucuaugaagccaguuucugccccuuguaagaacaguaagugcuaagccaucucauaguuaauauauauuacuguguaugucagagaguauauaggguggacauguagaguaagaagguaacuuguggagucuguuugcuucucccaccucuguggauucuagggauugaacuuggguuauuaagcacaugucuuugggcugcaaguaccuguagcugcuaagcccucacacuagccuccagcagcugucaaaacaaaauaaaacaaacuuagauguucacuuaaaacuggaucuugucccaaauagcuugaaguauuagcagugucaagacuuuuaauuacuuacucaucuuugguucuucuuuucuauuuaaguaauaaaacacuugaauaaaaaaagguauugccagcaaauuuacauccugugucuuagauauauggugaaaggcacuuaccuucaggguuucauauguuaauaguuuacccccguguauaccugugucaaucucauguauacaaguaucauguauuuauauuuaccuaguuaguaggcaaaggaaccucuguguguguguguguguguguguguguguguguguguguguggacacaggugugggagauguaguaaggcuaugguguggguucagcagccugggauccaacuuaaaauucaguucuccagagcagugcuguuguguuuguguaguucuacaagucaaaggaacacaacuggccuuaaaaagaggacuucugaaaugcaugaaaauacucagacuacaaccucagugagaagauucuuuaagcagaaaauucuagagcgauugcagagcuugugugaguccuuuuguaaguguggggccaugcugauccuagaguuccugucuccugugggauugacccauggaaacuuggguagaguuaagcugaacuggagcccugccugguugcucagugcuucaccagccuugaggccugcccagagacugugccuccccuaugugaaggacagaacaagaaaagcaagagacuaacagcucuuaagauucauaguggagaucaccugucagccccggggaaguucgucacgaaggauaacccugaaaagaucaucuaagugaggucacugcuguucaucucagggucacuggaaacuucagcaaaugguaaauuugcugagagcagagaagagauuagguuuuaauaugucccaaaaaaguguugauaauggagcugaaaagaaaaagaaaacaaacuucauagaaaauaaaucacauuuuauauuaguuuaguaaaaaccaacacuucuuauauaaugguguacugagacaguuaucgccuugacuccagguagcuguugcuguuccaguuaccagguagugauuccaggcuccaugccagccgcuugcuuaugcaccuaacauucacugucacccucagaggcagcacaguagccuugggcgucaagcacgguaaccugugcaggacuauacaucagcucucagacuucagagucucuuguauaagagaguagacaagcaagggugucaagguagauuuagcgggacuguuguugcuaaaggcauuuuaggaaaagaggaaauuaguaugaaaggguaagagugggcaagagugagugacuagauuuuuuuucuuuuuccuuucuuccucccuccuucccucucuuucuuucuuucuuucuuucccuugauaaaugauugcugucaaaaugucuauugucuuaauuaacuuuuagacuuaguuuuauaaacacgccagcaguuuagaugcucaaggagcaggguaaaucuucauguuaugaaauggcuauuuuugcuaugaguauaaauagucccaauaacguguauuuguuugcaguggaaugcuaaaauguaagguugacugauaacucucucucugacccucacagauacuucuugugccuucagcuaaggcaggacaucgccucuggccgccugcccugcuccuuugugacucacgcccucuugggauccuacaccuugcaggccgagcauggggacuaugacccagaagaauaugacaguauugaucuuggugacuuccaguuugccccggcccacaccaaggaguuggaggaaaaggugucagaacugcauaaaacucacaggucugucgaugagcuggcaggagacagacacauggugggagacagacauaggcguauugcuugcuuagcauugagaagcagcuuuaaugucuacuggcuccuuugggugcuuguccaacacugaugggcacagccucgagcucuugagaugcccuuguaugguugguuuuaguguaacguggagauuguguucuugauaaacuccuauaucagaguagcguauguucccacgugacuucucccucacccuguuauucucaaccaguacacaggaagcagacuugugugcauacuguaugacauaacuuuacauuucuucuaccucucaguauaaaguauuacuauauuuuauaagaaagccagggagaugguggggggagaugauaucaaaacacacuguauucauguuugagauuuuucaaaauaauacuuuuuaaaaagcuaaaagguauugaagcaucuggauuugaugugcagauagugacggauggggacagcugaaguuaacagcuggccccaugagucacagaaagcgucccuuuguuuaggugaggaguacuuaaauuacuugaaugguauguguacuuuugauuacuuucauauuucugucaagauggaguuuuauaugaguuuucuaauaucuuucuaagcuauaaaauauuuacauaugaagaccauaaucuuauggaauauugacuaaaaucauuugaauaacuuucagagauuuaaaacucuuaaggggcauuauacauuaacuuucauuuaaaaaaaauuaaaagggcaacauuugauuccccaccccaccccacccuuuauugaaauucuacucaacagacauuuuuuugucacccagauuugaacugguaguaugaaaugcuguguuggaaaugaagacuuuugagacagagaucaguauaccuguugcuuaaguuuguuuggcuggagaaauagaaauaaaaauacauuucucuaggcagaguacucugcugcuugccauacuuagaaaaucaaauacaaguaauucugaucaauacuagcagaauuaaacaaacaacuaggaauuuaccaguuuuaagauugcaaagucagaguuugcucauucucucucguuagcauggguugcacccguauugcuugggcuguucuccacagugagaaccacaaagagcaucauuucaaggagaaaguaggaaggguggaaguccaccuucuugagcacgcaggcuaaaguucugucuuuaguacagaacugucuuugguagcccuuacuccuuacccuggccuuagaggcagagcugcaucuugucuccuauucugcuuuucuacagccagacaguuucccccugcagccccaacucuccaggccugcgaacagccauaucugucaugacuacacauguuugcaucucccggugacacagugucuuuugauucucaggggcuuaucuccagcacaagccgacucucaguucuuagagaacgcaaagaggcuuuccauguacgguguugaccugcaccaugccaagguauugugaaugaauuccagcuuggugacugaaguucugagaaauuuccacuuucacaaagccugauucuuuuuggaaaaggugguuugucaccacuuuggucugcaauauuucuuggugauuacuuauaaaauucaugcugugggaaucccuugucucucuacuuucuucuucuguugguuuuauuaaugucucuguaagaguucuuacuacagaacugucuuugguaucccuuacuccuuacccuguuguccugguucauugcuaugcuccaucuucugcuaagaccauugguucucaaccugagguuuguguguggcccauugugggggcugaggaacccuuucauaggguuugccuaagaccauuggaaaacagauaauuacauuaugauucauaacaguagcaaaguuacaguuaugaaguaccagcaaaaauaccuuuaugguuggggccagaacugccugaggaacuguuuuaaaggcuugcagcuuuaggaaggcugagaaccccuguguuaggcccagugcugcugucugcgcgcugucugcgcucccuauuccuuccucaccucuuuuuuugggagaagaaagcauaucuugaagcaugggagggccaaaagcugcacagaugugcccuggcuccaggucaugaaaucccacagacuaaucucagaaguaguacauggaugggacgaugguggcuucagcugucucacauggaugggaugauggaggcuucaucuguagugcaugggugggaugauggaggcuucaucuguagugcaugggugggaugguggaggcuucaucuguaguggaugggugggaugauggaggcuucaucuguagugcaugggugggaugauggaggcuucaucuguaguggaugggaugguggaggcuucaucuguagugcaugggugggaugauggaggcuucaucuguagugcaugggugggaugauggaggcuucaucuguagugcaugggugggaugauggaggcuucaucuguagugcauggcugggaugauggaggcuucaucuguaguggaugggaugauggaggcuucaucuguaguggaugggaugguggaggcuucaucuguagugcaugggugggaugauggaggcuucaucuguagugcaugggugggaugguggaggcuucaucuguagugcaugggugggaugguggaggcuucaucuguagugcaugggugggaugguggaggcuucaucuguagugcaugggugggaugguggaggcuucaucuguaguggauggaugggaugauggaggcuucaucuguagugggugggaugauggaggcuucaucuguagugcaugggugggaugauggaggcuucaucuguagugcaugggugggaugauggaggcuucaucuguagugcaugggugggaugauggaggcuucaucuguagugcaugggugggaugguggaggcuucaucuguagugcaugggugggaugauggaggcuucaucuguaguggaugggugggaugguggaggcuucaucuguagugcaugggugggaugguggaggcuucaucuguagugcaugggugggaugauggaggcuucaucuguaguggaugggugggaugguggaggcuucaucuguagugcaugggugggaugguggaggcuucaucuguagugcaugggugggaugguggaggcuucaucuguaguggaugggugggaugauggaggcuucaucuguagugcaugggugggaugauggaggcuucaucuguaguggaugggugggaugguggaggcuucaucuguagugcaugggugggaugauggaggcuucaucuguaguggaugggugggaugauggaggcuucaucuguagugcaugggugggaugguggaggcuucaucuguagugcaugggugggaugguggaggcuucaucuguagugcaugggugggaugguggaggcuucaucuguaguggaugggugggaugauggaggcuucaucuguaguggauggaugggaugauggaggcuucaucuguagugggugggaugauggaggcuucaucuguagugcaugggugggaugauggaggcuucaucuguagugcaugggugggaugauggaggcuucaucuguaguggauggaugggaugauggaggcuucaucuguagugggugggaugauggaggcuucaucuguagugcaugggugggaugauggaggcuucaucuguagugcaugggugggaugauggaggcuucaucuguagugcaugggugggaugauggaggcuucaucuguagugcaugggugggaugauggaggcuucaucuguaguggaugggugggaugauggaggcuucaucuguagugcaugggugggaugauggaggcuucaucuguagugcaugggugggaugauggaggcuucaucuguaguggaugggugggaugguggaggcuucaucuguagugcaugggugggaugauggaggcuucaucuguaguggaugggaugguggaggcuucaucuguaguggaugggugggaugguggaggcuucaucuguagugcaugggugggaugauggaggcuucaucuguaguggauggaugggaugauggaggcuucaucuguagugggugggaugauggaggcuucagcugucucacaugggugggaugauggaggcuucaucugugguggauggaugggaugauggaggcuucaucugugguggauggaugggaugauggaggcuucagcuaucucacaugggugggaugguggaggccugugauaggaggccuggguugauugagaggacaccacuaacgagcauuccugcugagugauccuacauggaguggugagacuuuaggaggacaagaggaaaagugauagguuugguuugucuagagucaguaucugagagauucuacccauuccgccagucgcaugcaguuuaccaaguggcuaucgugcugccaggaaacguccaugcagagacgccuucucuuucuaggucugugguuaguaaccguugcuuuuguguuauauuugcaaaggacuccguugugcuugguggcuuuauuuuaaaauauuuuucuucauuucaaaauaauguauauuuaacauagaaaaugaaaaucacuuguaucucuuuguguagaaagaaaguuaaugucuugaagcauuuucuugcuugacuucauuuguguggcuggguugguuuuuuuuuuguuguuguuguuguuguuugugccucugaguagucuaauucuuggcuucuuucuaugagaucugcucugagugucuguuuuauuuuuguuuuacuuugaaauaggaucucacuguguagcuaugguuggccugaacuugcuauguaaaacaggcuggcuuugaacucaagagaucuaccugccucuguuucccaaguugcugggaugcaaggugugggugggccuccacauauggcuuuaguuguuuguauugaaauuguacuuacauuuacagauuuccucccuuugaguucagugaauagucucugguaauaucauauguuuagacugcuagaugaaacacuucaguuuuaaaaaauguauucauguauacugucuuuuugagauuugaauguauuuguuuuauaaacacaugaaauaauaaagaggacaccuugucugauguugucuguggcuggcagucaccuuugccugagacucugauaaauguuacuacuuaguaaaucugaucuuccuaacgcuggaggggcuuuguuuauuugcuugcuuuaguuucuuuuuauuuguagaagaaaagggggcaugaaagcacagacaguaguccccggggacgcuggcaugguccuguacccucuagugcugaaugguggacagcagaguggcugccagaccucuguagaaggcuggucugcaagggcuuguuucuggaggugccgacuguuagaaccagcugaugugacuacacagggagggagccuucagcaucuuaaaccucucaggagaccuuccagccaggcagcuucugggucagagcagacgacaauugcuggagucaguuuuuuuuuuuuuuuuuuauuguuauuuuguauugugcugaguggcacagcucagaccugaagauugagagugcuuuuccuccuugcacuucgugcccucauccaugacuguucacaaauacugauacauuuaaagcagugugggccagccauacaggcacugauugccuugaguacaggucgaguuguuuuuuuuuuuuaaguaaaauaaaaauacuuguuuguacugucuaaagauuguuucguacuagauugagcuggcuuugucuguuuccagugaaugucaccuccuuagcuaugaugaaaacaauauuuucggccaucuugcacccucucccauuggccauggguguugaugcuuuugacaaacacuuuaguuugaggccaaguaguuuggguaccuaugccuaauucaccugacuuucucugcugcuccuagauuguugaggccgcuaggauucccgagaguagaggacuggcuauuuuacuuuguuuuacuguuguguguuugauauguaagugggcaugcguguguggaaggcagagacgaguuuggagcugguuuccuccaucuccccauuggcucuugggucguugggcuuuugcagcaaaccuucauuggcugucggcagcccaguguguuaaaaccugcuaguguggucuacuguaaguuugugcccuuguauuugaauuauucagguaucauagcagaaaaugaaguuaguaucaauuaguuauauuguacguuaaagaaaagcuaaauuauguuauguucuuuuuuguaauggcgcuggcaaacaugcugucauugaauugagacuucuuaauguguugucuuugcucugugugaaauuuuaucccauauuguucaugauuucuuaacaagugcaccucucuugagucguacuguugaguuucucuguguugacugggauuaucugggcccugauggaaagagcgcuuguguguucugagcauugugcaucucuuaucuuaaguacugagugacuuuggaagggaagggucccgugcuuccuuuuuaaacacacuugaagcugacugcucuuuacuuuuguguguuuguuuaugugagcaaauaaaccaaacucuucaggcgugggauuauccuguauugucaucuaucccaaguuagcucucuggggaaaggaagcuauugaugacuuugggaguagucuccaguccuuuguagcugaagggcgcugagugagaacugugcgucagcacuuaggguacugaaugcuucaagggcucagaggccucaacacucuagaagacagguuuauagguauaaucuuaccagcugccagcuagcauagccauguaaguuuggugauaaaauaguagaauguaccuuagagcaggccaggcagccuguccauggggacagacuuguuccaggggcgugcucuguccuguagccucaaaauaccuccaucuggcgguuguuucuuccuuguuaacuuguuaaguuccuuguugcagaacuugaaaaugcauaaauuaaaucuuuuacagguuaugucuuguaaaugauauuuucacaucauuuugcaaauucaaccugaucccugaagauggaucaucuuauuaguggaguuaauuuaggcacucucacuaacguuuaaauguaaucauauuaaguugacauuuucacucauuugaaguuugauuugccucagucuaccuaacuugucacucuaacuguaccaucggucauacuuggcaggacucugaagguguggacaucaagcugggugugugugccaauggccuucucauuuacaaagacagacuaaggaucaaucguuuugcuuggccgaagauuuugaaaauuuccuauaagcgcaguaauuucuacauuaaaguuagaccagcagaggugagcaguguccuguacccuuggcguggcuaaagcacugucagugaccccuuccucuuaggagggguaaaugaauucuuccauaaaaauauugcagaaggaaacccuucuuuguucuuuaugcuacacaagacaucauucuugaugauauaugaacauuccuguugcugauuuacaaaauuacuagauuguucacaagaaggauucuuuuauucccucucccacacauaguaggagcuuuuuguuguugcugacucagguaagugauggaaugugcuguaguggcacugagcagucaguuugcuugggcagucggcaauucauacugcuuuucacagaaacaguaucgcagucgggaauguguuucuuguaugauuauauagauugacugacaguuauuuacuaaagaagaauuccuucugccagaaacgacugcaucugcuuaccguagcauauagcccuugguuaaagaauaggcugauuuuguuuuuaugggucuauuccagcuggaacaguuugagaguaccauuggauucaaauugccaaaccaccgggcagcuaaacggcuauggaagguguguguggaacaucacacuuucuacagguaagggaagaagucucauggaguggccagcuguaccuuguccaagccagaugggacggauggcauggcagaugcaucuguguccuacaucagaguuguauuucacaauggcuaucuuuguugccuguagccaugcuucagugugccaucugguucuuugccuccucucuccccaucaccaccaugggccuaucauugguccuuuuguucagagaggaucuauccugcucucaagccccuguguccuaacacacuagcuaccccagugugcugcuacugguuuaaucugauguccugacauggccguuucugugguuauugaugcagugucacaaccuuggguaucaaugcuauuucagaaaacucuuuuucagcacuaguuggguccucauugcugccagcccaccagcccgccagcccuucugccucccuuagcaucugaacuauucagucuucuagagccguucacacuggccuggccucaggauugcucucagugcagugcagucacuguagaaaucgggggucacaaacaccccaccuuucuuuaaucaccucuuuuccuuccaaaaguauuaucgcuccaucuuaccaccuuccuuguuuaauguugccuguuuuaaggauggauagacauuguuuugguuuauuuauuucaucccuccuguauuaucaucaauuccaaguuaacucucuggggaaaggaagcuauugaugacuuugggaguagucuccaguccuuuguagcugaagggcgcugagugagaacugugcgucagcacuuaggguacugaaugcuucaagggcucagaggccucaacacagucagucuagaagacaucaaggcauccugcuuggcaaauuuacuuuaccauagauaccucuggcuucuuuggccaguuacauacccaugcuuuccaaagcaaaagccccaaacuaaaaaaauuccccuaagagcuccuaaacuucaaaucucaguacgugggaaguagaagcaugguggcuuucugaguucaaggcuagccuugucuacauagagaaauaaccaugcaacaauaccaacaaacucuccaaaccuccuuugacuccaggccacagcucuuguauuaucuccuuaaggccuuccucagggcugcucuuugccaagucguuugcuggccuucauugccuucaucuccucugccuuugcucacugguuuaucaagccagaugggguuaaguguugucuccagacuuaggaccaagcacugugcugccacacuagccauggaauagugacaagcuagacagccucuguuuccccuucauuaucccugcgugauacuaauaaaggguccuuuauuucuuuaugggcuuguuuucaaaauuaaaugagauuuuacaugagaagcaaacaagcuguuucuaguguauaauaaugaaaaauaaugucaucaguaccacuuuaaaaacauuguaguuauuacaaaugacugguucuugcagugaaauggaacagauuuauuuucaagaauacucuaauaugcuaauuuuagagaagacauauaauucagcauauauuugaaucugucugacucagcuauaauaauuguagaaguccuugaaaaguuuagauguuucuugguagcuagaaucaauguuuucugaagaagugugggccugccucauauaaagcuagauaauggcgucggcccuauaggucuagaguggacagagagcaggcuugccaucaaagaaugaugccaacagcaagcauccuguuggaaaugacaggugcuaggaaugcuguuauugcuagacacacuuuauugucuuagagugcaaugguuuguuguuuuauagaaguaagaccaaaaagaaauaagugaugauguauguaaaacaucucacacaaaaugcucuaauggauaaaugucuggauauauacuuaaacuguaaccaacugacucuaaccuuaccagaaaaugaaugagaagacauuugauucuguagcgauccuuucauguggacauggacaguagaugucuucucagcccaugguaaugagaacgggcagcuuucagauuggguggagggacagcaaaaccaagcucacccucaagcucauuuuaaggacuaauuguuuuauguucuccuaagacagagcauuucagcagcggcucuagugauggcucagaggucaaggcuugcagcacuugcuuuuuccuaaauuuccaauacgcugaacaaaaaaguugcuucaagucugcaucccugagcugucagaggagagugcugacgaggugcugccugugauucagcuuucugugugugugugugugugugugauugugugugcacacgggugugugugugugauugugugugcacgcgggugugugugugugauugugugugcacgcgggugugugugugugugauuguguguguacgcgggugugugugugugugauugugugugcacgcgggugugugugugugugauugugugugcacacgggugugugugugugugugugugugugugugauugugugugcacgcgggugcauauaccugcacaacgacagugagagcagacagagacaggacuggggcaggcugucacuugaguucaugguuuaagaccagcucaagcaacauagugaaacccucaaacaaaacaaagcaagcaacccauugagcugugguuuggaugugucuagaguugaggugacagugggccccaggucuaguuacaaaaaguaaguuaacaauugcaaaccugaaaaaguuuaaauuuucuuuaaaauuguuuucuuaagcauaagaaguuuguuuuaaaucuauuuuguucaaaaaaaaaaacagaaaauguauuagaauuugaaagaggauuaucucuugaaaauaugugaucuuuaaaguuuucuuguaguuugguaaaacaggugcccugucuguaauuucagaucuuucuuugagaucucuuucagggcccagugcaugugucuuuguugcaggagucuuuaaaucuucucuauuccugaguagacuucguuaauagacaagaaggaucuaugugucuuuaaaucucuauuccugaguggauuucagugacagacaagaaggagccaugggauuuggcuagagaguauuucccaaccucuggcuguaccgcccagcagccuuccucccauuucuauaacugauugcuuuccugcagagcaguucaaggucauguucauaaagcauugcgagcuggggagacuccagccaucaggaggcagccgggggugaagagcccccagagugcaugcucucagcacagcgcucuguuguaucucugaggguagaaaguggagugugcuuuaugacaugcacauggcuuuauguguccaccacaugaguagauggggccaagaaagccugaugucuuagcuucucuuauuugauccugacugucucucugaggaaacaggauuuagaugcccucugagcaggauuauuccuuaccaccuuaacucagaacucgucuuccccuaagccgaagauuuccaaaaucuuaugcagaagaucugggaauaccuggaaugauuuuagggagaaaaaaaaaaaacuuguaaaaaacugacuuuuccuuggaaaaugauugaaaucuccauauucuugaacucucagcuaaagucuucauuaguaaauuguaagaucucugaaaguauauuuuuguuaaguguuuuucugacucagauaauggaaagaugauuucaguuguaucaaaaaagcguacuuauuaaaagcaugcuuuacguaaaucagaaaauuauuagucauuaaguuugaauucuugcauuaugaacccaacugcuugguagaguuacaccggcaagaaagaauauuagccaccucugagaacuacugccuguucuucaggaacagauugcauagcugaauagauucccugacuuagaugggguuuuuuccuaccagaaagaggcauaaacauuaacaauugcuaaugauaaugggcuuuuuacuugacacuuagagcuagcagcacaaauucagacauauguguuuacauaagugaucuacacuaaaucaaauaaauacucuugauacacacucagagcagcugcucuuuugguugggcuuaaaaaaaaaugugagcacauuacuauuacaaaacuaccuaugaccaccucccccucccccaaucuggugcugcacuucagccccagcacuuaguggacgaguuggaggccaacuugucucaaaaacccaaaacaacaagaaaaccacacauacagauaggaaggauguuuuuauuaaggcuguggagcaguaauuuuuugacugaucauauaugaaaugagaacuuaaaauacauaccugugguuugguuuucuuaauccaccugaagacuuuguccuuauuuuauuuuauuuuuuccuucuuuguaggcuugugucuccagagcagccaccaaagaccaaguucuugacccugggguccaaauuccgcuacagcggccgcacgcaggcacagaccagagaagcaaguacccucauagacaggccggcaccacaauuugagcgugccucuaguaaacgugucucgaggagccuagacggagguaacacguuuauacuuuuggauucuacucaucuuuucuagcccaguggugucagaaaacaauaaucuagucauaagaccaugagacacccucuagagcaguggucuucagccuuccugaugcugacaccauuuaacacaguuccuuauguuguggugaccccaaccauaaaaccauuuuguugcuacuuuauaacuaauuuugcaucuguuauagauugugauguaaauaucugauauguaggauaucugauauggaucccccauagaagucacaacccguaggauugaggagcacuggucucaagugauagacaguuacccccaaauuaguaaaauguugcuauucucaaaguaaaguaauuguaugcagguugucacucugaacauacauuuuuguuguuauuguuuauguauguuguuggcagcauacauaaauaguauguauuuuuguguuuauaagcuauuggaugaauauguuucucuugguuuuauuugauuaugaccucuaauguggcuuaauuucuuuuuuuuaauacauuuuugugguccucuggaagaguauuaagugcucuuaacuacugagcuuucucuccagccccucauuuguuuauuauuauuuuuuuaaagcaugcuugcuugcccucccucccucccucccucccucccucccucccucccucccucccucccucccucccuccuuucuuucuuucuuucuuucuuucuuucuuucuuucuuucuuucaugugaguacacuguagcugucuucaggcacaccagaggaaggcacuggaucccauuacagaugguugugagccaccaugugacuugcugggaauugaauucaggaccucuggaagagcugucagugcucuuaaccgcugagccaucucuccagccuccaugguuuaauuucuuaaacuuguuaguugcucacauugcucuaugggaauuuugggguauguuugcacauggauuccaguaauuauaaaacaguuauaaacuacucagauuugaaggugugcuuucagaaguuuaccagacucaaaacaugugagaaaucauucuagguuucaaaaguauuaacuuuaaauaugauuuuaaauaacaauaacaaaagaaauacauacucaugugucuggggagauaguauaaauauucaugguuucucuuagaguucuggugagcuacauauuuguagucuugcauggcaacauucauggauucaggugauguuucuuuuccacauauuugucauaucgcuuauuaguaaauuaggaauuaauaauguuuuuauacaaaagaugauguuacauuuuuauuaaacugcuuuucuuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauacaaaguuuacguguccaaugggccucucuuuccagugauggccguuaaacugcuuuucuuguuauauaacaaaaauaauauuaauuuucauugaaaaauaguguuucaaccuuuuucauuauauugaauauuaauauugaauaguuugaaaaauuuuauuuuuauugcacuauuagcaaaaauaccauuuugauuguuguuucuuuauauaacuauagaaauaugaaauuuggacuugaauaguaagauguuaaauacuuagauaagacagaugauuccuagacuaacauucuuucguuaguagaggauucucacagguuagccuugcucuauuuuuccggguagaagaaaugacuaaauaggugcaggcacacacaguuacuucccgggcuuugcuuguggcuauuuugauauaugugguuguuaacgcacaagagucuuccuuaaacuuuuaaggaaucaccagaaaaauacaggcuucaagcaaauaauuguccauauuuccagauaagacuauuuauagagaauuagcagugucagacaacaacuaaguauauuccguaguaggucugaacaaaacgugccaguuggaguaggcaucucuugagucugcucuugccaugaguagaugcaguugcuguuguuucugccccagaggagccuucuggggaccgucgccagcuuuuguucuaagacuggaggccguagaguucucauguuguguuagagcuaaugaaggacagucagccagggcaucuuuguaggccgugcacuucuuugggaaaccugccaucuugauugagcaguuauuacagaaggugaacaguuuucccgaggaaaagcuauaggcguagcgccaauccuuuauuucccauuugugcuuuggacacugugauccaucggaugggcagggcaucaaaaggaugauuguguuacugugaaaaguaggagacuuugcuugcuaguauggcagugaaaucuggcuggggucuguguucuguuucccagcauggcagagcugcucugacccagcaccgagcuucuuccuccagccuuuuaucaggguuccaucaguguugcugauguguguuguguuugaagguuugaacaauauagauaguugaauaaucuuccuuuagugauugcaucacaggcagaguugaaggugacaucagaagacuuaaaaguaaagaucacccagagcagcugucguaaagcagggagccuccucugagguuaggaacaacagcaaucuucauguguuuucugaaucugaguuaucaauagacggggugcugggcugcguaaguagaguccucagggaaggaagccuucucagaugccuagaaggaugaaagagagacagccaugacaagagaggagaacauaggucaucccagguaguggaaggugcaaagcggcucggaagugagagaccagaaaaaagacagcacacucaggccuuguaggcgagccugcugcugcuagcuaggcuugcuggcuccauucuguaggaagccuuggagggauccuuaguguguugguccuaccgugcagagcgcaguguuaguuuugaagaaucaacuggucccggagaauggugagagaagauugagucaggaagcccacagacugcaugcaguggucacauaacagugucugcuguggucuucaccuuagguuggagcagaucacuugguuaccacacaauagaaugggcgaguguuuaaaugugugccaucaacauauugucaacuuggcuuuguaauuuuuaauuuuauauugacucauauuucaguauuaguauaguugaaacuaucuuuuggucagauuuuucauuuugucauaauuugugauggcagcaagugcuuaaaauuguauaauaagucaaagagguaugcauaauuauaugcuucuacacuggaaaauuaguaaaaccuuagcaaaaacaagcaaaaaccagcuuuaggaaauaaauagguauaauguaagaugugaacucauuuuaauguuguaacaauuuguguggauuuugaaaauacauucaagggcccuguuugacuugcuaguauuaaagggugauguucuagaauuugagguuccugacuaaagcaaaugggucuaagaagaaguaucauuugaugcaaaagcagggcuaggaaaggggcaggucguggcgggacaggcgagggguguggaguguuugguacuguguagaacaaagauugaaaggguagaccccuuguugaacugauggcuuacacacaccauccuuuaacaguuuccggcccucuggguuuuuuguuuauuggaauuuuucuuggugcauggaaaaaagcagaccacgggguguaaaaaguaaagcacuuuuuauaaggaggaaaagaccugagggguauuucauuguucaggaggagucucugguagagagacuugucacuuggcuugcugacucuugaggugauccaacacuaugacaaaaacacuaguacaguagguucugccucacugagagagagagaggacagcagcacacaguagguucugcuacaaugugagagagaggacagcagcacacaguagguucugucucacugagagagagaggacagcaacauacaguagguucugucucacugagagagagaggacagcaacacacaguagguucugcuucacugagagagaggacagcagcacacaguagguucugcuucacugagagagagaacagcagcacacaguagguucuaccuuacugugagagaaaggacagcagcacacaguugguucugccugacuaugagagagaguauuggugacauuguaauucugcaguugggccgagagcuccuccuacuggccaaguaccuggugagccacaugcucaaaaaucugauuuacuggauggauuuuuaaaaacucagacuauuaguagaguuuuguauuaguuuaaaaauaaguuuauauuacauauugauauauccaaaguucaaacacuauggucuagcuacauuugguuaagggguucuguucuucaaagcuuuacauucacuggucuaauguauuucaacuucucuucugauuagccccgauugguguuguggaccaaagcccuccuggagagggcucagugccuggcccuggaguuaucagcuauacuaccauccaggauggccggagggacagcaaaagcccaacaaaagcuacaccccugcccgcugagggaaagguauggccuauuagcacuugugcugcuguguaggaugcucagaucagagacucucugcugccuuuaguaguuaagacgucagaauuucuuguuguuguguaaccuacgcuuacaaucuucuauguuucaaauggaggcugcuacuuugcacugugauuucuaaccuuguuuuuauuauuuuucagaguaaaauauuuguuuccguguaaauuauacuaaugcaagaacagaguagauuauacaaaaauaagaaagcaauguacuggcauuuccuguuuucuuaguuuauuaucaguugacuuaacaaugauaaaagccaugugguuugaaauugcguauuuuauuacuagucaauuuuaaagguaaucccugucuuuuauuacauuaauuuaauuuuuuaaaaugaauccacuaauaauacaaagcugugaauaagugcaggauuauaugcugucucugccuuguuugugcuuacacuauagcuaaugaacugaggcauuccuuagucugucaguuuuguuauuuuguuacuaaagucauuucaagugguuaccagucacuugacuaaagaacuuuugagcuccucacaaaucauuuccaugcuugcacaaagcauuauuuuauauguaacauuggaaguagaucacacacacaaacacacacacacucccccccccucucucucacacacacacacauacacacagagucucucucucucucucucucucucucucucucucucucucucucucucucucucccacacacacacuuccucucccucucccucucccccucacacacacacacacacacacacacagccuggaucauccuuuugauacacugugccuuuuuagcucuggcuuugaaaacuguagugacaugcagaaugaacguguaaaggaacuauuaacugcugaagcaucugcugauacuguaggaauucuugcaagcacugacagccucuguggccaccacagacacaugccacaggacaguguaucaaacagcaggggauacgaaucauuugcauccuuuuguuaaacaauuugugauugucguguugaaaaguaucuggcuaaauaccauuuauuaaaaagcaacacagcuuguguucuacaugauauccuucaagugcuaaguggucagaaucuuuucagucaugcuuacagaguaucugaacaaacagcuacugaagagaaaguucaggauuucuguucaguuugucuucaguuuauauauguaauuaugaaaaaaaucuagacaaauauuguauuaaguucuaaaugaaaucuuucuuaucuuuagcaaaugacuaguucuaugagcauuuuucuagcauuuuuagauacaugugucagcagcuagguuugaguaauguuagcuaaaaccucauagucauuaauauguguaaauuuuaugugauaaaaggaguccaguuucucuccuuaaaaguggauuauucaguuaaguuuuuaaugacuguuuuuuaugaaacuugcuugggcgugaagcuuucacuaauguuucuucuuuucuucuguuuccuucuuguuucuuugaaaauaaccauugugggauucaucaccaaccauggguuguuuaaauagaccacuugcaugugcccccugucaccucucauuugcuguacuucaucuuuuccuccuuaccuccugccaguccuugaaguggacuugcugucagacauuucagaggaagacccuuuuggggaggcugaucagaccacacucgauagcuucgagcugcuuuccaugggugggacaucagagcagggugacucugaaguggccacauuggauucggucuuagauccuauuguagccccucgucaaccugacuguccuuccaugccugagaagacugucaggucggcugucccuaaggaugcugagcuggguuacuucuccuuuaccuuucacaaaugcuuugccucuggcuucccaucccuccuugaugaagauggcuaccuggcguuccccagccuccccaagcucuggguuucuuuccucccugcugauguccagcauugcguccccaucacaucgccuuccuucaucccuucacuccuccucagcuucgggcugcugcucucggcuucucagucgguugcuuuuucucuuaccuuuucccuuccucuggcacuagcccucugcuaucuggaagggaaggccacugcacuucauguuuuuuaugauugugauuugagugacaaaccagaggaagaagaagcagugaccaucaugccuccauaagcuacagugucugaagucuacccuccuguuuuuguuauguucccccuuauaauauagagucuagccaugugcaucaauuuuacugacuacccucauaguauguacacauuuacacacacacacacacacacacacacacacacacacacacacacacacacacgcacacacgcacgcacacacucacgagcaguaaguuaagcuacuuuugcuauuugaaguccaggucuauacacauucuaaauucagugcaaacugguaagaucauuguaugaauaucuuagaucauacaauguuaaaggagugucugagcauucauauuggcuauguuuugaagauaauaaguaucaauauuguuccuuaagcaugugaacauuguuuugaaacaaaacuuagaauguuuugggcauaauuguaauugacacgugucaggagaacauaguauuuuaaucuugaucaaaacucaauauugcacuugcacuuaugagcccaagucuguauguaaauuacacuccugauguuuuaagucucagaaacuccaugucuuuugcacuuuuagcauuuggggaccaaguagauaaauuuuacuuagucuucuuucuuuuacccugaauuauguaauuauauaagaguaauuauugagcauuuuauaagauagaugauaauucgguuauaguguguauuaaaaaugaaccauggcuuugagauauuagacuaaacaugagguugcccuucccaucuauguauuuagaauuaggugucugagacuucuuacaucuguguaagagcuuguuugacguguucuaccuccgcacuacuaggaagccagccuuagcauguacagcacgauuuuaauuauuuuguucaauauggucugguuaauuaaguuaaaguaucuuguaucuuaggaagucuaucaacacagaguacauaucauagaaaaaaaggcaaacaaaaagaaaaauauaagaaauugaaugaauaugccauuguagaagaaauuguaauucuuuacauuuacuugagaaauaaccacaaaucaacauuugagugaauuaaaugucgaccaagaaaguagaagcugacucuucccaaguauaguagcuaugucaugcuuuucaccucugauacagagguggggaaaagcucuuagcucccacuuaccucucacacauaccacagaaugguuagaaaacaggauuccuuccacucuguggcuuugucguggcagcccaggaggggagcuccuggaugggcuagccugggaagcugacguuccuuuugugucuguuuuuguuucugacaugagucuccuaaugucaacauuuacucaauauuucuuaguccuacuugcagauugauuucuggggucauuaaauauuuggaaauauccaacugcagaaaacuauuacauaaaaauuuuauggaaaguggcaauauaugaaagauuauuuguaaauaucuccuuuaauaugaaaaaaaagcuaauuggcuaauuuugccccaagaaaaccuauguuuaaaaacugacagggcaauguauagugauguaaaauuuguaaccuacucagagcugaagacaaauuuggcgucucuguaccucguuccauugcugcuuggcuuuugccaucuuugcacucucauuuuuauucugcuuaaaaaagaaaauucuuuaaaguggagcgcacucuagggacugagaaagagugaguugcccuuguccaucccacccacgcaaaggaccauuucaucaugcacagcaagcaacuagcgaagacagccacuggcuuagcguguccugggguagggcaagcuuguccugccacagcgcccauucagucggacacagcaucucugcccuggagguggagcccugccaggagcccuccuuucugccuguguggccaguggcuuugcaggggaagauggaagaugcagagauguccccagagcaggugucugcuucccuuauguuaaauaagugccugcugccuguugcuccuuugcuuaggguuggagugggaugggagaugaugguggaauguacucagcuuuguuuguugugacucuuaagauuuuuauucuuuuauuuuaaaaucuuagauuaugaaauucuggguuguuugugcugcucgaugacugauacacuuguguuuauuugccuuuucucccugugugugauuuaauuucacagaaaaauaccuugagaguagacggggauaauauuuaugucagacauagcaauuuaauguuggagguuuguaugaucuaaaaaagcauugcacucugcccucuggcugccaggcugcuguggacgggaggucacgcagagacuggcuggcugcucucuucaagcacagugcaugcaaugcauggggcucuugaucuugggagugcauguuaccaguccgccuugguucuuagauggcgugggaaggaauauuucuacuguaaguuuucaagcugacagcuugggagaaaagcucuucuuauuuaaauuagguuuauucuuuacuaaguaagccuguuuuucuaauagaucaccuuuaagcuauacaauaugaaguaauacaaccucgagauuaauauacgucagaguagguaauuuuuauauaauguuagcccacuugcuuaacccuugaacuauggcuuccccugcuugaaaucuuacugcuaucuaugugacgagguauguggucccuuuaaaguguuggaccugagaauaugcuaguuaauaggauugucccuacugaaagaaaagaagagaggagagagggugggagggaagggagggggagagauauagauagagacauugggaacuguaaagugugcuccccaugucacaaaaggacaucuuuccuuguugugcugcaggguguacagcauauucagggacccccgcagcucuaguaaucugacuaaucucuccguugcuuuggcagcuuugagagugugaagcuguauugucgcuuaccuuacuaaagugcuguagaguauaauaaguaacauuguugugaacagacgcaagaaacgugccugaucucaagccagucauuccccaugccaugcagccguuucagggucuccugacuuggcagauggcuauagcagcuccuggugagcgacucugcuugugcaugacuguggauuagcugguuuaccagaugcaugaccugccugcccuaugggagugggacuauaaucuacaggcagccugguacuuuugaaauacaacagaacauuuaaaaugccauucauucaaauuccugaacauuggcuauauaugcaguacuuaccagagccaguuuccauuuugcuuugauuuuuuuguuguguuuuuucuuuuaaaucugccacuuaucugauucuucuggguccauggcagagagaagaacgaauaggccuuucucuuguguuauguuauuacaugagaccaguaugccguucauuuagagagagaccaagcagaaaagucucuggaaggaguuauuuuuauucuuuaagaauuagaagacacuggcauuugaauuuccugacaaagccaucccuugguuuuucuauuuuuggugaugguucugggcggguuugcucccuucaggccaagugugucucuaacuuuacccuucuguauuuuacugcauucacagaauacaauuuaggaagacccuuuaucccaaagauaaaugugugcuaacaaagucauaggcugcaauuuaaacccaaguguguguauauguggauucuuagccauuauagucaguuccauggcucccuucuaaugugaauaauuuuaaaucauuuaaaaucucaaauagagaagaaauuaaaaucauucagauaugaguaaaagaacucaaugacuuuguuuucaaauuuuuauguacucaggguuauccacagauaauaacauggcuuuugagacuuggcaucuuucuugcuuuauuacguuuuugaaucauaaguuuacuuuauuguuuuuuuuuuuuguuuuuuuguuuuuuugguucugcuuuugcccugcuggguuuuucguccuggauucccccuuugucauguuacauguugcuaggaccuggauaaggcccaggaggccauucugaaacaucaggcuagcauuagugaacucaagcgcaauuucauggcguccacaccugagccucgccccagugaaugggagaagcggcgggucacaccucugccuuuccaaccacaagcgguaugucacuggcugccucucggcucucugucucgugugcuccugcaacuuguuugucgauucucagacguuagaaaauguuugcacauaaacucuuuucuauugcuaacaauuuuuaaacuacuaaguauuaacaauguaauauuuguuaguuuaauucuuagguaaauuuuaugcacugcaaaguacuuuggaaauauuuucagaguaauuuuauuguacuuagguaauaaauuagcaguauugaguuguuaggccaacucaggaacuaaugcaagcugugugucuaagaagcuuaguuacuggcuucgcaaauacagauucugcuuugugaaggaaaauauauguagauuaguuuaaguuuauuacuaugaagauaaggagcuaagauuuaccuuuggagauugaugagcucuguuggaaaguucugacauauuacaaaauacuauacaucaauacucuuagggcacuucuuggaaaaacuuuuaaacaccagugaaccccaaacauucuucuuuguuuuuaccgaagguaaggccuuacugcuuacugucacaaggauugccuuuagaguccucucagauuaucucugcauccauuccauuuucugccuucauauuuuuuuucuugaugcuuccagauacaguuuauccuucuugagauucauaguuugcuuuucacuuuggaaagcugcugugguagaauuuauuauguaccuuuccuuauguagugccuauugcccaauuguaaacauuugguuuggauacuuccauguugguuuuucucgccccucuucagcgcaagccccuaguaguaauaugcuucuaaguucguggccuugaguggaaagcagagcuuuaaaaaccagugaacaaaagcgguuggugaacugaaaaauaaagccugucaaauggagagguuagauaagcugcacgcuguguugugaaggaagaaagcagcguuuacuggccggugcuuucaacagcguggucuagaaucucuagagaagcagugacuucagaucuaggacugagcggccuuccucuguguacuguuccaucugguuugucccacugccccaugcacgcauccucuuacaucugugucgcuaaggugugaugcaugugucuuuguguugauugugucauuguuuaaagcaauagagaaaaggccagaauccuuucaaggauauucugucugcgagggagcaguacccgauggcggcagcacagguaucaucggcaggggcagcucaggcgcacaggugcuuuccucucaucgcugcgucugcuuccacucccuuccuccagagaguucugcucacauucaggaauacgauuuuuaacgucaauuuaucuuucaaauaguuuuugaauguuuaaaaaguuaggcucauaacagccaaaguuccucagaggaaacaaaaaacaaacaaacaaaaagaaaaggcauggugacgcacgccaauaaucccaguauuugggaagcagagggaggugaguugaaggccagccuggccuucugagugaguucuaggacagccugggcuacacagagaauccaugucuagaaaaaucaaaccaaacaaaauuaacaaguuaggcucauguguauuugggacuguaggaacauuggggagaaauccuaaccccuuacuugcguuuugaaaguauggaagucuaggaagaucagccauguuaggugaugcaugacccaucauugugcuugggaaaggaccuucacgggacugcccuggacugccccuuagcacagcugcugcuacuccaugcagcagcuucuuccucucugucccugaguauugucacaagggaggcaacacuucuuucuacuguacuucugcucugguugcuuagcuggcuugguagcccugagagcuuagagucugcuggggagggagacagcaggcgcacgcaugcagugauuagagagugucauacacuaagaaugucaaaagguaagucuuaguguguguuagaagggucaggaggacccuuaaaguggguucuuaauggugagaaaguuagaugagaagaucuuucuacgcuaaaggaagagcauacacaacuguugaggcuuaagcuauaaggacacacaauggcuaaaugacaagggaguauuaaucagaaugcacagaagccagcucaauggcaucauuugaagggcuuuuggcaauauuaccuagaauuuuggugaagauauuuaaaauuaccauuuuucuggaucucauguucuaagaauauauaauaauauaaaauaauguauagaguggaauuauaugauguuuaaucaaggaacguuccuagagggauuauauacacuugaaaugacuguauuuucugucuuguguauaaaauauauacgcguauacuacauaucaggugucuagcaccuguuuucugguugcuucacccacaaaaccuuuauggcccugugucuguguucuuuuguucucuugagaugacagaccacuguuggaagugugcgcucagugugcucaggcucugacuugagcugaugccauuucaguuguucuaugucucccuuucacuguugauuuuacaggguuucuuauuuaucuucagauaaucauuauugaaaaguagaaaaaaacauguccauguauuugcuuaaaguuuccagauucucauaauaugggucuaagaaaaauaaucaaaagauuuguguauuuuucuuuugugugugaguguuugccuacauauauguauguauaccucaugugugcuuggugcccagagaagucaaagauaaggcaucaaauccccugaaacuggaguuacagaugcuugugaaucgcuuugugggugcugggaaucgaaccuggguccucugcaagaacaagggcucuuaucugcugagccaucucucaucucuaaccgaccauugagguagcugguuuuuugauuuuuuguuuguuuguuuuguuuuuuguuuuuuugggguuuuuuuguuuuuuuuuuuuuaaagaaguggugucuuguuuaaaaaguauauacauugaauuguuaaaauggcuuugguuugaccaugaauaauuuugggggcagaacagcacagaaaauuagaggccaauagauuuuuagucuuuaauggguaaguaaccacuguguauucuacaacuuguauucucuugacucugcaugagagaagagcuacacuuuguuguaagguacuuuggggggcugcaguacugaggaugggucccaggaugcugagcaugcaaggcaagcacucagccugugcagcaugccacacggugagagaccugggaaaacacucgauccagugcacacauagcacgguaauugcacaauuuuuauuaagaucggaaacuuuucuuucucugcugaaaauuuuaagaacuugcacacucucccacucugaagaacacuuuauacauggcaagcauuuaucuuuuuaaaaagauugcuggagaaugugguuuauuaagaauucucacaaaguuccacuuagucggggcaggagggguggaaggauuuccuaguucauucuuuaugaaauuccuaguuucugaggauugucacagcuuuucugucacccucaggcuggcuaggaaguauugguuaagggauagaaauaugaacguuaaauauguguggaugcugaguugucaaauuuugggauugucuuauuuuucaaaccauuuuugaaaacaaguggaccccacccgguuccgucaggacuguuuguugcaguuauaugcaguagagaggagaacauaggaguugggugguuaugcuuugucacgagggugcucagagauccagagugcauauggaagugcauggagagcagggcccagccaggaaagaggcauuucuaaagaaggggcugcuggagagagcucucuggggaaaguggccaaggggcugccucagauggcaguguuugagggcuugaggggugcccuuuguuacagugcgggugauaaauggcagugcaaacgcuggcauucaggcaagccuucacuuucgccugcuuccaucuccaauguuuucaucuuugcuuucauuggaugcuguucuguucuuucuuguauaaccuucuuuccuucaguaggucacugcugucugucuguccugauguguugcuaacucuuugccucuuccuuuucugaccucuagagccuagaagaggagauaacauccauucuguuuagugggcagggcuuuucucuuagugugaaagccuccuucccuucagccaccacuuggacagcagagggcccuguugugaacgcuaaugcacccagagagccgcuuucuucuucgcccuuuucacacucgccugaggugcauuuuacuucauuuccccacccugcuacugaaagcucaugagacggguuuucauucugggggcauuuagguaucuuuuccuccacuuauuaguaaagucacugggagaaacaucaagaaacaaugaauacgauuauagagcaccucucauagacuggggggaaaggccagcauguugagaacuguugaaagcacugaggcccagagcuguaguuauucacagaagaaagccucaccuaagcagagccagcuaagagcuuugcagagcucaaguuucaaaacccaaacuccagguaucuucugguaguuuauuauuuaaaacagcacucacaugcccgaccacaguugcugcgguaaguguguuggaaugauccucuggaauccugagcaagccaaaccugucuagccauuggaggcucaguaacaguucugccacuggccuauagugagcuggagaugcgucccuuagagaugcucugaguaccaggcaccuucaucucugcaggagucuguaguuaaaugaacuugcuuauaagagcaggcaugagguuuucaguuuacucuccgcaacucuugagucuucaguaaaauuggaaaggugauucuuugaucuauugaucacacuuuuaccuggcaugacaugcauuuugagcaacucagacauacaguugccaugacuuugagaguaaccagugacagaggcuguagccuauguuuguaggaacuacagacgauuguaucgcuuagcuuuggauguccuugguugcugggacccaugaugugacugaugccuauuaggaaaaccucugaguacaguuagugucuugauggcacaacaguuagcguuccaguauggucagaggaccagugcacaucugcauucagugugggugauauuuugaguaaacaguaccgcugccuggaacuaaauuauuuuuuguuaggucacuaauaggagugccacaaggauauaaacuuaucucacuguuuuauuucuguaaguguaagguagcaugaagcauugagccuccuaaaagaacccugcaccccaguuaauacuggacuagagaaauuuauguuacuauaucucuacuucaaauugagguauuaguaacuuucuggaaugaacaucuuaauguaaauagcuguuugaaaccaaccacaauaaugccaauccaagaugcuuuuuuuaaaaagcaucauccaaaaagaaagaaaucaaucaguccguccuugaugcugcauuuguuuaggacuuggggucccagcccuucuucuagauucggacuaaaggauuuggggcacagaauuuuaauuugagaacuuuauccuuuaagccgauuaguaagcuuagguauaagagcauauuuuuuuuuuaacauuuucaaguccauaaauuguccuaauaauuuuuaaaaauuucuuugugagaauacuggcuguguugguuguugguuuguuuuuguaaguguuguggcauuugucuaauuguccugugugugaccuugagcacagcguucaguaggguuaauucucgcuguucuguguuugcguugucacaugucugucuuggugguuguugagguaaaaccauauugauuuuguguccuugguugcuuuuuguuucgcagacucguccucccacgucggaagggccuugcacuggacccagggacgcuguuaagguucuccuuccauguuaaugccauucccucacaccucucauccgccucauggucacgcuucccuuucaguccgcaucacagucaucuuguucuuccucaugacaugaaucugccaucaguuaauuugggcuuccacuguuuuuauuuauucauauauuuuuguuuucccucauccgucuuguuuuuguacagaguucacaugagacucugaauguaguggaggagaagaagcgggcagagguugggaaagacgaaagcguaaucacagaagaaaugaaugguaaagagaugucaccggggcaugguccuggggagacucguaagguggagccuguggcacacaaagacuccaccucccugucuucugagagcagcagcagcagcagugagagugaggaggacgugggagaguaccagccccaccaccgagugaccgagggcaccauaagggaagagcaggaggagugugaugaagagcuggaggaagagcccggccaaggagccaagguaguagagagggaggcagcagugcccgacgccgucccagacagacaagcaggggccagugugcucccaguagaaacagaggcccaggaacauguaguugcccaaaaguuaccuggagaaaagggugcacacggaggcacugcugagcaggacccgagagaagaagcagaggaagacccgcacagaguuaauggagaggugccccaucuugaccuugaugguuugccagagauuauuuguuguucagagguaaaugggagucucggcaugagcuaagcuauagcacuguuucucagguggaaacgccugccauucuuccccuucuacugauucuccuuccgcuuugcagcaagagucugguuuuucugucucgugggaagaagggaaggcacugcucugcugcucaucugcaggucacacuugcugccuucucugcugcuguggcuggucugcaggccaacugcagcugcagccuuuugcugccuucucugcugcgguggauggcuugcaggccaacugcagcugcagccugccuuucuuguuuccauccagguuuccuuugcauguucugcaugcuuuugucuuccuuugcaugccuuccucaaucacaugccguuucucauggguuuauguaguaaaauguguguguacuguugagaguugagaggcgguggguuuggugugcgcuccugagguaaugacugcacgugacucccugcaucuuuccauucuucccuagagcucacagcagcugcuguagguaauggggagaaugcuguuuuuugggugccauugcgacuugucuuuagaguccagggaaaaugugguuuggcugagucuuuuucuucuuggcauccaaggacuaaacagugcacugcaagcacaggcuucguguucuuccaucaguccuggacucucugccauuauuuuguagaccaaucuauauuagaugugucuccucuuuguugucaagaaagagaaucuugcauauuccucucagauugguucuugaucgugaggggcauugacucacgugauaguuuacuugagcaggaaugucucucgguuccagaaggcccacaguugucaggguuugucagcauuucucucugauggaguggacagucuuuaaguggguuuauuuuggaguaaauaguuuacuuuaaauuucauauuucacuucagaaaagacaucuaaagagucuuuugagcacucugaucugccuuuuccauuuaagcaguuacccguguugggcgcuuucucucaaagacaugcucgagcauuuggcagugcuguagucugcuaugcuuugaugcccagcaggguuagcagacucuguaccucuccucaugcuuaaaauccuucagagcacuuaacccgacacugauggacugcuuuuagauaauaacauuuuauuguacuuucugcgaaagaaagcaaacuuucagaugaguguaauugaaaauacucauacuugaaaauauccuuucugacaaggguuucagaaguugggggaaaaggagcaaaucuuggaucuuagaguuuacagucaaaaauaauaagucuucacauuugguucuuuaagugucaguaaagauaaagguaccuuuaccuuuauacaguacacgcuguuaucuuucauuuuuuccaaaguagaauggacauguguugguguaaugguuuaggaccagcacagucugaagaguagugcaguucagggaaccacuguguuagcuuagcuuagcuuaguaugugugugugugugugugugugugugugcaugugugcacgugugugcgugugugcgugcaugcgugugcgugugauguacuuuaaggagauacaucuuuuauaucuuuuacuuuauuugcuuuacucugacuuuccaugcaugaauguauauuuggauauuuuuaacaauuauuuuugaagguuccuuuaaccacuucuacuucaugaccacuagaauuuaucuuucccuuccuuuuccaccucagccaccagugguaaaaacagagaugguaacaauuucugaugccucacaaaggacagaaaucuccaccaaggaaguccccauuguucaaacugagaccaaaaccaucacauaugagucuccacagguacaaaagcucacgauugacacuguauuugaauccccuuucuuguucaggaugccuauuucuguguucagugucuuccccuguuccuggcuuugauagaacuuuucacacacugcagcugucccaacacugugacuagcucuguugcugucuuagauuagacagagagcuacagucaaccccgacaccuacagagaaaccgcaguuagagaaggagaggaggaacaugcuggugaccuggugcuucacaggagagccguacacauggguggcuaagacagguugcacaagcccuagccuguuacuacggggcuuuucuggccuguuguaucuaaaaaugugcacauucuuaggacucagaugacucugcaaagcuuacuagauaugauauuuuauguagaucuguaguguuauaagcucccucagcacugacuucaugaaggcagaccaaauaagcucugauuuuauuaugucguuagaggcacccacauacuuucucccuuauucugggccauuuaccuuacaugugugguggauuccaugcaacaguguccaggugacuacaggaaccucauccucuacagacucuggaucugcaaagauauuuuagauaagaaagcuggagagauugcuuacuuuuaugguaaaguucuuccuacacaagcauaaggacccgaguucagaucccuguucaaagccgggagugguacagaccuauagucucagugcugaggggggucaucccugggcagugcugccagauucaaauggguaggggaggaguugcggaagacaucugacacuguccucuaggcuccacaagcauaugcauacagaugccaacgaaugaaaugggacaagaaaguucacuucaaacuggaccuguguaaaaguguaugugauaaguaacugaccuuucucugguaggauugcaguauggugaagaaugucaggucucaaaauacuuuaagacugaauguauacauguaugcaacauuuaucgaaacaguuucaagcauguuaucuauaugugugcauggcuccccccuaagggcaagcaaacugaugugggcaggcagaucugugagaagguugcucugacuaggucugcaguguuacugguaaaccucucagaaagggggucacuugccuaaggugaguuugagagaagccuccuuguguuuaugucaggaaacagggagcuguguuugugagucucacauaacuaagcuauuaauuugccuuguuauuuuuccugggagucucuagaauccucugccucuuccaguguuaacauaaacaaaguagcucuuuuaaaaauauauacaguggcauauguguguauguauguguguguauccacacaugcaguauuauuauguacacucauguauauacucaugagauaucaaccauuggaagaacuuugaacauuuuacagaauauauuccagggaaguaaaugaccaaauccuucaaguccagucugcucucaccagguucuaccacuuaguaaucugaggaaauguugaccuauuuuuacccaccugugcuuaaaaacaguaagcaaagccaguacuucuggucacuguggaaacgucuuccucggguucucgggcucuuuuucuagcuucuacaaaugcucuuuccucuugugugacugacagucccaccuccuccuucauucuuccuccuccugacaugguuuguuuccguacaucaugguuuuuacagcucuguuuucaaugucagcugcucucuggaccaugaaccaccacuacaacacgcagagaauaggaagauaggaucuccugccagcuguggagcucuuagaagaugcauauguaguggggggcucuuuucugacaugauggaaguuaagcauuacuuuguauuuuuccuccaacuguccaaagauugacggcggggcugguggugauucgggcguguuacugaccgcacaaaccaucacaucugaguccgcgucaacaacgacaaccacacacaucaccaagguaaagcaacccaggggagcucuagggagaagaacgguccauggcaaacagcucuuuucuguagugcuccuuuguuccuuuacacacuucuaaguaagacacagacagugccaguggacugaagugcccuucuuaaauuauccaagaaauuaggcuccaaugacaaauuguuuugaaccaaauuucaguuuuguaaaguacaaggggguaaaaauaugacuaguauauuuaagacagcugcauagacaguaguaauuuaguaaaacugugagacuucucucauuuauuucaauccuaguguguagaccugacauuuacccagagcccuuucuaaacauuuaaugcuauaucacccauaguccucagccugacagcaucugcugugucuggggcuuggaagucuaacaauugcgcugagcacuccagaccuacuaagacccuaggaggaagcgucuagcugacucugccgcgugucaacgcauucaagucugacuuuccagcauuucacuuugcuucugcuuucacauuggauuagugcuuaauggucuuagacguauuugcuauauccuuuccacccauguuucuggacaauaauuuaaagaagcaaacaaaaauagcaggaaaugugaguuagaaaugaagugaaugcuggcucucauucuaacauuguaaagcuaguggugagcauugcuucucaguuacgugccacugcugggacauggugugugaauucugaugguuguagagguugccugugugccugcucaggacgcugguauuggcuguguucuguuucaaagaucucagagcaucuccagcaugccccggguacucuugagcugcaccugagcaguaacccucaugaguccauucauucaugcagggccucggucacccuagucuucugcauagccggugcacaaccacacauggaagcaaucaucaguucaaaccuuuaaugaaaaucucauuugcuuucuuugucuuaaaucaaaugcgaguauucuuuuugguugcucuaaauugaaugaacucacgaaaugaauuuguaugacuggaaucaagcaucaaaacuguaguaucaaacgauuuccuaaauguaaaacccaccuaaaguauuuguagcucuacaaaucccaaacagguuuuucuucuuucuacuauucuuuuuacaagguggccaacugacagggaagaaacauggggaauguaguagauuaccccaauggaaacacuuggauuuuaaaauggcaucuguuccauuuuaaucucaucagaauguugguauuuuggggggcugcugucaaucagaggacacguaugaugcugcaugauuuuagcaauaggacucuguguugaauuaaguacagcacaggcaagaucuagagcccgagucuugcacugcucuguguucugcucuuaagauggugacagguggaagcugggcuuggccuuuagucucugcuugcaucuccaguuauugugucuucuuucugaccuuagacugugaaaggugggaucucugaaacacgaauugagaaacgcauugugaucacaggagacgcagcucuggaucaugaucagguaagcaccuuuccugucacgucugugugugguugcuuccugguacauccuggguaucguccaaguucccuccuuagaggggaaggacacuucugagccuggagugucccgcccucuagaggucccaaguacaucggcacaaaacaugcuguauucuucaucauccacugugaugacaugcaagagagggagggcuucuggugaccagggaagggcuucccauuggccugguuuaaagacaagucgucacauguuguaaaacaauggcaguuacugaugucccuaaaaaucaaacagagcaaaagccaccaacacuucucaugccuaguuguuaaauauuuucaaggcauuuuuaaagcaaaggaagaaguugggcuauugacuacuaaggacuuuucccuguuauaauuuggaguaguagagggaagaaaagauuaucuaauauuucucucaagaugaaaauguauugaucucagaaaaagaguaacuaauaagguccucuucuucaaaauugauacauuaauuacaaauaucaagcaaaacauucagucucacucuguuguuuuuuuuuacaagccaccucccaaauuaauugucuauguuucuuuuggcuguauaaauaauuuugaaauauguuaguuguucugaaaacuauaguacaggauaaaaacaucacauaaacaauccuacuacuaauagagaggcugagauaggagaagcaugauuucaagaccauuauguggcacacaguaagacccucucauauacaaauaagaaguguauauagauuguacaauauuggaccuauuucucucauuaccaaauuaaagagaucaguggaugacagccaagaaauuucuaauuccucauauuuuugaauuucaauuguuuaggauauguuaguaauauuaacuuucauauuaagagauauuaaggaaacgcgauuguuccuuccuguuauuuuuuguuagagguggaauuauguuuguguggguuuguugauuacuuucuugcuuuuucuaggguguaguuuugcuccuuauguugguguuuuccaucuaucauucuuuguagggcuggauuuguugaaagaaauuaugaaaauuugguuuugucauggaauaucuuguuuucuccaucuauggugauugagacuuuugcuggguauaguagccugggcuggcauuuguguucucuuagggucuguauaacaucugcccaggaucuuauagcuuucauagucucuggugagaagucugguguaauucugauaggucugccuuuauauguuacuugaccuuuuacccuuacuguuuuuaauauucuaucuuuauuuaguucauuuguuguucugauuauuaugugucgggaggaauuucuuuucugguccagucuauuuggaguucuguaggcuucuuguguguucgugggcaucucuuucuuuauguuggggaaguuuucuucuauaauuuuguugaagauauuuacuggcccuuuuuacucuuuuucugaaaugaggugucugugccauccuccaagcagaaccacuguucauugaaacaguugaugaacgacuucauggauacaccuucuuaauacacaccccauuuuuuaaaugaauguaaccuguucccugugguccgagaaugaugacaaucacuuuagucaaauaacuuuguccauagcaggaaaucuguguccaaauaaucgugccuacaauucauuccuuggcgcagcagaacugucaacucuuagcuuagcuacuguggagguaaaauccuuuggugaugugagggacauugaaguacagccuucuuacaaugaacuccaaugucuaaaaauuguccuuauuuuguguuuguaccacaguuaagagccaagauuuuaaacucuacuaaaaacaaaacaaaacaaaacaaauaaacaagcaagaagacuuuaccuauuuauguucauuuaauaacauguccaucauuuuuaugauugguauaaaauauauauuguguugaauaaaguaaaaaauaaaauaaaaaaagaaaauguauauugauucuauuuauuuguuuguuuguuuguuuauauaagugcagugcuuguuauaacaguuauaaagagguaauaaugagcugcuugaugcuugauuuuagacuguagucccaaaugaugagaagaguuguuugcugccuuccuccuccucuuucucuuccuccuuccucuucccucccuuccuuccuuccuuuucuuccuuucuugucuuucuagcucucuggcuuuucuuucuuucuuuuuuuuuuuaaaugauuuuuaaaaaggagaacaagguuuuugggggguguuguuguuguuucacaacuugaagaaaggaaaagaaguguuuaguggauugcuucugcuggagaagaggaacaaaugguagacaaagcuuugaacacagcauggucuccaagaaggccacuguuagauauaagaacugcgugcuugagaaaggcucugugugugauguuuguaagcaugguauuuuaauuacauguuccauaauuuacggggauucguuugcuuguugguuuguuuugguuuugguuucugaggguuagagauaaaguuguugugggcgcucagugugaacuuagugugagggguuucuaggagcugccuaguacacucaucguggacaagaaccuugucuuggaagugaggcucccagucucccagacugucagcggugcgcgguccacuguuguccucuggaaucuggacaccccugaacuggagguggugcuugccugacucuuauuucccucugggcuucuugcucaagagcuguuugcuaaguuccuucagcauucuaagcaggagagugugaauguucccagccaucguuucuuuaacucuccccaaagugcaggccuucccaugcuuuguaaggacuuucccagcugagcagugcuggguucaguucuguguuucaccuuuuauagccuguucgccuugaaaacucguguuuauguagcauugcuugugaaaggugaauauaacaaaugugaagcauauggguaggaaaauaacacaaccccaauguagaugacucggcaggcuuaccugccugugagaccgggcuucucccaggccucagcucugcuaaagugagguccgacccggacacuccccaccaggagccugcggcacguucacauccuccuuaaagcuauguaagcuuaaaugaaaauggcuuucuugccaaacaaugaugcugauuacauagugacccuggguggucauucacacguuuucuacauccccuuccuuguguucagaggaaucuuaggcuauuccuuucuaugagcuacacacaaagagaaacaccuccucacguugguaugucugcgaggcgugcucucuuaggguccagcucagcagcucuuccuucugugcugggcaugaauccugcuccauucugggaguaaacaaccuguuguuucucuucugagcacauuucuuccuaauacaacaguucucagucuggugcaguggugcggccuguuguucaagguccgcucucaggagacuagauuagacggaacccaugaaguucaaaacuaacugacucuacugagacucaugcucacaguuuuuuccugugauuuugacagugauauuuucucaugaucuuuauuauugccauaauacauguuguugcauuuagcuucuugaguugauauggaaugaaaggguuacagccauaauuuaagauaugggcugaagagguggcucaacgguuacaggaugcuggcuuuucuuccagaggaccugagcuugcuucucagugcccaucugguggaucaucacuuuuuauaacucggucuaggagaccauacacucugucuggcuuccaacgacaccagcauacauggguauacaggcaaacaugcaggcaaaaauacccaugcacauucaggcgucagguauugauuauggcucuuagucuuccccugugcuuauuagcuguaccugguuuaaugagcaaagcuucaaggugugcuccauagccuugcaucagagagaagcuguacugugauccggcaaugcauuugucuccacagacaggcccccggggaaaagaaacacugcgcugcguuuugcuguuuccaacuaccugguuuccuuaaacagugagaagaccuguaccuuaaaggauuuuuccucccauuuagaauucuuuccaagacuuuguucuuguaugguuuuguuuucuuuauuuuuccuccaaaccuucuuuacaaauaaaauuggcaauaauuaagaaagauaugucucucaaaaauagggucuuuccauguuacauaguuugcucucugaugagacagagguauuuuuaaucccuaccuugucgguggaagagaccaugaagccgugcuuuugacacuggaugcucuucacuugcugcugaugguggcugccuguuugagucuucagcugcagaaaagggccugcaagguccaucugcucuuugucuuagugauggcuucuauuguuauugcuguucuuuuuucugucuccuauagguuuauagguguuuuuuucuguuaauguuuaaaauuagauagcaaagacuaggaggccugcucccaugucuuggaguucccagcugucuguaugguggcuauacuugaauguucauauaaggcacuacacuuuugguugacaucauuuacguucauacagcaaaccucaaaauauucuuuauugccuuagucugcacuuccagguaaaaguuauauaaggcucagagaaaacuuauguucuccuaaugugcgugcaagccaaaacucaguauaguacagugagugcacccaguuccaggugagaacgggcuucaaagccagcgagcucuccuccaugcaucacccugcugaggugcacaggaaggacaggaagugcagaacagcagguauucuuugccacgaccccaauucaaacagcccuguuacuguaaaggaaggcacaagaacagauugcuggagcuugugucugguugaugaaguugcguguauucugccaucuuuguguggagccaaauacucagcucauaguugcuuguucuucugacccugguaggcgcuggcucaggccauacgggaagcgagagagcagcacccugauaugucggucacaagggugguagugcacaaagaaacagaguuggcggaggaaggagaagaauaagguaagugagccuggccauccgcagccuugccuggcugcccugugucccuguuugugcaguucuccaucagugucuucaccggaugaguuucuccacauuguuguucucuucgagcacaaaccucuggcuggcugucuagugccaauggccuucuaaagaagcugccagcagugggcacuuacgcuccuucucccaucaagugugcuagugcacuugguaguuaguagucacagugacugcugggggcgaugcuggcaccuuucugcuagauuuauagucuuuaaaaucuauauguuaaacauuauguaucaaacagugagcuauagagagagcauaaagcuaguauugccuaaaaguuuaagauuuuagcugaaccaaaggggaaaauagugauaagugguguuuaauauaaccagcagaaaaggacuaauauucucaacaaacugggaaaucuaauaauuuaugaagaaaauguaaacacuucuggagaaaaauaggcuaaugaucacacagguaaaccauuugaaaacuuaaguacaaacaaaaaacuuuggccuuauucuuuugcuuaaaucauuaaaaauuauacaucuaguauaacauuuuuuacccaugugguaaaaauguauguuuuaaucacugcuuggagauugugagaagaaaccauaguuacauacuauauauuuuauuucuuagaagacaauuuggaaaaaccuaucucaaaguauuuacauuauaguuaccuaucuuuaaacuaccuuugagaauuuaaugagggcagugagauggcccagcaaguaaaagcucuugcuuccagcuagacaaccucaguuccgucccugggacucauuuuccagauggacagccucaguuccaccccugggacuucuugccugcaauguuggaggacaaacuagggccugcaaaugcucaguuguuuguguugcugugaugaaacagcaugaugaaaagcagccagggaaggggagggcugacucagcuuaaacuccacaccacucuucaucaucaaaggaagucaggacaggaacucaaccuggaggcaggagcugaugcagaggccaugggggugcugcuuacuggcuugccagccugcuucuuuauagaacccaggaucaccagccuagggauggcaccaccacgaugaccugugcccuuccccaucaaucacgaauuuugaaaaugcauuacagccacaucuuauggcaacaucuuuucaauuaaggcucccuucuuucugaugagcacagcuucugucagguugacaugaaaucagccaguacagaagaugagguggggaaacugcuauugcuccaaauguuauccaucagcuucuuacaaagaagaaaaacggggcuggaaaaaugggucaguggcuguacuucuaaaagaacuguguuuggucccuggacccacuuugggcggcugcuuaucuuuucaggaaauucagugcagacugugagcaccuagauguaugucuuuuuucuuuuaauugaaaauagauuuuuuauauaauauauuuugauuaugaauucccuccgaaagcuucucccagcucuuuucacuaucucacccacucaaaucucuacccuuuguuucucucauucgaaaacaaucauuaaaaaaauaaaauaaaaacaaaugaaccagaauaauacaaaacaaacaaaaacgagcaaaagaaaaagcacaaggaacacacagacgcaaagacauaccuuugcauauacagcaacccauacaagcaaugcaaagacauacguuugcauauacagaaaaccuauacaaacaaaaguaggaaaccauuuaaaaaacaaacaaccaaauaaaaauaaaaccuugcaaaauaucauugaaauuuuuuuguguguuguccaucuacuacugggaagaguaugugcccuuaagugugguuuauauacacagcaagacuucauuggagaaaacauuuuuuuuuccuuugaaagcaguuauaauuuagagcuagcuucuggguuagggguggggcuuguguccccuuucucucaguacugggacccuaucuggcuuagaccuguguaguccccaugcaugauaugucgguccugcggugucuagaagacuuguuucuuuggugucuucccuacugggucuuaaaucuuucauucuaacuucuacagaguucacugagcucuguauggagggauuugauggagacauccuauuuaggacuggguguuguuccaaggucucacucuguauccuguccaguugugggucuuuguguuaguugccaucuuguucaagagaagcuacucagaugauggcugaacaaggcacuaaucuaugagcauugcagagugguguuggagucuuguaugcugugugccuuuagcaggacaguaguguuggguuuccuccugcauccauuaccagcuaguauuaaguucuugaccacaugagcaaugaauguuaagcuugcauuucaucucauggaacagaccuuaaaaaacaacuaaucauauagaggcuggucgcugccacagcuuuugugccaccaccacaucuuuguauccuacaggcaggacacaucuauaaaccagauuuguaguuggguuggguuuaacacugucuuuugauagugugcagauaguguacuucaaguaccaugcaugguagguaguccaugagaggugaaggcucugguagguaccaguuugacuucuccaugcucugugagguguguggauguugucuugaguaguaggccuuucccaucagcguguggagagcagccacuccuguuaucuuagccacucagauguaucaauucuuagcacugcagcccucauuccuuggccacagaugccuacuuaggcucccauuuguugauuuuuuuuuguuuguuuuuagauuuuuuucacauauguauauauuuuaaggaacuuauacuauauuaugcuuccauauggccuucaguuuuaacugucccucucuguauuuccuuccuugcccguaaccauuucuucccauccccauuugaucucccguucuagucugccuccccaucccguccauaacuauuguuugcuucucuguuuccaccacugucccuuacucuguauugaacuuauauaaacucuagccuacuuaacaagacuuaacagugaauauccacagauagaugcauaugagccguguuugucuuuggaucuggguuaccucgcucagcgugauuuauuuugccuagguguauccauuuaccugcaaaguucaugauuucaucgcaccuuucucuauaauagcugaguaauauuacauucuguaaauguaccacauucucuuuauccagucaucuguugguggacaucuaggcuguuaacaaucuggcuauuguuaguagaacauccaugaacaugaaugagcaaguauuucuguagaaagauaaagaauccuucagcugggucuugaaauagagcuuuuccugucuuccugaggacccuccacacugacguccauaguggcucugcagacuugcacucccagcaacagcagaugaguucccuuuuaaacacaucucaccagcacacgcugucauuuguuaaucugaucuugaccauuuugauugguauaaaaugaauucucaaaguaguuuugauuugcauaucccugaaaauuaaggauguuggacauuuaaacacuucucagccauuugauuuuccucuuuugagaauucucuuuuagaucgguacccuauuuuuuuuuaucauuugaugauguauuccuacuaauuucaagcggaaaaauauuuauuaacuuuaaauauacuuugaaguuucauuuuaaugaucaguaauagcaucuaccaguuuguacaugguaauaaccaaugcaucuucauugcccaauauacaugucacaaguacauuccuuauauaaaugacauucuacuuucuuuuuuuccuuuuauuuuuauuggauauuuucuuuauuuacauuucaaauguuaucuacuuuccuggcuucaccucugaaaaauacccuccccuuucuccccuauuuccccugcucaccaaccuacccacuccugcuuccuggcccuggcauucaccuacucaggggcauagagucuucauagaacaaaggaccucuccucccauugauguccaacuagaccauccucugcugcauaugcagcuggagucaugagucccaccauguaugcuuuuugguuggugguuuagucccugggaacucuggggguacugguuaguucauauuguuauuccaccuauggggcuacaaaccccuucagcucuuugaguccuuucucuagcuccuucauuggggauccugugcucaguccaauggauggcugugagcauccaccucuguauuugucaggcacuggcagagccucucaggagagagcuaugucagacuuccaucagcaaacacuuguuagcauccacaacagugucuggguaugguaaaugggauggauccccagaugagucagucucuagauggucauuucuucagucucuauuccacacuuugucucuguaacuccuuccauggguguuuuguuccccccuucuaagauggauagaaguauccacacuuugaucuuccuucuucuugagcuucauguggucugugaauuguaucauggguauucugagcaucugggcuaauauccacuuaucagugagggcauaacauguguguucuuuugugauuugguuacucuuacaugcauucacgcgaccggccaggaagaacgcaacaaaccggaaucuucugcggcaaaagcuuuauugcuuacaucuucaggagccagagagcaagagggcaagagcucuauugcuuacaucuuuaggagccagagcacaagagcgcaagagcuuuauugcuuacaucuucaggagcaagaagcaagagagagaauggcgaaaccccgucccuuuuaaggagaauuauucuccgccuaggacguauuacucccugauuggcugcagcccaucggcugaguugucgucacggggaaggcagagcacaugggguggaaaacuacccuuggcacaugcgcagauuauuuguuuaccacuuagaacacaggaugucagcgccaucuugcaacggcgaaugugaggguggcuuccuacagguuaccucaaucaacauauccuccagauccauccauuugcuuaagaauuucauuguuuuuauuagcugaguaguacuccauuguauaaauaauggauacagaauaugugguacccuauuuuuuauuuuaaauaguacauguuuuauucuccuauccccagagggugguuuauccagaaaccaagaaaauaaaaaucaaccagaauaaauucaaggggggggguggugguggagagaaacccauuaacgaccaggcaggcaggccagcagccucccuccaccucagaggcccaccaccacaaggggaaaaucaggaggggcuggggagggcaucgaaucagcuaugucuucauuaugagagugagagaaguggcagagauaugcaacuagauggauauauauuuauauaauaaauucguaaguugauauaguaaauaguaaaucucuggaaguucuuaacuuuuuauaguuuucuuuuaaguuuuuuucuuuucuuuucuuuucuuuuuguuuguuuguuuguuucuguuccauucuuuguauuuuguugguuuugguccuuagaaaaucugagacucagagaccaggugaaacaaggccgggugggcuggggcugacugcccagcagccacuccugaggcagagaaggguuauguauggcagguccucugcuccuggugaccacacaggauaccuuguuuuuuaauugagguuuuucuuucucccuuccccuccccccuccccucccccuccccccucucuuccucucccucucuuuuccuuuccuuuccuuuuucuuuuccuuucuuuuccuuuucuuuucccuuuucuuuucuuuucuuuucuuuucuuuucuuuucuuuucuuuucuuuucuuuucuuuucuuuucuuuucuuuucuuuucuucauccaagacagggcuuuacuauauagcuguggcuggccuggaacucuuucuguagaccaggguagccuguaacucagagaugugcuugccucuguccucagaguggcggugggauuaaaggcguucauuaccguguugccgauuugcucucacggugcacaguucuuuagauacuuuggguguuagcccucugucgggugcugcuuucuccagugacgauguccuuugccacacagaagcuucucaggguuaugagaacccacugauugaugcgcauuguuccugugcuuucuguucagaguccuccugugucagugaucgcaagaccguccaccacuuuuccuucugacagaucccgagugucuggccuuacgcugaggccuuuccaucugcugguagugucuuugauuucuucuuuuaaugcccucaauguuuuuauuauacaagccuuccacuuucuuggauagaguuaaccuaagauauauacuuaugauuuuuuuuuugguuuuccgagacaggguuucucuguguagcccuggcuguccuggaacucacuuuguagaccaggcuggccucgaacucagaaauccaccagccucugccucccgagugcugggauuaaaggcgugcgcaugauuuuuuuuuuauuauuauuauuaagagagauuuuuaaaaccuagagaaaaaugucaugaagaguccuaaaugucaccucugcuguagauuuuugagacagucaccgcugacuuguuucuucuuuccagucuuacuacugugucuaacccauuguaccuaaagcauuguuucugugggugaaaggguuuguuuucuaugcuaacuagacagcugcgacaguugugaucaagaaaugacacagauuuaccaggcagggcagagauacuaggucucaaagugcaagacgggguagugaguccagaggucacagauaacuguccugggcaguugauuggucaccaucccccacauuucucuuuggcauugguagccaaaaagacuuugauuccauugauuuuccggccuggacucaagcagaagugcuaaugaguaaugagauaguccaaggaagacagcagggugggaaacaauggacuucauuagucauccugcccugguuaaucaagaggcucucauauuaucugugcugcuucuuaauaaugaggaguauuuuuuccccuaucaaaauaagaauuuuaucugaccaauaccguguacauucucuauuuuggggcugguauguucuggaaagaacauuaauguccacgguucucuauaauuaguacauuugccagaauuuuugucaaguugacauagacuaugaaacaguuauaucuagaaaccuuuugcuagcucagggauggugagucacuugcaguccuuugugcugucugccugccuuuaaugaggggcuugggagcuucccaagaccguguuuccuuuuucugugaagcucacauccggucuccuugugcuuggucuugcugggaucucugugugcugacucacagaucugccucuaggccucauggcucgcacaugcucucggccucccuuuucugccccuucuagguuccagacuuuguaguauuauauauagccacuuuucuuuuuaguuguuuuugguuuuguuuugugacaaggugucacuauuguuagccuuggcuaaucuggaacucaguaugaaguagaucaggcuggccuuaauaccacagagcuccacuugcaucugccugagugcuggggugaagggcaugaaauaccacugggcaggcauugguccuguucuguggcaacaucucaaacccgagucuuaccccucuucugauaacaccugcuugcuuguugccaucuucuucauccagcuggcaccuggggugcuucuucuguccagcguucuggccucguuccccuuccccuucagcagacuucccacacugaaaccauaacaaggcuuucuuugagacuaggaauccagcuaugcagacguccucaggagcaacaguugcaucuccucuguguuuguucugcauagcugaugccccucacucuugacuccucuucucugacucugcacuccucuggcucagguccguacgccucacucugguuaagaagagccugauccaucucacccuuguuacugugugcccaugcuuuccagugugcugcuucuggaugcgucuuccucucacccgucuucucccccacauaaaucuaagucugucucaguaccaugacccuguaccucugagccucugugccuucugugucuccccgccuguuccucucagugaguaaaaaacggcuaguccuucccaugcugagcuuaaagccugcaucaguuagcuuucauuuauauaaguguguguguguggggggguaccucagcgcacuuaugucucacugcucugguagaugccugaaaccagccaguacugaaccuccacgcacugccccuuuggcuuuucagucaagguaagcuuauugacuucugagcaaaucucaauugucagcaucucugcucaggcaguuugagaccauuaauaagaaaaauagggauuacuugaaggcaaccacagaaauacugugauauuugacuugguaaccaaaacagcugcuaaaguggugaauggcagguggccugcgcaguauaucugugcuggacagaggggucucggcucaucaacuggguggggcugggggagagaccagcagucuacuuaaagcaguccucagcuucaagcuuuaccuuugaauuucgcauguaaugucuguggaccacaguuggcuauggggaucugcggcuaaagaagggcaaacuagagacuagacacuggggugucacacugcgcacauggacaccggugucacacugcacauguugucuccuuggcuauaauuaagucuugcuaccucuuuuguucaugucaguuuucugggaauuuuaaggcuucuagguuuggaaugugugcuucacguuuguuuucaguagauacacuggcuccuguuaaaguaggcagauaacuugauuacuugauugaaaacuuugauuauuuaacucuguuuuuaagccacuggcuuuggaauauuuaagauuuaugucuuuuuuuuuuucuuuccuagaaagucuuuuuuaaacaacauuuaacuucaugaaucugaagaacuuugaccauuccaagucuuaacgccguaccacuacuccagcaaaacugugcuccgacugguaacagugaccagaagccugaagaauuaaaaugccaacagcaaaccauaccuuaacagcucuggucucuacuauucccauacacuucuaauauauuguuuguuauauaaccacuucuagacacccugcuccccuguucuuucuuucccuaccuuuuuuuaauucuuuguuuuuuauuaggguuuguguuuguuuccuuucccuaccugcuuuuuugacucauuugcucaaaugacagugaacaaagccagccgggcugguaaggcgcuguucaccugaacaggugcuguuauguggaaaggaaacucgugacuaauuuagauagcaauuuucauucuucaagauugucuccauucaacucuuacagucaauauuuacagcuuucagacugcaguagggauacugcaugagaacauauuaauaccaauuaaaagcauuuuuuacaucuugaaauuuuucuaauauuagggaauuucacuacggaugauuuuuauauagaucuuugaccuuccaguccuuugacuuuguacuucaguagagucagacagagacucucuggacuggagaauuaagaagcucacugaccagguacuguguugagagacccucggcccacagugcaguacuucucagacaugcgcuuugccacagcauuccagaacaggaggagaaccacaccgugugcccuucccuuuuacuaagagaaaaccaggcagcuuccagccuuagagauuucuuucuuaaccuucccaguuccaguucuucccacugucugaacacuugcuuuguaugaaacuugucugucuccauguacacggacccuuugcuacugagcagguaaucucugacauaguuugaugacuugcagcuuugaagacacugggaagaagagguuggggacagucggucggggguuugguugguuguaagaagccauaccauguaaaacuaacaucagagaagcugauaggaguuuaacuguauugaacauucuucucauuugcuuuugacucuauguauaguuaugacggcagauuagauuuaugucagcuucaaguuguauuaaauauuuugcuuuauguaauacuguuauaaaauaaaaguuuguuuauucuauaaau

SEQ ID NO: 5447 - RNA, 988 nt, Mus musculus
cuaaaaaaaaauuuuuacugguaauacaaauuccuaugaaguuuuuuuuuuuuuuugcuagcauaagaaauuaaagaaaccauuaaauauuuagaaacauucaacaucaaaagcuuuaaaucuaacuguaguuguagccccugaaaaagcuacaaacucuucuuaaaaaguauuuucucuacaaagaaucucaucagcuauacaaaaaucuguacaguuuuuauacugaagcuaauguugagcugcacuugaauuucacauucuuagcaaaauaauugccugagcaaauauacuccacacuuuaggacagccacuuauucuucauccuccucuucuuccucuucaucuuccuccucuuccuccucuucuuccuccuccucaucuucugguucauucuucuucuuugagccuguuggccuaccaggacccuucuuuccugcuucacuuuugcccuuggcacgguaugcagcaauauccuuuucauacuucuccuuuaguuuagcugcuuucugcucauacgguuguuuaucuuuggcagauugcucagaccacaucucacccaguuucuucgcaguaucuccaauagacaggccuggguguucaauuuugaucuuugggcgauuuucagagcaaaacaggaagaaggcagacgguggucucuucggagcauuggggucuuuuuucuuuccuuucuuauccccuuugggaggaacauaguucuucaucucccugucauaacgagcuuugucgcucuuggccaaaucuucaaacuuggacuuuuccuuugcagacauggucuuccaucucucggagcauuucuuggagaacucggcgaaguucaccgacgagucgggaugcuucuucuugugcuccucgcggcaggucugcacgaagaaggcguacgaggacauuuugccccgcggcuuguuggggucacccuugcccaugacgacggcgcggcgucugucuaccugcugcgagcgcugcc

SEQ ID NO: 5448 - RNA, 1236 nt, Mus musculus
cuuuuuuuuuuuuuuuuuuuuuuugaaugcaaugccuuuuuauuuguacuugacaaggaggaucaacacacucggcagcucagaugacuuuugccuaccccacugagaagcaaggggcuuaagagggucucucuccacagcagcacuguucuuuagacacuugauaccuacgcagccaccugaucuggacggucagggcucagcuaagaugggagucuugaguugucucaguugggggacagggcccuuaaagaccccacugugcccgguucuggacaguuuccuuguucaaccacucacagacaccaccagcuccagcucuccucuagaccugauccuggcggaauguuuccuuuuucagaguugcucuuuuuauaucaacaacagaaugacuccaucagaacauuagaccccuccccagacggaaccuaaacucaaucaaacagaaccugggaugggacuauccagaaucguaacggcuggcagcaagagggaagacacccuaaaccucuauccuagcacagcuaagaacucccaaugagaggguagcaagggggcggggggaacagcaugcuuuacacaacuuaacaaggcugugggggccccugugcagcaccccuacuucccugacagcugcucguacagcuugggcacauagucaucccacuuggcuugguagcacgugcccgccgccggggcucccagguuauacuucuuucggaaggucuccaccuugaacuugccgcgauugucuccagacuuguugcugagaaugggcucgucgcagcucagcggcuguuccugcucguacaccagccagacguagcgguggagaccugugccacugggaggcccggagcccacauaaucugagaggacagugccacugcuaaugucguuacccuucauguugaccaccaggaaguggugccacucccugaauuugggauccuuccugcugggagcauuggggucugugaggaccaggguguagaguuucccaggaucaaggccgucccaugaaaugcugcugggccuguucauaaccugggugggcguuagcacuuugcccagcucguccaccgucaccccggcguagucgacccgcagggcgugcuggggcggcucguccaccuccugcaagcacaagggcccggcccacuggcugaugucggcggccauggcgauggagaguuggaaggcacgcgcacgccgaguccugagcgcuguuaaccu

SEQ ID NO: 5449 - RNA, 657 nt, Mus musculus
agucuauugauuuuuuuuuuccacugguuaucagauagucuuuuauuggaauauuuucuuguugcuucuuaacuagcugggcacuccacugcaccacuguugaugucaucuaugaugucaugaggguggcggccauccacauugcagcccacagacugugcaguacccaggaucuccuugauaguuccagaaaguucucuagccaaagaccggugucucaucugccgggcaauguugacaaucucaucaaaaguaauguucccacuguguuuaauguucuucugcuucuuccugucucucgguggcuccuugagggcuuugaugaucagggcugaggcagaaggcaccaccucgaucugggccugucuguucuggauggucaguuucacuguaauucugagacccuuccagucaccgguagccuuggcaaugucaucgccaacuuucuucggagacagacccagaggaccgaucuucggggccaaggcggauguggcgccgaccucgccuccggugcaccucagguacacgacuuugaccucguuggggucgaacuugggcggcaugguggaggcggcuggugucggaugaacccggauucgggacgaccgaagaaaguugcaccguugccuccuccgagccgaaagccgaaaagcg

SEQ ID NO: 5450 - RNA, 638 nt, Mus musculus
uccacugguuaucagauagucuuuuauuggaauauuuucuuguugcuucuuaacuagcugggcacuccacugcaccacuguugaugucaucuaugaugucaugaggguggcggccauccacauugcagcccacagacugugcaguacccaggaucuccuugauaguuccagaaaguucucuagccaaagaccggugucucaucugccgggcaauguugacaaucucaucaaaaguaauguucccacuguguuuaauguucuucugcuucuuccugucucucgguggcuccuugagggcuuugaugaucagggcugaggcagaaggcaccaccucgaucugggccugucuguucuggauggucaguuucacuguaauucugagacccuuccagucaccgguagccuuggcaaugucaucgccaacuuucuucggagacagacccagaggaccgaucuucggggccaaggcggauguggcgccgaccucgccuccggugcaccucagguacacgacuuugaccucguuggggucgaacuugggcggcaugguggaggcggcuggugucggaugaacccggauucgggacgaccgaagaaaguugcaccguugccuccuccgagccgaaagccgaaaagcg

SEQ ID NO: 5451 - RNA, 1078 nt, Mus musculus
caugcccuacccauacccagcacugaccccggagcagaagaaggagcuaucugacauuacucacuggauuguggcuccugucaagggcauccuggcugcagaugaguccauuggaagcauugccaagcucuugcaguccauuggcacacagaacaccgaggagaacaggcaguucuaccgcccgcugcugcugacuucucugacuaugugaaucccugcauuggggauugggggaugggagugugauacucuuccaugagacacuguaccagaagacagaugauggacaucccuucucccaaguuaucaagcccaagggugguguugugggcaauuggggaagauaaggguaugguuccccuggcaggaaccaauggcuagauuacuaccaaagggcuagauggcccgugugaacgcugugcccaguauaaaaagaauugagccaacuuugccaaguggugcuguaugcuaaagauuggggaacauacucccucagcccuuaccaucauggaaaaaugccaauguucuggcccguuaugccagcaucuaccagcagaauggcauuguacccguuguggagccugaaauucucccugauggggaccaugacuugaagcacugccacuauguaacugagaagguacugcggcugucuacaaggcucugagcaaccaccaugucuaucuggaaggcacauugcugaagcccaaaauggucacgcccggccaugcuugcacccagaaauuuuccagugaggagauugccaugacaauguucacagcacuuugucguugucgcuggggucacuuuccugucuggaaggcagagugaggaagaggcauccaucaacuucaaagcuaucaacaaguguucacugcugaagccaugggccuugacuuucuccuauggccgagcccugcaggccucuacucuaaaggagaaccugaaggcagccccggaggaguacaucaagcaagcccuggucaacagacuugcuugucaaggaaaguauaccccaguggccagucuggagccgcagccagugaaucucucuucaucucuaaccaugccuacuaac

SEQ ID NO: 5452 - RNA, 2873 nt, Mus musculus
gaaugcuguaaacauuuacauuugaguuaauguuaagcuuagagccaccucagcagaggcuuguguggcauugcuuuugucuuuguaaagaaugagaaaaagacaagguggcuuugauuccugauguguacuggguucaaucuauuacuaauaagagaucuaaccuuaaauuacuaauugaugaugauggugguuagguuuccagccggcaccuuagaaguaauguacaauugauaguggagagcgcagaagugacccacuacuugccuggggcgggcugggcugggcugggcugggccacaguacuggucgcucugagauuucagugcaacuccagccaguggccccaccaccaugagcaccaagcaggucaccugcagguauuuuaugcaugguguaugucucuaagguagccagugccuguucucacaugacuuggugaacagcaagccguccaccaucugcaaauacuaccagaaaggcuacugcgccuguggugcacauugcagauaugaucauacaaagcccccaacugcagcagguggagcuguggguccugcacccaacccuucacccuccucaggccugcauaguccucacccuccuccacauugccacaucuguuaugaggacacauucaaaugaaccuggaaagcaggagaagaauacgcuggugcucagagaccucaaucucacuggucuggcugaagacaagacuccuccaagcacagugaaauauccagguggcugcagugaccuucagaacagcccagagaugacgccccauuccuaccuaaaugccaucaggacuggccuggaugacuuggaggccagcagcuccuggagcaaugagcuucaguugugucccuaugcugcugcuggggagugccaguuuggagaugcccauaucuaccugcaugggaacaugugugagaucuucaggcuucgauuccuccacccuugacccagaacaaaggaaagcucaugagaagauguguauguugacauuugaacaugagauggacaaggcguuugccuuccaggcgagccaggacaaagugugcagcaucuguauggaggugauccuugagaaagcaucugcuuuugagaggaguuuuggcguucucuccaacugcagccgcaccuacugccuguccugcauccaucaauggcaaugugccaaacaguuugaaaaccugaucauaaagucuuguccagagugccgugugauaucagaguuuguaauuccaaguguguauuggguagaaaaucggaauaaaaggaaugaauuaauugaagcuuucaaacggggaaugagggaaaaggcauguaaauacuuugaacaagacaaggggaccugccccuuuggaagcaagugccuuuaccaccaugcuuacccucaugggcggcuggcagagccagagaaaccucggaagcagcuaaacucugaaggaacugugagguucuuuaacucaguguggcuuugggauuuuaucgagaaccaagaaacccggcaaguccccagcacugauaauguggaugugauagugcuaggaggccuuuucaugcaccuuucuggaguagagucaucagaacccuagucagugcuaaugccuucauuugggcucuguagucaacuuuccaaggcauggugcagacgcaucugacacugacccguggugacaugguaccgggauuugaguacaguagugagucccccuggaaagagaagggagaucaccaaguccauggaaucuugacauuuagaguugagcucucaguuguaccuccagucccuuucucagggaccagcuaugugguccagcuguuuuaauugagugcuuuaaaugaaaccugacugccaucuuucuuuugugacuuucuuccuuaagcaacaguaaacuugcagcugcucauaaagcagcagaucugguuuuuuguucuuguuguuuuuguuuuuauuuuucucuugccaagacaucaccagcccuguagaaggcuccccugcagugaccaucucuaauauaguuguugagccuuggaauuuacgcaacuguguaguaagaacacauuuggucauauuggugcuguaccauaguguagacuuuuaugacugugaggguggcuauugaguuccuuccagugucucaagucaacaggugugugcaguugugaagaucuccagagagacgccaucuuacucuccccuuguacugagagcacaagacauaggacucacacacaaacugcuuguucuccacuauaaaguaggcucuacacugguuuuugugggagaauggagcagucacuccucugucuaagaacuggagccaagaaagagcaaguuuguccuaaaucugaauuuauuuuuguaaaaaaacuguuauuaucugugugcuuuuugcuuggcuguucauguaagugcagaggaggcuccuugaguucugucugcacaagaaacugaacaaguagggcccgcacuucgaguuugauauuacuuuugaaggagucaguagccauuaaaccuaaauuuaauuuauuuuauuaaaauaacauaauugagaaaccaucagauaacuguauuuuaucaggcucaauaaaaacaaaguuaacccccccaaaaaaauaccaaaacaaaaaauaauacuaauugaagaaaaaaguuuuaaaggauucauagacacuggagcugauguacucacucuccuccaagggauugguuauuccaccaauccaaaacauaguucaaacuuaagauuuaugaaagguuaaugaggcuaugaaauuuguagagaggcauggcaaccugucuugccaauuccagcugccuuuccaggaaaugcauauagaauuauuauggauuuggaagauug

SEQ ID NO: 5453 - RNA, 2873 nt, Mus musculus
caaucuuccaaauccauaauaauucuauaugcauuuccuggaaaggcagcuggaauuggcaagacagguugccaugccucucuacaaauuucauagccucauuaaccuuucauaaaucuuaaguuugaacuauguuuuggauugguggaauaaccaaucccuuggaggagagugaguacaucagcuccagugucuaugaauccuuuaaaacuuuuuucuucaauuaguauuauuuuuuguuuugguauuuuuuuggggggguuaacuuuguuuuuauugagccugauaaaauacaguuaucugaugguuucucaauuauguuauuuuaauaaaauaaauuaaauuuagguuuaauggcuacugacuccuucaaaaguaauaucaaacucgaagugcgggcccuacuuguucaguuucuugugcagacagaacucaaggagccuccucugcacuuacaugaacagccaagcaaaaagcacacagauaauaacaguuuuuuuacaaaaauaaauucagauuuaggacaaacuugcucuuucuuggcuccaguucuuagacagaggagugacugcuccauucucccacaaaaaccaguguagagccuacuuuauaguggagaacaagcaguuugugugugaguccuaugucuugugcucucaguacaaggggagaguaagauggcgucucucuggagaucuucacaacugcacacaccuguugacuugagacacuggaaggaacucaauagccacccucacagucauaaaagucuacacuaugguacagcaccaauaugaccaaauguguucuuacuacacaguugcguaaauuccaaggcucaacaacuauauuagagauggucacugcaggggagccuucuacagggcuggugaugucuuggcaagagaaaaauaaaaacaaaaacaacaagaacaaaaaaccagaucugcugcuuuaugagcagcugcaaguuuacuguugcuuaaggaagaaagucacaaaagaaagauggcagucagguuucauuuaaagcacucaauuaaaacagcuggaccacauagcuggucccugagaaagggacuggagguacaacugagagcucaacucuaaaugucaagauuccauggacuuggugaucucccuucucuuuccagggggacucacuacuguacucaaaucccgguaccaugucaccacgggucagugucagaugcgucugcaccaugccuuggaaaguugacuacagagcccaaaugaaggcauuagcacugacuaggguucugaugacucuacuccagaaaggugcaugaaaaggccuccuagcacuaucacauccacauuaucagugcuggggacuugccggguuucuugguucucgauaaaaucccaaagccacacugaguuaaagaaccucacaguuccuucagaguuuagcugcuuccgagguuucucuggcucugccagccgcccaugaggguaagcauggugguaaaggcacuugcuuccaaaggggcagguccccuugucuuguucaaaguauuuacaugccuuuucccucauuccccguuugaaagcuucaauuaauucauuccuuuuauuccgauuuucuacccaauacacacuuggaauuacaaacucugauaucacacggcacucuggacaagacuuuaugaucagguuuucaaacuguuuggcacauugccauugauggaugcaggacaggcaguaggugcggcugcaguuggagagaacgccaaaacuccucucaaaagcagaugcuuucucaaggaucaccuccauacagaugcugcacacuuuguccuggcucgccuggaaggcaaacgccuuguccaucucauguucaaaugucaacauacacaucuucucaugagcuuuccuuuguucugggucaaggguggaggaaucgaagccugaagaucucacacauguucccaugcagguagauaugggcaucuccaaacuggcacuccccagcagcagcauagggacacaacugaagcucauugcuccaggagcugcuggccuccaagucauccaggccaguccugauggcauuuagguaggaauggggcgucaucucugggcuguucugaaggucacugcagccaccuggauauuucacugugcuuggaggagucuugucuucagccagaccagugagauugaggucucugagcaccagcguauucuucuccugcuuuccagguucauuugaauguguccucauaacagauguggcaauguggaggagggugaggacuaugcaggccugaggagggugaaggguugggugcaggacccacagcuccaccugcugcaguugggggcuuuguaugaucauaucugcaaugugcaccacaggcgcaguagccuuucugguaguauuugcagaugguggacggcuugcuguucaccaagucaugugagaacaggcacuggcuaccuuagagacauacaccaugcauaaaauaccugcaggugaccugcuuggugcucauggugguggggccacuggcuggaguugcacugaaaucucagagcgaccaguacuguggcccagcccagcccagcccagcccgccccaggcaaguagugggucacuucugcgcucuccacuaucaauuguacauuacuucuaaggugccggcuggaaaccuaaccaccaucaucaucaauuaguaauuuaagguuagaucucuuauuaguaauagauugaacccaguacacaucaggaaucaaagccaccuugucuuuuucucauucuuuacaaagacaaaagcaaugccacacaagccucugcugagguggcucuaagcuuaacauuaacucaaauguaaauguuuacagcauuc

SEQ ID NO: 5454 - RNA, 2366 nt, Mus musculus
aaguuaaagaccagugagagaguuuguuccugcuugcccuuccugccuuccauugguuugcucuaacuagcuguaaggaaauccuugacugagcccucagcucacugaggacuuuaacauaaaguaucaagcuaaggcauccucuauuuuugaagaaucaaguaauggguguagagcauggguauuuccuguugcucuguugacaaggagucugagcaguuaaaggaaacugcaaaaacagaaucacaugaauaaaaaucaaaccaaacacauggaugacacgugacauagugaccaugggcuacuuuggcucuugugacuucucuggauagagagugaauacaggaaagagagauuaaugucuggggauagugauccagaugugcuuccucuuagagagccaaagacucaccccuuuucugcuuucucuccaggguuuccauagccagaccaagguucaaauugguuuccagcucacugugcauggucagagcuuggaggaugcuggagggcugccacacugucugcugcacagauaugcucuccucugccuccuuucugcccacucccaugugccuaaaacacucacauacauuuuccuucuccaaaucugaauauaaaugacuuugagaucuugcuguauucccgaggcagaaguuuuugaaaaaaaaaaaaaucaaauuggcucauaagaacagaaaacugagugaaaaaugaaguuucauagaacucaauuggugauuaaauuuucacuuuccccuuugcuuuuuuccacuguauauuaaauaaaauacuucuuauugucuagggaauuguauucuggcuaguggcaucaucauauaugagcccaguuugaauauuaaugauaugacuauauaacaacaccacguuauaaacauuuauuuaaaaagggcauuauguauuuuuaugcauguuaucucauauaauccuuaaaacaaagcaauauguuaauagucuucuucacagucuuagggaugaagaaacugagguucagagagaugaugcuguccagcacuccaaaaagacuuagacuucuuugaccacaaccauguucuucccaaucucauuugcaggccacacugacugcauuguagaagaaaauuaacccuaagucaggaagauuugggcagcugaucagagcugaauuugaugcuaaaggcugucuggaagacagagggagauuacuaucaucuguggucuuacucuguccucagccugauacuucuucuuuucagaugcuguucccucuucauacaugaacaguaagaguguaguaguuuuccauaaugugugguaacugguuaucacuaaucacugcaugcagcccuguuuccucccagggcuccuuuuuggaugcugauaaaucuuucuaauuagcuguaaaacucacaaaaaugagaugucauauuuuaaucguaagagucuugggccacuggcauuuuguugaauucuaguugaauucuuacuuuuguuuaccaaauuggcuggagguuauaacauuuuuaguagaacucuuguaaauccacagaccuuggauuuacaaaggcuauggauuauuuucaguaauacuauuacagaaaugccaaaagagugugugggggcacugacauagugugaaugguugauuuucccauguguugguggaauaguagaagauuuuugagaucuuuucagguuaauucaaugcagacccacuucuaacaauauaauccagcauccugaacagugagggagaaauggccuuacuuucuguuuuguucuuggaaguuagagugaacucccacaaaaguugcagagaagaaucaggauuagaaguuccacugaagaauacagaaagucaaaacuggaggaagugucugacccuaggacucaggugagaucaccauuuucuaucccacgacucucuaaggcggguccacucaggaguacacagaccacagacgugacagagcaucugggaaggguccuaugggccuacaucugcacccaggagguggggcuguuccacagcccucugugcacuggucuugccaggagggagcuggucucccaggagugcugacacagguuuacaaacucacaggaggaacacgcuccagcuagagacagcaagaacaucugacaccagagauuaccagauggugaaaggcaaaugcaagaaucuuaucaacagagaccaagacuacuuggcaucaucagaacccaauacucccaccacagcgaguccuggauaccccaacauacaggaaaagcaagauuuggauuuaaaaucauaucuuauuaugcugguagagaauuuuaagaaggacauuaauaacucacccccccccaaaaaaaaacucccu

SEQ ID NO: 5455 - RNA, 195273 nt, Mus musculus
aauggccggggccugcggaggccgcgcgcgcagcucuccggggcggagccgcugggcccaggguucgggggcccgagccaccucgaggcuguccagccugcggcuccgaggucgcacggggcaggcaagaugucgcagcugcagcccgcaucgcuaaggcggucggcugagcucccgggucccagccgcagcagacgagugcagcgcgcgccccgggucgggcggagcuagaggcgggcgccgggcuggcgucgcgccaccgcagcuccccgccuuccgcccagcucgcgcccggcgcccugaccgugggugcugcugcagguaccugggcgaggccucgagcaccccggcggcggcugcucgggccagaucggcacuccggagcccuucaggagcgcaccccgcagcgccugacgccucccuuagcuccuccucggcgggcgauccccuccccggcccucccccuccucccaccccggaggaugcgcuucccagcgcccagcggcagaggccacggcucccagaaaugcgugcucccgaaccacuucgcccagacccgcggagcccgcgcccccgcccaguagguaggucgccgaggcggggccaggccuugaaggcuaccggcugcugaugcugcggccaggaagaaccggagccucccuccugggcugccgagguguacuaauggcgcugggcgcagcccccgggggacccgaaacgcucugcuuggaacguucgaggccgagccggggcgcagggccacuggacccuccucgcuaacaaucaggggacccucgguugggggcugggagagcuuggaaggauagguuggcgcggagcuucuuugaaaggagaccguugccuuuuucucgagcucaaguagauugugucauugcauuuuuaaaaaacaggaucagcaaaugcguucuuccuguucuuuuugcuaaaauguagacgaccacgguuguuguuuuagagguauuuaggggugguuaugaauuuuuguguaauuuacagcuagccgagugguauauaaagucaguggugcaaacacuuuaacauuuugggugucaguuuaaggaaagucuuucuagaaaucagauuaccuagguaggugauggaugaggcuggcguguucucguaggauaaagcugacuggagccaauggguuugagagcugcaaguuugauacaggugucgggaguugagacucugaaagaugcgccagcagaggcagucuugucuccggccucgccuucaacucugagcugacccuugcuuuucugagaaucugguugagucuuuuuuuccuguucuugaaauaaaaguaauacauuagggcuuuuaauaaaauuguuuccucucaggcugccguuuuggauuuuacguuaagcaauaagguuuagaauuuugaaaaaauuguuauuguaagcuccaauuuuauaagcacuauuucagauuaaagauuuuggcuaacugaaucaauauaaauacuaagaggacagaaucaccaucauuaccagguccucuucccccugcuacuccucgaccaccccccccuucucuucccauucucuaauuccccaauguugaaugccuuauagcuguuuguugguuauuuguugaaugaaugaaauuguauuucaagauacacauuguauauaacccaaccauuuaaaauuauaguauaagauuguuguuguuguugcuagugcaauuaacuguauuuuaaauaauugcuucuuucuauaaacaggcuaacuugguuauuuuucauugacauuuccggcgucaacagcaaggcucuguuaagguucccuucguguccacuuuccaguguuauagcaauuaauaccauuucaauuuuacuuuaaaaaaacaauuuagaaggcagaauuuauguuuaaagaaaucuauuaaguuauuucagaaggagcagugaucugguuaauaaguaacagguaacuuguuuuaaaguugagcugugguuuauuuuuaauauauauauauauauauuguuaaagcuaaagagggaaacaaaacauuuaaaagcgucugugguuccaaaguaaacucauauauauaucauauagauagagauuuauuuauuuauuuauuuauuuauuuauuuauuuauuuuugaugcuaggagccagauccaagauuagacucgaggcuucugauguauugggcuaauccuauuugagcaacaucuucaaccuuagaaauggcauuuuagcuauuuucucuauaaauugagguuuuuagaugauccugugucuuuucugcuugaaaauguuuaggagaaaaagacaaacaaaacaaaaacaaaaaauccguuucuguuugccuuccauuuacacugugaggguuugggcuuuggcauuuguuuuucugucacauaauguagugagucaucauuaacuucuuuaaaaagaaaaaaaaaagguuuguuuauuuuuuaucuaugugaguacacuguugcucuuaaaacaugccagaagagggcaucagauccuauuccagaugguuguaagccaccauguaguugcugggaauugaacucaggaccucuggaagagcagucagcaucucuccaacccccaucauuaacuucucuccuuagcacauguaucagggaacucauuuucuuuccuucucccacccuaauuuccaugcaucaucuuccuuacuauccagaauauuacccacaauccuauuuucacacagugguaaaucauauagaguacuauuucuucucuaaucuaguuggauuguuucagauaggugaagaaaaacuuuuagauaaaagguaggaagaccagaggauauugugggaagagaaggugugauuaaaccaauuuguaugaauaauguaugaaaauaaagcaggcugccaugcccaauaaagauaggggcaauuuuagaaucuuucuuauaaucaaggguauugaguaauucauuuguguuguuuguucuggaaaaccugcuauuuucuaagagagccuguaguucugauaugccuuuuacuucuuuuaaaaugauguuuuuauaugugugugggugucuugccugcagaugagucugugcaccaugugcaugcaguguauauaaagggcagaagagggcguaucuccugggaccagaguucuaaacuguggugagccacuauguagagguuugggauuaagcccagguucuuugccagaguucuugacagcugagcuaucauuccccaccccaaccccugacuccuacagacaucuuacuuuuaacuucuggacaguuacuuguuuguuuaauaccuagaacuugagaacuuucacgaugugcuuugacugugugcucugaaauuagucaaccaaaugagagcuuuuguuguugcuguuguuguuauagaaggaugcagcuucuaauuuauuuauuuauuuuuaaaaaucuccaguguccugaauggaaguguagcaucuuuaggguguggugacucauauguugaggcuugccucaagagccagcugcaacacugccuccacaugcaccacaacaaugcaauucuaagcuucuguucugcaucuagucuuucuguaucuuccuccugguaucugucauuuuaggaaucugucuguccuuuguuaaauguguguuuucuaacucucagcaccuaauauucuuuuuuaaauuaaacagaauccucucaauucacacauacucuagaaucaagauuauuaguauuaugggaaaaacacaaggaaguaaauuuggauaaucuuccauuuagaauauagggaaugcacgguugaagaaaaagauugucuuccucacuggguacacuaaaugcauuuguuucuccauacacaaaggacuauggauugucaauaaacuugauaugauuaacugauaaaaacaaaacaaaacaaaacaaaacaaaacaaaaccgguuuguagagguucaguugaacaaaggucuugccaucugccugucuuucucuuauuuagaccaggagaagccuagcuagagcuuuccaagcugugcaguuuugguuuccuuguucagcauucuugacugcuugacaucuccaccauuacaugcacuggaaaugauucacauagcagacuguggaaaagaaacuacuguuagaucacuucauagaugggaccaagggaaggacucuuacaacaacuccugcuuaaagcccaugcaaagcauucuguugagcucugggugccaaagccaucuauccccugaacaauuaauauuugugucauuauuuccauuaugcaaagagagaaccagauguucuucuuucugucuugguaacaaguucgaggcagauuugcacuuaaauucuaauaacaauuugaaaaacguaugauuaauauuauuagucuucuaacuuucccucuuuuuuccuauuagcuucuguuucaccauguuucucuugauucugauucuuaucuaauuacauuucucauauuuuauugaaugacauuauuuuagaugacucauucuuaguggaacaagaagaaaaauacaaaacaugaaacuggauaaaugaaacaauugcaguugacccccaaacaugugguguuucugaugaacacuuucaaauuggcuacauuaagugaguuuugcacaaguauuacaauuuugauauauuggagcuuguguauguauagguacuuuaugguuuugugugucaacuugacacaagccagaguuaucggagaggaaggagcgucaguugaggaaaugccuccgugagauccagcuguaaggcauuuuucucaauuagugauuaaugagggagggcccagcccauugugggugguacuguccuggggcuggcgguccuaggcucuguaagaaagcaggcucagcaagccaguaagcagcaccucuccauggccuuugcaucaacucuugccuuuagguuccaguccuguuugagucccugucuuaacuuccuucaauaaugagcagcaguauggaagugcaagccaaauaaacccuuucuuccucaacuugcuuuuugaugaugguguuucauugcaauagaaacacuaagguugguaccaggguacuggcauauugcugugacagaccugaccuuauuugggggaggauuguggaaagacuuuugaacuuuggccuagaaaaaccauugaguguugagaccucacugggcuguucuauaggagcuuggaagcuaagaauguugaaaacagugcaaaugauggagaccugcuuugugaaauuucagaggggauauuaaauggcauuagagccauuugcuauuuugguuuaagauucugugguucagauuagcuggaguugaagcaucagcugugauaaacaagauaacagaacuacuaaaaugaaacuuuuacauuacugggacaauugaugcuauuuagauugagcuaagaaauuagcugugauaagaagagaccagcaucucagagaugaaaucuucugggaaauguuucgugagagcagagagaaacuguuuuccagaggcagccaagguuguaucuccuggcagcuggacuuguuaaagaguuacccuggugguauggguuuuggagaugugaaggggucaugcagagaaguugaggcuuggcaccaggaagagagccuaugagaggcuguuggggaaagugaagcccaguuucagcaggagacaccaguguuuuguagauaccaguacaaugggaugaccaacaagaacaguaggcaacaguggagccagccagagccuagaagacaaguuauguguauugcagagggcagagccugagaagugauccaagcccuuuagaggcgcccagaagauugaguggaucucagacauuggaguuuauuuuugcuuuauuugauugugagugugcgcugauuuuucccuccuaagauuuugaauuuuaaagacuuuggauuuuaaaagugauuagauauuuuaaagggacugaaaauuuaauguguuugaauuuguaaagauuuuuaaaguuauguuuuuaaugugagaucuuggggaugaauaagaaaggaaggguuggacuuaauagugauguguuuugugucaaguagacauagggucaguuguacugacuguuuuugugugucagcuugacacagcuagagucaucagagaggaaugagccucaguugaggaaaugccuucaugagaugcagcuguaggacauuuucucaauuagugaucaaugugagaggguucaauccauugugcguggugucaucccuaggcuggugauccuggggucuauaacaaagcaggcuacacaagcuauggugaguaaaccaauaagcagcuccccuccguguccucugcaucagcuccuaccgccaggauucuaaccucaaguuccuguccugacuuccuucaauacugaacaccaauguggaaguguaagccaaauaaacccuuuccucaccaaccucuuuuuuggucaugguguuucauugcaacaauagaaacccuaacuaagacaguagacaaaugggaaacaguauucugcaguuuuauaaaacuaaauuccaauuagguaaaguuaaauucuacuuauuuuuaaacuguugaacaucugcagguauuuggaguuggugaaaccguuucaccuaguucacuuguaucuggaguaucuggauucuauauaguuuucaaaggucauuuucagccaaagggugaauccaauuagcucaacaauuucuguacugaccagucugaccuuugugucaacagaccgugugacuuggccuuguccucuuaaauuacaacacucauuucuucucagagucucuuucauuuaccacaauacuuaaauaauuauauuuuccaagugaauugcccagacuuacuucacuguguaguuacuacagguaacuuaaaaugguugaauugugccaggugaguaguuauuuaucauugugugauacuaugcuugauguguuugucucccaggcuagcagaaacauugccccuacccccugucuccaucauugcuggaaaucuggacucuggcuuaaaaacaaucuccauucaaaugcaacuugacaugauagcagaagguuaggggaagguuuugaauagaggcaucucauuuaauuaccuucucaucugcagucuuucuuucuuuccuauccgugggcauggguagccagagauugcagcuaaaacccuccagggaguuuuuguuuuguuuuguuuuguuuguuuuugcauaugcaagugugaacaggaaaccuacucucucuuguuucuucaacucagccuguucauuguuggucugguaccucagguguuuaggaucaagagcauacauucugcuucugucuguaccucaguuagcucuccuacuaaugccccaucuucagauuuucuaccuggucccugcaaugcaugcauuguaguuugcuuucuuggguucaguaaugaggacuuuaucuucucucccauacuccuuaaugcuuuuugacccacagcuauucuuacacaagcccccuuccucugcugacuggacccuuuaaaaauaucucauggaaauucaguguuauaugcagugcacucgccauaucuauuugcuuauuggccccauguuaagaauuuuauuuuagugauagaaaacuagcuaucaguuuauguccacauauacuucuugugguucccucuccuuagaaauacaucagucucuuggauggauguuugcuggugcacuucucuuccccaguccuuggaaggcagaggcggaggcagaggcagguggauggauuccugugaguuggaggcuaauagugagaacaaccagagcuaccuagugagacugggccaaaccaaaccaaaccaaaccacaaccaccacucuccauuuuucuuaacaggccacacaguucaggcuucaauucuagaggccuuucuuuguucagaaucuguaaacacauggagcuguaaugacuuacacagggcuuguccugacaaugaggcauuucuccuaaguaguaaaauugucuuccuauucagagugaacagugauuuuaauuaucaggucugguaggcaacacaaaacaaaguuggaauauuaaccauaucuuugucuuuccauccuacccaaccaccaccuaauacauguccuuaucacguuuaguaauguuuaguaaucauggcugaauuuaauaacuccucaucaaauauuauauugauacucauuaaaaauaacuauuguacucaucaugaucccucuuugggagagugucuuucuugccuccaaagcuaggcuuuucucuaggauugguauuaaaaggagcuaaugauuuuaauguuguuuugauauuuugcaugcaaauauaucuguacgagggugccagauccucuggaacuuguguuacagacaguugugaaugcuaguaauugaaccuggguccucuggaagaacagccagugcucuuaaccacugggucaucucuccaaccccagaaauuuuacuuuaaguuauuuuauuauuuuauauguauggaguuuugccugaaugcaccacuugugugccugaugcccaaggaagggagaagaggguguugaaucgccuggaauaggagcuacagaugguccugagcuguuaugugggugcugugaauuguaucuggguccucucuaagagcagccaguguggugccacagugcuucauacccaaauacugcuggaagagagcuggucucccaggagugcugacacgccaguuagcacagguacaaccaccacuucugcuuaaauuccuggcccaagagggaucugcccagagccaucaggacacaagaaccaaggaacagccagggacaggauccuucagguuucuuucuaaacaucccagagcuaauccugugccacagcucuccauauccaaauuccucccagagaaaccuggucucccaggaguagugacacacaggcuuguaggagagacaagccgaagucagagacagcaagaccagcuaacaccagagauaaacagauggugacagacaagggcaagaacauaagcaacagaaaccaaggauauuuggcaucauuauaacccaguucucccaccacagcaagcccuggguacccuaacacacgagaaaagcaagacucauuuaaaaucacaucucaggcuggagagauagcucagugguuaagagcaccgacagcucuuccgaagguccugaguucaaauccgagcaaccacauggugguucacaaccauccguaaugagaucuucuacccucuucuggugcaucugaaggcagcuacaguguacuuagauauaauaauaaauaaaucuuuaaaauaaaauaaaauaaaaucacaucucauggugauuuagaggacuuuaagaaguauauaaauaacucccuuaaagaaauacaggagaacacaaguaaacagcuagaagcccuuaaagaggaaacacaaaaaucccuuaaacaauuacaggaaaacacaaccaaaacacaauugaaggaauugaacaaaaccuuccaggaucuaaaaauggaaacagaaacaauaaagaaaucaguaggagacaacccuggggauagaaaaccuaggaaagagaucaggugucauagacacaagcaucaccaacagaauacaagagauagaagagagaaucucaggugcagagauaccauagaaaacauugauacaacagucaaagaaaaugcaaaaugcaaaaagcuuuaacccaaaacauccaggaaacccaagacacaaugagaagaccaaaccuaagaauaauagguauugaagaaagugaagauucccaacuuaaagggccaguaaauaucuucaacaaaauuauagaagaaaacuucccuaaccuauagaaggagauguccaugaacauacaagaagccuacagaacuccaaauagauugaaccagaaaagaaauuccucccaugaaaaaauaaucaaagcaccaaaugcacuaaaccaagaaagaauauuaaaagcaguaagggaaaaaggucaagaaacauauaaaggcagaccuauuagaaauacaccagacuucucaccagauaauaugacagcuagaagauccugggcaaaugucauacagacccuaacagaacaccaaugcuagcccagucuacuauacccagcaaaacucucaauuaucauagauggagaaaccaagauauuccaugacaaaaacaaacuugcacauuaucuuuccacaaacccagcucuacaaaggauaauggauggaaaacgccaauacaaggagggaaaccacacucuagaaaaagcaagaaaauaaucuuccuucaacaaacuuagaagauagccacacaaacauaaaaauaagaucaaaaauaagaggaagcagcgaucacuauuaauaucucuuaacaucaauggacucaauuccccaauaaaaugacaucaacuaacagauuggauacauaaacaggacccagcauuuugcugcauacaugaaacaccucaaugucaaaggcagacacuacuucagaguaaaggacuggaaaacaauuuuccaagcaaaugguuccaagguacuaugagguucucagcaccucauaguaccuucuccaaaacugaccauauauucggucacaaaauaggccucaacagauacaagaagauugaaauaaucucaugcauacuaucagaucaccaaggaacaaggcuagucuucaauagcaacaaaaacaacagcacacauaaacauggaagguaaacaaugccguacucaauaacuuacucaaggaagaaauaaagaaagaaauuaaagacuuuuuagaauuuaaugaaaaugaagacacaucauacccaaacuuaugggacacaaugaaagcagugcuaagaggaaaacucagcucugagugcuuccaaaaagaaacuggagagagcauacacuagcaacuuaacagcacaucugaaagcucuagaacaaaaagaagcaaauacacccaagaggaguagaaggcaggaaauaauggaacucagggcugaaaucaaccaaguagaaacaaacaaaaaaaaaacuauacaaagaaucagcaaaaccaggaagcugggccugguggcacacgcguuuaaucccagcacucgggaggcagaggcaggcggauuucugaguucgaggcaagccuggucuacaaagugaguuccaggaaagcccgggcuauacugagaaacccugucucagaaaaacaaaacaaaacaaaaaaacaaaaaacaaacaaacaaacaaacaaaaaaacaggagcugguucuuugagaaaaucaacaagauagauaaacccuuagccaggcuaaccagagcacacagagacaguguccuaauuaacaaaaugagaaaugaaaagggagaaauaacaacagaacacgaagaaauccaaagcaucaucggauccuacuacaaagggcuauacucaacaaaacuggaaaaccuggaugaaauggacaauuuucuagauagauaccaaauaccaaaguuaaacagggucagggaaaccaucuaaacagucccacaaccccuaaagaaaucgaagaagucauuaauagaagaagucauuaauagucucccaaccaaagcaagcccaggaccugaugauuuuagugcagaauucuaucagaccuuuaaagaagaccuaauaccaauacucuucaaacuauucuacaaaguagaaacagaaagaacacuacccaguucacucuaugaagccacaguuacacugaguauucucccuuguagauguaacaguuucuguauaaucaggguccugucacaauuuccuuucauagaagacuucacaagagauuuuuuucuacuucuaucaaguuuaauguuucaaauagauuuuaaaaacugaaaaacagaaaaaauaaaaaguaaaaaauaaaaggagcuaaaguuccaaagagagugccaugauauuuagggcucuaaaaagaagaaagggaaauuuuggaagucgaacuuguucaaccuugcccuccauagaugacaugaacuaucaagaaaaaagcccaucauaaaaaauaacuuguuagugagacauuuuaaauucuaaccuagagggcaugucaggcgcucaguuuauuacaaaaugcccugaauggggugauggcuuucaugacuuauuaacagucuuugacaguguuuagcccuguuugugugaaauuucuggcugguaaauuauuaucacaagcaaauucuugugucggguggcccaggaagaaugcaggagaauucugcaguuugugcucacuccaggucuccuuguuaaccucuguaauucugaccuccuguugcaaauaucagauuaacagauuuguuuuuuugcauacaaguugacaaaugguaccaagagugcuccaagugccagagacaaauacucuugagccugaaugaauguagccucuacuucauaguggaacacaauuuagacuauuacucaucuguugggagagccugcucaauucuguguucuuagggauuuccagcugaacugugaagauuuugcccaaggaauacccaucuauuaaguccuacugaaacauagcuagcaacauacuuugauguguuacacugcaaauuucaauuuuauaugcccuaacuuuaaaaauuauacauauauacauauaauugagaagaaaaaugaaaaauucauaaauaggaauuuaaaauagcuaagaugugagcaaacauugacuuuauuacaucaaagaauugaguuuauuguaaucagauugcaaaugucagaaagacagugcugacaaaggaaacauuguuucauaucacacagaaggcuagaggguguguugcuauccauuaggcagaagacaguuuagucuuagaauuucccaggcccagugauucucuuuugaaugcacaugauguugauaaugaggccaguggcaagcuagaugaggucagaguggaugcaacagcaagugauguaaccaucauccuacuguuuguuacugccucgugaacuaaggcagguuagugccucaauuaucugucaaaugaagauaauaauaguaucuagccuucuacaucacuuagaacauuagaucauuuauauaaaguacugggaaggcugccugguguaaaguaaggaauuauguuagcuguugucauauuauaaaaauuugagaaaaaucuuaaccauuuuuuaaaaaaugacagcauauauacuuagucaucaaaauaaugguuuuaaauaauauuugacccuguggagaucaucauaauaauugaauuaaguaucagauuguguguucaguggugagcccaguuucuuugggaggaauggguagggauaguagaugucaagagaagagacccuaauuugauuuuauguuauagcagcauagaaaaaaaaaggcccaaaacaggacaaaauauuaaauugguuuuuucaauaugaugagagcaugagugauuuauauuuuucccacauuucacuuguucauguuuugcaaugauauuuuauuaaauaccauauaucauagaauuucuauauucuugccucucaucuuuacagauuuuguuggacauguuuuaguuuccucuucuuuucaaagcuacuguaauuucacuuccucaggaucuucacccacacacaaucuguuggguuuuucuuguaccuaacuugcuuuuuuguguacagaccggucccaagguugugcuugugugugugugugugugugugugugugugugugugugugcacgugcgcgcacucacgugcacccauaugcaugugucugucugucucugucuauguugcuguucuggaguuggagcacaaagcuucaaauguucuacccaugagcucaaugccuaaccucucuggaaaaauaaaacaaguggaaaguuuuuugugcucggcuacccauucuaaggguacccauucugaaugcuggaaugcauuauugccugcuuuuucuuacugaagcucucagggauugcacccuacauuaccuuauagccuucaaguuuguuuuuagcacaguguuacucaaauacacauagagcacaagaacauaggaugguacucugcucuguggcugauguucucaggagugauugaugaguuguggguuuguucauccacuuuguacaugcuucuuauuuucaagauuagaauauuaugucuuuugguucucuuaguauuagguuauuggcuugaaaaucuuaucuagauuuuccuuccccagaucuaaaaucugaacuguucaguugcagaggaugguauaguuggcaguguacuuacaauagggguguaguaauuacuaacaaauccuagcuguuauccauaaaacauugcuuguuugauauagauaguuuaacacacuuaucagaggauguauuuaaaguuuauacauuuauuagaaguuaguaguucucacauuuucuggaaaggaugaaaaccccagaaaguguuuuauuuaacugcucuuauagucucaaccagcgguucuaaaauaggacucacacaccuuaccagcuguaagaagagaaauuuagaauggcuauaucaucuuugauuucuguuuuauauaucacauaagggguauauaaugaacaagacauggguuuuguugucacugccaugugcugaaaaauaggauuuuaaacucagauacuucugcugauguggaauaugcuuaaguacagaucugaauagugacagucacuacuguucuauuaccuacgguugguuucuguuguuuaacaauaaguuaaaaucuauuugaggcuggagagauggcucagugguuaagagugcuugcuguucuuacagauaaccuauguaggguuccuagcagccaagucaggcuucucaugaacacuucuaacuacaguuccaagugauccaacacuguauacuggccucaggugccugucucacuuauacauacccccucacacacacacacacacacacacacacacacacacacacacacaccacuagguaauuuaaaaaaaaauuaaauuccauguccagucccagcuaggaguuguggugcauguuccugugugucuuacuuuuccauugcagugaagagacaaacaacuuauaaaagaguuuauuggugcuuauuaucaucaugguggguagcacagcagcaggcauggugcuagagcaguagcugagagcuugcaaccugauccacaggcaugaggcagagagauaaguaggaauuacauuuacuuuugaaaccucaaagcccaccccagugacacaccuccuccacuggggccccaccccuaauccuucccagacaguuugaucaagugggaccaagccuucaaauaugugaaccaaugggggcauacuaccccauuguguaaaccugucuuuuacugcacagcauuggaaacagucuaugccauuuugggauucacagucugguuaaaaaguguauagaagaaggaaguagaaaaugccaugucaugcaaggaugcacuaggaaacuggcagugugauuuuguucauugaaaauuguuaaaguaugauguguagggcauaauacagagucacauauucuacggcuacauuaaacucuuaucucgaaauaguuucuugauaagcaugugaguuuucaugcucuuaucucccgauuacugguguuaacuggaugaauguuuguuguuacucaguauaguauuugccaguucccuaaauggcauucuuauaauuccuuuaaaugaugagagacaacagcauaguaguccugaugggaaaguaaaguuuugcgacagcaugccuuugaaacagugauaauauagagaaguaauuuaaaaucagcauauuuucauguuagguuuguaaugacaauguacuauaaauaggguggcuuaaaacaacaaacauaggggcuggagagaugacucagugguuaagagugcuuguugcucuugcagagaacccaagucaaaucccaauacccagauggaggcucaaaccuauaacugaagaucucggagcucugacagccucuucuggccuuuaagaacacagagaacaugguacacaugcauacauguaggcaaaguacuuaguauacauaaaauacaauauuuacaaaacagaaaaauguauuuacuuacaguucugaaagcacauuuccuccaaucugcccaucagcaaggacgcauccccucugacaccuguagagaaauuccucuuugcugcuucuacuucuggucacuugcccuuccuuagcuuguaguaguaucacucuaagcucaggcccugucuuuaccuagcaucuucuuccuguguuuuaaugcauagucauuuauaaagaagccauuguauuggucagggcuccacacacugaagagugaccaaaucuuaacuaguugugguuuuggugaccuaccuuccaaauaaagccccuguaugauggacugaagauugugaguuaaggcugugguuuuauggugauucuauucaagucagaacaccgaagaauauauaagucuuuggacaaaugucucaagacuacauaagguguuaacugauguccucucagugaauauucaaaagccauguaaauugggugugggacaacuggaagaaaagaaugauccuuggguguuuugucauuuggcuacuucucuuugugacuacuaguuucucagggauggcuggagaucuauauaaacacaguuacauuuugugugauuuguggucuuucugaugaaacuccauaugugggucaggauguuacugaagacaaacugggguuuggguuuugaaacugccucacaacagcuuccaaaccucgauggcuuuagauucacaagcauuuaugucacaaugaccaggcugcagguugacugcgguuuggcugcucucugcugagcuuggcagugcugagggccagaucuguucuccaugucauaaagcugaugaaggaacaucagguacccaaagcugguucauuagguagagagccgcaacucaccagacuuggugcucugggucagaauaaguaacuuuauuaguacucacagucuauucugcugcucagacaucacgugacaaacuuaguggguaacagcugguuauuguugguugucagugcagcaaaauccguaacugucugggaagccucagugggggauuagguuguccugugaguuaauugaguuaggaagacacacccugaaugugggaagcacccuuuuaagcauggggcacuggacugaaugaaaagaaggagcaguuucugcucaugaccauggaugcaguauagucaguugccuacugacacugacuucucagaaauagaccaugacuuggaacugugaguccaaacaaacugcuucucccuuaaguuucuugugucagaaugucuuaucaaaguaacagaaagaaggaaagaaagaaagaaagaaagaaagaaagaaagaaaggaaggaaggaaggaaggaagaaagaaagaagaaagaaagaaagaaagaaagaaagaaagaaagaaagaaagaaagaaaggaaagaaaggaaagaaagaaagaagaauagggagggagggagggagggagggagggaaggaaggaaggaaggaaggaaggaaggaaggaaggaaggaagaaagaaaggacccuguacuauucuaaaaaguaagcacugcauugcaagcaugacaggggauuggggugggagguucauaacaaaauaaucuagucuacugcagauaaucuucuacaggauucuauagacaauuuuuuauggaguaauuuuguaugaaauaaucccuuuuaaaaaaguauucaccaaaugcuuguuccuugaccuagauuuuuggaaaaauauagcuaaauuuguuucuucccccaaaacaucagaaaacuucauaaugcuggcucaauuucaaacucugcuuauuucaaacuguaguuauucucuuaaggcuaacugcuuguugggcuguuuaaugcuugcuugcuugauugcgugggacaggaucuucuuucuuguucagccuaggcagacauagagcacguucuuuauccuacccugggcuucaaaaggaggccauccuucugccucagcuguagaugcuugguguugggcuuuguuucuuggaaccacaugcugaguucacuccuacuuacacuuugcuuuccagagccaagcugagcagccugcaggucaacaacagcucucaucauuacccaagguggacaaggcaggcuuugugagcucugcugcuuccuggagacugugcuaacaguauuuacauacaggaagagccauaugcagugugcauaacacuccaaacaaacacacaugaacaaacaacaguuuaaggaagcauccugccucaaagaccuucuggaaauaugcagauccauguggccuagccucuuccucuuccuccuccuccuccuccuccuccccucuucuuccuuuuccuccugcucucucuucuccuccucuucuuccuuuucuucuucuucuuccuccuccuccucuuucccccccuucacaagaaaaagaaccaaagaaaaagcaccaaaaaugccaacagauguagagacaaacacgcgugauuacuccggaauccuguaaaaacccaaaacauaaaccaaacaagcaaaacccaccucaauuucacacuaggagacaaagacccuccaaagacacuugaucuaauuuuguucauuggaaaucuacugcagggcauaggacccacccuuaagaguaauuuguuuccccgugagacuuccuugaagaaaagaauacuuucauuugcacgugguuuucaauugaagguagcaucuggauuagagauggagacugguguccauuucuccuuuuaguucagaaccucauuugaugcagaccccugcaggccgugugcaugcugccaaucucugugaguuuuuaugugguccagcccugaugugcuuagaagaccuugauuucuuuugcuguccuucgucucauugacuccuacacucuuucugccucuucuugcacagacccaugauccccgaggggagggauuugauggaagacaucucuuuuaggacugaacguuccauggucucucauucugcaugcugucuggcuguggaucucuauuuuuucucaucugcugcaggaggaagcuucuuugaugaugguugaucaagacaugaguacuacagaauguuuuuaauuagucguuuuaugcugugauccuuagcagaacaguaguauuuguuuuuucucuauaggcucagguucucugucaccaaagcagcauuggauauggguuucaucuuguggagcggacuauaacucaaaucagguauuggguggcuacucccacaagcucugugucacugugauagcagccugucuuauagucagguccuucuuucauaacaaagggcuuguugguguuuaucuuuccccuuugguaguuuguugaguaccuucuagugcccugaauacuagucaauagggaugaaagcucuauguaggcacuagcuugacuucagguucacuaaguugucugagugucuucacucuagggcuuuacugucuuacugggccaccccaggagagccaccuggguuguuugggggaauucccaugggagcccuuuguacaaaagcucgauuagcuguaaccugcuucugguacuggcagcuuuauuuaauagccaauuuggggucuuucuacuucuuaauggggcaauuuuauuuagauuccuuucguauauguauacauuuaaugaagcuucuacuguauuagauuuccauauggcuccccagauaacccuaauuuuuaucuuucucccuacauuuuuucccuuccuccccucuucccucccuguuugguucuuucauucugauaugcucaucucucauccauaacuauucuauuucuccuuccuguggaguucucucccucccuccuagucucuuacuuucuaccucugguguuuuauggauuguaauuugcuucucaaugacuuaccaguuaacauccacacaaagagaauacuguaaccaugggcuuuuccaccggcacccaaguucccagaauaaugacucuaagacuucuuacauaugaauaaaugcuuaggccaauaauagcuuugacucauuucugcuagcucacaacucauuuaucccauuuauucugagugccacauggaugcuuaccucgucuucaguuucaugugacugucuucccuggaguuuagggugacucuuuccugcaccugacgcuacuccagaaaucaccucccuauuuccugccuaagccaacaggcagauagcauuuuacugacaggugaugcuuccauacauugcucaagagucucucuagagaauacaagccaucuuugucuuucuaggucugauuaaccucacucgggaugauuuuguauuucauucuucccauuuaccugcaaauuucaugauuugauuuuuuuuaauaguccacuguauaaauguaccacaucuuuacuuguucaucugcucauugacaucuagguugauuacaauuucugucuguuaugacuagagcaaaacugagcaugguagaacaaguuuuccuauaguaagaugaagugucuuuuuggugugugcucaagagggauauacuaaaucuucaggugaauugauucaucuuucugaggaaccaccacacugguuuccauaauggcuguacaaguuugcacuccaacagugggugagugaguguuucucuuccuccacauccuuaccagcaugagccaucacuucuuuuauugauaugggccauuuugguugauguaagaugagaucucaaagugguuuuuauuugcauuuucuucaugacuaaggacuucgaacaauuuuaaaaaguguuucucagccauuugcguuuucucuugagaaauaucuguucauaucucuaccucaauuggguuuuuuucucaaucuucaguuuucuggauucuuuauauauuuuagauauuagcccucuaucagaaguacaauuaggucgcccauacucugagcaaagaacugugggcagaggagucgggguuagugaggacugggaggcagauacuuugcaguguucaaauccaaaucaaggguacaaaaaugcagagcaauaaagccuuuaacuuggagaagcagaaucauacuccaaggaagcagcagcagcagcaccaucaucaucaucaucaucaucagcagcagcagcagcagcaacagccacccucaccaauaucugcaaaugaccagcaguccagcagccagaugaaggcuucauucuggccagcagccagaaugaagaauuuuaggaaaccaggagagaagaccuuuacacagcauagccgucucuuugugggcaaucuucccccugauaucacugaggaggaaaugaggaaacuuuuugagaaauauggaaaagcaggcgaaguuuucauucauuaggauaaaggcuuuggcuuuauuugcuuggaaacaugaacccuagcggaaauugccaaaguggagcuggacaacaugccccuccgugggaagcagcugcgagugcgcuuugcuugucacagugcaucccuuacagucugcaaccuuccucaguaugugucgaacgaacugcuggaaaaagccucuucuguguuuggccagguggagagggcuguagucauuguggaugacugaggaaggcccucagggaaaggcauuguugaguucucagggaagccagcugcucggaaagcucuggacagaugcagugaaggcuccuuccugaccucggccugugacuguggagccuauggaccagugagaugaugaagagggacuuccagagaaacugguuauaaaaaccagcaauuucacaaggagagagaacagccacccagauuugcacaaccuggguccuuugaguaugaguaugccaugcgcuggaaggcacucauugagauggagaagcagcagcaggaucaaguggaccggaacaucaaggaggcucgugagaagcuggagauggaaauggaggcagcgcaccaugagcaccagguuaugcuaaugaggcaggauuugaugagaugucaagaagagcuucugagaauggaggagcugcauaacuaagagguucagaagcgaaagcaguuagaacucaggcaggaagaggagugcaggcgcugugaggaagugaggcgggccacagcaagaggaaaugaugcgccgacagcaggaaggauucaagggaaccuucccugaugcgagagaacaagagauacggaugggccaaauggcuaugggaggugcuaugggcauaaacaauagaggcgcgaugcccccugcuccugugccaccugguacuccagcuccuccaggaccugccacuaugaugccagauggaacccuuggauugaccccaccaacaacugaacauuuuggccaagcugcaacaauggaaggaauuggagcaauugguggaacuccuccugcauucaacaguccagcucugggagcugaauuugcuccaaauaaacacccccgauauuaaaguugcauugucuaguuuccugcagcccuuaaaagaaggguccuuuuuggauuagccagaauucuacccuggaaaaguguuagggguucuucccaauagauaggccuucccugcuugugcuacucuagggagcaugcuugaaggcagaggggcgagggaggggugguauuuaacaagucaaagucugugguauagugcuuuaucaagucugucuggugcguuccugaacuauauugauuguugagggccuggagaaccaugggaaaaugaacucagagcuccauuaaucuugaucauaaccucccccccucuuguuuuaauuacuuucucaucuuuauuccccuccaccccugaaacacugccauauauaccacaaaacauaaauauccuccaaugaccuagccccaucccuccauucacucccagguaagaauucagacaaauguccacagagauuacagcauagauaugguucuguuauaucucauauaugaccccuuuguguccuaaggaagacauuuucacuuagagguuuucauuuuaguacauaaaagaaucuucuguuaccuugccuccaucuuuuucuuggguaaggacuacacuuugugucucugauguugcuguucacagcuuuucuugauaggccuaguacaaccuugggaacaggguugcuguguggugaaggucugacaguagcucuuaguuuugccuaucuuagguagcuacgcugugcguuuuuauugguguacuaugaauuguuccagauaccuucaauuuggaaaguuuucugagacauggagacgucaugcagcaucagcuuauuaaaauacauccgaagccuuaaaaaaaaaaaaaaagaaguacaguuaguaaaaucuuuucccauuuuguagucugcugcuuuggccaaaugacaguguucuuagccuuacagaaguucuucaguuucaugagguuucauuuauuaacuguuguucuuaguaccuauaguauugguguucuguucaacaugucuuuuuugugccaacuuguucaagacuuuuccuucuaucagauucaauguauuuggccuuaugcugaggucuuugauccauuuggaguugaguuuugugcaggaugguaaguauggauuuauuuauauucuucuguuuuccauuuuaauacacauauuuucuaauguguaguucuggcuucuuuaucaaaauuaagauauacauagguuauggacuuauaucuggguauucaauuugaauccauugaucuaugugucuguuuaugugacaaaaucaugcuuuacuacugcugcuaccacuacuacuacuacuacuacuacuacuacuacuaccaccaccaccaccauuacugcugcugcuacuacagcuuguaguacaauuugaggucaauuugaggucagggaugaugauaccuccaucuuuucuuuaguuuuccaggaauguuuuagcuauucuguguguguguguguguguguguguguguguguguguguuuccauaugaaccugaaaauugccuucccagguucuguggagauuuguguugaaauuuugaugagaauugcauaugaacuacagauagcuuuugguagaaugcccauuuuuacuauauuaauccuacuuguacaugagcauggaaaaucuuuccaucuugugauaucuucaauuucuuuucccaguggcuugaaauuguuauuguacaagucuuucauuuacuugguuagagucacccuaagauaguuuauauuauuugaggcuauugugaaauguguuguuucccuaauuucuuucucuguuuguguuuuuuuuucuugcuacuuuucugaaaguguuuaucagcuguagaaguucucugauagaauuuuuagggucacuuauaaauacuaucacaucaucuagaaauaaguauacuuuuacuucucccuuuucuauuuauaaccccuugaucuuuaacagcugacuuauuuuucuaacuaugaccgcaaguucucuauuaaauaguuacggagagaguggaaaacuuuaucauguuuccgauuuucguggaaauaccuugaguuuaucucuauuuuaguugaugcacgggcuuucugcaaacagucuguauuauguugaaguaugccacuuguaucccuaauuucucuaagacaggguuuucauuaaucauaggaaaaugaggucaaugcaguuggcuguacuaauaucccuaagcaucaucuccuaacacugcacuccagcaauagcagauggcucaggguucuccaagccccgcuuguucucagacauccccuucugcauccucguuccagccaacuuccugugcauuccccugcugacuccugggccuccuucauaacccagcagugacaucaccuaugacuguccuugacacccucccucuuccuggcagucauuggcucccucuugcucugcuugccuuuguuucugccagcaccagagcauacauuuuucaucuugaaugcuugaugagccacuaccuccagcccuuccugagcuuccaggcugcugaagggcugccuucccucugcacaccccuauaggauauucgguucacaguagauauuuccacaggaauccacucuguuucugcugagugagugguuuuuugaggacaugcugaaucucaggggucacugguuccuauuuaggaaucaucucuuacauuguccuugagaucuuugcaaugcucucuagugcauacuuuauauaacccucuuucuagcuuuagcugaaauuaaacccuuucccauuucccaguuuguagcaugucuuacauaguugaucccuccugacuccugguuuuugucuuggagagcucuuguaugaauuuccccuucuugaacuuguaaaauaaccaguucaaauuagaguucuucauuuauaguaugucgugguuugggugggauuuccuacuaugcaguaaguauacacugaaacucucuugcuuaauucaugcuuccaaggaagagaaagugaacacaaauugaucccucacuugcuuugcagugaaagcacuuaggugcauuucccuagagacaacguccucgacagauucuuuuuuuuuuuuuuuuuuuuuuuuucccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucaugcuaguauaugcaauggugucagcguuuggaugcugauuaugggguggaucccuggauauggcagucucuacauggucccuccuuucaucucagcuccaaacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuaagccucgacagauucuuaacccuuuucuuguucauucauuugccucaggcguaaccuuuggcucuuucugacccucucaucucugcuuuguggcuguugcacugugugugugauuacauauuuguuuauuuggacauugucucagcugucuugcagguuuguggcacacauuuggauuugguucugugucuuucuuccuauguuuuucuuuuuguuaagaaaaacauucaaauuucugaccuggguuaauagugaauuuugaauagccuuccauuguuuaaaugcggcuuugcgagagaaggaacaccugucguuuugcuauguguaauuuucuggaagaaaagugucuccauaaaagguacauuuuagucuguucugcaggggccagauugagugucacuaagcccccagcaugugugccugucauuauuucagcuguguauuaggaaccauguccuugggaaaagagucaguggcuuugagaacugacccucccugguuauauaccugccugcucaaggacgacaguguaucacaugugggcccagaagccuuguaacacaguguaguccacacugguuugauacaauagggaguccccacuagcucuguccuugaauauguuagugauacuauagacucacacagaggacacuauacucagaauuaaaaaaaaaaaaaacccuugucugggucauagcuuuaaggagcggagggguuucauugaaaaaugaacugaauuuagauugauauugaccauucugguuuaaaauugaagaaaaaaaagaaagaaagaaacauuuagaugaaugauuuaucuugcacgcucccucagaaaacacuuuuaggucugcaauagaccauaauugcaggagacucuuguccugaguguaucgaugugaggaaugucaacauuaaaugaaugaagggcuuuuaagaagcccauuauaagcacuuacccggaaaaugccauuccuauuagagacugaguuaggggcucugcuuccucacuggagcgugaagggugccaugugguguucccuaagggucccuucccagcauccaguguggaucgcuuccuguuuuaucuggugcuguguuuccagaugaaaugaguacaucugucuuguuuuaagaaucauguuaaaauguaaagacugaaaaccaaacaaaauuagcauauuuuaauucaucuaauagaauauugggagucuggaagaguaggacuuggacuuaauuauaguuguaaccagaaaaauagaugccaguucucggauuguuuccuugucccucucuugccuauuuuuaucaauauuuuucuucuggacucaaaguauuagcaucuggcucagcuuuuaauauaaaaaauuuccaauuagauugucauggcuucauauuuauucaugagaagaaaucuaauaaacagaaaucauaacauauugaugccuuguggaagagaacuuuaaaauaggccaucuggcccaggcaggauggagagccgaggauuugaaucaauucaagacucugaaggaagcuauaucaccaucaaauuuuuaaauauuuuauuauauacaaugcauauaauauuuauauauuugucauauauuauauguaauauuuauauaucaaacacauuuaaaguuuacccuguguugagcucuuaacagcaaaucuggauuaaugugaccucuugcuuaaauaacuuuugucugaauugauaccaauuacaauaccauauacuuaggaaaagucaaagacaguggcagccaaggugguguuuggccugaaagcacugguuugggcugugggagcuaagggaagagauuugucacacauacgaugcaaugcccugagguagaagauagcaagugacuugcauuccugaagaggagagaaaagggcacacaagaaaggccugugcuagaucuggucuggagaaacaagguaaccucaagcccaggaaagguaugaagaaaaggguagaguugagaaagagccuagauucaaacuguaguguggggcagagcugaguggagcuggagguucacaccugccuuucuccuuucucuuagaucaccccgauucuuaguugagcauaaaguaccucagcucacugcaguuuggccuccaugcccacugcucuuuguacccaguucuagcugauaaugccagcuacacuugucuugccugcaugguauuuguuugaaacauuggccauuguagaucccaaguuacauuuuuuggcucaucucccacuacuuuugacuccaaaguuuauuacaagacaccggagaguacaaaacuggaucuaaaucacuuuaauucucuugagugagggaaauuaguugauaucucagcugccucacauccccaacccauuuaaagacaggguuucugagugaagugguucugaggauuaacaaugaagauaauaggcugcaauaaaugacuugguagaugacaggaaaauugguuccuuuucccaguccuauccuccugauuacauauuccuccaucuuggggccccucaucucucuuuauguaucacaguccuaacuacccuguaugcuuuguuaugcuacuguuucuguguuagauccugaggguuaguuuuugacagcucaaaguugcuacgauccauuggcaauuugcuccuguuuguuucccccaugggauuuuguauuuuuauuuuuuugaugucauagcuugugccaagcuuccagagugaucucauaguauuggguuuuuuucuuuccuuuuuauuuauuuugucuuaaugauaaccacaugcugcaaauuucuuaaucuuuucccucuagcuuuuacucucccccugugccuucauuguaaccaagugcaccaaaagacuagaaaaugucuccaguugaccacccacaggcucuuagaagccauacgugaaucuucucacacaccaccucccacauagggugcccucuuccuguacacagaaugguagcucuauugucacaguccaccuggucccagaagcagaaacauggcggccuccauuccucccugugaauaaucugccacauaucaauuugccugucucuuaaguguuccucagauucauuccccuuucuguacuaugugcuguugcuuagcuuucagccuuguucucuuuaaccaaauugaacacugucagaccaugauucugccacauugaccagagaaagaaucaaaccuaugacuuccuuucauucacaucauguguagcaauuggaguauuugcucacggcauggcugcugcaaauacaguccuuuggguucacuuagagguggcuugcaacagccugaaagaguaggaagugcaggaugcauagcagggauggugggugggucuuuagcaugacaaacaagaucuuccugcgccuuucucuuuagccccacacugcuguguugcacacuuggcgcugguagcucuucuguucucuugcuuggguucaagcagaaccacuucccuguagcugucuugggaagccugcaguaauaccuacauccuuagugugugaaauguaggcgucagacggcuaaguaaggcugaaugguuuguuuguuuuuuaauguugacugguuuuuuuuuuggggggggggugucacaaagauggugauucagcaguuaugagcauauacuauucuugaaaaaaacaguuugauucccagcaugcacagaaggcagcucacaacugccucuaauuccagcuccaggggaucugaggucucuggccucuguaucugcacuuaugugcauguauucacacagagacacauacauguaauuaaaaguaauuuuaaaacaauaaggcuuuuaauugacaaaaauugcauuuuuaucaaguccaaccggacacauuuugagcuauguacauuuuagaaugcuaauuuugaguguucuuucuguagucuccugugggcaugucccuucugaaacaauagauucuuauaacguugcaguucugugucugccucgcauaugacaguggaucccauuagagcaaaucuaacgccucauuuagcuuggacuccaaaauaauagugccuuuccuauaguguauguuguguauggaacuguacugaauuaaaauaaagacagagaccagucuguuuuguaaauguacuuugcuuucuugacauuuuaauuugaucgaugagcauacucaguauugugugaaugcgaaagcauugucaguaacugaacuugcggaagcuaguagacuuggagaguuuugagcagaggacuagcaugaugaaagugguauuuagggaagauugcuccauaaacaagcuuuuguuauugguuuaagccaccacagcauggguaguugaggguaucuggcuagagcaaguaccgaaaggcacagcuuucagaguaguuugcucugggcuuuccuuuccacaguugcucaaguuggauguaaguuacugaauguaaaagagaaugccaaagucauuuuuacuuuugaacaaagcaucuuucuagaaaacaccuuaauaagccaucuucauacuaccuaugagaaguauuuauagugaauuuuggggaaguagaguuuguguguaugauauuuuaaaaauaaauuuauaaaagcagaauccguagcacuagcccagucuucuagucaguaaaguguuuguuuugauauuauuguuaauuaugaagaaagcauucuggcuugguuucccauccuaggcugcuuuguggcuuagcauuauaauuguaguguugugguuugccugacucccaauccauuugcauuuuguacuuuacucaugugacuguuuccugguuaaaguuuauccuccauuuguuuugaaccaugucacucugcuuuauucugcauauuaucagccauuauaaacgucucaacugauaguugcuuuauuuuuuuaauugcaggaauaugacucacugauuaaagaggacguuuccaaauacuuuuucacuuuuagcuguguauuauggauacuaaggaagagaagaaggaacagaaggaacggaaacagaguuauuuugcuagguaagcauuuauuuuccaauauuauaucagugcagugcuuuaaaacacuaacaaaggagaagacuuugaccuggagaacuacuuggcccuuuguguucugugugauuguucaguauccuccacuuugaccuuuguaaaugacccccuucuacuuuuggugguucucugagacuacaaccucucaguguauagcaggcuggugcugucucgcaggaugcuuggacuuuuguuuuaacucuagguucuuagcuccugcuggucaggaacucaauuggcugggcacucauguaaaaucuuuauagagaaucacugcuaagaagcauguguuucagagauggacuaaacgagacaauuucacuagagucugcaucuucggcuugucacaggcucaaacuguuuggcugccacugcucauaauuaagugaucgauaacgcuguuggccucagagccacccuacguuucgaguacucauuauuaugggcgggcuuaguaugccuaagagcugaauuuagccuucuucaauccccaacccucacucuaugcucggaaacaugcacuuccuguuuacugaaauauaagccuuggaacuaaaaccaaaggauuauuuggucaauauauuuauccagaaauaaguuguguuuuagacuuuuaaugggauaaaaauaauagauugaaaccuuacaaugcaugagugcuuuagcuguacaaccucaauauaagcccuggacguagguuguuuuaucuucauuuuacaaacaaggcauauaagacucagaaaauguuucaucuacuucaugcaacuccagagucaguauucaaacacaggcugucuccaaaggacccgccccauucagaauaauaaaucacaaauugggcaauuagcaaaggaagaauugaaguauuuacuauagcagaguauuuccuccucuuaggacuauaacaacaaaauaggggaaggaagaaaucaaccaugugauagaugagccauuagaaaaauaguauguucaggguaaggacugucuuaacucuuuguuuugacauaacuggcuauugccuuauagacauuuguaauaguagagaaauccuguauccuucagucacuuccccccuuacauguuucacaucuaggaaacugacauugaugugggaugcugccucguguguguguguguguguguguguguguguguguguguauguguguguguauguguguguguggugugcauauuuaguuacacgucuugugauuauauuuauuuggcaaguagaguaucacaguuaacaucuacugguguuaacugguaacuauuguaacuguguuuauuucccagacucucccugacaccuuuuuaacuauuuaguggauucuuagacucaauuucucaauccaagacuacaauauaaaugaaaucauauaccauauaaccuuugguaauuagauuuauuuuccccucugugauuuacuugugaucuauccaaauuguugcauguauugguuaccaauaauuuauuccuuuguguuaaaugauuuuguuccauugauggacagauguuaacuuuuuaguuguuuuuccauugaagaacaucccccacccccaccccugguuugggcuguucauaaacaaagcuucuuauuaccaccagucugcaaauuuugugugaacacaaguuuucauuucucuagguuaaauacucaauucuugggucaauaauacauuaauauuuuaccuuauaagaaacugccagucuuuucagaaugaauaguuguaucacaugacauucccgccaaccauguaugagugguccuguuugcacugucgcuagcauuucauggagucagcacuuacuuuagccguuucaaugaguaugcaguaagaggucauugcaguuucaguuaauaccugaugaacauucuguauacauuacgaguguucauaaguacacugccaccucuggaucuucagugaaauuuaucugcauggcuuucucccauguuuuaauugaaucuccuguuuuuuacuguugaauuugggggcuugucacacauuuuacguauagucuuuuaugggauggacaauuugaaaauauucuguuacagcuaguaguuuggguuugcuuuucuguuuguuuuuuuguuuuguuuuuuuuuuuuuuuuuuuguuuuccuuuuaguagagcacaaguuuuaaauuuuguucuggcucaguuuaucagcuucugcuuuugugaguugugcuuuaggugucaagggugacauuucugucccuguccuagauucuaaagauauucuuuucugcuuuauuuucuaaagguuuuuagauaauauuuuguuuuauauuuaaggguuuauuacauuuugagcugaauuuuguuugagauguagaauucaagccaaaguucucggguucuuggcccuucuuuuucccuucucucuacuggugcccugugcaaacaguucuaaaauugcuuuccuagucuggcuacaaagggaucuccacaucccaauacuaaccuguuugaugaugaacaaccugcuccauguugccuucuuguccuguaacugugaagagagccccuucaaagcacacagacccacacagggaaaaagcuuuacagcucauaagcauccacucauuugugaugugcaugcaccuuguccucuucugaaagacagucagaggaaaaccaugcuggaagugcuuuggugugagcucagcaguuuccuggguacaucaaggugaaacaucacugggaccuuaagacaaauuaacagauuugguaugaggaaauguagacagcaaugggcaaaggagagaggcagacagagaaagacauacagagauauagaaaaagacagagauacagagaaaggaggagaaucgggagacacagaagagaaaagaggaggaaaagagagaaaaagaagagggaaagaaaaauaagagggagggagggagaguaaagauggagagagaaaaagaaaagggggaggaagggaggggagaaaggucaccuuguaguuuagcuauauaaugaaacccauaaauggugacccugcaaaauuuaaaacaaccccccagaaaagaagaaaggaaaaaaaaagaaaagagaaauaaaaaggagcuccccgcacccccgagucuaaaucuuuccaaaugcuuccugaugaaacuggaauuguuauaaggaggaauugcccaauggaacuuacuugagagccaguuucuggccacacaggcgaauuuuucuggggcaguguacucaagggcaguccaagcaaggccaaguaaucucuggagaaacacaaagucaggccaagggcaaggccaaauugaugcaaucccagucuuucucuaaagucaauuacauacuuuccuuaaagcuccucuugugcucagagaagaguaaaggcaaggacugucuugcucugcucaccaccacuguauguaucugagggcccaaacuccuuucaaaccauuuuccuucuuuccaguuaguaaauagucacugggguucuuuugugcuauguuaucaugggguuucauaagcauuguaugacuuuguuugguaaauacacuuuuaccaaaccucuccuucauugaugugccuuucacuuacagcaagguuaaauuuaagagucuaccguaaaccagcauacugccaugagcuuggaaucccagcuccugagagucugaacgagacagaaguacacagacgaaggaggggcucaaguucaacaggaacuuggacuucauagugaaucccagauuuaguaaauuuuuaaaaauuuauacuucaauaauccuguauugaauaguuauuugaaaucuaagugggacaguggauucccacugguuguauuuacucugcuuaaguccuugcaagcuuuuaggauguccgaccuuggccaccugguuuuuaaggacuuccauagaauuguuauuuagugagauuggaugauucuugggaccuuuccucauauuuuugcaaaggauuuguaaacucaaauauauuaucucuacauuuauuaucgccuugauccuuuauuuuuuguuuguuuguagaacaugauuuuaauauuuucaacuguuaauauucaacaaacaaaaucguuauuuuuaagauccauuuuguuguuaugucucccuuuucauuuuagauuuuauuaauuugaguuuaucuaucuuguugauuuuucccagcuucugauuuuguugauucuuuuuauaguucuuuuuguuccuauuugguaugauuauuuccugccaucuacuccucuuggguguauuugcuucuuuuuguucuagagcuuucaggugugcugucaagcagcuaguguaagcucucuuuaguuucuuuauggaggcacuuggaacuaugaauuuuccuccuaccacugcuuuuauugugucccauaaguuuugguaugaugugucuucauuuucauuaaauucuaaaaagcauuuaauuucuuucuuccuugaccaaguuaucaucauugaguagaguguuguucagcuuccauguguaugugugcuuucuguuguuuuuguaggaauuuaagaccagccuuaguccgugguuaccugauagggugcaugggauuauuucaaucuucuuguaucuguugaggccuguuuugugacugauuauauggucaguuuuggagaagguaccaugaggugcucagaagaaggaauauucuuuugcuuuaggaugaaauguucuauacauaucuguuagauccauuugcuucauaacuucucuuaguuucacugugucucuguuuaguuucuauuuccaugaucuauugaugagagugggauguuaaagucucccacuauuacugugugggguacggugugugcuuugggcuuuaguaaaguuucuuuuaugaauguggguauccuugcauuuggagcauagguguuuagaauugagaguuuuugguagauuuuuuuuccuuugaccaguaugaaguguccuuucuuaucuuuuuucaguaacuuuugguugaguguugauuuuguuuguuuguuuguuuguuuuuguuuuucgagacaggguuucucucuauagcccugacuguccuggaacucacuuuguagaccucaaacucagaaacccgccugccucugccacccgagugcugggauuaaaggugugcaccaccaugccuggaugagaguugauuuuauuugauauuaaaaugacuacucaaucuuguuucuugggaccauuuccuuggaaaauuguuuuccaaccuuugacuuugagguaguguaugccuuugucacugagguguguuuccuguaugcagcaaauugcuggguccuguuuacauauccagucuguuagucuaugucuuuuuugaggaauugagucuacugauauuaagagauagugagaaaaaugauucuuacuuccuguuauuuuuguuacuagagcuggaauuacauuuguaacugucuccuuuuggguuuguugaaagauuaguuucuuguuuuuucuaggguauaguuucccaucuuguaucuguguuuucauucuauuuuccuuuguagggcuggauuuggggaacaauauuguauacauuugguuuugucauggaauaucuuuuuuuucuccuucuaugguaauugagaguuuugcuggguguaguagccugggcuggcauuuguguuuucuuagggucuguauaacgucuguccaggaucuucuaacuuucauagucucuggugagaagucugguguaauucugauaggucugccuuuauguuacuugaccuuucucccuuacugcuuuuaauauucuuucuuuguuuagugcauuugguguuuugauuuuuaugugacaguaggaguuucuuuucugguucagucuauuuggaguuuugaauauuucuuguauguucaugggcaucucuuuuuuuagguuggggaauauuucuucuauaauuuuguugaagauauuuacugguccuuugaguugggaaucuucacuuucuucuguaucuauuauccuuagguuuggucuucucauuguguccuggauuuccuggaugguuugcauuaggaucuuuuuguaucuugcauuuucuuugacuguugugucaauguuuucuaugguaucuucugcaccugagauucucucuucuaucucuuguauucuguuggugauguuuacaucuaugacucaugaugucuuuccuagguuuucuaacuccaagguugucuccuuuugugaguucuuuauuguuucuauuuccauuuuuauaucuugggugguuuuguucauuuccuucgccuguuugauuguguuuuccuguaauuguuuaagggauuuuuguguuuccucuuuaaggguuucuguuuaccugugcucuccuguauuuuuuaaagggaguuauuuauguucuucuuaaaguccucuaucuucaucaugagaacugauuuuagaucugaaucuugcuuuucuaguguguugggguaucuaggacuugcuauggugggagaauuggguucuaaugaugccaacuacccuugguuucuguugcuuauguucuuauguuugccucccuccauuugauuaucucuagugcuaccugcucuagcuauaucugaccggagccuguccuuccugugauccugguugugucagaaguucucugaggucagcugucucugugauccugugauucugugauccugagauccucaguaugucagagcuccugggagucaagaugccuuugggacacuaagguccuggugugaacaagcuccuggcaucaugggauccugugauccugugguccuggguguguuagagcgccuggggaguuguuccuccucuggguguugugggacuggcugagcaguucgcccacaauaucuucucugccccuuuauccuuaaacaugucucgaaaaaguaaaugaaagccuaggcaugaucaugcacaccuguaaucccaacacucaggaugcagaggcagcaggguuccuacauguuucauaacagucugucuacauagcaauucccuagccagacaagacuaguacaaugagacucagucucauaaaggaaggaaggaaggaaggaaggaaggaaggaaaggagggagggagggagggagggagggagggagggagggagggaggaaauacaaaaagaaaaaauaaccucaaaacauaaauaacagauguaaacaaaacucaccaaaugacgaauacaauuauuaaacaaauguauuccuuguucugcuguucucugggaugauauuuaaguauggugauccugcgugccugccuuuccauuguuaaaaugcggauauuucuuacuuuuuuugccaaauggacucccccacucccauguuuauuugauauuguuugcacccugugauuuucauguuuguuccuguguguauguguguacauaugugccugugcaugucucugugugugugugugguguuuguguguguguguguguguguguguguguguguguguguaauguguguggcaugugagugugaauguuuuguguuugugugugcuacauguguguauuuguauauauguguuguguguaguguuuauauaugugguauguuugccuauauguguguguuguguuguaugucuguaguguguuugugugauauguguguguugcaugugcauguaugugugugucugugugucuguguauguauguguguuauuaaggauuguucccaggaucuccaguauucuaaacauacacacuacuacuaaacucuaccucaagcccaucuuuaaauguuuugucaggacugaugaccugaauuugagaaccaugauaggagagacugcguaccucccacaguuuguucucuuaccuccugacaagugcugagacauggaccugcccagacccauacuugggaaaauaaaaaguguaaaagcauuuuguuuguuuguuuauuuuuauuuuuuuuacauuguuugaacauauaacguuucaggaucaggguuacuugaugacauuaaaccaagugguauguuccgggagauuucuggacuuucuggaaguuuccaggaggacuaugggaggguugugggaagacuacaggagcguuacaggagguuuuuuuuuuuuuuuuuuuuuuaccucuacaagguuugggaggucuggcaaauagaccgugagugacuaagcucuauagaacagucugccuucccuagacuugcuggcucccagccuccucuuugcuuaucaugaacagcagaacugccccucccucccacucucuucucuuaccugccccugucagggccagcgguaucaucccaacccccucugucagcagcugcaaugauagaggaugcagaguaggagcacacuugagcacccauucccacuccugauaacuaaagcugcacucccacugccaaccucugccccagcguuugcaauccugagccucccaguuaccgagguguggcagucacuucaguaaacagcccuggacaaguccuugaaacguccuauacauuucuccaguugcuaaacacaaauaauacacuguaaaaauuuuaucguaucauuucuuauaaccacugagccaucucuucaucaggcauagugguaacacaccuuuaaucccaacacacucaggagccagaggcaaauggaucucugugaguuugaggucagccuggucuacauagugaguuccaggauagccacagcuacauagugagacucuaucuugaaaacaaagauacauaauauauauccacuucuuucuuaaagauucaugguaaauuuucccauuccaguagagagaaaccaagagagcuguguagagaggaaaauuuccuggugcacugaaugaaugcugagaucguuaauuccaggccuuccuccaauggcugccugcacuuugauccucagcagguccucauccccacaggcuggucucaucuggugagcugcuucuguuguugaggucagggagggaacucuuauaauccaaauuaaaaucacgagcuucccagagacacuuagguaguacaguuagguagaaaauuauaaaguagaauuauauuguucaaagggccuugagaaaucugaguuucacauguauuuaauggucgggcccuaugccuaugaggcaaaaguauuaaugauauacuucugguuuaaccccagggcacuguauagucagugacuaguaaucaaagucacuguuauacauuagggaggcaugccugaguuguagccucucugcgcuaccaggaagaugcugagguagcaggaggguaggacuuguuauuuuuaucugugaucaccaucuuuuuccaggacucauuguaacuauuacugucuuacuccaugccuuuauguaagaaaggcuugggaaaauggauccauauaaucuuuauaccaaacaucugauaaauacagaucuuuauuccugauugggauuuggcucuuacauaaauugggaccuauguuaauuuaauaucagguuggcaaaaaagcaacaucucagcccacuauugucuguucccauccagagcuuuuccuucacaacccugcucaaggccacauggcaccuuuuggcuaaagguaucuugugaaacacaguuuuuuaaauuguaggcauaucccacauucaugaaugugagggucuugaaaaauuuggcaccaagaaaagguuucccgacauagaaugaacaaaguguaacuguaaaucaaacuuaaaaugaguucuggggaguuuuugaguggcugaccgugcucuguuacacagccucccugcagccuuggaucuaaacacauagcacauggguguauacuguguauacuguauacucagugcugggcacuguugccuaaaauaccucagcuccuauuugagacuacaguaugcugugaacuguagcauguuuacuguauauacaggugcucuguuuuuguagaaacacaguuuaauuauagaaaacaaagauuacaguauuucucuacucuuauuccuuagcaucuaaguaucaaguuaguuaguaugucuagauuuuacuguguuauaauguuuguuuuuuaaaaguauuauuauuauuauaauuauuacuaauguacauauguauaugcuccauaugagugaagaggacagagggauaucaggucuccuggagauggaguuacacgcaguuauaagcuuccaggugugggugcuaggaauugaacucaggucaucucugaaaaugauauauguucuuaaccacugagucaucacuccaaaccauaaugcuugauuguuuuaaaauugcaguuugaauugcugagcugaguuuaacuuaaaaaaaauuauauggaucuaaucuugggccuaagauagaauguacaauauaauaguuucugugauagccuuaaacauacucguguccuuugugcuguguauuuaugaagugacauuuucagccuugacaauaauaaaauaaaaaaugugggucuuuucugaagaauauuagaaaugguaaauguucaauuaccagcuaagaguuauuuauuuauauaaaaauaaacaaauucauuuaucucauuaauauacaaaguugccuuccucuguaauaaaugacaaauuauacaaaugccaaaauuauuuuaaagugaauggaugacuuauuaucagugaauguuuaaucuguacuugugcuuuauaauaccuauauauccagggucacauacaaguuucucaggucaaaagaauaauauuauauguaggaaaaguuugaagaguucuuuuguagguuaaaucaggcuauguaacuugcuguuccucauacuguggguggaacagucauccauggggaauccuggcagcuuaaaacuaucuuaacucauuguaaauuaaaauggaaaaaauucacucuagcuucuagaacuucaaguuguuuauaaaagaccuuuggacaguauuuuguuugugcucugaagauauccuguacuauguuuaaccaaguaacuccaucuaucauauuguuacuauuaguguauuaaccaaccacagugauaggaaacccuggcugcauauuucaccucugugacaggguuuugaauccaaucgucgucaaagugccugguuucucauaauagacaugaacacagaaauauaccugacacaaguucugacuggcuaugcugccagauuggaugaggacaaaggggcaugcucuuccuccgcacauccucagagcauuaucugauccuagaaagagcccaucaugugggcagaguggugucacgugaacuguugcccuuggaagcugaagucuguggacuguuuuguccugcuggccaucauuuggcugcccgcuugaaguuuuaggagaaagugauuagcagcuggagucagauauuccuucagaucacaguuuuccucuguauugauacuugaaaagcaaaugacacaauuuuaagcagguggucacuguuaaguuuauaccucuugccaguugguuuuacucugucagcuucacugugcuugcugcucccacaagaucaugcucuaugugaacauuuacugguacuuuacaaagugccuuugcaaacauuugcuuuaugugcacgcuagucugauggguagcuucaauacacgugaugaaucuauuguucguguugccugucggguagcaugcuuggagugacccacagcucggccuaugaggucuggaauccauucugcauagcucugaauuguuuauaguuuauaguccaucuccucucaaaaugccaccugccaggagaagacucuuaauggcuuagugcuccuuccgugaacuaacauagucuuuggcacauaaccaguguuaaauauuuacugaccacgugaaagacagaauauguuaaacaucauuuuaaauggacuauaaauggauagugagccuuaguuuuuaucaccauaagauuugccguucucagugauuuuauuaaucuuaaaacuauuaagaauauuucauaaguauugguuucuuuggcugguucacuaaucaaacuuuugugugcacagugcugcuguuuacaucuuuauuuuuucuaucagaccaggcagcucuuaagggaauauuuacaaauuacuacuguucauuucugggaaaaaacaucuacacucaaguuugaccugcuaauguuuccuggaaaucauuaacuuuuuucuagugauuaaaaaggagcuugugaauacuuagcuauuugcaguuagaaucauguguuuugcuucucuuuaaggagcagguugagcaauuugauugaaucccaagugccauuuugcuuuuucagcuauagguuacaacccaccagggagagguaggucaugaguucaauucaguagauggaagcagcaguuaaaaucuuuaauugacacauaaccauauauauuuaugagguauaggguaacauuucaaugcaugcauauaauauauaaugaucagaucagaguaacugacaugcuuauaacuacaaaaauuuauuguauuuauuucuuuguauucagaaucaucucuauuauccacuugacugguucucuuggagcccaggcuaccuugaagccuggagaguugagaaucaccuugaacuaacaaucauucugucucagauucccaaaugcuaggauuauaggagugcuguaccacuuuguuuggcuggaccuaagcuuuugagaggcuucugugcugguuuccauagugguugaauaacucgucaguccuaccaauggugugugugaauuuucugucuuccauccuccccacucauucgcagugugauugugugcuaucucauuguguuuuuuaaauuucauuuuaauuuuuaaauuuuaugcuugaugauguuggacauuuuuauuugugugcuguuugcuuuacuuuuauuuacuugcaucauguuugaugaugcgagucacuggugucaucaugccugaugguaggcaccuucccauguugagucaucugaagagacccauuguuuauguuauaguuggucauuauacaucugcuuuagggaaaugccuauucagauuacuucuuauuuuuuaaccauauuaacagauuaggacauaaugguuaaaaguggguaaccuggaugaaguagaaauaguaguauguuauauaguaucaaaauaaaguuuguaaaaauuuucuuauacauauuuuaaguauacacacauacacaaaugcuaaaucauuuuuauuguguaccaugcuucaacauuuuuacaugguuuuagaaggcccuuugguuaguaucuugggaaugaguuugcuuuauacccaaguauaagaguauuuuuuuuugagugucuuugaaauuauuuaucuaaugaguauuaacauuuguaucuucuaagaauguuuucccacacacacugcagcaucauggcucuauauuaagguuagcuaaggguuaacaacauguguauuuagccugaaaucccaggugagucuggaugcuccacaucuuagaagaucaguaaauuaaccuaacaacccucuaccaaacuguugucaggaagccgaggcuacuuaugcuuuggggccuccuacagguuccagucuauggagcuacuuacuagccauggaucucaggcauagguuuuguuguuguucuugcuuuauuuuuuuuuaaugucucuaagauagaugagauaguacucuguccucgaugagguuguuaagaggacugaguaagcuuggguuugugagguggcucuugcagaggacuggauucaguuuauagcacccacauggugguucauaaccauccauaacuccaguuccaggugagccaacaccucuggagcacagcagguacuugguacacacauccugaaauaccugcauggagcaaaaucaugcauacacauuuuaaaaauuuucuaaaaaacuuuaaaauacaugaucuuaagaacaauacuauuaaaauaagugcuuauugaacuuugugugauggcauuugcuuguaauccaacauaagacggagaggugugagugagaacugugaauucaggaccagucuggguaacauagcaaggcaugucugauauaagagaaacacuuauaaauucaaggaauuuauauaauucuugaaauuuuucaagaaacguguuuuugaugacauucauuccaacaugaaaugacacagauugucugggaagauaagugugguaagcuaucaccauaccaugauaccuggguucuguguguguguguguguguguguguguguguguuuauacucacaugugcauauuccuuaugcuuuuguguuucuuuuuuuuuuuuuuuuuaagauuuacuuuaaagcugggugugguggcguaugucuuuaaucccagcacuugggaggcagaggcagguggauuucugaguccgaggccagccuggucuacaaagugaguuccaggacagccacccugucucgaaaaaccaaaaaaaaaaaaaagaagauuuacuuuaaaucuuaaaaucuuaaugguuaaggucuaaacuuggugugaauguuuuaucuguggccccgaaaucacucuguuucuuuacuaugaacugaguauuugugcugcuccuccuagacuccuaaacuaagugcucgauuccgcaguaucaauaggagggaccucuuguaagucaucaggcuguguaauagggcuaaggagaguacaggacaagaaagugcccauccaucaaccaggaagagggcccucugcaggagucaaauugaucagcaccuagacuuuagucagucauaugaaggaauaguuuaagcagcacagucuagaguacuuuuguugcaagcggcaaauaucauggaagacacguacacaucugccacuuuucacuauugccgacacagugaguuucacuaaaguaaaauugggguguggaccggagcuuugugcuucagcugaggaacgucauagcucccacaugaaacucaaccacugaugauuuuagcaaaaaucucuuuuccccucuuuuuuuuuucuucaaacucccuccauacaauccacacuagccucaaacuuaccauccuucugccucagcuuuguguaagcaucggucuuuccaccauccucauguccuaagugcugacugugguccagcauccuggcugaugugguccagacaacucccacuuguguccuaguugugauuuagcaucaguuggcucccucuuauccccacuguuuugaucucuuccccugauuucuguuucuuaaacuuugcucccuuuucaaaaccuuacuauauuauauucuucagcaugcucuuguuauagccugugauguguauaucacucugaaacucauccugaguuggggccuuaccucuugaggcuguuccaguuucuuucuucuucuuaguggaucuugaggguguuaugggccuaaaggaccauucuaaaccucucuugggacccuugacacagucauucuuggaguauauccaggaaugcuguucuuuucucugccuuguuuguaaaguauuauuuaguuaguucuuuucaaguugcuugguuccuuacaaaagucuagccccaugugccauacucaucaguugugagugaguuguuugcuauaaauaauaguuuguagauuauuuacuauuugacagagacugauuugcauucuguauagccucauaauaacacaacgaaguaguuucuguuaucauccuuauugacaaagguguuacaccuuagaugugguaugcuacuagcucaaggucacauaacugauuggcucuggaugcaagucucucaguccuuuuauaugaccucucuaccacacuugacuacuaugaauccauguugauuugcauuuuauagaaccuuuuaaguucaaaguacaaggauuaguaagaaucacuaauuaaaugauaaaacaauuaaauguauuuaaguacuagauuuguauauugugauuuuuuuuuucauuuaaagguuuacuuaagaacuuuggaacaaacuagagaugcuaugguuuugaaagaauugccugacacagcaacaacagagucuucugaccuugucuuugugugguuugacagcaauucgcuuuuuguuuauuuugucuguguauucaguguaggaucuuccagcuuaguugcgucugacaugaaagugcugacagucuuuagcuguggggcacuuuuccuuuguuuauaguucaguauagagauuacaugaacaagaugaucauggcucacauugaggggccuuauccguauuuuacauuucuauuauauaauguuccaucagacaucuucaugucaguaauaguacucuuugauuacauucucuccucuuuucuuugcccuuccccucccguuaacugccucucccgcacaguuucacuucuccauuuuuguccuuuguuugugcaugacuuuauggauagauaaagagugugagccacagauaagaaaugucuggcagaauucauuuagugugguguucucuggucucucccuguccuugguggugcacucuuguugagcacacagcagcacuggcugccugcuuucacuuuuuccgucucacaccuaaaucaaaacuaaacuggaauauguagcaggccaaguuuaaggagacagauugguccaugauuugcaaauuugaagauggcagcaacaggaagcacccaucucaguguuuuggggugggguggggugagggugaguugaaugaggaacuuuuauguuuguucugaagcaaggcagcaucuagugucugcugaggggaagggaagggucuuugcucaauaaauucuauuacuugcauauguaacugauuuuauuugcagaaaagucauagaugauuuggaguuagggagauggggaauauggcuuaauggcuguacaaugagauaggaaguguuuagguacagagaauggugaccuagguuguuuagauaugcaaagcccucagaugcauauggauuauauaaauaaaaacuucaaaugucucuaagaguuuuauuuauuagaacacuugguaagguagauggacaaguuguaaccauuugaauuuaugagguacugaaaaacgauuuauuugugucuuaaauauuuucuaaacuaaagaaaaacauuauguccacgaaucauuacucuagcuuuugcaaacauaauuugacaagauacuuaaauacauuuaaucauauagaauacaucuauaguaugcgacagaaaugaaccaaaauagauccccuuuggaacacaggaagucuuuuacauccaguagcagcuguggaugacuuaccucagcucucauuccccucauuuucugcacaugugagacugccuggguugauugugacaaccacacagaacauauacuuuauacuuuauagcuacaggggguuuguuuuagauguuacauaacgugugauaugaggcagauguacugggauguuucaggguaauuucgucagccggagaaacagacugcugauggaauuauuguuuccagaaagcaauugaacagaugcugcuggggucccuggugaaaacaaucuccauuuuaauggcuccauuuucucucuccuuccuuccuuccuuccuuccuuccuuccuuccuuccuuccuuucuuucuuucuuucucuuucuuucucucuuucuuucuuucuuucuuucuuucuuucuuucuuucuuucuuccuuuuucuucuuuuuucuuucuguuugucugucugucugucuuuuaagggcaaauauuuccuuuaacucuguugacccaacaauuuaaaauagauaacaggagaauuuaauuuuuguuuguuugcuuguuuugagacaggaucgcucuacauagcccuggcugaccuggaacucacuauguacaccaagauagcccugaacucacagaucaccuaccuauuccucccaagugcuggaacuaagggugugugccaccaccccuggcugagaauugaaaauuugaaaaccacaacagcagauauauauaacuuggauacuuuuucuuucuagauguagguguaauggagggggcagggggaguuacagagauagcgcagagguuacgagcacuuguugcucucacugcucuagcagaagauucaguuccguucucagugucagcuugacugcuuauaaucaaaugcaauuccaguuucagagcauccaguacucucuucugauaugagacuugcacaugguacacauucauacaugcaagcaaaagacucaugcauauaaaggauaaaccugaaaaaagauuuaaaagugaguauauuugagguauaaaaaugagauaauaucugggugguggcacaugccuuuaaccccaacacccaugaggcagaggcaggcagaucucuguaaguuggaggccagccugguauacagagugaguucuaggauagccugaguuacacagacaaggccugucuuaaaaaacaacaacacacacacauuaauauaugcgaauacauuauaaauauaugcaaaaauguuauuuuuauaagaauauauuuuaauauuuaaaauauuaagauaauauauaaaauauacauauuuauaauauuuuuauaaaaucuuuaguuuauguauggguauuugcuuauauguuaugucucuguguaguauguguagacgucaaaauagggcaucaaauucucuggagcaggaguuagagagguugugagugccauaugagugcugggggaaacaaugcucuuaaacauggagccaucucucuagccccuguuuauaauaucuuuaacagaucauugaaauugugaagugaucaauugaguuaugaaccuaacacauauaaucuuuccuucuucauccuguuuauuuuaaugcacgggagaaaucauuugcuguuuauguuaucugaugcaacuuaguuauguaagacuccuucuaguucuuugacucaaacaaugugagaguuuguuagcauacuacaguguuuggauuugaaauguggcaacaucuguguuacaaggugaaaggucuccacuacuuguaugcacuuguugugcccagagggcacaguggcaagcaaagcaaacaggcuccuugcugaaguuaaauuuccauagagacauuaggcgaagcaaaacacaaaugcacuaaccauuaaaauugugcuugcuguggggaacguaaugggcuauuaucaaaaguacuuagaagggcagcaggcacucuacauaggaggcauguuccaggaagaacucuggacagaaaugacacuuagaugucaugugauauucuuuauacaggggacaaaaugugucauuaguguuuaauaauuugauugugaucaagaacucuccagguaaucuuuggauuuagaacgagagcucuggacagagaaaaggcgaucuuugccuaggggaaaugcuuagcugaaaaggccauacaagugauaaaaaaccauccuccuguguuugcagggcugucagggcaucuugaacaaaugcuuuagaggaggaacauucaagagagaagagauuuguaaggacagucaugcgaggcugcacggccauauuaaguuuagacugaauagcuagauguauggaauaaccauaagagggaacuauaaaaguugcaguuuugagaaggaaucuaaugauauaaguaggcaugugcuagacuuggggugcuugugagauauccagugggaccacuaaauucacaguuggaugugggaggcuggagagaaaacccgguggguuugggcugacauggaagcuuaagaguucuuggccccaaccaugggagggaugugaucauauauacagagggcauaagucagcauagaauagaacugggggguaaggaaccaaguuggaacuucagcacuuaguggucucguacagaaaagggaagcagaaggagcccaaaggaggaggagucacagcaaccacguaagcagaaugugucaaagcggaaggaagguucagcaguuuagaaagcuacagcagagaguaaaugaagaugaagacugaaccugaguugacauccugcagcuugaccauguguacaugguaaagacuaaaaagcauccauuaggacuguccauuuggaaacuguagagauagcuccacugacagaguguucacuugcaaguguaaggaccugaguucaaguaagaaaagccaagcaugguggcaagcacuuguaaucccagagcugggacacacacacacacacaugcauacacuuacauaagacacauaugaccccagacacacacauaugacucauaugaccacacacauacaugcacauauauaacuauauaaacacuugcauacacacacacacaugacuauauacacacacauggacacagacacuacacaugaccccauacacacacacacacacacacacacacacacacacacacacaugaccacauacagacacacacacucuugacugccacuaaugaaugaaugaauaaaagcagcuccuguguacaggugggaaaagccuguuguauguuaguggaguccaagauucugggcaauucuuuuggagccuuggcuaaaagggcagccagaaauuccuuccaugccaugaaggagauuauagaauucugagaaggauguuuuuaggauugaggaggagguaugagauuaggcuuguuggccaacagguacccuccaucagagaaaucucucaggaagauuagaagacuagccucucuguaauggcaucaauguucaucaagcagagcaugugccauacaagaucauuuauggccuggccaucuugggccuguaauguguuguauagcuuggugguaugcagguucucuguagcuacuuguucacagugcuaguugcuuuuaaaauaugucuguucuaagucuucaggacaucucccugaggaaguugguuauugccuuucucaucuucacaagcaaugagccaaguuugaucacacaguaacuaccacagucacacagcuagcuagcaagcaauauggcuaggucuucuucuuacuuuguucaacauugaagcuuugacuccuaacuacuaccuucauaguaucuuccagauacauugucaaaauagagaauccuccuccauaguagaaaacuucaauuguaguaucuuaugagaaauucauuuaaaaauuuuaguagcuaaguuuacaauucuaaacucagaauuuuaauucuaaagauuuaauuguuaguuuccagaaacuuucauaauuauuauaauaugccucauaugaucugucuaaagaugguugaagaauuccuguauguuucaguuuacuaaacaucuuuauauguuuuauaguuuuauaugucauuuaaagaaguggaugcauaguuaaugcuaggaguuagagcaccccugguaguaucaacauuuuuucuugcugacaggcauuuuaaaaauaaauuggcaauuuuauaaacugguuuuaguauauaaguguuuuaguggaaucuguuauagaugaguaccaguguuucaugucuacuucaaguggagucugugcucuugaugguacuuguggcaaugcugguguagcaaugagaugccucuugagaacgccaugagccuguugcaucguucucuucuuggaacugaaagcagccggccagcagcaaaccuguuucuucauguucauaugagcaacacacagugaaauacuugugucugcucaguucugauaacagcagcuuauuucuuucccugaauacagagcucuggguaucucgaggacauuucaugagcaugguguuucucuguguguuaucuuuaggggaagaguagcaguacccagugauaugacuaguagaugaugcucuguggagucugggaaguaagaagagauggcauuuucuaagucucaggcucaugucagcugccuacuuuauugguguuucccuacuuuucuaauacaggaaccaugccuaacuucagaaucacaguccuuaguugaaaaaccuugucuagucuaccuugugacgacuggaguuuccauuacaccacaauaggccuuuuccagcccagacuuggcuuugugaugucccagggaacuccccaacucccugguuccuuauuugaaaaauucucaucuguagaaagauuuuucagauuuuaguuaaauaagacaucuucauggucuuauugagaccuuggcaugcuauucugugaacuccaucccaccuggcagcacugucaaaaucaugccuacaguagugugcccuuauuuaaguacccacaguggcuagcuuuuagcagccaguaauugauccuuaaaagauaacaaacccguugucuaaucccuguugcuuuauuuuuuugugggaauugguaucaggcugcucuauauguuccucauaccaaucuggugguuuuuuuguuuuuuguuuguguguguguguguguguuugacaacuagaugaguuuuauaauuuuuucucuaaaaucuuuugggacuguuuagaaaacauugguaaugguucuacagcucaaaguucucugugaugcuccagagccaacugguaaugguucugauucucagaggauugcuuccaaugggaguacgucuuucaucuugucuuucaauuuccucugagccauggaaguguugucuuuuucaguuguuaacacauuuauucgaugcaaucucaaguggacuggagcuacaauaucacaucgacuuaaccucuuucacgagcuaccuuauuaagugugccaugggcugagucugcugguccuugucucaucauucucucagcaucccugauacuucuggguuacucuccugcauuguucaaaagcagcuacuuguucagagaucuaauuucccaucauucuguugcuuguuguuugcuuuccuucgugcucagcuaugcguguuuuuugcccacugaagccugacuucaucaggcugcauuugcuucuuggcauaccuuccuuugugauggaguugacagagcuucuuuuugaagaauguuguaucccucuggagccauuuccuuugcauucucuagcuaugaaauaguauucaucuauccuauaagaaauauacaaaggacuuucuagaaaagaaugcauggccuauuauaauaauauugcauauaguguagaagggaauugccaaaccucagagguguaaugcaugucuuggcuagcaaaauaugguagcucaggacuuucaucccacuaauggggagggauugucaagcagagcucugugaguucuaagucaucaugaguccaagccagcaagacauugucuaaagaaguggcauugugugugucuucaaguggaaguaaccguuuuccaugaagggaagaggaggauagcaggcaaagagagaccauguggaggugaacacuuauggagguacacagguuuugcaugggacaccaacacugagagaugcuuuguuuucucucagacaaguguguguguguguguguguguguguguguguuggcagucuuuuuacacugucuauucaauaauucuauauauuccauuuaauuuauagccaauauauauuaggaagguaagaugaaaacgucauuaaagauccaggucuucaagauucauccugaccauguaaaggcccuggggaaucccuuacagucucuucccucaguguuuucacugugugugacaaguucgucuggaguaauuguuuugauaauucuucaaaaggucuacauuuuauugccucuuauacuaaaccacucuuccuugaugaaauuuugguugcuuucaaucucccuaaacauauuacucuuaaagauaaaacccaaagaaucgccaucaaauauuuaugaaacaauuccaggaccuauuuguaacuuuucagauaauaacacacaggcggcagcuccuuguucuccuaagaugaaaauuucccacugaguuggggaaugagucuaugaggccacaaucauugcuucuaaccuggcuguuuacucuugguuguaaagagccuucagccaguuucuaagagucuaacauuuauagaugcuuaaagaucaguuuccugugagcuuugacugauggaccauguaaaauucacaacuaauuggagagaaaugugccaacuuuacccuuugaagaauggcugcuccgugugggagguucuuuaucgggacuccugaaagcuaccaggaaucccgugcuccaguuugcaucgccugaugcuccaaaugucaggccuguggauuggcauuagaucgucuuuucccugaguacuguggucucuuggccacguuucugcugcauauucuaccuacuaacauuuucuuacuuguuucagauauucucuagaaauucagguuuuuauuuguuuuguuuuaaucuugcauacauuaauuuccaacccuaaguccucaugguaaggaaagagguugaauuuuuucaauugaauuuuggcucuaaucuguugaaguguuugguucuagaaauuucauggcuuguuuccuugacgucauaaaguuaagucaucugcauugcuuauuuagcuuuauugaagauaaaauaaaaguuaaggaaaauuauagcugucaagugucaggacgcugaaccagcaugugugagauucugagugugauacucagacuggaaaaauauaggguuuaguuaggugaauagauagcuggacucucagaagcacaaaucauucgagcuggucuuucccuucagaauuucaguagagguggagacagaagguuuccugggaacuuaggaccuugacgcaccccagcauuggcuaucuauguuuuauauguaacauucccacguaaacauccccaaaaggagccuguuuguuuagcccaugcugcuucaaaaauuguugagcucugcucugagcucagcgcugcugcuucagccucugcaaacaaaugcugcaguuccuagcucaagccauucucugccugcccucccucuuuguagguacuguaacauuguuuccucaggggaaaaaaaaucaaggacuuuucaaaaaacuaccaugcuaaacuggcaagcuucaagccagcuguucucaaccuguggguugugacuccucuggggguugucaccuaacaccauuguaaaccguaccuacuuacauuauggucacaacaguagcaaaauuacaguugugaaguagugacaaaaauaauuuuaugguuggggaucacuacgacaacaugaggaaacuguauuaaaagcauuaggaagauugacaacuacugcuuuaaacuauuacucaaaaaucaccaugaauaaaaccaauacugggaaaugacagggccuuuaaaaucgaguugcacuucacuuuaauucacagugaaaggucauuaaaagaaacauagguggcuuucuuagaaaaguaagcauagugugcuugguguuuaccagggaacucuuaagaaucgccugucuguaugucucauaucacuggcagagaaaacgaaauaacugaaaagauagaugauauuucuuaaauauguguggucauaauauaguuuguuagcuucaugcuauuaggaaaugugaaagcuuuggaguauguaugagauucugaguuugagauucagacugaaagaaaagaaauuuaagggauuuuauaaugaacagcuaaagauuuucauucucuaaauaauggaucuaugguauaugauuuagauuuacuuuguuguucauuuuuguagacuuuuagggcugggaaaugugugaccauuuaccuaaguuaacuucuugguagaggugcguugcugagucauagagguugcuauuuaaccagggucacuggacucuuagcuguuguaagccacagacauuugcuucuagccccagcucuucucuuccugcaagaccuaaccaagggcugcugugaaguuggcaacucacuccagaagcuaaucuccuacccagucacuggcagccauugguaugugaucuugugccaagacacauagguacccauuuugucauaugauaaaacucaccagcuuucccuuaaccagggaagcacaacucaccagccuacauuugggagucacucacuuagaaaagaaaaaaaagacaaaaccucuaccucuuaugcaaauuucacuaaaaaguaacagaaaagagaucaaagugccuuuaggaauuugcagguucauagaaaguuaaaguccaggacuagauuugucuguagauguucuuggaucagcacgucaguaccaugugacuugauaggccuguauggaagcccgcucauucuuuggucuuuucuacuucugauaaaugcugcugacucagaaucccccauugugcaagagcaggugcugcugguguauuuacuggcuggucacuuagguccaagguguccugugauuggaugagcaccaagagcuuucuuggagcaagccuugcaacccugaagccagggaaacuagcuaggcuccaugcuuugauugggcucaauuaugagaaauguuucuuucauuucuggacaugggguagagucccacccaaaucuaccacugagugaaagguauauuuauugguauuugagcugugacaaaauaccaaagagaaauagaguauugggcaggaaaagucuaggacagcuuuuuguagucugcaaagcucuaaauuacgaacuguauuuaaaaauuuuuaaaagcagaaugauuuaaaccaaguuuugaugagacaugggaguguuuuaagaauuuuuuggcagugcuacaaauugaacccagaacuuuacacaugcuaaucaugugucccacugagcccuuucugaaaacccaacugggguguuuuggaggccaaacauacaguuguuaauugccauuguugaacacauauuuuuuaaaauaauuuuuauugaguuuccuaguugagauucuaugauuuaagaaaaaaauacuucuugggaaagguaauggaagagauaguuuaguaauuauugugucacgguaaaugguuuauaacucauuuacaguuuuaaguuuuacacaauuuuauauagaauuuagaggaccuaacucauuguuuagugauaaauucccccuaaaagaauaucugaauuaauauugauauaaauaaauuaauauguugauucauuaguauauugauagggaauccuguuuguuuauguaguauuaauaaugaugauuauggguaaugcugaauuuuacuuuuuuccugugccuucaugaauugugaugaauucauaaguuaaauguugagauccucuucucacaggacucuuuagcaggauggccgggagacugugugaggaugggucgagagacuuuggccaauagaggugacauuucccucaguuuugcuuuuauuugaauuauaauugauauaauccuggaaaagucucagaagucguugaagaugugcuuguuuucuccuagcugaugaaggaguauuaaccaccccagcuuuucauccagacaauuuuaggguuuuaacccaagcuggguuucacugugcuuuauccaagagcauaaaauccauaggaaauuuggaagaccaugaaugauucaggccuugucaauguuugauuaaagcacauguauuagaagagauuuauaugagaaaaucuaugagaaauugccucaucauuugucuauagcuaucaacaaaaccaaccaaccaaaaacaaucaaacaaacaaacaaacaaacaaacaaacaaaaaaacccaaccaaccaaccucuggaagagccaguaggguagcucuuugauauagugcuugucuaauacacaugagguuucggcuuaauuuccaaaaaauaaaaaaaaaauaaaaaguucuguugguaaaggaugcucuuagaaacagugcuugaacaguguuugauuauucugcuuggucagucaggugauaagcuggugucaucuuuguacacagugcagcaagggaauuauaaacgaagaguuuaugguagaauacuguccagucucaggggcauugugugcagcucaaaacacaacaaaaccccuguauccuucuuucaaaugcaguuugguagagauugauuucucuuuuuacauuauguaguacaacuucauuugggcuguugguccuuuuuauugccuguggcaggugagauucugauuugugaaauccaacugauagucugagaaacuuggaagggugaggcaggaagaucacaugaauucagugcuggacuauagugugcugcacaggacaggcaucuguucuaacuuuggcaccagugugguagccuacugggagcaggagacuaccagguugcuucuaguccaauuggauaauuuguaauuagcuuauucuaucuuuccaacacuggcauuuguuuaucuuauuuuuauauuuuuauucacuuguuuauauuccacuuuuaaauaucuauuucuauuuuuaagagagagagagagagagagagugugugugugugugugugugugaacacguacaugugaagguccaugguccauauagagaacaggugccauggguccuccuggcgcugcaaagagagguggcuaugaucugccuagccagggcacugggaacugaacuuguguccuccuaaacaauagaacugcugagucauuuuccagccccuaucccccacuuuuaaaucaccugagaaaaacuuaauauguguaacucacauaguauguaacuggucuuguuuuggccuagucucaacaguuucacauucaaagaaauaaagaugauagggaaaauaauuaaaauaauucaaauaugugguucacgucucagaaaaugcauuguguauuuuuuuaaauuuuuauuuuucgacacuggaucucagauaguccagcgucacuuuaaguucacuguguggcuguauuggcuuuaauuccugauaaccuaucuucuguacuauugggauuacagguguguaccugcauuuaauaaaaugccuguggggcccucucuccucaugucuuuacuuugugcucgacucuuguuuuccucccaaaccuuucacuuuaucuuggaaccuaugcaaaagcucucuccaaauucgcugacuguaucuccugaugucuuugucuagccucuuucuuuuccuucagguccuauuauuacuauuauuauuguuguuguuguuguuguuauuguuaauuauuauugcucucucccccaacauuguagcccuuaucuguccuagaacuugcuuuguagaccaagcuggccuccaacucagaaaucuacuugccucugccuccugagugcugggauuaaaggugugcgccaucaacaccugcuucagguccucuuuuauuucuucuucucaucugugucauuucuauuucugucugcuucuucauguaugucuuaguaaggucugaacaaggaaagggaagaaagcaaaccaauaguuacgucacagaacuaaggaaaauguccaaggcguggugucuucucuuuguuguucauguaaaauuaucuucucuauaauugaacugaagguacagaucaaaggauguauaaauuaguaugaaaaauacuagauugcacacuaugaugguuugaauauauuugguccaggacauggcacuauuaggaguuguggccuuguuggaguaagugugucauugugggggggugggcuuugagacccuccuccuagcugccugaaaacggcuugcuccuagcuuccuuucaaugaagauauagaacucugggccccuccagcaccaugucucccuggaugcuaccaugcucucacuuaggugauaauggacugaaccucugaacuuguccuuuauaagaauugccuuggucauggugucuguucacaacagugaaacccuaacuaagauacacacuaaacuucauguaguuagucugaaaguauauuuuugacaguauggaccagaauccuuuucauguuucuaugucuucaugagugacacauacaucaguucuuugcaaagcauuuucuguguccuacuucugugaaaugacaaaggauugcacauggggacacugaagaaaauguggcauauuuguaucacccacagaagaaauuuauuguaacaaccuuaggcaaaauggguggcaugaggugcaacuugguggaagucauucugcagagagcagcacuguacaguaugaggcuuuggccuucugguagucugaaaugaccaaauaccgaagaagacuaauaguacuguagaauccacuguaacauacggguggaagacacaguaaucuucagccauggaugagggacaacugggaaggaaggagaaagcaggggcugcugcuucugcgucccacccuguuuuguugugugguacuaucagucccugucguuccguuuccugggccuucaaagggagccugaaauccagcuucuccuguggaucaccugcaucuugaaugcucaucguucauucauuuggaucuuaagcaacacuuuuggauagagaauguuaauucaucuaucccuuguaggcaguagaauucugcuucuuaaaaugagucuuuagcaguccagcuguguucuucuaugcuguguuugaguuugguugucugguaaaaaugaggaguauguguacuuucugauucucugguacuuucuggauguugcuuauucaguucaggucucauaucaaucccugucuaguccccaguuccaucaggugcccagauguuaaguguucaccucuacaagaauggccucuuuucacauuccaaucagaugccccaugucucaggguaaccuggcuucuguuugacuuggcuagaauucugggggccuuccaugauccucuccccagacuguuucccuggaaggauuuguguuaacucgagaaaauaccccguuuacacuuuuauuuguuaaaaaggaugcaagucagagcagcacaaggaaaaaguuggcaaagacauggaaauuugaugggcacuaagcuguuaugucuucuucauguacacuauccuucuagccuaaauguguucagcacccugaaaacucuuuggacuuuuagggacguuuaauggagguuucuuuauauacaucugauugcuuagaucauuggccaucagugaccaaauuccccuuccaguuucuugugucucuccugagaucaaccuugcaaggacaaggcuggaaacucccaacauucugguuacuuuggucuugugaugacuacucuucaucuugagucucucugggcaucucuccuaucccugacaucgagucauuccuagaacaacaacaaaaaaagacaccucuuacucagagcauuucaaguguuuuaggaucucaggacugagauaaaaauuacagauuuacuuagaguaaagguuacauauuuauuccuguuauugugguuggacacuuagggaaugaugauagauagccugaacaugaccaaaaucugguuguauggugucgauccuggagaaagguccccuuagaauauuaaagcaaggaccauauuuuccuuuaaaagucucuuuuguguuuacucuuauauacaaaugaauuaucccuaucccagaguucuauaugaauauuaagaaaaagaaagaaagagagaaaaaaugaagggaggaaggaaggaaggaagggagggagggaggaaggaaggaaggaaggaaggaaggaaggaaggaaggaaggaaggaaaauacuuuacaggauuuuuuacuccaauuugugaucaauaaaaccugaggaaaugacuaauaggccuaucaaguaacaaaacaaaaaacaaaaaaaccuaagacaauaaacuaauuucuaaaaacuuuaaaccuaauguuagaugauucuucuuuuuaaguauauacaauggugaguugugaggucacuuguagcuuaugacauugaaguugggaucccagaccuuauguaaauucuuggcuuggaaagacucucuucuguaaucucagugggacucuguggaaggugaaaggcuaagaaaggagauuuccuugaacuaguggaccagugggcuagccaugcagcaguacaagagauugugucagacaggguggaaauuaaggucuagcacuuagcacacacaugugcacuuggccucccauguuacccggccccuaacgugcacaugcauguuuuaaagcaccuuaucauaaaaaaguagguauaugugucccuaaaauuauuugaagguaauguaaaauuaauaggacauacucuaaaucaagaggagagggaaaauuuuagcuacagaaaauuuuaacuuuaugcuacucauaguuuucugugagcguguccuuucugcugaucgcaagcaacaugguuccuuacuaggcuugcagaggaggauuugcguagaacucuuuguuuucagaacuguaacuuuuuuuauuagauauuuucuuuauauacauuucaaauuucaaaugcuaucuggaaaguuccuuauacccucccccccgcccugcuccccuacccacccacuccuccuucuuggcccuggcauuccucuguacugggguauauaaaguuugcaauaucaacuaggccaucuucugcuacauaugcagcuagagacacaagcucuggagguacuggucaguucauaucguuguuccaccuauaggguugcagaccccuucagcuccuugggugcuuucucuagcuucuccauugggggcccuguguuccaucuuauagauaaccgugagcauccacuucuguauuuuccaggcacuggcuuagccucauaugagacagcuauaccagggucccuuuaucaaaauuuugcuggcauaugcaauagugucuggguuugguggcugauuaugggauggauccccaggugguguagucucuggauaguccauccuuucaucuuaguucuaaacuuugucucuguaaguccuuucaugaguauuuuguucccuauucuaaggaggaaugaaguauccacccauuggucuucccucuucuugauuuucuuguguuuugcaaauuguaucauggguagaacuguaacuuuuuagauucuauuuucauccauauuuaugcaguccaagcgguuacuaggaagagaaguuaaagcugugguuuucaagcuuccuagugcguaugacaucaucucuugguacagguguucucaaccuuucuaaugcaguuuaauacacuuccucauggugugcugacucccaaccacuaaguuauuuguugcuccuucauaacuguuauuuugcuacuguugugaauaguaaugcuuuuucuguguuuucugacggucuuaggugaucccuauaaaagggucauuugucucccucaaagggaucaagaaccauuuaguuggcaaugaaacucauuacaucuuuguguuucugcuugagguuuuucaaggugguugcauguuaauuauuugcuuuucacagaaauguacacaagaaaagaauucucucaaaaauuuuuuauuacaagucaauuguguguaucauuaaacuauguuccacuguuauuuucuauauaaacucauugccguguuagaaucucaggugucauccugacagaccucaccaggccaaagcaguuccacgugagaaagguuuauuguggugggaguggguaaaagggggcaacagaggaaagagaaaagagaaagagagagcaauggucuagagggucugccuuuuauuuagauugugacauaacugcucucagguaaacaugggagguaaaccagauggacacugggaauguauggauugucgugccaacagaugugagggucccuguugccuaugggugaugucacugucaucacuggauuuggaaguuaccugcaacuguaaagcugguuccugauaccagcacucauuaaauauagucagagcauaaccaugauaccccaaccaaaauaagauuccugugugcacuaagguacuguacuagggaguggaaagaaugugugagcuagaagaaaauuuugagagaaagguuguaaaaugcugucuccagcccuuguguuagaucacaauaaugaucuaacaguagccauggauauguuaacugggacuagacuguacaagacugucccugucaauagccaaccauggaucugggaagggcccaugggguggggguugggagcuacuucuagaaccuacugagcuauugucuucugauagggucagggggaaggguaguaauugucuucgguugcuccccacugauggacucaucaggcuccaaggaauaguuccaaacccauggucagauacacaauguccuugauaagcucagugagucacaaaacagcuuugaaugggggaaagggagugguuggugggugggguuggcaagaauggaaggguggggaauaagaggugagcgaaaucagaaugcauuauauucauacacaaagcugccaaagaacaaauuuaauaaagcuaggggauuguauuuuucaaagagaaagucuuccuuggcuuugcuauaaucaaaacacugaauaacuacuauugaucagauggaaaugauguaugaaggugagauauaaccccuaaauauugugcauguuuaaauuuuuuuccaguaucuuggcuuccauaaggcaguuuuagacauacugcaaacagaaggacacaucuguaauauucuugcucuagccugugaugucagagcagucacugcucauaaacauugugcuuuuucuuguggccccucauugccacacugaacuuauucuuauggccuagauagugcguuccuuaugcauagucaugacuugagcuuggaugcuaagguaaugaugugaugcuuugaguccauuagggcucaaugcuaaguuagggcuagaaauagaaccugcuugcaccucugagaagacaaccuaaccccaagaaacacaccauagugucacaaaaucucauaucccuagaaagucaggagcggugguugauaccuguaauccaaacucuugagaggcugaagaugaaaauaauaguugugaguuaaaagccagccaggcuacagagugagccuaugcauguguuaaacaaacaaacaaacaaauaaucaaacaaaugaagaacaaaucuaagggguauugcugucuucauauuaaaauauucagauccuaaucugucagaccaggaauguuccccuucauggcaaaggagaccaugaagauaguacuaaauugaggaucuauagacagggagggaggguaugagggugggcccugggcacagucacaaguacaccaguacagaggaccccggacuacacaaggacaaagaaaugagaguugaauguuacuaucucugaaagugaaggaagaauuuuaagaaauggcagucuaccagcugaaccaggcaagcacagagauuaggggugacaauccugccuacuucuugauuucgaccugguacugaguucagaguugugauuuccagagcuauaagacaggaugugucauuuuuggcuuuugcuuuguuuuguuauuacgauuuuuguuauuguuguuguuguguguguguuuguguauauuuguggagaucagaggcuaauaugcaggagucaguuuucuucuuccaugugggugccagggauuaaacuucuggcgucaaguuuggugacaagcaccuuucccugcugagcgguguucuuuuaagccauaggcuuguguuaauuuguuacaguggccacagggaauuaaugcugcuaguaugguauugaaccauacuaaaauaaguaagacccuggauaauaucaugguaaaacaaaggugagcgagcaacuugcaauucuuagcauuucuguuuuggacugugauuagcuuguuuugcuguguucaucagcuuauuuuugguucauaagcaaggaaaucaauauguaaucaguauauuuacauacugacugauuaucucuagcauagugacuuaauuaauauucuuuuugucccucuuucuguccaucgccccucuuccaacuucaagcuaagagauauagcucuugaaaugauguaacuuaauccuuuuuuuuuucaauuuuuaugaugaguuuauugguguuaaguguauauuuuagcuuacuguggguuuaucuaagucuaaccuacuguauccugaggaacaugugcaggccacucuccucaccauagguuccccuacaacuuuuccagucugugaccuagcaccuagauuuucagaaaauggagccauauuauucagagagcuauucaacgugcaaaagccugucuuguuuuuuauuaggaggcaagcauuuaccugcaucuaccuuuucauuagaauucuaucacuggaagguaguugaaaaggucccaaaaauguuccaaaugaacucgccccaagacuucucugacugagaaguugggagcuguuucucauaacuguacuuugguuaucagagguaccuaagauaugcuggcccaucacugacuugguaccagaagaaacuccuagaaaacugacauuacauucuuacagcuugucuuagcaucaaauuuauuggucuuuauuaaaaugcaguuguucauugaggccaagagaaguuuauguguauauguaccuguauacagagauguuauaauuacagaucucuaucuaacccucauggucauuugguuuuuuguuuguuuuuaauuuaacuuuuuacauacucacuuuacauguucuucacugccccucaccaagucacccccuuccacaauccuuccccccauuuuaccucccccuucuccuccuagccaguauccccccacccuaacucuguacuucaagauuuccaggcuaggcguuuccucucccacugaggccaaacaauaaaacauaucccacauacauguacaagcaacagcuuuucggauaucucucgcuccaguuguuugggacccacaugaaaaugaagcugcacaucugcuacauauguguagggaagucuucguccagcacauguauguacuuuguuuggugguucagucucugagagcccuaaggguccagguuaguugaccuuguuggucuuccugcagaguuccuaucccuuucguggcuggaaauccuuucucucacggucuucugaauucagccuauuuuaauuuacuggugaauuucugauuuggggugggaagaaucucauuuugaugauuacacauagugaagaaaaggaauucgauucuaaaauuucuguuacuggaguuggauacaucuacaaauuuucucaguaacuguucagaauauuugcuuuuauuugaccauaauuccaagagaauuuucauaaauauuuuuauaggccuauuuuauuuuauuuuuuuaaagauuuauuuauuauuauaaauaaguacacuguagcugucuucagaugcaccagaagagggcaucagaucucauuagggaugguugugugccacgaugugguugcugggauuugaacucaggaccuucagaagaguagauagugcucuuaacugcuaagccaucuugccagccccaacuuauuuauuugugguguguguguguguguguguguguguguguguguguguguguguaaaccuuaguacaguguccucagaggcuaaaagagggcauauggagcuggaguuacagguagucaugagcuguguaacauaguugucaaacuagggucuuuugcacaagcaguacauguuguuaacugcugagcucucacuagcuccucaagugauuuuuuaaaaaaaacuacccccccccuaaguuugauuauauuuagcaaacaucacaauuuuggauuuguagaaaagcugaacuucuaguuuauaaaaccauaaaaugaacuagaauguaaaaaguggugcucuuuuaggaacaacaaguagucugucagugacaacauucacaacaaagaauuuauacagagugagaaaaagaacaccagccugcauucaugcuggugagaugcugagcaccuucuuuguguugucuaggcugugcuuuuuguguuuaugcauuuacuuguauccuuacaaaucucccaguaaaacaaaagcagcaacagcagagacagagcucauguuuuccagcucugaugaaccaagcacaggguguguucauuaacagaucuuccuguaccauuuaacugucacaaaaacaaaccaaaguuaauuuguaugucaaagacaaugaacccaaggccuagauuuagaaacuugccaaagauguacacccaaggaacgaaagauuauuggagcacaaaugauuuuguacaauggcuggccucauucccuugcuuucucgaacuuagaugugguaagagucaggcuuagaaaaccuucuauaggucagaaggugacaggguguagccaaagaauguagggacagagcaaagucccuuaagggagauagaucagcugccucugauaaucagaaaagaguaggguaggguggggcugcugggcacaaauucacugcaacaguuaaggucagaaggaaggauauaccaauaagcaaaacuugggaaaaugucaccauagcugcugauauuuauuauguuucuauugguucuugcuuuugugaacucaaaagaugcccccaccucauuuugaaagaguucagcaccaaauuauauaauuauggaaguucuacuguccucagcaaccguaauuccgaauccaccaaaaccuaccuguguguguuuaccuuuguauguguuuaucuguauguguuuuuaccugugugucuauguguguauuuaccuguguguguuuaccuguguguguccuuaccuguauauguauuuaccuauguguguuuaccuguguguguauaaccugugugucuguguguguuuaccuguguguguguuuaccucuguauguuugcauguguguguauuaccugugugucuguguguguuuaccuguguguguauuuaccuguguguuuaucuguguguauguuuaccuguguguguuuaacuguuugucuguguguguauuuacuuguguguuuaccuguauguguaguuacuuguguguuuaccuguguguguuuaucuguguguguuuaccuguguguguauuuaccuguguguuuaucuguguguauguuuaccuguguguguuuaacugugugccuguguguguauuuacuuggguguuuaacuguguguguauuuaccuguguguguuuaucuguguguguguuuaacuguauguuuaccuguguguaguuggucugggagguuuuuguuguauuuuucauuuauuuucacaagaugaaguaucacuagaauucuauuauguaacauuuuucaugaacugauguuauaauugacuaugucuuuuauguuagaauuuauuucccuagaagucaguuugagggagaaguuuuauauuaaaagaacucacuacacaucucccaugguugaucaauuuuggaauuuuaugucuuucuuccuagaacauuagccucaaauuguagagcagcagguguuuuguuguuguuguuguuggcuuaucuuguuauuauuauuuuguuuuuugagagauuuuauacauaauugauacagccuauugcauucuggacuuuccaaaguuugggacuucuacauuggaaagaaaauacaccacaugugagucuuaaggcaaacucgaggaaguguaagacuuuuaaguagguuuacuauagauuuaaauuuuuuuuuuauacaucagaauagcuuuaacauauuuccuaauuuucucagccaacuauaacuguuaaaaucaggcaagaccuuaaaagaaaucucagucccuugucucuguuuacuuugcuaugauuccuaaggaagucacagagcuaauuacugaacggaccaaggccagaauccagaucuguauucaaaucaaauuugagccagcucuuuaucaaccuugccaagaccaugaggccaucccuucuucagaguucuuagaauuccccagcccaguccaucauacuguaaagucaaaggagacaguguuguauaaacacccuuaggacagcagccugccagcuugugacaguggagcuagccuugacuugugaaugccugcuccacaacuagacucugcccugugaccuugggaaaugguuccagcuuuucuuagccuuucuuaucuaugagacaaagauaaaauuggcugccuuuugcauuuguaacuuagccuuuuguuuaaagaaagaucgcccaagguuuuugauguguuaaaauuauggcuugcgucugaacacagcacacugggcccaaggaguuccaccugugagagguuuauugggagaggggggggagguaguuuauugggaaagagagagagggagggguguuccccuuauuuauauggaaaaugacauaaugcagguaaaggugggaggugaggcaaguggauucugggaauucuguugucuugguaaucggucuguaggucacacuguugccuaugugaugucauagguuuaggagguccugaugccaacaguuuucuuuucuucuuucuuaacuucuuccuuucuuucucuuccuucuucccuuccuuccuuccuuccuuccuuccuuccuuccucccucccucccucccucccucccucccuuccuuccuuccuuccuuccuuccuuccuuccucucucucuucuugaagauuuauucuuuuuauuuauguguaugaguauucugccuacauguaugucuccauaccauacacaccugcaguaccucaagaggccgggugggggguuguauuccuuggaacuagaguuaaagaauauucugaucugccaugugcuucugggaauaaaauaaaacccagguccucuaaaagagcaaccagcacucuuaaccacugagcuaucuuucugccuuccaagguuuucuuuucuauuuuagagauggggucccuguaugaaacccuggcuauccuggaauucuccauguagacuaggcugaccucaaacucacagagauccaacugucucuaccuccugaguacuaggauuaaaggcauuaaagguuuuacugauaaucuuuaugaaaacguaaaacucaauuuuugggcaaaauguauaugcuaaguucuucuagaaggaaaaacucuucaagacuucuauaaauauuuaaaaauuuagauaccucuuaugcacgguauaaaaauuuaaaaccagaaaaagaaaauacaaugaaaaaauucucgcucucuucucucuguccuuauuaacuuuauuuacuuauuuauuuauuuauuuauuuauuuuguaaacucacucccaugaguauguauguguucauguagccuguagacauagcccaggcauguacucauugggcuuugaauacaauucucaucuucccuucuuggcuaaccucugccaguagggcugcaguagcuaugaucagagcugccagcaaugggaggauuguucuauguuuugucccauauuacuacuagcguaaguccauuaagcacuugaaauguauuauuuuuauacuaacuuuuuauugaaaauuucugagcuucacaucaugcaccccagucccacucaucuccccaucccuuuguaucugcccuugccaccuccuuuccuucucccacaagaaaguaaaaagcaaaaagaauaaaauuuaaaacauaagaaaacauccgguuaugguagcuguagugugucacuguguguccacucagcuuuccuugcaaaugcucauugccaugagucauuggugugguuagaggaccuggcuucugcuacacuaucaauacuggauccucacugugacucaucuuagagaucuuguuguuguccugugccauggaaauccugcagcuuuggaucuguaagaccgacccuuucacacacucaguucauagaugagguagauguuagggcaggccagcccaaagccccuaaucugggccuggguaguagcuuuguuggucagccuaucagugaagaggucagcucaggaacuuuggaaaauuccaccagacccuuccccuccagaagggaaaggcuaauuacauuccucagaccacagggaguggaccaaccaucugccaccugcuggugggggaggcccagagcacauagacacauuccucaaccuuuggccaccuacagacaagggaaguccaugccaccucauucccuaaagaccaaucaauuuaaaagucacacuucucugccaaccacauugugccuaauggcugcugcucugaaaacuguauuaaaaacucaccuuugugagggucguucucucucuccuuccuuuguagggcgaccccaccaugcuggaacaacaaaaauuccucuugguuuugcauagauuccccaggaguuguucacuggggguggggguggggguucuccggugagcuaaggcucaccagagucuuacaucagcucucccauacccacaccaccaggguaaacucuccagcacugcccaggcucaccuaaugccauaucuggaaaggggcaagaccagcucuccugcucucaugcccauggggcuggauuccccucacccacaccaucagagccagcucuacugugcuuccaaguugaaguacagggcccacuuucuuaaguguugaagccagcaaagagugaggccagcucugcacagccccuggauaucaauauggucccaggagguaguccagaccagggauauccacgugaucuuuauuguuaauaggagacauggacaucaacacagaucccugcugcugcauggccaccaacccagacauggcccucacuggcagcacaggcugggacuucaugaccucaaacugcucacaucaggcuauuccucugcacccuccacccuccuaucuccaauucucuuuauaauggccaaaccauuuggcuucucguuucucucuggucucuccaccacauacuuguauauugcaguggcuccugcuaugaaagggccuccuggcuggcuggccucugggucaaaauguauuauuuuacaacugaauuuuuaauaguuaaauaauuuugaaagauuuaguaaucagggcaagugagguagcuuuuugauagaagugcuagcuucaaaaaccugauaccugaguuugguccccagaccccacaugaaggguagaagaagagaagagagcccuuguuccacagaauugauucugauuuccauacuagccacagcauacauaucuaucuaucuaucuaucuaucuaucuaucuaucuaucuaucuaucuaucuaucuaucuaggcugguuauuuuugcacugcagagaacugaauucaaagcuucauggaugcuaaagaagcaacauaccaaagaacuguaucccuaacccaucuauuuaauauauuuugaauuauaacauugcauguuucuguucaaaucugccacaagaggugagcauccauucuugcaaacacaguagggauuagaugcaggcguaucugcaggggagugaucugaagcccagcgagggagugacucuguucacaaaacaguaaugaaguaguaaccuuguuaagccuucccucauccucaaacauccauuaacaguagaaguccuugcucaggaugcuaacugcaggggccagugugugcuuuaguuucacaccacuguguugcucucuacauugcccccaccagggaagggacuguagagucagagaggaaguuuuucaaagccauuucugauaaaugccagugucgaaaacucguuuucuauacuuuaggaagcugguuucauucagcuauacaaauuauuuaaaaguaucaccaaguuuguucugcuagcuuuggcaagaacaguuauaguuguaagccgcucauggccuacaagaacaggguacuccugaaaggcaggcuggggcugaaaaagacuuagacuucgagagaagaaugaggccaagacaaauugcucugauuaaagccugcgaguuuacugcgagacugugcuuauaaagggggaaggcccauccucagacaauccagucuugguguccggagucagccuguaggcgaugugcaggauaggaugugucucuggaaugucucaagggucucucagcagguagcagagaagagaagggucuccgagaagagcaguggcaggugacagaacaauagagccaucuaggucggaaggcuacagcccagguggccccaccucaguggugacaaggucugcaccagccagcuucaggcugggggaggcuacagacugugauggggagagaaugaaauaugcuuauaucaugugagugccuuuugcuuuacuguuaagaaaaaaaaaagcuacuguaaacaggucuucugaaugccgcaguaagaagauagaaaguucagacucacuuugcucuuggggaaggucuaucacuaucaucucccugugggaaaacugcuaauuaaggucaaaguccaccaugaccagauugccucugaguucugcucaaaaugugagacucccuuguuaacagguuuucuucuuuucugaccuuaucuggaggauauucuaagccccaacacuugggcuucuaccugagaaaaaucagguagcagagaaggcuggaguucuccaagcuaauugcggcauuuagauaggccccugaguggucaggcaaugaacuucccuacuuggguauucugccuggcaaaaggucuaauuccugguucauccugaguaaggcauauguguucucauucgccaucuaauaaagcaguuucaacaaucaagaccuuuucuucauuaaggaucacaaggggugggggugggggucuucucuagaaagccuucuuuccuagcuccuccauagucugggcacucacuuggagccaaacugggauccaccccuguccugugcucugccauccccuuucugccaggcaugugggaaugcccucaggggaagugccuaccuagcccccccccccccaccaacucccaacugugccagcagcaccugguacacaggcaacugggaacuacaguaauccauccagcagcgggcugguggcguucugugcacccccaacaaggagguaaacacucaguaagacaucuccccuugguucuggcuuucccauuagcucccuuagucaccacacucaagaauuauucugacuuuucuacaauuugaauguuauaauacaguauaauaccacuuugauaauaaaaaaaaacaacaauaguauuggacaaggcauccaggcaaagcaugcgacauacucauugggagaagaacaggaagagagguagacuugcuugggagguuuagcagcuggaagggaugggguuuaaauggaacagugggagggaaagauaagaacgauuguucuuguaccugugguucauuuuaaagaaaguguaaucuaacugaaugaagauuuguuuucuucacuuaugccuauaacaaucaaaugcuaaauguaauccaguguuuuguagugagcuccaggcccaaugagaagcccugucucaaaacauaagguggccaguuaucaaagaauaugcugagaguugaacucuggccuccacacacauacacacauaagugcacauacaaaugcaaacuuccacacagaaauauacauauagcuugaguacacacacacacaaacacacacacacacucaaugaaguaaaggaguuuaguuuucuacaagacauuuucucuaguuuaucucagugcagcuauagaaaaucccuaaugugagacuaaaguuacuguguuagaugccaacucuaaaaaaggagaaaacauaaacgcuccagaaagcagagucugaggacuaugaauuuggccacugucaucaggcugccagcuccucagccuugggaaagguuagguaagggucuauucuugugucuaggauuaagggcuuccuaucaggguuccaggaauuccucugauuuccagcugcaagaccacaauguuucaguuaguuauaaugauaauguccaaaacaacagauuacucuauucaaaacaaaaacugauuuaaaaauucuaaaauguacucuauuuuauucuaaacuaguuugguguugcuauuuucuagcaucguuccccuucugaaguaacaacuguuuuggcuaaaccauugacaauaauauucuguaaaaagaaaaaaagagagagagagagagagagagagacaaagauaaagaaaacaauauaucccauuuucuaauuuccgugagugaaaauuagugucuaaugagauguucccaaacacugcugcugcucaucaaaacauaugccccagaucagaguggauuuaauuaucacugggaggggguaaaacggggacaucaagaggaaaaauccagaccacgaggaaaacagcaugucucaggagauagguacggagcuaauuuuaugaaucugcuuuauucuaggggagaaaaaaaaaagccaguuuugaaugacgugaaagguucauuucaagcaaguuuugaugagcucaugcauagagcagggccagccugccuaccuacaagcagcauuuugagaaagaagugaggucuuuacagaaccacgccuuauaaagagaugcuugagcucucucuccaccaggagaggcagggcaaggcaaguuaagcuucaaaugguaauuaggucugaaaaguuucauuuuaguagaggcagaccuaacuucaugacgaaccaccuauacuuuuaccaguaaaauggcuuaaaaccugauagaaaguaaucauguacucacugaaaauaaucucuuauuguaguucccuaaauugaauuuguaguuguguguguucaguguguguguguguguuuucagacaagcaaacaaagagaugaguugcauacuccucugcacauuuucccagcugucuugucuuuuagaccauguauacaaguaaaugagaaucuuagaacuggcuuccuuggugcucagugaaagauagcacacuugcccacuucuuucggcucuaagacccccaucuuguacagacuccuacaggccuagugaaugcugccacagucuuggugaauucauauguacaagggcuuuguuuucauuuucuuaguguucuccaucacuucuggcucuuauguguuuccugccuccuuuucuacaugguuccccuaccccuaaauggagagauuugaugccagcaucuccuuuagggcugaguguuccaaagucucucauucucugcauaauguuuggcugugggucucuguauuuguugccauuugaggcagaagcaagcuucugauugaugauggcugagcaaggcacugaucuauggguauuccauauuaucauaaggaguuauuuuauugcuauuuuuucuucucuuuuuccuuuuuacccuaggucccugggcugucuagucucagguucuuggucacucgaaaagucuuuggauauggauuccauaucaaggagugggccuuaagucaaaucagacauugguugauuacucccucaucacacuagcauaucuugcaggcaggacaccauuauagauccaaggguuuguaguggcuggguugguguuuuaucuuucucuuuugguaguauacagaguaucuuccugccuggaccaaagaugcuugcucaaagggcugaagacucuauguagguaccagcuugacuucuccauguucaauaagcuguauagguguugucuucagcuguggagcacaaggcaagagaacuguguaacggaaugcaaacuuuacuccggcaguuauaccuagugcccagguucaagagguuagaggcguuaugaaagaguuuaugcucuguagaacacaaacuuucucaaggacuugcucacuagagggugcacagcaguucauugcagagcaugcauuccuugggaaacauuugcaggggauaguuccagugaugauugucuucagcucauacaccuuggccuugggaguaacuaaaagcauggaauauguucacuaaaucauugugauuacuaaucacaaugauugccccuagugucuauuccauuguguuacuaggggauuucagaucucaaaagauguagcacuauauggcucuuaucaucucuauaaagaguuacacaagccagaguuagguguuauaauucuuuauccugccuuuaagccaguauaaaacacguuucauaccugcuugucucucaguucuuggguagaacagaaaaucacucuuuuaaaaacaugcaaugucccgaaugaggccuuauagauggguuacuguaucuugguuuaauaacaauacucaugauuucagagccuauagaaaaaugccauuuuucuuagacuuagaacguaucccauacuuuuuuuuuuccugagauuuauuauuguggauacaaaauugagcaaagauccccuggucuucaugguagaguauuuaaguggcuagaaaagaaaaucaacuugaauaauuuuaugagacccugucuuuaagcuaguaucuccuccuccuccucuucccuccuccccuucuuccucuuccuucuuucuaagugaaagcagaacugaggauagagcucacugguagugcgcuugccugucauguacagcaccaggauucaguccccaguucuaccaaaagaaagguggaggaagacccaggccugucagccuguaagcccagcacuuggagccagucugugugcuugccaagaaggaggaggagaagaaaaagaagaggagagacagagacagagaaacagagagacagagacagagaaacagagagacagacagagagauacagacagagagaauaucagagagcguuuuauauaucagacaacuacauuuuagagucccacagcauaaaauuaggauggcauguaacaacuuucccccuuuucauucguagacuaaaaaagaaaaaacaagccaaacaaaaugcagagauaguuucagcugcguccucgaagagucguuccgggaaagaugaugcuaauucagacauuuuggaacaagacaaguucaacguuacagcagagggggaccauagcacugaugacaaaaagaagagaaaaaguaaccaguuaaaggaaaucaggcgcacggaacugaagagauacuacaguguugguaaguacuugugacgccgugggaguauuuucuuuaaaaagcugucauaggcugagcauggaacuaaaaucuccaugcucaggaaaaagaagccagaggaauggaaaccgaagccagcccagguuacuaaggcccugucucaaagcuuuaacaggaaaagcaacaacaaauuguaauaacuuguaagcuagauguggucaucacaaauuugaagccaaccuggucuacauggggaggucaggcuagccuguucuacauggguagauaagcccaaccauaucucaaaauauaaacaaaacuuccacccucaaaaaauuaaaaucuguaaugauuuuucaaaaauuaugauuuauaagauaacauuauaacaacagcccagcauuuagaguaaguacuccaugucucugacucuuacuguauauguuauaugauacucuuauuauauauguuauaugaaaugaaaggauaacuguaaacucacauacuccacucacuguuggacacuugucauuuaguagugugucugucacaugcuuugugcugaugaacauuucccuguaggagaaaugcacuuuuuucucauguuuuuguuguuuugugugugugcuuguguguguguguguuuguguguguguguguagaugugguugcuagggaucagaaguugacuucagaaucuucuuuuauugcucucuccuuuauuuuugagaccaagucucacugagccugaagucucucucuggcuggccugcuuccaggaguccuccugucucugccucauagcccuggaguuucagaagaccagcacuauguucaucuuuuuacauggguuuugggaaucaaaauucaggcuuccaauuauacagcaggcacuuugcccacugagccagguuuauuucuuuuccuuaguggcuauacauagguccauaaaaguacuaagaguugugauuguaauauuuggaggagacaaggccuagugugugucagcuagaaacaaccacuaaacacaaaaccccucauuuagaauaaguccacaauguuuuagaguuucuuagacuagccauugcugcaaacgaacaggaaauaauggcuuacacaacuagcuguacccaucucauaccgacuguucugucauaugcaggucugaguauaguucaaagagcgugccaagagaggauauuaagaaucagaaauuugguuugauauugcuaggcaaagagagaaaaagauauaguagugcucagagaacauccugcagcuaaagucaugagaugaaguagugcaaaauaguaggcagaucuggugacccugaacuugcuguagacccugaauaaucuugcuccagauugugguggacuugcagagaaacauaucguuuaccauguuuacgauaacuucuuaaugggccuaaugcuacauguaugauggugcgugucugcuuuaauagguucugaaaucaccuaugauacaagcguccagggcacaucugcaaggcauuauuuagccucugggcauguuuuccaaggauucuauugauuagguuaacugagguggaaagauccaucuuaaaaacuggcaguuccauuccuugaacacaaauauccacuccucucuucuuccuggcugaggaggcaacaugaccagcugcuucaggcucccacaaccuugacuucccaucagaauggucuuuacauuaaacugugacuguacuuaaccccuuccuuccuuaagaugcuuuggugacguguauuaucacagcagugagaaagucagaggaacaguucuugucaaggucaugcuacacuacaguguggugggacagugcuugucaaggucaugcuacacugcacugaggugggacauugcuugucaaggacaugcuauacuacaagaggugggacagugcuugucaaggucaugcuacacuacacugaggugggacagugccugccaaggucacgcuacacugcacugagguagcagcgaggacugcuucauaugcauugaucuaacagacagaugaggaaucugcucucagccaugaccauggggcugcuaguacugaagagggcaagugaccuauggauaaguugggggccauuaaugucaagucaucaauacaauguguuuguaaacacugugcauuccacccuagugaaugaggcucucaaguaauuaauaagcuuacaauuaaaaucuaaaacaucaguauacuccacgacuucugagaagaagagaauuaagaaaguuguauugaguccuauuuugauugacuucuugcuuuguuuguuucuacugcaggggaaucuguugaaaguguguuguugaguuuaaaauggcaucccugucuuuauccugcuuacucacucuuaccucacaaaauacguucaguuaccuucuguucugacacuuccuuccugucucuguccaggccaagccaguucucaaccauuuucauggaugaucagugcagugcaggaugaccuucacaagcacugucccaucucagugcagugcaggaugaccuugacaagcacuggcccacuucagugcagugcaggaugaccuugacaagcauugucccaucucagugcaguguaaccauucucugguugcagaugauuuagacccuauagugucuccaccuugacaggugcucuuugugugugugucugcauauaugauggacauaucuguguucauuugugugaguggagaccaaucuugggugcuauucaucaccaucuaccuuguauuuuguacagggucucucacggaccuauaacucaucugguaggcuagccucuaagccucaaaguucuaccuagcucugccuccuggugcugagauuauaaaaaugggccauucuuccagauuuguauauguauguguggaggaguggguagauuuugagaaacucacucuguagaucaggcuggccucaaauucagagauccauuugccuuugacuccuaagugcugggauuaaaggcaugugccucaaccuccaggccagacauuuucuuaguuuacauaauagagauuggcacucaggucuuuuagcacuucacucaguuaccucccuauccugacagauguguuuuaaaugugcauucuguagaagaucaaacauauagaugaaugaauacucuuguaauauuuggcuccauuuccggauaagucuacaggauauugguaaacagugaagucauuuaguugaaauugcugugugguuuuccuuguuaauaguaagagaugccauuauaucaacccucaagaaugacaguaauggccauugguuuggauauuuggggaauuucaucaggagacuccagugcugggaucaaaccucuggguggggcuucauuugcucuaaccacauuugaccauaguuccauaguugacaaaugcccacucagcccacucagauuugauuagccucguagagucuguugccuuucagagucccaucccaggauguaguucuauaccacuagggggagcaucagaccuugagcuaagagucauuccuguuagagaacacugccucuuucgguguugcuccuaaguggccagauagugaggggacuugacaguggguggaucuugucugcuaaggauuuagauuugccugguaaaacucaaagaaaguugggggaagugccauuauuucccagacgaaucugaauugaugaaggcaggcuguacugaucagagacaagcccuuagggaaaugaagugcugaggagagauucugcucacagguagaacaguauaugcuaauuaguaucgugcaugaggaagaaaaagagcagucaguacaugacaaauuugaacucaggaaugaggaaggauuuuguguuuagagaugagauuuugaaagucuaagucauuuuucucaaggggccuagagaugccuguuuauugcuuuuuuacagaugugaggugaaaucuauauguaaaagaugcgaucccaggaacagaggucaaaaugagcuaguggugcuaagagagaacaugaacuuagcagugcauaauggaaaaagguauaggugagaguugaccuaucuggguacagaaaguauaaagcagucugccuaccugucugucugucugucugucuaucugccugccugccugccugucuguuuuaaucuuaagacagggucucacucuguagcucuggcuauacugggauacaauauguagagcaagcuggccucacacucaccuuccucugccuccuugugccaugaugcccugcaggauuguuuccuuuauuuguugaauuuuaugcauuaaagaacuauuucaaauauuagcauacagggaaaagcagaacuuaauagcaugacaaagcaaaagcaaaggccuuguaaaaagaauauuuauuaugcaaguacagaguuuguugaaagcaguuacuuccaauuguugcccauucugcauauacaauguaauuucccagaacuaaagaaggauauuuugacaaaauguuuuuauuuuuucaaauagauuuaucugugacuccuugcagccuugagcaauacgucauugcuaucuccuuauacagugauaacaugcaaaagaauauuauggagagacugagucacuagaauugccucauuauaacaacaugguccugauucuguaaauguucuguucuguuuuugagaagagauuaggaaaggaaguaaucauauuaagacaguuuguaucauauaauuugagaucuaguaccuagcacagcaccaaguagguaaauaucagaauguuucuagaacaagugaauucaaccuuucugugcuugcauuaauauuugcuaauauguaggacugcuuucacuuacucuguuuauaugguauaaacucuuaagaaguuuuguaggggauggagagaugacuuagaggcuaagaacauuugcugagcuuacaggggacccagguucaguucccaguaccuucaaggaacuucaugacuaucuauaacucuaguucuagaggauccaauacccuuuuuuggccucuucagauacuguaugcaugugguacacagacaugcaugcagcccaaacauucacauauaaaauaaaaaugaauaauuuuuuaacaagaaauuguuugauaauucugugucuuacugugcuuuuaaaauuagcuauuauuaaguuuuuagaaaaauuauuuaaagacagagucucacuguguggcucugacuggccuggaacucacuguguagaacaagcugaccuugaacucaagagagauaauccugccuuugcuucucugccgcugucacgucagguuaaggaugugugugaccaugccaagccaaguuuuauacaauucaucagaacacuucuaaaccucccaaaagaugauuaauuuauugcagcaucaaacucuaguaaguuggcuauaaaauacuuuuacuuuaaaagaacacuucauucauuagucuuuaauguuaaaauagugcacaucuuccccucuaaaucacacagguagaaugggaauaugaaaaagccauagauuucaaugucagaccauucuucacuugaaacauaucuauggaaguacaaggguaagaagagauggauuuuaugucaggaaaauaaggcaauuuugaauaagguaaauuauuaaaauaacauaauguguuaauuaauacaagcauuaaugccagaaauccuggagagcaauuuagaaauguuaagauuuugguuuuuuucaagacagggucaguuuguguagccuugacuguccuagaacucacucuauagaccaggcuguucuugaagucauagagauccaccugccucuaccuccuuauugcuacgacuaaaugcaugcacuaccaucucccaccuacuuuaaagaauauuauuugggaagccauuauaaugaagaugaaggacucauaugaaggagcuuggcauuuuaugauugucaaaaccaaagauuugcuuaaagagaucauuugucaugaauguagcucaucuucuucucaggcuccuccccuucuuccuucccaggccccuccccuuucccucaccgccuuuccuguccuccauccuuagaugcuuccuuuccuuuauuguuuccaucuuucuuuuuuccugagaugucauuguguaaucccaggcuggccucagauucaugguaauucugcugagcuuccuggugugugguugaauguguuuaucuuaacaucagccucauguaguuucucauuuaacaagccuacugagucuacuacauucauuacaguuuuucauccugaauucaaaagauuaacaagaaaaaguaaaaaaaacugaaauuuucuacugauccuuugcuauagauucuuuguuucucaugaaaauaugaaagcaaccaacaacuggguucuuucccauaguggcaaccacaacuuuccacacaacuuaacacuuuuucuaaggguuuguuuuuucuuuuuaaaaccacaugggugaguuucguaucuguuauuugauuuuuguuucaauucacaggcuuagaucaagguuauauuauuuuuauaaguuuauuuccaaacauaaauaggccaggccauuaauauaugaccuucagcuuaggaguguaaagccuucuuguccuuucgauuuuaaagauuagaaggguauaagauuaaaaugaacuuuuaugugaaaagaaugucaagagccuaaggggguggggauagucucagugguaaagaacccgauuguagguccaagacuuaguucaauuucuaguccgaaaaaucaccuaaguacuauuguuguaaaauaaccaggaauguaguuaaaaaggaaagugacaugaaggaagaugucagaugugggggguauugaaggaagagucugagggggaaaaaaaaaaaccaaaaccacauacacacacauucugcaugaaaagacaaaauacaugggaacagaagcaaccgaagcuucugugagaccagaagccugcauucaggagugcaaacacuuauuugagcauagaaaucaaaggaguucaccauauguagggcaagaugaaggagaaaauguagguuaacuguaggaaggauuuaugggucauggauaaauggcuugaaaaauaguucuaaguaaaacuauggaauuuugucauaaggccagacacaguggcacauacuuuuaaucuaagcaauuggaaggcagaagcaggccaauaucugugaauuuuagaagaguuuggucuauauagugaauucuagaauagccagagcuauagagagagacuaguucaaagacaagacauucuugaacacgccaacuguccaagaacauguugcuuauaccauagaucuccuggaacaaaccgcuccuggaaagggagccucauucuuaauaugaaugaaauacaucaaaauuuuggcauuaagaaaagaggucauauuaacuggugguaaauaccacaagaauuaagcugaaaauacauggugaugaacaugaaucuaaacuguauccugguuccugcaacacccugaucuagccccucauuuugaugcaguauuuaaccaauuguauaauccucagauugacagauauugagagacucuccacugggaggaaugccugucucauguguuuguuugcugcucuuucaccucauggcauuuauaaguacuucgaagcugaagggucuucuuguuucuaaaguccaagaauuucauagaaaccuauagagugguuguauuggucaagaguuugaugcuucuccagucuuuagcaugggcuucagugcagugguggucuuguuuucuguccccaugcucuacuuccagcgacaauaccacuauggaaaucucuauccagccuauuuguaaaacuuacuuuacuuaaaaaauuguaaaauaucagcacugguaagccuuugucucaagcaaaauuguuccaaaguuuggaugaguuagaaauucuagugguuaaggaauaugagugucucucuggaauuuaguaguggugcagcaaauagcucuuaguaaaauuggcuuugucucaacuuucuuauucccuaaauauucccgugugucuuucaaacacagccuccuguaaccuguucucaugauugucgcaauacacacacacacacacacacacacacacacacacacacacacacacacacacacugcugcuacugaccaagaagcuguguauuaaaagcccagguucuccuauaucugaucuugaauucagagauuacacuugucauaagcacagcccaucugcaugacacacauucauuccugauguguagugcucuguauaguguaaaaucucccagcaugagaaauacccaagagcguaugaucacugguagcuucagcuuaaaaaaucaaauuaucaccaagugaagcagcaaagacuaaggggggaaagacacugaaaucucaaaggcuagguggcucauauaccacagaacugucaugaucucuaggcuaggaagucauucaugaucaagacacuaguaaauucugagucuguggggcacuguuuucucuacuaggcauaugaggaaagccgaggcagggucucuuuuuguacucauucauaaugcuuaguaugaaugccugauuucugucuccuaaaugcccaguuucugucuucuaauaccaugaucuuuggggugagaauuucaacauaggaauuuuaagggacaugaagauuggaaccacaauaaacagauuagugguagagagcaaucuaguuaaaucuucguggaggacaguauagcuauauuuacugagagccuuguuuuuugaauacccuuuggcugaacaguucuuucugcuaaaguucaccauaaggaaacagucagaaacauuaaaagauuucacugucgugacugucauacuguuuguaauagcaugaaaauauaauuaacaugacagauaugaaauguauuacuagguacaauuuucaagugauacagacauauaauuaguuagguggaaacuucucaaaaccaugcagugggaaauaguucuaaaaugugguucuauuuuauuaaaaugacaacucacauauaacuauauaaaauucagaugaagaagaacugaaaguagauucucuaguagguaaacauaggcugucucuaaaugggagccagaugggugaacuguauuucuguuauuuuguucaaaugaaugcuguggucauuuugaaucuuucuaaauucauuuguuaaacuaugcauugccuugggccaccaagauaccuaaguggguaaagaggccugcugccaaguuugaugaccugaguucaaucucuuggacccaugaaauucugcugugagcuagaugcuugcuuuccuaauugacuucaugacuccucaugauguacaacagaaagcaacagccuguuuuacagaguuagaaaaugagaugauaaggaguagaccaaagacaguaugggcuagagugugacagacacuaaugcauuucccucugaugacaaagccagagugaugucucacgcagcguucucagcucugcaagucaacucuggagcaaaaagcaagacaacacaaacuagaacauucuugguucuuaguacagaagaaaggagagacugcaggugagcuuucuuccccugggcuguaauuuuaauggugguagaguugaccccuuaccuacuuaagugaguucacuucugcuggaacacuagaauuacucuagaccuggucauauguguaggcaugcucaaaauacccacugagucuauggcuaauauaaaucagaugcugaccaaaaccacuggaauccucuaucguuacauacucacaaaguuugugggcugucaugguggauauagcuuucauuacucauccaggacaacugucaugugugugguaaaaacaguccucuagauagacaguuccucugcccuugagauacuucuagauuuccacucagugugacucacuguaguuaaauauuaacaauguuaaauaguagcacuacuaaccagucauaacaauauacugggugugcuguacaugagagagaggaaguaguauguacuccaugauauccacugugucagaggguaaaauucaguguaguacuucuucacacauauuuuuaguuuccuuuuaaaauuguaacaguccauaauuuaguuuuuuuuuccaguguuuucgcuagucaucucaguaacuccaguuagcaacacuagcauauuaagugugguuuuugaagacagaccuaugauaugaauugugagcaucaccagcggggaauaugcuacuuguuugugcagaaauccaaacccuauauuuuauucaaagucauuuaugaugauaauguuuucauuaauuuauuuauucacuuuacauuccaauauagccccccuccuuuucucucaguccugcccucucaagccccucccccaccacucccuccucuucuccuuagagaagaggagcucccccguggguaccaaccugcccuggcauaucaagucucagcaggacuaagagggaacuggccuuucccacugagggccaacaaggcagcccagcuuguguguugguugauuuuuuuuuuuuuuaauguucauugguguuuuaucuguaagugugucugugugagggugucagagauucuggaauugaagucauugaauuuacaagcaaaugugagcugauauguguacuggaaauugaacuuggguccuuuggaagaguagccagugcucuugaccacugaggcaucucuccagccccaugacuuauuauuuuccuuuaaaggugagcuuuuuuuguuucccaugcugaaccaaaacucuugaacucaauucuuccuccugucucugucuucugaguaauugaaacuaaaggcaugugucaccuggcuuuguuauaaaaucuugaaucuauuuuauauuauauugucuuauaaaaucuugaauuucagugaucuaacuuuuuguuuaccuagucucauuuaguuaucuuugacaucuuguuucucucauuguagauugcuuuuccagaauugcuuuuuguaaggcaucccuauuuuacauauuuacucaaauuugcauggggauugaaagaaagaacugggcuaauuauguuguauauuuggugccuaaacuaaaccuacccaacagacauuuauaaagaaauuuagcuuuucuuacuggcuuauaaugaugauuuuacucuacacuaaaugcccaucuuuuuauuauaugcuguauugucuuaauugcuauagcuuuacaaaaucaugcuucauuuauugcuagguaucuucuugauagacagaaccaugccugggacuuucccaauucaaguucuauuacaacuguugaguuugaggccagccuggucuacagagcaaguuccaggacagccagggcuacacagagaaaccuugucuugaaaaacaaaaauuauuaugucuggauacuuuucuaagcaaucuuauaaauuuuggcauucuugugauucuacuaacuauuuaauagccacuuuugcuuuucauacuuaaaacccuuauccuucacuuagacagguuuccaaacugucuccauggccccuacuguuucugaguuuauguccauuccaaaguuaggguucuuuucuuuaugaauaacuagacuugacuucauaugacacuguguuguuaguguccugggagaguccauauccaggaaccuucuaggcuuugcuggaguugcucuuaaggacuuguucucaaagcacauggcagauggaaaacaugaaacaugcacugguaugugcacaaugcccgugggaccucuugacccuccaguggacucuuucuucaaaaaccuuagggcuaagcugcaccuauaaacuaagauucagggugacuuuaaguacuuugccagucacuguagcccuguaaguauaacacuauucuuggagagauaugaacaaacuaguccccuaucuacccauccuagauaaggagcgaaugauagccccaaguaacaaaaagugccaccagaguccaacuuugugaacuaauguguuuauuggaacauguuacuuaaaugaucagggauaacucaaagguaccuacauugucuaaagcccacccacccacuaugccugacagcucaggaaagcuagaauccuagcagucucuacucaacacaucggucagucuccuucucaguggcuagugcugcuuacauaacggagggggagguuaaggcaguuccucuaucuuuaguuuucaaacaguugcaauguugucgcucuuacugugggguuuguuuguuuguugguuuguuuguuuuuuaaugcaguggaacuucucgaauggcuuugguggugagaggggcaugcauccaagugaucaacaaggcuuuuuuuuuuuuuugaagugagguuuaauaaugugucaucucaguaccacgugacuacauuucuagaaugaaaccucuuugaugaugccuuggaacuuuuaacacucaguuauuuaaaugccuguuuaaauaugucaucugcaugugacuaaugauaauggcagcugcacuuagucugcgccuggcucugagauucauccugcaucguauacaucauacugcuccuucaaugauauuaucaggcaguuccuuaugcucuagcuggcaaacuuuauacauacaguucuuuauagaauagcuuguugacuugauacagacaguuccucaugggaauagcuaaugggcuugauaugcacaguuuaagauguaguuggcggacaugaugcagaacacuuucaaguuacuugcuuuccguccuacugccaucggaaccugcucauuuugaucucacagugaaauuguacucagauguuuggugacgcgauugagcuggcaugugauuugauuucuuggcuaagggcaucaaucuguuacauuugaaugcauccguuuccaguauugggacaugcugguuauagaguucccuuucuuuaaaagaucuggagacacacuuguuuccuuugccucucugauuccuucuccuugggugccauuuaaacaucuuuccuuaggaaagcaagugcugaggguauaauuucaucaccucgacuuauaucccaguaaucuuaucuuuauuuauuuaaacauuugagaacauuugaggugacgcuuagccaaggguagcccucagauucuguguagcuagugguggccuugacucauccuccugcuucagccucccauagucugagaugacagauaggcagcaccacaaccaacugauacauugucagcgauugcgcccagggucucuuacaagugaggcaagcauucuaucaacugaaccacaucccaucucaaacaaaacagggacucauauagcccauuuucauuuuaucuuguagauagagcuaauaaaauguucagaauaguuuuuugaggaauguaggucuggcugcuucuucuguccauagacauauuuuuuuauuugcuauaaauccuugaaauaagagagagagaguuugaauuuggguagguauggaggccauugggaaacagcuacacagcugcaucuuugggaauaaucauagguucucaccuucaaagcuggaguugaaucuguggcuguaccugccccuuccuagcucuccucaggaucagaacucucaugcccguggacugugcauuucagagcuugucuugauuaaauucacugggauacagaguuggccaucuuaacaucuaauugugaauacaauuuaggaaggaaagugaaacuuuacauugugcugcuauggacaaagaugauuaugauccuuaaaauuggccaguuucuuucuguuuuguuuggcaaccauacagcauuuuguuuggacuguagauuugauagguacaugugauuuucccaguguaauguuaucacaaugaaaaguguuucccacaaccagacaugucugggaaguugaucuguauugggaaguuucuuuuuccuuauguaucaggugacauugugacagcucaacucauccaagaccacucccuuugagcuccaccucaaggaguucacauuuguagacgcuggaaguaaggggugugcacuuguguguguguguguguguguguguguguguguguguguguguaggccagaguuguaggugaaguguucauuuauugaaaauucgugacucaugcagacuugggacucacaauucugcuccuaccucuucagcauagcuugauggcauguacacaccacaaggacucuacuuuauuuacuuacguaguugagacagggucuuauuaagcuaggagaucacccauucaacuagacuaacuggccaacaggccugcccauuucuguuaccccuccagugcugagauuacagaugucacgcuucggcuuucucuguuagagagaggagucuuguccucgugcaugcaugaaagcacuuuauugacugaaucaucucacauguuguuugccucucuugagaagugagcuaagacaauggagccuaaaaaugaggcagacuaaaacaugcgauugccaauguuauucagagucucaguuuauacucugaggguuaagaagaaccacacaagaacaguacagucacaaggacaggcugcacauggcaaaaauauguuuucccacagaggcauguaaacaaauaauauguaaugaauaauuacaaugaauuauaaauaauauguggugaauaauaaaaacaaauaauuguaaugaauacucugaaguaaacucacuccuauccacuauaccugguuggggcacaaaagcaccuuccaugagcaauucuguuuuucgaagaaacagaggccauaagacucucguuuucuuggaguuuuaucacgaacacucaggacuucccuagcacaccuccauccuuggccauguucucacacccugccuuuguuuuaguuguuuuucauguuauacauuucuuuaauguaugccagugacagggaaacuuuauugcuuuuucaugaauucaaguguacauauuaaauuuauccugaaaguuuuauccagaacauaucuucuuuugcauuuuugcagucuauuaacugcccacaaguuagugagccugcaauaguccuccucauuucuuggaucuagcaacacaacguaguaauagugacuuaugaagccagugagaaaggcagagugcuguaaagagaauagacagugauguugaagggcugagcagugcuguagaugugacucagugggaagaauguucgcauagcaggcaggaggccuguguuugauccccagcacugcauaaaacccacuguggucauaaugccagcacucgggaggcagaggcaagaucaucaggagucaagggucauccucagguacauacuguguuugaggcaagccugggcuaguugagcuucucucucaaaagaacaaaugaauaaagcaauaaguagccuuugccaugaucaaagaagagaaucuacuuucuggaaauuguccucuggccacauggaccuguggcaccccccacauacacacacacuuuucuuuuuuaaaagagaggaugaacguguaaccuugugccaaaaagaacauuuggagaaauguuucugggaguggcagccugggguccaucucccauguaaacaaaaaaaggccaccaauuucaguuucucugacucuuuagauggaauuaagaaaaaggaagaaugucgcuaauguuccguugcuuaccuucucgaauauaggugaccccuuuuucauauguguuauaagaaucagaaauccugugguuaaauuguuugaacgugugcuauauaaaauguucuugucugagcucaauaguucaguucucugaaauuacccagauguggccacuugaaggugguuagaauggauauuccuggcacuuucuucauuugcuccucuugacuuuuuauucaauuuuaaaguguuuauaggaaacaaucuaggaaaguccuauaugauguaccuuuuuccacauucuaauacccuccucacccagcauccucacccagcauccucacccagcauccucacccagcauccucacccagcaucccuauagcuuugcauaggugauccaaaugucaguaauuucuggguuggaggcuguaaaacauuagauguagguggcugaauuguucucguucccuuuauuuauaggcaauugugaauguucagagacaggcucauucuuucuuacuuaaucguuuguuugcuuguacccuguuucuccucugccauuuuccucuccaugccacaucauuuucuauucuauuccgugugauagguuuaauuauuuuauguguucuugaaaacuuugugugacuguuuuagacugguaugagugguaccggucuaucuauccuguuucucuuggugugaauuuaugaccguguaacucuggcuuauuaauucuaaugaguaccuuggaaucccagagcacagcuaccacguuuauucaccuuccauccacgcuugccucgaaggauguagugaugaacauccuccagcagauuuucaugguaucuauaaagugcuucccuugcaggagacccugggcaucugugaguuuaauugcucagauaucuaguuccccuggcuugucaggugauuucuaauuuugauaugcauuuuuuucuguccaaauaaaaguuggaguaucucuucuugauuucaauuuuacauucucuuguuacgccuguuucuuuaagcaauuggauuaugccuccauguuuuuuuauauuuauauuaauauaucacaguauauuuaaguauaauaauuaagugggaugauaugacgcuggcaguagcagaccauuuugaccuguggugcauaccuguaacuccaggguaucagagauggaggaaggaagaucaggaguucagaaucauauuugccuacauaaaaaguucaguucugaggaacaacaacaugaacaaaccaguaccccccagagcugugucucuaguuucauauguagcagaggauggccuagucgaccgucaaugggaggagaggcccuuggucuuacaaagaucauaugccccaguacaggggaaugccagggccaggaagcaggaguggguggguuggggaguagggcagagggaggguaugggggagcuuuggggauagcauuugaaaugaaaaugaagaaaauaucuaaacaaaauuaauuaauuaauaaacaacuguguauuauaaaauaaaaagaaaagaaaaaagaaauggaaagaaacaggcauuaagaugcuaucuaggauauauauuaaaguucauuaggggacuuucaggauagcauuugaaauguaaaugaagaaaauaucuaauaaaaauuguuuaaaaaaauguucaguucuaaccuaugauacucuagaaccugucucuuaguaauaaaacaaaucaaacuaaaaaauaacaaucucuacuucacccuaaucuguuauuagaauuaugguucuucuauguuuauauuauaaauaauauuuuaagauauauguguuuacuauuucuuuuuuuagcuugucaucuucgauuguuaaaagaaagacaacuuaaucagagaauaauaauacagcuguuguuacauaaaucaaagcacuuuguaaaaggcuaaaguuacuugcauugugcauaguuuauauagugauuauacuaguuuagcugcaaccucaucucauuagauauucucauuuaaacuaauaucuuaauaacuugaaacuuuaccuuguuuuugcuuguauuauuugguugcaguggcuauuaaucauuuauucugguguucauagauauaguauacuuuaugcguguguuccauuucuacccauugccuauuuuccuacugauaccauuucuuauauuaauuugauaguggauuucauacaaugaagauguagucugucuucaauucccgaaaaugaaauuauucaucaacauauguuuucuucuucagaugacaaucaaaacaaaacucaugauaaaaaagagaagaagaugaugguccaaaagccacagggcaccauggaauacacuguaagugcgaucaggguggcuggagugaucacuagugcucugugacuuaugcauacugcuuuucuuugacugacuuugccccuucacucuauucuucuugaaugcccaucacauaguguaguuucucaagacacauuuuaggucaugucuuuuucccuuuguuuuauguggaaagggggcucaugacccacucuaucccauuuaacuccugaguaaauaacacagagacauuaaauuuuauuaacaagcugcuagcacuaugcuggccaggcucugagcuuuucguaucugacuaaucuauuaaaaccaaauaaaugccccguuacuugccagccaaguguugcucuguuccaugugcguccucagggugagcuuuucauggcuacaugcucaugguccauucuuaugguucauccuaccucauggugaccuccuuccucuccuuuccuuuuuccuucucucucuuugugaucucuccucacauccccucacucaauccaaaguuccaccuuccuuucccccaugcccagucacaggcucuagcuuuuuauuuacaaaucagagauuauuagagagcauucuuuacagcacauuagucaguacaaugcccauggucagacuucaacuugaucgugggguaaagaacucagcgucugaauacacaguguauaagacuaauccauguuuucucucuggcuacaaugucugucacuccacuaauuaucaaccuugcuuaagaucaucuagaaggccaugagaggauccacgucaucuacucugcuaaaaccugguuuaaagagaugaccuuucucaacagagaaggaacacuuucaguuuaggauguacucagcuuuuuuccaccagacaaacaaauaaaaugucuucagaauggccaugacuaccaauuguagcuguuuaccccagacaucgucucuaagaucuaaaggcgucaaucugauguugcuuaacauauccacuuagaucuucuuuauguuugauccuuuuccaaaaagcaauucaugauucaaguauucauacaagcuaaggucucuuaagacgcgccuuuucugcuuucucucauuuaucaauaaguaauuuuaacugcuaauuuuuuuuuaacaaaaugucaaacguucgauuuuaccaauaaagauuugggagccuuaugauggagugaaagccuacuaacucacacaggcagaaaaagcacccagcugaccuuccuccucagccaguguucccaaaagaagugguccuucuccacgcugucucgaaaacuccucaaauugaguauuccuccuuacuacuuucuguaugucucuccaucugaccuccugacuuccucuuaaccucuacgguuuucuccuauguucacucccuaucagcuguuugcuugccccaccucuugaccuaugguugacuuuauuuuauccuauuuacaauaaacagaaaucuuggauugaagauauguuuuagggauaagccauaccacaacuagaaauaggauuuuccaguaaagaauacaaucuaccgguuuacagugugcacaaauauacugcaacauuuaacacugcucauugauaugcuugguuuaaugucuauuaugugucuaucauucucuuauucaaggcagaaacuagaccucuuuuguguuguauucuuggcccaugccaggguguguuuccauauccuugaaucuauagauaauaaugcugcacaaaugucauuuacuguuaccuuacucuaugugccacgaagucaccuuuguuguugcacuuugagcuccugaaacccagcagcuguguuuaucauagauugcauacuauaugagcauacaauuguaguucuauuuaaauucacugugaaacagcagugcuaauggucugcuuugacuucuaaaaguuucuuucuuaaagugacuucuuuaguuucuuuagaagaaacuaaauguuguugcucuucgaugauucuauucuucuaauaaauccuuguuuuagacugaccauguaaagcuguacagccagugagcagcagacuugguguggauucucagccuuauguuuuauguugauguuaaagcugaaaauccuuaggguuggauguguuuucuaauagaaaauaauacaccuaaguuagugcacggcaacagcagaggacgaggagguccagagaugaaccgcaguuaagaugcuuuuguguguaguuuuauuaaguauuauaaaggagccaagcaggguagucacaccgaaaaucucaguacuuggguagcugagacacaagagcuaaggcaaacuugaggcaaaguugggcuaccuagugauuuucaggcugaagugcaacuuuguuucaauacaaaacugaaacucaacagcaacauaaaaacaaccagcucaagaaaggacagaaaaaggaaaauuuaauagcugcucuuuuacaugguaggucugaacagagcuauuauguuugguucaaugcugucaugaccaaguugguacuuuguaucuguuuguuguuugucuguuuguuuugguuuugccuuacacacucugacucuuguucauuuuucuccuguaggcuggaagccaggacacccucaacucuguugcacugaaguuuaacgucacucccaauaaauuaguggaauugaauaaacucuucacacacacuauuguuccaggccagguaauuauuuuuuauggugaccauuacuuuagaaauuuugccuucauuuuuuuguuaccaaaguaaauaacuuaguauuggcgccucaaaauugucuucagugaugacucguucaucucccuuagagccaagaguucugaaggugucuuaguucugauaauuaacucagauguauccuuguguuuacaggggcaucaagaggaguuuuagauuaagaaacacuuuuuccugucaaauauaacacgaucucuuacaauguuuaacucugauuuacgagcucaauuuaaucuauuaggaaagcauggccaucauuucauuuuaauuuagaaauaauuuuuuaucuuaauuuguaccauaauuguccacuugccaaagaaaaagaaagauauugagaaaaaaucgucaugagaaaaccaaccuacauugugcuucaggauuuuacgaacuuuagucagcauaaauaaagaacaaauguacagugcuuccuuuuaguuuugauaaaguaaguguuugguacucuguacaggaugucagaugauuuagcuggcuugguuuuuuuuguuguuguuuuguuuuguuuuuccuucaaaaguacauuuaaccaauguguuaauggcucagucacuggaaacgcaucucuaaggugaagugcagccuuguccacggaaucacuggcuaucuaaugcuaucuugcuaguagaucugagccuucagagccaguuugauuuguucuguuuccagacaacuugagaguuauccuucugagguugguuugcugaucaccuugagauagagaugaacuaggcuggcuuugaccauggcagggauguggacuuucucauugaaugaacuaaaaacucuuacccuagacuuguugcuucaaaagacaaauacuaggaucagaauagcuuuauaaaaaaaauagcugagaccuacagugcuuuucaggagacucugaguuguacuguuuugugacuuguuccaaaugugguuuaauguacaaugcauguacuuuugcaguuuuaaguguccuucugugaauauacacuuaaaacuguuuuccuacuuauaaaacaccuuggcuauauauacugaauuguuuuucucuagguuaaagaggcaauuuguuuuaugaugaacguuaaaucuccuuaaaucaccuuaaaucaccuuaaaucuccauuucucuuguacuggaacaaacacaagaagaaaaccucuccccagccccauugucaaggcccaguuacacuuuacugaagaagcccacccagcuucccagccuucucacacgcugucgccuacuguguugccuguuacuuucucggcauucagaggcauugguuucucuaguuuaacuacauaaaauaaaugcaggcacuauguacuaagaccacacaacuagaaucauuucugaauggauuucauuggacucaaagccuuggcgguugccauucacugauacugaaggugugguaaacagaaacccucuaaaccgccucaauguguucguugcuagcacaucauggaagcucuauaguucaguaugacgcuguaggcgagugcuuauaccccgagaaacgggcucgaucugaucuuacagaaacuagauucuacuagcugcugauaugccucuuuguuuaccuuuauguccacucagagcugcuuuugaucaaccucuccauagguguuuaauaauuguguggcucauauuuucagcaguauccagucaucaaucaucuuacauccauugacuuagauuuuucucaccuuuauuuuaauguauuuucugauuauagcucuuuuuuugggauucaaaugaggguuguuuuuuuuuuuuuuuuuuuuuuuuuuuuuugucccccgcucccuguguguguagguguguaaguuuaggugcacacaaaaauuggugugacaaaagacuuuugggaggcaguucuuucucugugaaugaggcagcaucagucuuucucugcuccucagcugaguguucaaggcuagcgggccugcaaguuucccugugcuuccccugccucugccucccaucuucuuauuaggaagcuggggcuauagaugugaugcugcgucuggcuuuuucuccaguuucucaggucaucaggcuuggaccucaaacucugagccaucuugccagcucucugaagugaguuuaaauagcuaaugcuaaaauagaaauguuaacgcuauugauaugagaucagcuguugaaugauuggccucaaauucugucaacaacagccaagguuuuuauguuaagauuauuguuaaauuauaguugauuucaugcccaaauguagcuguuuuauuggaagaauauugaauuaugguaucacaauaccaguucaggaugcaggcuguuuugcaguggagacuugggcuacuuuuauuuuuaaucgauaaaaugcaaagaggagagaaaauguagggauaacuauauugguacuaccuugcaccauucucuguauagccaccagccuggacugucccagugcugccuagcaggaguauucuaugugguagccugcugugcgguuuuuuucucucuucauauagguuuagcauuuacaaugcagaaaucuaaacuccaaaaugcuccaaauucugaaacuaagcccauuuggggcauuuuagauuuggaguuuucagauuauuaaagcagguuaagucuaugaauauauauauauauauauauauauauauauauauauguguguguguguguguguguguguguauauauauacauacauauuuuaauuauacauuuaaauauauuuaauauauuaauaaauagauauaguaaauaauagaaaaguauauauuuacauacaugaguguuacauauaguuauauauauauauaguuuuacauauauauauacacauacacacacacacucacacacacacauagucuuaggguaacaucaugaccaagguaacuuuuauaaagggaaacauuuauuggggccagcucacaauuucagggguuuaauccuuuaucaucauggggaagaagcauggcaagauccaggcagacaugugcuggagaagugcucugcaggcagcagaaggagacugugucucacacugggcagagcuugagcauaggagaccucaaagcccucccccacaaucacacacuuccuuuaauaaggccacaccuauuccaacaagaccacaccuccuaauaguacuacucccauggaccaaacauucaaaaacaugagucuggggugggggggcauaccuagucaacaaccaccacaacacacacacacacacacacacuguauuacugacuccaaguauuucagguauacucaagcuguugcguuacucuuacuccuuggaaggcucuucucucccuccuuuccaguuccuacugugcagguuuuuccuagucugaccagguagauacucucugguucuccugcagugucaguaaucuguagccauuacacugugacauuuauauugcugagaaugguuuggggguaguuuagaagacuccauguugcuuguuaauagaaagaaagcucccugggucuugcugaggcacugagugugauguacagaggggugaguucccucggugugagaucaggaauugcuugacuucagcccucacucagccaugcugucuuguucccagguccuguuugugccagaugccaacaucucuucuaguaccauacagcuuucuucauccaccccuggugcuacugucucuccaucaucaucagaugcagaguaugauaagcugccuguauguaugccagcaucuuacacaagggaguucaugcuuaugauuaguuguggaaaucaguucacuauguuuuuaaaagauuacauuugaaaacuucuguaaaguggugagguuaggaaaguugcuaucaguugagagaauguagccuaucucaauauaccuuuuuacaaagggucucaaagguaaaaguacaugcugugugcaaaagcagugauuuucaaccuuccuaauacugugacccuuuaauacaguuucucauguuggguugacucccaaccauaagauuauuuuuaucgcuacuucauaacuguaauuuugcuacuauuauguauuauaauauaaauacuaguguuuucugauggauuuagaugaccccugugaaagggucauucaauccccaaaggggucacuacccacagguugagaccaccguacaaaagcuggaugcaaaauccccaguuaagugaguacauugugcguuuccuaaggaauuggaaucaguaaucuacaaugaguucuuuaauuugggauauuuucgaaaacauuuaaugaaacaguuuuaugggccuacauauauuuuuugaucuuaguuugauugggauacuuagcaaucuuaccgcuaauuuagaaaauaagcauuuucaauuucguuaggaguuugugauguuagcauuaaaaauucagcugugucaugaguuuaguuuucugauuguugauguuuaaaaaaauaauucaacuuuuagugcacuucuaaagaaagguauuaauacucuguuuuuauagucaagaauuuauaucagguuacaaauaguagggaaacuuuugaaaacaagaaaaauaaacaaauuguaguauuuuuuaauuagguauuuauuucauuuacauuuccaaugcuaucccaaaaguccccccccccacacccacucccccacccacccacucccaccucuuggcccuggcguuucccuguacugaggcauauaaggucugcacgaccaaugggccucucuuuccauugaugacugaccaggccaucuucugauacauaugcagcuagagacacgagcucuggggggguacugguuaguucauauuguuguuccaccuauaggguugcagauccccccagcucccuggguacuuccuccagcucuuccauugggggcccugugauccauccaauagcugacugugagcauccacuucuguguuugcuaggcccuggcauagucucacaagagacaguuauaucaggguccuuucagcaaauucuugcuaguguaugcaaugcugucagcauuuggaggcugauuaugggauggauccccggguauggcaaucucuagaugguccauccuuucgucucagcuccaaacucugucucuguagcaacuuccaugggugccuugcucccaauuccaaaaaggggcaaaguauccacaccuuggucuucauucuucccgagcuucauguguuuugcaaauucuaucuuauaucuuggguauucuaaguuucugggcuaauauccacuuaucagugaguacauauugugugaguucuuuugugauugaguuaccucacucaggaugaugcccuccagguccauccauuugccuaggaauuucaucaauucauucuuuuuaauagcugaguaguacuccauuguguaaauguaccacauuuucuguauccauuccucuguugagggacaucuggguucuuuccagcuucuggcuauuauaaauaaggcugcuaugaacauaguggagcauguguccuucuuaccgguuagaaggacaaauuguaguauuuuugaaggauaugugucauuucccuuuuuaauguuuaaggagaaguguagauagcauacuuaugguguaauauguuuugcaaggugauuuuuuccccuuaauuuugaacauuuuugcuuuuauaggaugcagauuuagcaagaaaggccuuaaaacccaucgagagggucuuaucaucuacuuccgaagaagaugagccagguguuguaaaauuccucaaaaugaacugucgcuacuucacugauggaaagguaucugccacugugauugcuuacuggucagggaaucugcagaaacuaaauaagaagacccauugcuggaugggaguauuuuacccacaacugaagugcaugauuugacaaacauucauugauuuuuguuucugguuccuuggccuuuuuccuacuuaagugaauacaaucauuaaauggaaacacggugucuugugauuuuggauuugccuuuuuuuuuguugguuuuuuuguuuguuuguuugguugguuuuuuauaccucuucaccuguaaauuuuguaugauuaaaauucuaacucuuaccucuugcuggauauaagaugcaagggaggguacuuaagcauccuuauuguauacuuuuuccaucuaucagauaagaauggcacuaaaauuuaacuagugggguauaauacuuaaaggagaugaaucucguaaugauuuaccuuuaaucuaggcaauggaaguuuuuaacuuaguguugaugcuggugauguuaguguuuaaaauuacuucagcuguaucauguuuucacuuuucuaguuguugauauuuacaaaagaaauccaacuuuuugugaacuuccaaauaaaggucuguauugauauucugugcugaauauuaauacagaccuuugacauuuuacaucagauuauaaacagcagagaaacuuuugaaaggaaaaaaauccugaacugcaaacauuucagaaagauaauuauaagacucaucaaaguuagcaacuggcuuagucccugggagucuccuaaggucccucauagauacuaucuugcugaucaacuggggaauucaguguaaucugagaaaguuccagguuuuagaucggcaggcuacugacaaauuuccacagcacaucuguacaaauuggaccugcaaguuuucccuguugccguuuauauuaaauuugacuggagaugauacuugcaguuauguuagacaaaaacauugggacuguccuuuggcaccacgauuccaauucuccuuccgcacuacacacaugagucacacacuagaaacaugguaaugucuugcugaguggauuguaaagcaccuuguucuugaccaucaguggucuuggaacggucuguuuucuuuuugauagggaaauggggacccaugagacgugaguguauggggcaacauuuuuucccccaaaagcaagagguuuauuuucuggaacaucagugucaauccucagucagucccucgagacgagugaugagaaggcaaccccgaauggcuauuacaagcaguuauauuuuuuagggacacagguuacaucagcaagguuacaauucaaacuuauuggcuagcaagcaugacaugcauuuaaacucuaccugggacuuuccagagggucagguaaccaucagucaauacauucugagaauuuuuuacucaagaauguuccuuuggauggagaauggaacuuggccuauccuuggccccaggcaggaggaagaagcuauaaggagagugugggacuggggguuccuaauuccugccccccuuuuucuuguucaaacuccaauccuggagcuaugcucaggggucuuggguaacuaacaaggcaagaucuuaauacagucuuccaguugcagcuguaugagcaaccaggagcugccacugcucugacuccuucccagcuaccagcauuguuuucuagcuuuccgaacagggaugugauugucacacaggagacuggcucaggcagugggaggacauggaagguucugugauggcugaggaauacuuuccuaucccaaguaauaccuucuguuccuuccuucugcagggugugguugggggugucaugauugucacuccuaacaacaucauguuugacccucauaaguccgaucccuuagugauugaaaacgguugcgaagaauauggucucaucugccccauggaagagguggucuccauugcccuguacagugacauaucccacaugaagaucaaagacgccuugccaucguaagggccauuucuucucuuuagaccaggggcuagagugagcuuuaaauggaauuucaaagugaggguauuugcagaagcaagggacuaagaaggaaaccaagagguggagauuuuguguugugaaauugaaaaauagaaaaaugggaaauagaaaugauuaagaaaauuuaguaaaguuucccaaauaguaaaggaaaaaaaauagcuauuuaagaucuaccuggcgucaguggugggggguugggggagguaaagagguagaagguggggcaaagaggagagaauaaggacuuuagcuuagccauccucacuucgggguuuuggggugaagguggguauuuaauggguccagcugccacagaaaguaggaagggaacaacugugaggacuaucgauucccuaauaguugcugggcuaaaucuaggaaaauauuaauuaacagaggaaugagaacgaguugccaccauuauauacuuagucucaacaguuccuggcaguugcaagcauacaaagcuuaugauuaaaucagucuugcuuggggaacuggcagcuuggacuagagcaaaggaaggagaauggaggagugggcaagcuuggguaggaggcuggaaugcaggugaaugugucaagcgagucauucuccaugagaguggggaaguaaaagagcuuggauguuuauggaagaaacuucaacuuguuaaucaaggaugugaagaguucuuuaaucugcaggacaccucagucuuuagccuaccaaaugaaauuucaaguugcaauaugacaggauuaucucagucauuuaacuguacagucaaagcguccaaagcguuuuuugggaucgcuuagcccacuuaguggauucacauuucuacagaacaaacgcucagcuaccaccgucauuuuaccauagccuccuaugaaugcuuauuaaauugaagggugaauuaaagcuuuuacgccauuuaguagcgccuagcacuuauaugggguuucauuuccuauugggaaaggcccgaguuuuccaugcaaauacuucauaaagucacuccagggagggagucuuuguuuaaacucaaaacuacuuggaacuuaguaauuuuauuggcuugaugauuucuuuuaaagcuaaaauggacaaaguacuacuugaaaacccuuuaagaaagcauacuuaauucuggaauugaaaguauuuacuuuggaaaggaauuuuuuaucuuugugaacucagcagagaugcuacuaguauuguaggugaagacucaggggcccucaagauuauuacagccauacuaaaauguguauuuuucuuaaccaagugcagugguacaggcuauaauccuagcccuugggaggucuacgaaggagggcuguaaguucaaagcagucugguuuacaaaacaaacucacaaagcaauaacauaaaaacuagcaaaccaccauccgaauuaaaacauuuaauguccuggcuacugauuuugaacuuggaagaacauacuuagcaaaucuuuuauauaauucaaaucuaguucuaagcaucuccuguuagaggguaguuaacugacuauaucucaggauaacauguuucaguugauaaauuaaaaauuuuuaaauaccuuagaaacagaagcaauguuuuaagaacuuuucuguaaaaguuuugauguaccucuuuaaauuguaaaaugguauuacuuccaguaacaaugaaaguuaauuuuuguaccuccuuugcaaguagcaauuuuuuuuaaaaaauuggaaaaauccaucuuuaaggcaagaaacacuauguauauucaaagucaguuuauagagaacagauaaaugagcagagauaucaaggauccuuucaggauucugcuguugauuucuaauuccuaccaauuucuaaaaagggaaacauuugacuucaggaauuuuagucacugaugcuaaaucucuucuuugugcuucccuucauaaaugccagacacuuuauuucauauugaagagucuuucagguaacaucuguaugcucagaacacaucugugugaucuaucagaagguacaacucaugugacucauucauuugucaguccuuuuguuugaguuauauuuuauuuuacagucggucucuugguuucauuuucuuauuuugaaaucauuuuuugcauaacuuuaaguuguaguauguuuuugguuuguuuugguuguauuguuuuguuucuuuccuccaguucauuuuugcuuuuauuuuuaacauucuaugugcauccaccauuuuugccccuacagugaccuaccucgggaucuuuguccucuguacaggccuggagaaugggaggaccuggcuucagagaaagauaucaauccauucaguaaauucaaguccaucaacaaggaaaaacgacagcagaauggggagaggacccuugcuuuagaugccaaaucagugcgcucuccugaggagucaacugaacguacuugcacacgcauagagcccccagacaacucugaauuguggaaauuaaagaaucugcaaucuuccaggggaacaaccagugagucucccucagugacccagcucagcaugcgugcugccuuggaaccuacagccaaagaaaacugucuuuuaaaaggagaugaggacuuuguugacuuggaagaacuuucuucucaaccugagaguggaaucaacaaaggagaugccacgaaagaaugucuuuccuaugaccaaaagaaggaugggccgcauacagucaugucugcaaagaaggggcacgugcagucagcccaggaaguuaugggaccagagagugauacugaacugaagggagcccuagaucuagaaacugcugagaagcaagaugaagccccagaaguagacaaacacucuggauccccagaaaacuugggggaaagcacgcugaauauacacgaagaucuagauaaaauuaaacucauugaauuuuaccuaaauaaaaacaaggaagggucacagcuguuagaaaaugugcagaagucagaguuaagugaccgcaaaaguauugaaccaggaggaauagacaucacacuuaguagcucucuuccccaagcaggugauuccccaccugaggacaacaaagagccagguacacucuggguaaaagggggagaaacucugccccugaaacuagauccuagugcagaggaaacuguaauuaacaauaaagagguucuggauucuuugggaucaucucuagacaagaugugucacagugcacagauggauaacaaaucugagauucaguuauggcuguuaaagagaauucagguaccaauugaagguaagacguuguuuggucggguuuugguuggauguuuuguuugguguguguguauauguguguguguguguguguauguguguguauguguguguguauguguaguauguauguuucugcgugugcauguucucauauguauggcuacauauauacacauggaagccgugugucuuugguuauggcccacuuuaauuacugaggcagacugagcauuaaugacugagguaaaaauuuacaaaacaauuuguagaccuugaacuaaauauagauuucuguuucagaaguauuuaacucuuucaaacaaauuuuuuuauuaccuugcaugccuaaaucuaaagaaguugaaacuguauauguguguaugaguguaugagagagauggggggaugaauagcaggggaggacagaagaggggaggguagaggagaggaggauagaagagaggaggaggagaggagaggaguucucacuauguauccuugguagaacuuguucuguauaccagguggcaauucacagagauccuccugccucugccucccaagugcugggauuaaaguugcaugccaccauucccagccaaaaaugcuuuugagagauuuuagcuauaaaccauauugcauugugguguuaugcuauuugucucugugcugguuuuuaugcuuacccuuaguguguagcaugucauauaacauguacuauccugaaacaugcaagcauguugucuuugugugccaaagagcgucuuaugguucauuaggucuaauccuauguaggugaaucgugcucccacacggggucagccccucuuuguaagcugagaaccuuuuaacugucacugguguuaacaggguugaggauugcuuucuucugugauucagauauacuucccucaaaagaagagaagaguaagaccccgcccauguuucugugcaucaaagugggaaagccaaugagaaaauccuuugccagucacaccgccaccaugguucagcaguauagcaagagaagaaagcagccugaauacugguuugcuguuccccgggagaggugagcagagcuaaggcagcccccacugccccaauuccagcugcguguggaccguuuaucuguaaauaauuuaguuuauucuugaauaagaacuuuugcuucauuauaacuuuguuuuagcuucuugaagggugcauacuuguuuucuugcauaaauggucauuuugacacaacugcaaaguugauuuucaauugaaggaacaugcaaauaagcucaaauauaugaaauuggacauaaucuuugaugggaauaaaggagcaagcuagagcugauccaagcuggugaaguguaguaaagagacaguauugaugcuuguuuuaaaagugcuuacaugggcgagaacugacuauucuagggccuucugaagggagcguuugacaggaagagaacuauaugauguuaguccccaggguagauagcagaguuacauggcuuuaaggagauuuaauguuuuuauuuguuggggggggggcuccuuguauuuaaacugguaguaauuauauauauuuaugaguaggauauuuauacauguguguaacagucuacaaagaucaaaucuggguaauucgcauauccaucuccauaaacauuuaucauuucuuuuuggagggaggguucacaaauccucccuuguggcaguuuuuagauagcaaauaguguuacaaucucucauugcccccugcacuaacgagcuugcuccuuuuaucuaacugaucuugucauuacgagggucucaugguugcacacgcaggggacuaugaagaauauuuuccuugccuggcguauuucacauaauccucuagacucaucuguguugcuguagagcacaggacugcauugacuuacagcuuaguaauagucuugugugcuuauaccaccauucauucauccaccauguguuguuggacaugacauguagauugaugccacaucgugacuguuaaugaaucaguucuacagugaacaugagaaugcaggcagagcuuuguagcagcauauuaccaaagaagagaucuuauugauuuggggacagaugauaguggcauagcaaucuuuagcaguguacuauaaaugauauguuuauagaauauaaaauaggaacuuuaaaggaaaaugagaaauagucuuuuuagaaauugauuuauuuuuauacaugugauggaauaaaaagacuuagaauaaagacuuagaaaggacuuaauuuuaacucugaaauccacacaccuuuuccugacuagucaccagcaucaucauuuggacagguguuugauuaauaaauagaacuuauugaccuucugaaucaugaauucucacaaagccaaaugagacucugagcaaggccuugccuuccagaugguuauugccuauggugguaauucuuaccagaagacucaccucauuuuaauaaauuacaguuuaaugugaaaauaauaggauuuuacugaauaaguuugcuaauaucuccccuuucucuuagguacaaacuuacauuacuaagggcaauaaacauaguuuguuuuguauuuaugugaugcacccucuaaccaugcaugcaaccccaggaucucauggaaguuuucaaguggaacucuugggaaugugcauguccauuuccuacuguuuccuacuuacaaaugguucaucagaagaaauguuaauuucugaagcucuguucucucaggaguagaauauuguaaauagagccaucucugaaaagauuuggccccuucaugauuuuauagguaaggaagaaauagcacugaauuuuuuagcuacauuuguggguuguauagacuuaucuggugaggaagagaggagaaggagaaauauugagagauuggcuuauuacauauauacacacauguauauauauguguguguguguguguguguguguguguguguguguguguguguguguguguguaguuuuuuucugagaaaaaauagaguauuuggaaauugaguuccuuuccgaauggaacugcauauaccuagagcucuuggagaauaauuuagcaaucccauguguauuauuuuuccugucauucuuuaacuuggaagauacuuuuaaugcugaaacaguauuuuucuuggaccucuuccucaagugguuuugcaaacuucuuaauauaggucauguguugaauuccaucacacuuuauauugacauagcuuacuugucuuugaguagcaaauaguuuucuuucuugaauucauuaucaauuagccaaauauugucuuggggacauguuacauuuguuaauuaugauagcuuuugugauaaauauuagggaauuuucucauaacuauucccuuuuguauuucaaugcgucccuggcccuaaauaaaauuugcauuuuagaauaagagaggauagauagaguggcccuauaguuaugucccaccaagacuuccaagugcuuaguaugaaaaguacauuuauuuuaauaacaauuuauagaauuauuaaacuuaagcucaucugaagaacuuaaugaggagcaaaggagugccaugaaguauuucuuauuuugcugauagauucuauaucccuucacuagcccucugcugagugaauccauuugucuauuggugugucaacuguagugcugagucacacuaacagaugcugccuucuaaaucacauuguccucucaucgaucuuagagaugugacaucaaauucuucaagaugugucacugugauucauccacugccccagugcuccugguuacagggaaauaguuaaagguugacauaacguaucaaguauaugcaugagguugacauaacguaucaaguauauacaugagguugacaugacauuacauguauauacaugagguugacauagcauaacaaguauauacaugagguugacauaacauaacaaguauauacaugagguugauauaacauaacaaguauauacaugagguuaacauaacauaucaaguauauucaucacuguuccuccccauuguuccuaguauuccuuaaguagauauuagauuuuuuuccuucuugguacuuauuacuaauaaauuaaugcuacuaaauccacuucuuguuccugugcaguguguugcgacucccuuagcuccaacaauaaaggaauaguuuguaaguaagaaaacagaguuacacaacucccugcauaaucucugguuauuucuuuuguaugucugauagguuuuauuuuuguuuucuguaccaauucuuacuaaaucauaagcauuagaaauuggagaauucaauuaauuuaauuuaaauuugccuaaaacauaauggucuuauuccuugguggaaauugucaguaggucuaagaucuccaagacuccaggaagacuggcagcuccuucauacucagucagauaacacugcuugaaaugcacucagauucuccuguggguuaaauacaugacaaccuuaaccugucucugucuccacuacauuuugcaaagucagcuacuucucuugaguaaucugagaauggcgauguuaugcuugggauauuugugaaauuucuagauuucugauuauauaacuacaagaucccagcuuucuuugcuuuggcuccugguccuaauuuaaccauaaaagcaguggauaauuucaaucugucaguaaucuaauuuaaauugggaauuccuuaucugaaagguuuauaucuugauguaauucuaguaucugaaucauagcagaauauuaugacugacaugucuuuuucaaaauguuucuauuaaaaucuaaaauagaaugcccacuuguagccccacaaauucaacuguccauuuacucagaucuggauuaggcagagugaaggagagcuuaugggacacccauuagcuacucucccuggccaugcuaggcaaggauguauuaaguggugccuugcaccguuaacugauacaacuguuccacaaggcauucugcauuuuaccaaugguggaccugggaugcacugaauuuugacaccuugcucguaucuauuuaacuuuaaaucuuaucuccaucuuacaccagaguacacaguccaaauuauauucauuacacuauucguuuauguuauugaaucauggaaaugagguuuaggaaaggauauuuaacaguuggagucauuucauggcuagugucuuaggguuuuauuguugugaagagacaccaugaccaugacaacucuuauaaaggacaacauuuaauggggcuggcuuccaguuuuagaaguuuagcccauuaucaucauggcaggaaacaugcagacagacauggugcuggagaaagagcugagaguucuacaucuugauaugcaggcagcaugaaguaaacugaaacacacuucccccaacaaugccacacauccuaauauugccacucccuauguggaccugugugggccauucucauucagaccaccacagcuauugaggauauauagcaucuccaaguguugucucccuggacacuauugaaaugccuuuucucuggucugaucucugcaaggaauguggugagaaaggauguggauuaggagugcccuccuugguacucuuuaauugaacuaagggagucuaaucugaauauaguauuaaaauaaagaacgugccuaacauguucauggucugauauuagauuucuuaaaaagcaguugcaauccuguuuuuaucauuagaucacuauuaggaugaacuuuguugauaaaguaagcaggcuucuaucuuccauagcaaaccugacaagaucuaggugcaugacugaauuacucccaccaugaacauagcaccucauaccuaaaguacaauuugucauucuguguuucccuuuaaaaugcuucuuguaccuuggagcaaugauaaccugaagaacuauuuugaucuuauuauauugcucuuaaaucauaaacuucaggacuaaaguugaaaccucuuguuuaaaagcccucugccgacuggcuuuuucuuucuagauuuuucugagcuaacuugaaucuauagauuuaccacuuucugaaucugaccagaacaaggguucuuuagacugucguugcuuuuuuuuuuuuuuuuugguuuuguuuuggguuugguguuuuuguuguuuguuuguuuguuuggguuuuguuuuuucaagaggucggguagggguaucucauuaugucccggcuggcauugaauauuagauugaaaauuucauacauguauacaauguaucaugguccuaccuacccuuauugucucccuccaccucuucccaggacaucucccuccuucccccggcccugucacaucucccuugcaacuucugucuuguuuuaaaauuacuaauuuauuuaauccauuugaguccaguuauuucugcucauaugugaauggguaugaaguuauccgcagggcaaagggaaccuccaguguucacaaccccaaagaaaaguuauuucuuuuuccuucgcuagcagccauuaacuaccaauagcuccucagccaaaaguuggccucaggagccccucccaucuccaugcugggacuuggcuugauggugagcugguaaccacagggacuauaaaucuguguggccaucagacaugcccuguccagaggacagaauuucucagugcuccucuccauccuuagcucucccauuauuuccauuaucucuucugugauguuccccaaacgcuaaagguagagguaguuaacaguugauauagauaucccauguaugccugagcccucauaguugcuucuguucagaauuccaaacaggaaugagucucugcaucaaccaaucacaaccuacucagucagaaacuucucuaacuaaggcugugaaacaaacaaacaaacaaacaaacaaacaaacaaaucuaugccuaugaacauaaauauuuagaaggugguuugaccacuuaggaauauaacaucgauaguuucuccccugggaccuauggcuuuccuugcagugagcuugaccuuguuuacagugugaguuaugaguucucuccuauggaacaggccucaaaucuaaucaguaaagugguuaguuacacccauaaacagucuugucguuauugcaccagugggcaccucuugccuaguagaaaggucaacauuggaacacucaagguucagcuaugggaaaacuucuagcagccugcgccuucuggcagauguaaaacuauccaucugagggagagaaagcaauccuagucacuccaaaauuguuuucuuucaacuguaaccaaagagugcgguggcaucaacacuaggauguuaccacuugauuacuuagugcuugucaaauugacagaaagcuagauauaccugacaugcaaggcucuaauugaggaacucccuccaucaaauuggccuguggagaugucuauaggacauuuucuuaauuucuaauauauguaggaggauccagaacacugcgggcagugcuaucucuaugcaggugacccuggccucuacaagccaggaggaacaagccagucagcagacuuccauggucucugcuucaguucuugccuucuccagaauuuugccuugagcuccuacugugucuucccucaaugauggacuaugaucucuaagcugaaauaaacucuuuccucccauauugucuuugguuaguauuuuaucacaguacugacauaccaucuaauuauggugggugaucaagagcaauggcaauagccuauauuauuuuggguaucucuggguccuuacugaccaauaacuuggggcaccuggcauuaaaauuuucauuuaauaauuccugacuuuuggaaauaguaguguucacuaauguggguuaccucuguucaaacuccuaaauauaacaaacacacacacacacacacacacacacacacacacacacacacacacacagccuaguggggauucguaaagccucuuuguuuugguuaacgccugcccacucccccuuccccuaccccuguccucaaccuugcuuaaaccuuucgcucccuauguccaccgcaccaauggcuuucauaucuuguguguuuuacuauucccucuuauacaauuuauuugcuuugugaguucauugguucgugaauagcuuuucuaugagccuuucauuuugcuuguguuuuucccugccuccucccccuguuuuccuguccacaauauuccacucucugcaucaagucuucugccccuaggauuuccuuuuucuacuuuaguuuaauuugcauucuacuaucacuccuuccuaaaugcauucacuuaccaucagugaccuguuguaauuuucucauaacucccaaguuaaacacaugcaaaaaagaaguccacuugaagcuaguacccacagaugagagagaauggguggcauuuguguuguaggggcuggacguccuuacucaauaaaacuguuuucaguaacauccauuuaccuucaaaugucuuuuuuuucccccacacaacuaugcacuauuccauuguguauacacaccauauuuuucuuauucauagguuggcggacaucugguuugauuuccauuucuuuguaaugggaauaguauaguaaugaacauggauacgucaguaccaguguaggaagaaggccuuuugggugguguacguacaagcauaacugggaaauaugcuagcucuauuucuaguauugugagaguccuccagacuguguuaguuuauauucagaguaugacucuucuuccucccucacagccacaucagcauuuguuaucauuuguauuccgacucuugacuuugaacauuugauccuccugccuccauaacaggguccuaaaauguacagaaaugcaccaucacacccuauaguguacagccaucuauaaacaguguuuuucuuuuauuuuauuuuaagugugugugccugcguauauguaggugugccacauauaugcaggugcucacagaagccagaagaaagcauuggauccccuggaauuggacuuacaggcaguugugacaugccaucucaaaacugacuucugagaguauccuacuucuguggaucuggauuuuuuacuugaucuuagaauucauugggcauucuuaguuacucuucuguugguacagagaccccucaauugaagugacuuauaaaagaggucauguaauuggggucuugcuuauaguuccagaacaugaguccaugaccaucauggcaggcgcaugccagcaggcaaauaggcaugguguuguagcaguagcuagagcuuacaucugauccacaugcagcaggcaaagagaaaacuaagaaugcugugagcuuaugugaccucagagacccuaccauaacccaguggcauaccucuuccaaggucauaccuccuaguucuuccuaaacaguccaccaauuaaaaagcaaucuuuccacuuauaugagccuaugguggucauucucauccacaccaccacaggcauccacaacauuuaacacuacuaccugccacccauguuuccuuugaaucuuuugcuuucuuaagacuuuguauccaagaaacagcauagcaccuacuaugcgauucauauuccacaguauuuguuacaucaguacaugaauagucgagccuuugaucuaauagauaaaccuuggucauauuuaguuguucuuguaacuaaaauauuuggacucauaauaucuguaaaguccagaaacaaaauagaaguuguuuucauagcuauuucacagagcugaagcaaauguauauuuaucccuguaccuuuugaucuuuucucuguacauuuucuuacuuaacacuauggggccacauauguauauuguuauauaaacuacuucuacuuaauaaaauaucucucuucuccacuaaaauucuguuugcaugaauuuaaugagcuuuauauugguuuuauaauaagcaaaaucauaaagaaaacuaauucuccuauucaauucauuuuacaauaggaagauggccaaguucuaaagaccccuagggagaccaaaauauguccacagcagcacauuucuuaggagagcaaagaaugaauuaaagccauugcaagcugaccuguuuuucuagcauacacucuuuaaccaccguuaauaugaaauuuucugaucagaagucacauugcuuguaaugggaucauggcuaaauuggaauuguuaauaaccauuggugcuaacagaacccuuguuugggacauucacuaauacauccguucuggaacaacauugcuucugcucagccuaacaagguauauuuuaggauaaaaauccuccgauuuuuaaaguacuggauaucauuauauaauauuuucuuuuccuuuuauucuuuuuccuuauuauuuacuucagugcuaaggauugagccagcacccugcccucuaccacuaacccaacccaagccugugcugugaucuuacugugauauuuucaauugagaauguugcuaggaaauaaagaaacagaaagaaaaccaaacgauucgcaagcuaaagcuagcaucuucuucuguaaugccaauuuaggaaaagugcugaauagauauacuuuuauuagucauccguguaaauaucuuccauguuuuuagaaaguuaacauacaaagccuugagggaaauauugcuuggucuucauucuuccugaucuuuguuuuuuuuucauucccuuaaaaguccagaaaugugucaucuucuagaacugccuuucagcaacuucaguacacagcuuuggcaaauaucuugagcuaaucauugacuuuacagacauccacugaucuugagaaaagaccuuccuaagcuagcucugcagagcagggcugugcuccuaaggagggguaacugagucagcaccuccagggacagcuuaaggucugacucuaagaacgccauucaucauuuagcucuauggcaucucucauagucaauggacaauuuauauucucugucccacuuuuguuuguuuguuuguuuguuucuuuccuucuuucuuucuuucuuucuuucugucugucugucuuucuuucugucuuucugucuuucauucuuucauucuuccuuuuuuugugugauccacgaucugaucaugcuaaaugaagacuuggccuccuauguugucacaguucuaucugcauuagcaagacaccucuguaagaaggucaagaccacaaggccugaccacaauaccuaucuuccuuucugcuauauccaauuugaccuuauuacagcuacaucagcaacacacucuucaaaugccaugucucuguacauguucaggaaauugaaguauuuucuuuuuccuccuguaaugaacucuuuugucucccucaauaaacccugauaaacugugacaucugacaagcuuucuuagaccccuguuauagacauuucuccaucagacuuaccucugcuaacacucuuacuaaaaaugaugguagguagguagauagauagauagauagauagauagauagaugauaggugauugauagaugauagauagaugauagguuaaauagaugauagauagaugauagaugauggaugagagagagagauaauggauuaaauagaugauagauagauagauagauagauagauagauagauagaugauagauagauagauagauagauagauagauagauagacggauggauggaugauaggugauugauagaugauagauagaugauagguuaaauagaugauagauagaugauagaugauggaugagagagagagauaauggauuaaauagaugauagauagauagauagauagauagauagauagauagaugauagauagauagauagauagauagauagacggauggauggaugauagaugauugauagaugauagauagauagguuaaauagaugauagauagauaauagaugauggaugagagagagagauaauggauuaaauagaugauagguaaauagaugauagauagauagauagauagauagauagauagauagauagauagauaggcagauaggcagauaggcagguaggcagguagauagauaggcagauagaugauaagaaucagccuguauucaaaaugagaauggucucugugucugaacacaguagcacauuugagaguguggcaccaacaaggaucuugagcagcuguagagcucgaauuaguccuaaaccucugggaagaugcuagaagagauuuuuggagccagacaaagugauugauuuugcauuuuaaagucacccccauucucugcccuuuugucuuggccucauuucagccuccgaucuacuuccuuuuaaaagauuagcuuuucccaggacccaguacuugaccaaguuuuuugcuuccuuauuaacauguauuacaauacacugcuucaggacuaguuggcagcuacaguggcugcaauuacugguaauggugcuagcuaugaggaaagcccuggauaaugucugaaggcugcugacucauuaggggccaggccacgaggugaauuacugagcccaucaagccucaacaaccuuucuaaggucaaggcuauaaggauugacacacaguuguuguuuugcacaguuggugacuaaagaaaaccaauuucacugagacaaugaguaaugaaacaguguuuuuuaacccucuacuuccuuccagaaaguguguaaggcagaauugauagcaaauagaucagaacagaugaguuuaggguugaaacauuugcaagcucaaauaauggacucugaaaugaaaaugaagaaagggaaggaacuuugaagaaaaaaagaaaaccuacaaccuuuuuuuaaggguagagaaaagcaugaagguuuaaagaucaacaugaaggacacagaaggaugaaaagaaugggagaguaagggaacagaacggggaaaguuggcagggaguggggcugguaaggugcagaggagggugacgauggguaaaagaggaaguguggagaacuagaucaacuagauagauagauacauagauagauuaucuagauagauacaagaugcaaggggacucuuauuuacacaguagagaauccuucauuuaaauagggcauaaguagggaaggcugagagcuuggggugauggaaagaggucccuacucacugugaugaauaggaagggagcuacauguaaucugugacugugggaugcacaagaaagagucuauuaugcaugggagaguaacccaacagccucccuagaggagaaguuaaagaagguggccuguguaggcaggagacugggacaggcacacaggguaagaauaaagguaaggaugaccagauuggcuuagaauuguaugaaucuggaaggaaccaaauagcugagggaacuugaggcagagaggaaucaugaagguaaaagacuagucaggaagcaauggacaagacgggauccagaggaccaggaugggagagaggucugcggacagagcuuuacuuucugaagucuguuguguccuggaaacuaaaguagguugagguuaggaaaaccccauuagguaaaaagaaccaguccaagaauucagcuaaguaaacugaagguaacuguaauucagccauaccucuuccgguuccgcaaacaguugacauaauauaaacaaagggaagggacuuaagcacagagaguuggaaagaggaauaggauaggacacauaauccuuccauuuggucuccaaggacuuuugaacuuaaguaaaccuuccaaaucaauuuaaauuuuccucguguggagcaaguuguuuaaauuuuucauucauuuuacuuuuaucucagcuuccccgaaugauguuccugacuacauaagaaacugagggugcauuaauauuaugucagaaguuaauguugaaagaaguaaggcuguguuuuuacucuggaugucuaaaagaaaaaaauuugagcauuccccaugaguauguaacuuugcaguuugcccucucaucuucccuauugcucccaggcaagggccaacuuuucuagccuuugagacagggcccauugccaugcugcuuccgggaguugaaucaacugguaagucugacacugaauuauuaugcuacgugccuaccaaaagaauagaauuuuaggaacagaaauaggaacuaggaaucaggggcccugacuuagggacacugcugaugucacguaaacuuuguuaacagcccgaaaccaggaaguaauugugaugguugaccucucuaugggaacaaacaauagaccuaucuacagaauucuuuuaaaggcagucaagcugagcuggcuagaacaugucuagagacagauuuuugggacauuguuccauuguugguaacuucaguuuacuuaucuguauauuuggcaacucuugauuuguagggccuugauuuguagaguucuugaggcaggcagccauaccuuuucuuauagaaagaauaauucaaguuuuuuuuuuuucccaaaaggaagccuugcuuuccuaagcauuuguaagacauaaauauaauuaucuauuuauuacuaacaccuuuaugacucugaccuuuccccuuucucuagagaccaccccacuguggaagguacagacccagagcucagucaaaguaugaggcugaucuugacccacaaguggcuacuucacguuaugccacucugaucauucagaacucucauugauuauucacugaaaauuugacaguacuggaagagguugagauagauuuuuaaaaaggucucuuugccugagcaucccagauugcuuuccugauugagaauacuagaaagaauggugcugguagacaagaacacaucaaacuaguacagauaacuaaguauagugccuauuagcauaccaaggagcaugcuuagccucuaagcucacucaguacauugucuucuccuagcuugucucaccuucccccuaauauaagccacuguauccuaggggcuuuacuccccuucccccagcuuugcauuccuauauaaaccuaacacuuuggcuccacucuuggcccacuccugaccuuuuugcccucuugggacucuucucuuucuuguucuccgccaucucuccccucucauggcccucuucaaucuggacuccuccagcugcuucuggcuauucucuccuucauaucuacaauaaaaucagucuccuugucugagccuucgagcuaucauguccucguuuucauucauccaccuuaguuuguuaaagcuuccaagagacacacacaugcgugagcuucuauuuccuuccuuagaauggcucgugggggaagacuuggucuaaauuucagcaggagaaucauggcaugcaauagcaucacggaauacucgaaugugucuccuuaaguaacuaguacaaggccggagcacuccccaaggcccccaaagauaucuccccucaagaaugaugauguggggaaagggguacuauucuuuccuuugaguuuaucucuauuacaaucaucagugaauaucagagaugcuccaauaacuuccaaaagauacuaugaagcauuagguucccuguaagaggugcuccaaacuuauaugaauuuauagucuugucuuucuuuacccguuuacccagauucaccuucccaguggcuuguggcaaucaguugucuccauuaagcagauaauguuccaguuuuguuuucacagugaagcaguaagucggccuuaucuuacuucccucuacugaaccauugacauggucaccaugcgcaugaggaugucuuuguugccagaaggggaagccacuauaaguuacuaagauugguucuucccuaaaauuuguauugcccuacauuuucauaguuugccuuucuucucagaaggaauggagaaccaaguccaagcugccacucaucuagauuuccuuguaguuuugcaaagaaaguccaacagucucagcauuugucacaauggauguuuucuccaauaggugucauccugcacauugacuuuccuaugaaaguuaagugcuuugugguuccaauaguaauaauaauaaugaugaugaugaaaaugucuacaucauuaccuagaaaagggacgggaauagcucagaaaugauguggaauaggcagagaauuugaaaugugcuagaaagaacccugguggcugccuuaggaagcauaguccugguuaugauacagauagcugccuucagaguccacaucccuuacguguaaggauaauagcuugaauucaaaacccagucccagccauaauggauauugccgaaaaucagggucaguaauacagccuauagaugcucaggaagcucugucucaggugcagugcccugugaugcugugagccacuaaagcacacuaaagcuuaauuuuuaauggacucuaauagaagaguagacacuggggguucuagcaacucagugagagaguguucaggucugugcauguggcucaguggcagagcucuugcugaaagaccauugguauucacacuuacuuauaaaauaccaaaaacacacaaaugaauaaagccaucaucuuuacuugagggacauggggagaugucucaugauuugcccucuuguauguacuuuuauccugaauuucugcaccugugucaccuauggcuguguuugacacauuaggauggaguuacuggacuggguuuacuugagguaacuagugauggcuuaaaggaaacaguguuuugcucuagauuagauaaccucaggaaacaaucacuucugugauuugucaucugaggaaaucucaccagaagcaaggaaaaaguggacacaagggauguuucugauagcagcacuuacagcuauggcaacuuuguggcuagacaguuccguguuuuucaucugaguucacacugcacuagaauguucuuguuuuugucuagagugucuucaucucauugauguucucuguaauuuuuuauggccaauaggaaaacaucagggucuagcugugagugacaggccagcugugaaugauaggacaacugugagugacagaauaccugugacugauuguccuagcuaugcgugagggacaggccaccugccagcaacacugaggucuggcagacuacaucccauguguugaagccucuuuugucacuccacagagaaaccagccauaagcaaucaggaagccauuuguacuaccauauuuuguuuucuuguuccuaauaugaacaggcauuguuuaacaaauaccucuucugcagaaguuagagugaaguauauuugguucucuucuguagcucugcuccuccccaaauuuacaauuaacuucauuauuaaagaaaaccuagagaauuuuguauauucagcaaaccuuucuggaauaguuaauuucauguuuucucaaugaacagcuaguaaggagacaaaggggggaaaaaguaauauaauuccuacauagggcaauggaauuuccuaaaauuaauuuuuauauaauuauaacuguaucagauuguuucuuugauugugagacccuagucuacaaccauacacuacccugaacacauccaagcuugucuguuccuggaggccaagcaggguuggacccacuuagugcuugcaugguagucaguccacccucaguucugggaauagaaacagcagcuugacuuguaccugagggaaaugacacucauacaaagugcauugcucauagcuauauuugugacacuguaucugggaaccagcucacauggcuaacuauauagaauggcuguauaaacuauggagguacaccugguaaagaacuggguagccauacaaggaagaaugaggaaacugucaacauacugagauuggaagauaaaauauagaauaauaaaaagaaaggaaaaaucuaacuauacauucaucacaaucaccuuuauuugugagauugauucagaauuuuuuuuuauugaaauuggcuuuuuuucccucaccuacuauauucugauuauauuuuccccuuccucugcucuucuaguuccucccaaucuccuuccauuuagauuuaccuccuuuucugucucucauuaaaaaauaaagaggcuucugacagauaauaacauaacauggcaugacaugacauaacuguaaugucuauucccaguuaucaacuugacucuaucuggaaugaacgacaauccagaaaugaaaggcauacccgugauccagaucuugaggccaaaagacaugggcuuuuguucuggaccuugaugugggaugacacagauuuuugaugaagaucuggaggcagaguggccgugaaaagcuuaggccuaggcaaaguuguacaugcucuaauuccaggagacagaggaaagcagaucucugaguuccaggccagccugggacagagcaaauguaguaaagaacagcuuagguccagacauggcgauacacaccuuuaaucugggccauaccuccugcuggaggccuacauaaggacaaugaagaaagaagucuucuuuuccuacuugcacuucuugguaacacaucuguuggaauccacuccuucaggauucuagcuuauacaaaggaccagcugaaacaucuaccuucauaggacugaggaguuacuagacucuuagacuucgcacucacagcugcccguuguugaauuaguuagacugaaaaucauuccaauaaaugcauuuaauauauagagacauccaacgaguucugugauucuagaggacccugacuaauauaauaacauaguauauaaaauaaaaaccaauauauuagaauaagaaaaaagcaaacagaaggaaaggagaacaagaaauauguacugacucaagagacccauccacacagucaaggaucuuauauauuauggaagcuauaauauaaaggugaagaacauguagguaaaaagagagaauauauauacuuggguguuguauauauggacauacaugcguaucuauguaucguucugccuccacuucugcaggauucccugaggggaaggaauugauggagauacccuguuucagauuuaauguuccaaggucucucauucucuggauaauguuuagcugugagucucuguauuuguguccaucugcuacaggaggaaacuucugugaugauggcugagcaagucacuaaucuaugaguauaacagaaugucauuaggaguaauuuuauugcuguguuuuucuuuauuauuuuauauagaacagugguauuucauuuuucucuaggucccugggcuguuuauucucacguuuuuggucacccaggcauugucagguauggcuccaucuuguggagugggguuugaggcaaaucagauauugguugguuacucccauaagcuuugugccacuguugcacuaucauauuugcaggcaggacaccauuguagauagacgaguuuguggcuguuugguguuuuaccuugcuccuuugguagcuuacagaguaccuuccuguaccaaagauacuaacauauaggaguaaaggcucuauguaugaacuagcucaacuucuccauguucugugcauugcauagguguuaucuucagcaaugggacuuugcugucaguuuguggaaaacaaccuauaaucuuggcaacagcauagguuguuuggggguucccaugagaccccuuuggccaauaacucaauuaaauguaaccaaauccuaguacugaaagcuucauuuggugacaagagaugucucauuauuuggugauuuuauuuauaucccuuuauauuuguauguauuuagugaagcuucuacuguauuggguuuccauacccuuaguuuuagcugacucucccuguauuuccuccucauccuccucuucccucccuauuugaucucccacaauccaucuguagcuguuuccaugggaauucuauuuguccucuucuucccagugccuuauucuauaaccuaaccucugucuuucuacagaugcaaaacuugguuauuguuuaacucacagcaaauauccacaugcaagcaaauguguacuguauuucucuuucugggucuguauuauuucucccaggaugauuuuuuuuucuauccacuuaucuucagauuucaugaugucauuuuuuuaaaugccugaguaauacuccauuguauauacauagcacuuuggucuuuuugguuuguuugguuuuguuugguuuugguuuugguuuuucaagcugggaguuucucuguauagcucuggcugucuugaagcuuacuccacaaaccacacuauccucaaacucagagauccaccugccuuugccucccaagugcugagauaaaaggugugcaccaccauacccagcauaucacuuuuucuuuuccuuuuuaauccauucaucuguugagggaaauccagguuguuuccaguuucugguaauuaugauuaaaacagcauaguacaugguugagcaagugucucuggucaaaugaagcauccuuuggauauaggcugaagauugauauagcuacauauugagauagaucaauucccaucuuuuuuaugaacugcuacacuauaguagccauaaaagguccuagcccugucagcaauagauaagugucccccuuauuccacauccuugccagaucaccugcugccaccuccccauccucuccucccccuucuccauuggaucacacagaucauucccuccaaucuuucucacccccagccauccccagugccaacucuagcacacauucccuaacaaccagcugaucacuccagccagggaagugcuaggcuaacuguaaaucuucaccccuuucuccuuuccuccaaaggcaacacacagcuaccacacucuccuaaggaccagacagggcaacagaaaugaaggaauggacauccaccuaaccaagacaaaacuggucaucaguaucuagaauuauaaucuucccagucccagaugccuagacacuagcauaaaaaacacaaccaauagcagccaugacaguauagcucuacuagagcaugauaaacuacugucacagcagacccugaaaguuaccacauagcugaagcacaugacaaaaacuuuaaauugucuuuauauguuggagguccucaaagaggaaaugaaugaauuccuuaaaggaguguaugagaacaaaauacaaacaguggaaggaaaugaaaacaacaguccaaggaguuaagcuggaaauagaaucagaaaagaaaaccaaaauugcaaaaggauaaaaauuuaggaacuugagcaggaaccucaccaacaaaucucaccaacagaacaagugaugggagagagaaaugcaggcauugaagacaggaaagauggacaccucagacaaagauguuaaagcccccaaggaagucugggacacuacaauguuauuuuuacaaguuauuuaauaaccauuauuuauuuauaucaccuggccaguccccuaauaauagaagcagaauccuauagguuuuuaaaucagcucuaagaauauuaaugagggauuacccuaauauauuuuucuguaagcuagaaugcuaauuccccugcugugcuccccacauauuugcuguuugagucucgcccugguuauuucugcuccaucagccuguccucaggguccauguuuccuggacacaugcucaugauccauccagccucauggcagccuucuccucucuccaucaucuuucuccuucucuugucuccuuauuucuccuauuuucucuuucacggucccuaccugugaacccuagcccagaaccugaaaccccacuuaccucuauucuucccaguaauuggcuauaguugcuuuuauuuaaccaauagauuuaaauuagacagcaaaguuugggucacaucauuugauguaucugaggaucugcuagggggugggaaaccagaucuugugggccaguauuuaccacuuuaauacauagcagcagcagaucaaucuccaacuauuaaaagaccaaaucuaagaaugcuaggaauagaagaaagaaaaaaacaaaaaacagauuugaggcacaaaaauguuuucaauaaaaucauagaaaaaaauuucccuaaucuaaauaaugagauaccuuucaagcuacaagaaacauaaagaaugcuaaauagacuagaccagaaaugaauuuccccuugguacauaauaaugaaaauauuaucuguacagaauaaaggaauaguauuaaaaucuacucagagcaaaggccaaauaacauagaaaggcagacuuugaauaacagcugaccucuugguggagacucaaggagaaagaagggccuagacagauguucuacagacucuaagauaccaaacgugccagcuuggaccacuauacucaacaaaacuuuuaaucgcaguagauggagaaauuaaaagaguccauaauaaaaucaaauuuaagcaguaacugucuacaauucuaguucaacacaaggcacuaggaagaaaauugcaaccuaaaaauguuaaccacucccccaaaacaacaggaauauauaauauaaucccagaccagcaggucaaagaagcaaaagaaagacacaugcacacacacacacacacacacacacacacacacacacacaccccacaacagcaaaauaacaggaaucaaacaaagaaaaauccauaaucuaauggaauugaugugaaaauagacucugaccuuuugcagaauccaagaaauacauuuuaauaucaaggauagauauuccaagcaaauggaccuaacaugaaaacugcuguagucauuuuaauaucugacaaaauagaguuuaaauuaaaacuaaccagaagagauaaggaaggauguauucaugaaaaauccaccaagaaggcuuugcaguuccuaaccauguagcaagcacaggggcacccaaguucauaaaagaaacauuacuacaguuuaaaucucauagauauuucacacuaacagugugagacuucaagaaaagccauccaaacaaaaacuaaacagggaaguguuggaacugauauuauaaacuaaauggacauaagugacauuuacaaaacauuucacccaaacacaaaagaauauaucaguaccucacggaauuaacuccaaaacugaccauauauucagacaaagagccagucucaaaagauauaagaaaauugacuuaacacacuacaucuuaugugaccaccauggauuaauguuggauaucaauaacagaaacaauaaaguuuuuaaaccuguggaaccugaacaacucauuacugaacaaaaaaguggguuaagguggaaauuaggaaagaagcucaacacuuucuagaguugaaugaaaauaaaaacacaacauagcauaugagauacaaugagggugaggauaauucuaaaagacagcuuaguggcacugcaugccuacauuuaaaaaauggagagaucaaauauuaguagcuuaacaacauaccugaaagaucuggaaaggagaaauuagaaaagaagaaauagcacccaaaaggaggagauugcaaggaaugaccaaucacugggcuaaaaaucaaccaaaacaaaagaaaccaaggaaugaaauaguugguuuuuugagaaaauauugacaaacuuguagcuaacuuaacuaaaaaaguuaaagggagauuauaaaaagcaaagugaagccauagcaacagacacugaggaaauccagagaaucauaaagacaugcuuuaaaagucuguauuccaccaaauuggaaaaucuaaaaaaaauggauaauuuucucaauacaugccaccuaccaaaucaaagucaaaucaagaucaaauacgcaauuuaaacaaaccccuagugacauagaagcaguaguuagaagucuacagucaaaaaggcucacggccagaugguuucagugcagaagcccaguaauccucagguucucacacagcagaaacagaauguuaaccaauucuuuuuaugaggccacaguuacccugauaacacaaaccacauaaagauacaacaaagaauuacagacuaaucuuuguuaugaacauaagcacaagaauucucaauaaaauacuaucuaaccuaauccaugaacacuucaaaaagaucauccaccaugaucuuccagacauggaagaugcuucaaaauacauaaauggauaaauguaguccacuauauaaacaaacugaaagacgaauacaccaccuaauuagaugcagaaaaggucuuugacaaaaucuuaacagcuuuuuaugaaaaaaaaaauucugaaagaauuagggauauaggaauauaccaaaacacaguaaaugcaguuuacagcaagcccauagccaacaucaacuuagauacagaaaaaccuaaagccuuuccacuaaagucaggaacaaaacaagauuuuccacucuuuccuuaucuauucaacauggaacuuguagucuuggcuggagcaguaaaacaacugaaguggaggaauucaaacaggagggagagaagugaaaguaucuuuuucuggagaugauaugauaauagauauaaauggcccuaagaauuuuacuaggaaacuccuagagcuggcaaacacuuucacagaauuagcugguuacaaaauuaauucacaaagaucaguagccuuccuauauacagaugacaaagggacugagaaagaaaucacgaaaacaacaccuaucacaauagccaugaaaaaaguaaaauauccuggaguaauuccaaccaaacaagugaaagacuuguauuauacaaaacguugcagcacugaagaaagaaauugaagaagauaucaaaugaugaaaauaucucccacaaucauugauugguagaauugauauaguaaaaaugguaacuaccaaaaggaaucuacagauucaaugaaaucccaucaaaauuccaacacaauuugucauagaauuuaaaggaacaaacacuucaguuucuaauagaagcgcucgcgugcacacacagacaccagaauaacuaaaaacugaaugaguaaagaacuucuagaggcaucaccauuccugaucucauuuugaacuacagagcuaugguaauaaaacagcgugguauugacagaaaaacagagagauggaaucaaauugaaaauccacacauaaaucaacauauauauggacaucugacuccugacaaagaagcagaaaugcuuacuggaaaaaacacagcaucuucaacaaauggugcugguuaaauuguaugguugcauguagaagaaugcuaaaugaaccauauuucuaguccuacacaaaacucaacucugaauggaucaaagaccucaccauaaagccagauaugcugaaccugauaaaagagaaagugugaaacagccuugaauuuguuggcauaggaaaagacuuucuaaacacagacauuaagauugacaauaaguaugaccucgugaaacuauaaagcuuauauagagcaagugacacugucauucagacaaugugacagccuacaguaagggaaaagauuguuuuguuuguuuuuguuuuguuuuguuuuguuuagucuuuuaccaacgacacauccaauagaaggcuaauauccaaaauauauaaagaacucaaaacaccagguaucacaaaagcaacccaauuuaaagugggauacagaucaaaacaauauuauaaagaugaaacucaaauggcugagaaaaaauuuuaacaucuuuaaucaucagggaaauaaaaagauauacgauagucaguaccuuugucacacccacuguauuucucagugguaagcauucaaagcaauguuguuuuguagcuuuucaaaguagucuuuuguauuucucuaaaagaaaauaaauguuauguauaucauguaugccuggauuuuuuuuuuaagagauuggcuuagguuuaacugggacugacaaaacuaaaccuuucagaguagaccaggaggcuggagacccucaaucuugcucucuuuaagaaccucaacugauugggagaguccauucauauucuaaagaguaaucaucuuuacuaaaguguagugauuuaaacacuaacaaugucuuuuuaagaaauuaucuucauagcaaauguagguguuugacucaaaccuggauauuauaaacaagccaaacaauagcauaaccauugcacucuugaacaauagcuuguaucaauauccacauuuauuuuuaauggaaauauuaacauuucauaauacucacacacacauacuucauaacuuggucuugugacaaauuucugugguuugaaggaauggauuuugaaaagacauaaaaacuggggcuagagagaugccucaccaguuaagaguguuugaagaggaccuaggcuuaguccugagcaccuacgugaccacuaacaacugucuguagcaacaguaucagaauaucugacacucuuuucuggcuucuauggauacacacacacacacacacacacacacacacucccccuccccuuucucaauuaguucccuccuaguucugccuccugugacuauuuuguuucccuuucuacaugugauucaagcaucuuuacuugagaaaauaauugaaaauauggcacaaaauguacacuaugcaguuuguauaaugaaagacaucuacaagcgaacaugcugacaauguagaaauguaggcugggcauggcucauuaauuuuuaagacacaguauaguaauuuaauuucaguguaguuauuaaagaguaguaaugcaguaaaaguguuauuauguaauguuacauauaauacuguuauuuucauaccugaguaaacauggacaagagcagguggaagucuaaagcagucugguuagagcugcgauggggauugcauuuguuuuacuucuaucaguuuugugaaaguauuuugauacagccgaaguuucuuuaaaaauuaacuguccauaaacugacuuucuugcaguuuguuucugguaauacuaacgaauugcaccaucccucgcuauugcuggcuccucucagccccggcgacccugcuagccccaagcagagaccgcccaccucacuguucucuugcugcagauucugcucauguccccagccauccaaccccucuggucauuggucccauaucccaguaaccugcuaaaaucaaacucuagaggcuuguaauuuauaagucagacuuauaucaguaaauucucaccccaccaaacgcccacacaauaaacuuagagccaaaugauauugauauaaauugcccaccuagauaagauaaauuguccuguaauaaaacaucccuuguaagauauucuuagcuaccuguggcuauuuaaagccgcacagaaucuggaucaucuuuuucuucauccaucuuccuuccguccccucuguguucucucucccaucccuaaaaaccucugcccaccuuccuuuuccacuucccaaucacagguuucuuguugaauuaauauucaaguuaauugggggacaauucugcuacaccaguuucuucaaauuagauuguuuuguaauuacaagagcuuuuuaaaaccaugugguccucucuguuguuccaucccuuacuaucaugguuauaaaugaaacaaaccaauaaaccaaaaaaaaaaaaaaaaacaaacuaguauuugggacugguccauucaggguggauacugcaggcugugggaacuauagcucccaacuucagcugaacacugagcaauuuuuuucuugauuauaaccagagagaugcuucugaaauguguuuccuaauauaagaaaucagagaagccagaagccaaggacaugcccguaccacaagagauaggucuucccaaggauaaaacuguguuguuucuaguaacuucuuguugguuuagugguuggagggguuuuauuaaaacuguuauauaauguaucuuguacuuuagcaagagucuuugggcuuugcuuuuguucuuaaggaaagccucaagucaaccuuuuuccccugacaguauguauccaauaagugaaaguccccugaagaggaaacauuugguguacuauuucacuggggauuuuucauauucugcccuaucucuugaucuuucuuucagauugaggcaguuucaguagugauuguuccuugugggcuuuuguauuguuuuggggguuccuauuuucugaguuuggaagccacucacaaagguaaccuugacgguggggaauuuccuccucaguaaaacaguuugccaagcgggcaaaagguuguugcagguacuccaggcgcucuugcugccugccaggaaggaacaugggcucaauuguucacuugcaucacgaacuuguuuuccaggguggaucacuuguacaccuucuuuguucaguggucuccugaugucuaugggaaagaugccaaggagcaaggcuuuguggugguggagaaggaagagcugaacaugaucgacaauuucuucagugagccgaccaccaagagcugggagguaaacaccuagacuguuaaagagaagaggcuguccuggacccugaaaugccaaagcagcggaaacggccuuguguucacauuccaaaaauuauuaauagcugauacuauucuuuuauuuuucuaauguauuuaggauacauuuugaaucuuugucuccugugccauauaagagugacuagcuugauuugacuggcaguuacagcuugcugacccugaguucccuuucaaauuagaccaugauauaucaaguaucucuuugcuuggggacccuagugguauaaagauggauaagaaauaucucugugucuaauaagcuuauaggacugagacaggagaugaaucugucacaccuuccugccucuaagccuguucuauauuuucauggaugucucuggaaucuggucccuugacucugucuuacucuguuccuaucuugaaucccuugaagcaguuuuauucuccuagguagauggugaaugcauucaaagacaucccacuaccaguuaucaggguaaguugcuuagagcuucuuccauccuuuauacccaucuggaccauuguauuccugaagaguguauccucauauuagcucugauccuaggcagucaagcauugcuauaggaaaccuaacaacugaagccagucaugguggcacauaccuguucucuugcuauuccaugggcaaagacagaaggaucuuuugaauccaagaguuugagaucaaccuaagcaguauaggcuaggccucaucucaaaggacaaaacgaagcaaauaccacaaaacaagcagaacgguaccaagauaaagggguaguuuccgaauucauccggcuccucagucauaacuagaaaucuuuccuuguuggaaccucucacgggucacuuuaugcucccuagcccauuucagcauccaugcauccuagcauugggccucccuccaguuuaugacaaagacagaauuacacaaauuuauuuucugauccucccucuccugcauuuuuaaaugaucaauuauuacaaucuuaguuucugucucagagagaagagacucuuuucaucucucaggcugccuucuggcuuaucagccauggcuaucuuuuguguguuuaaaugcuuucuccuuccugugugguuccuuaucuuucacaagcauaugauauuuuguugccuuuuuaggagaaaaggggaagaaacaucucaucuccuuuauucguguguguguguguguguguguguguguguguguguguguguguguguauguacuuuauucuacaguuagcacgcaccuuccccucucccauuuaggggucuuuccuugguuugaaaguagccaaagaggcuaggguggcggucuaacucuccagguucuccuggcuccgacucuugugcaccaccauccauagcuuuuguacuccuauggcgucugggaauuugacucacucagauccucaugccuauaaggcaagcauuuuacacaaggcaagccauauacucacugagcuauccccagcuuccuucccuucgucuucacuuuuccugcugcucugcucucuguugccaccuaccuuuuggauaaaaacugcaucaugucauuauauucagcuucucaauugcccuauucccugcaguguacauugcaccaaagcccccauauaccccauacuuaccaccuauuuuuaguuaacuauucauguuccucuuuccuacaagaugcuaugauagagcucacagaugccucauaggcccagcagacucuaagaaacaugaggauaucccaucuugacuuuacuucugguaaauaauaucaaaggggaugcucuaucaggaaaacguaauuuucuuagugaggcuauagucuuucacccaauacagagcucuggaaagaaaauuuaggcccaugaugguuacuuaaccuuuuccugacuagaccugaauaucuugagccaaaggcaccauuuuguugaaaacauuuucuucccuuucuccauucauuugggauucagauuucaucuauugucagcuggagguggagaaggagccacacugcacacccaaagacaaggggugaaggaggugugaagaaugauauagguccccucaagggucuagcggcagaagaguuuggccaguuaaccccaaagccauugaggaaagugaaagagugaaaacucuuuggaagacuguaucuugaccuugguugaaggaggagaggagaggcuucuuugggacuucuuugccugacccauuucacgggucagugaacagggucugcaagagagagaguggggacugaugggcaagagacucgaagaauggagacaacacagccuaucagcuugagguuggaggcucguuuauugaaaaguaacuauagguauauaugcacucgcuggggagugcagcuggagacacuuaaccauagguccaggauguagaggagaaaaacaagauguuaucagaguguguucagcuguggugggcuucuugcaaaaacaucaugcuaggaaagcaagucucucgucaggguggaaaaguaccaccuguaaguaaauagcccgggauggcugcagagaugauagccacuuucugcuaagagccagcuuccaacauuugcccauaccaaagcuguugaucuggggaaagaaaggacagcuggcguaaguuaguggguagcuccuuuaugucugucuguccauaagggaaacagugcccagcugaggagaaggcuccauguucccucauucggaacaaguaaugcucagaagcguuaugauaggcaccccugugccucagcuucaugcugugaaggagaauugucaaccuccuuaggaguuaauggguuguaaucuucaggagacccagaauaacucauuaucuuucaacauuuuuguuucugcucauuuuuuuuuuuuauaucuuagugguaucuaagccacaaauccagguauaauaccagacccuucucuuucuuuaucucugaccagaaucccauugacuuaaauguugaagggccuugcaccccucucccgugccagaaccuccuuauuccaccaggauaucugcaccucacuuggacuccagucucaacccacuccaccuaucaacccacccucaccuguacucaaggccuucaaacacaacuaugucuccauuucauaagaaaaaugcaugucagaaaaaaacuuagcaaguagagugcagacauuaaaaaauaaauaucuaaccauacuugugccuuucauacaugucuuuggacuuuauuuucuauuuuguuugggcacauggggucccuuuuuuacucuacacaaagauucuguucuauguaguuggcauauggcuuuucccaccugacauaaucuuagaauuguuacaaguuuuugaaaccuuaguuuuuaguguuuucuuuuguuugucuguuugcuuguuugcuugcuuguuuuaauaggucuauacucagucuauaaguuaggcuagccucaaacuuccugcuacaggcucccaagugcuguaauuauagauauaaaccaucauccuccaacuaguugcuaguauuuuuauaccuguuaaaauuuauuuaacaguuucccacuugaguuauuauauugguuuaaugauuucucaaaaaugaggucuuccacuccaccuaucaaccuuaauuauuuagagaaguuccuggauguggaauuaugagggacaaggacaguagauuucugugauuccuaaguuuuaugucagcaacugaacuugccaugagugugagagauuucccacugggucuugccagcaaaaagaauuaucaguauuauacuuuuucuuucuccuaaaaaugcuugcuaauuagaaaaguagguaguguuauccuauaauuuaauuuucauuuacuugaauauugauuugccaaaaacauggucauacacaaguuagccaccugugaguuucuugcugcuucuguuuuucuauaguucauuuucuuagagcagugauucucaaccguccuagugcugcaacccuuuaguacaguuccuuauggugucacucccaaccauugcuaauucauaacucuaaucuuauauuguuaugaauggaaauguaaauaucugauaugugggguauuugauacuuagcccccaaaggauuugugacccacagguugacaaccacuguccuaaagggauauuagcaauucuccgcuccacugaguuuuugugaugaaagagacuuucuuuguguuuggcagauauuucuucauuuacaguuugucuuuugauguuguugguggcuuuuagguuugguuuuuugcuuuguuuuguuuuuaaaucuguaguuaguccuauaggcaauaguuaauuuuuuaaaaaaauauauaugauagguauuauuuuuaguaauauuuuucccaucacuauugagugauuuuugagauuuccuucaaucuuaaaaagucuuauauauguauuguguguguugucuauuuaacuuaucuuuuaaauacauaaguauauucauguacuccgaggcuuaaagcuaggaguaucauguuccuaccccccucccacauggccuauauuaaugguugaccaccuugcccaucacuggauuuagggcgagggaggguguugucucucuccauguauauguguauaaguaugugugugagggaugcuguaugauauaugcuaacaaacauguguuagugugaaugccccugugcaugcuugagaaggucagaagaggagguuugguguccuacuuuauuagucucuaccuuauuccuuugagacagcuucuuuuacugaacacugagcaaggauggcagcugggcaguccuagcaauucuucuguuuccauguucuacagugcugggauuacaagccugccaguggcugugccuagccuuuuacagauguuggcaucuacacucagcucuucauguuuucauggaaguacccuuuuacacugagccauagcuccagcccucuggauuucuaaaaaguagaauccuagacccuuaccucaggauacuuugguuuaguaagucuauaggaaggauguuagaauuuauauuuuucaaagcucuaagaugaaucugaaaaacagcuagguuuuaaaacuacucuccuauaagacaagauccauucaagcaagacacugaaguucuuuacucuuucagaucuuacccacgucucucaucucuucuucuagggcucuuuguucuucagccaucaggaaccuagagcauccaucucuguaccccuugcugcaacccuauaccuggcauaucuccccacccagcucacagauagauccacccacucccuugugaauaagccuucucugggcacaccagguguccaacccuucuuugagccuugaacacauucagcuccuuuauugcaugucauggcauuuguuuggcuauaauuucaucuucugucacucauccauagaaaacuaugggcugugucccuguuccuggcaacucaccuggcaugccccagaauacaggaagugcuuaauaaauguuggcacucuccaguauccaggaaacacuuaauuaauguguucuaucaugaaauaccaggcacugaaaauggugcuucucccaggaacagaauucaagugauuuagcccuggguuguuagguaugugcaugccuggcugguguguuguguccauucaucugccagaguauaacuuagaaccuaccccaggacccugaaccuucagcagccccugggacugagaguccccugcgguguggaagaguagcagaaaaacaggugaaaauugaucucuuguagaucuguauuucuuuccaagccugugucaccugaucugacgaucaaaaagaaccccguggaggacuuuaucagucacuaagaugcaucccauaaugugaaacgauaaacuguaccuugccacuuguuuugucaaacugcacauaagauggcauuguucacugccuccuauaaguuagaaaugcucccacucuuucaaguuacuuaugccaacaaauucuaaaagucacauagaaacugcuguugccggagugagccuggcuaccaccccugucaaaggcuccuuuucguaagauucaaacugaugcugggaaccaacccgcaccaguuuaaaauggaaguugaaccuuaaagaaguaggugaaagaaaaccuugaagagacaaggagaggacagcucaguuaccuacccugaaggcauauggaggaagaguucaggagaagagcgagaggggagaaaaaaaccucaacaccaggacaaugggguuuuauuguauggcuggguuucaaaggugaaagugucauuuuacagacucccgcucugccugacaggaagugugccugcucuaaauccuaauuuggguauguuccuguagaaacguugaccccccucccccccaacuccuugagggaaacagaaacucaaucuugcaggaagcuagaaaccgaagggagaaaaaaaaacacccaguguaggucagccugacagucaguggcuggugugcaggcaaccagagaaagaccgauucuucucuguggacagucuucugucccagcaccaugagaggcagaggacugccccuggacauucagauuuucuauugugccaggccugaccaagagccuuuugugaagguaggugggcaugcguccugugcuggggacccagggugccugcuggggagccggcuuuucugucacuggcgugcguuuggaauuccuucuaguuaaaaaguauugagcauguucuuuuauuugcuaugaaguuuuuugcucccucuuucugaaauccgaaaugcauacuugacuuguucuacuccucagccugaguuuggaccguuuauauuuuguagacuuugaaacuagaaacaaaucaaagugcuugguuuaguaugucuaaguguuagcuuugugguucuuugaaaguguuucuguaaauucuccaucagaagauaggaaaauccauaaguguauuucccuacccuaaauucagcucagaagaugaauaauuuguacaugucauuguauguuuuggaagucaaaccaugcacuaccugacaacuagaugugagauaccuuuucucuguaauagagcuguagcuacuacuauaccugggcauuuuagagagcuaauuaccccucauauguuucauguagugauuugcugagaaauuaagagagacaaaauguuuuuaagaugagaacauuaguaguucauaaacccaacuguauuuaaauaguagaugugcguuuuucuaucuagaugggaaauuuuugaucauuaugaauuguggagagggaauugaaucauagccuggcuguaauuuagaguaaagcucucugugauucccguuugcuucugguggcuguuaucauccaucauuucugcuagucuuaguugcuauguacacaaccaugaagcuuaauugaaaccuauccuuaucgccccaaacucucuguuuauagacuuucugaaggaucucugaugauuuccuuuacaauuuaaauuuggacucaaaggcuaaaggagccuagcuuaauuguuuuuaaggauauaaaccucguggagcuacugaguuccgagcaggaagaccaaaacuggaaagcuuaugauuuuacaucaugcauauuaaaugcucagcugucgugacuuaaauucugcauuuguucuggguuugaaaauuugucauuucccccaaaguccuuuucuguuuaucucuuauuucccaacacuacuccuuuuagucagcugcaugccccagguuauuugggggaaagugcaucucaucuggguucuuuccacauuggcucuuucuguccucacuucagaucaucacaguugaggaggcaaaacgcaggaagagcacuugcagcuacuacgaggaagaggaagaagaggaagagggacugccuauccuacagccccacagugcacuccuggaaaacaugcacaucgaacagguggguacuccacuccacggacugaacacuggacuucagggccuuguagaauauuccuugccccuggccugagugaaaccgcuaggugaggaagcagaggcacagaaccuaaccauagccagcacugccuuuccacuucugaaauguuucagcagccuucuucaucgccuuccugggagcugacaagaccuuaacaaagaggaggccauuucuuaacauaaaaaauuggaagugaucgcccauaguccugauguaccuaaaaaagauccaauaaauuaaauauauuuauuauuuaaaauauguauuauaaaaauauauaauuaaucugaaaaguuugcuacuugaauuuuaugaaauauuuguguuuagugagauuaauguggaauuuguuauacuuuuuucaccaguuagauuaggaacaugaauucccaaaaccuuaaagaauccaaccaggaaggcccagggacuuggccagacagcuauagagguggucuugacguugccccugacgcugacuuccagcacuugaauacauugcauuccauaacugccuugauaauauuuuuuggagagacucuuuacuaguauuuauggcaccuagcuuaagcuaaauauaguugauagacgugggaacaagguggacaaagucccuaugagcucacauggaaaacacagauguuuccuuggucuauaggacaccuuagucaguagcagcuuuaaaccuaugaaaaccuagaacaacuggaaaaauaugaaaugaccaaaagccacguugaauuauaaagaaaagaauauguguaguuaguaccccuuuggcuggcuugguuugucugagucuucagauacagucuuuucucugggaugcaccacaaguccucuagugacauuauagcugugcauguuuguauaacaaauuucugugacauucagauuagcacagauuuaccuaagaacacuuuuuuuuuuuuuuuuuuggugugaauauuuuaucagugacacuggaaaccaacaaucaggcucugagugagcaagguaucuccuggguggcauccuggccaaaggaaacacucucuagauuuccuuuuucuuucucagcuaggcaaaacagguccaaaugugaguguucaguccuuuaguuugaaccacaggcaguuaguuaacgcacuucuuagugacugauuagugguuaaaauggccuuuuguauuuucucuggauuggcagcuggcccgacgacuuccagccaggguacaaggcuauccauggagacuggccuacagcacauuagagcauggaacgagcuugaagacucucuacaggaaaucagcaucucuagauaguccuguucuuuuggucaucaaagacauggauaaccaggugaggccuguuccucucacagagaacauguaucuuguuuuuggagagauaugauuucaaucuaguucaggcuauauaaucuaagguauuuugaauuccugaucuuucuacauccacuuucugagugcuagaauuauuaguguguaucaucauaaaugguuauauagacgcuagggaugaaguccagggucacaugcaugcagacaaacucugccaacugaacuguaucuccaccugaaaagguguuuugguggcagauuuuuagaauacccacaguagagagacugcuauaucgacucccauucucagacuaaauggauuuggacauucuuguuuuaugucuuuuucuucuuguuuuuguuuguggguguauuuugaaauccuaauauaaagaaaauggaacaauuguaugcugagaaauuuucucccugugcugaccauaagauagaaaauaguaaccuaaagcaguuuaaaaguagaaguuagggacaaucauguguacaguugcaaagacaaucucagugacauaccagaguuuuauccuaagggucuuaaguaguagccauugaugaugccuacuggguaggggauagucaacuucuguuuauugggucugggguucaaugguucaguagccaugggaaauccuuuucucaugguacucuuaccuguguggugacugcccuuucuaugagcuguuugaguuauuacguaguaccccaucuauucuacacuguuaucaccuccuucaaaucaacuuacauugugcauggauuaugugcaaaccacuuucauuuccuguuuaaucaagccguuacauaccaaagucauuaauaaaucaguuaguuuagucauguuaugucuaaucaacacccauuauguacaggacaucucagcuuggauaauucucauccaagcuucuugggauaaaaguguuuugaaauauggauuugggggagucauggaagauuuguauauguauaaggguauaucuuggagaucgcucucuccccccaccucucauacacacacacacacacacacacacacacacacacacagagggaguuuucauaauuuuacucaugaaacagguuuucggugcagauuuuucuacuucuggcauuguguuggcauucagaaaguuugggacuuggagggguuuucugauugggguugcucaaccugugaugcucaagugaggagcuugcugugaaguacaacucucuauccugccaauuuaccucccugagugaggcacaucuaaucccuguacuuggaaggcagaagagcugaaucucugugggcucaacauuagccuggucuaaaaagugaguuccaagacugccaggacaacacagugagacucuuguccccaaaaagauuauggcccuggugaaguuauggaaggcacagucuuuaugacuuuauugccauaagaauuacugaaaguagaauaacuguuacuauuuuuauuauuauuacaucaggauugauaagaucuuauuuaauaaugauccaagaugaguagugugaacaauuaagaugaaaaucaaaauaauaccacaaaguguuuaaagucacauagaaaguuaugaaauguuagaaucauuggugcuaugucuugaauacaauugugacuagauaacacuucaguuacaaaaauauauauaguuucugucuguuuagcagucguauccaacuuguccacacugagaagguaccaaugaggcacaguuuugcuaaacuuccugucaacagugauguaacagaggucugaggcuaacacaugucgucaggcaguagagcaaagguucucaacuuuccuggugcuguaacucuuuaauacaguuccucauguuguggugacgcccaaccauaaaaugauuuugcugcuacuucauaacuguaauuuaacuacucuuucgaaucauaauauaaauaucugauaugcaaccccaugggggucauugacccacaaguugagaacuacuggaguagaguuuuaacauaucaugcacccugcagaugcuauugugaauauuuggacauuagcuuggcacauuccagccucuccauccugaggaaauaaggugucuuuucuguuuaugggaauaugacagacauuaauauaauaauauaauauaaaauaauagaaauuaauauuacacaugcagaaggaaaaugaggaguuguagagaguugugggaaucauaaaagcaacaauccuuuacagucucuggaaauuguccugaaggcaugcagcaaaugaagaaauauuuauucaagaaaaucuaauaagucucaguaauaacaaugaaauucuuugcacuugagacacaacccuauucccaccacuccaacaaucccaguucaaacccauaguuuuacucuggacuugugugguccaggagauggggguccccucuucucacagcugcuaguuuccugucccuucuaacaggcccagcacuucuuauacgccucccaaguucauuguuucagagaugaaaauucagacaaguauggcuagaggcagaugucuuuccucuacccagcccacauacucgcaucucagacaugaugguugugaaugccagauaccucauuguucuccuucuagcacuagauaaauacaugcacauuguuugagacaagcuagggccagaccagcacucugcuacuuaaagcaaaguuguuuuuucugagaaaagcaggcagauguauagcucagaguccaggucauugucuuagggacuuguuccagaggaagagauuggccauaggacaugaagugcugacccccuucccacagagcugggggugucuuucagugaguucagaaguagaaagccaacgauaucccugaagcgauuacauuuggcuguagacaguugagaagaguuaaguucaccgugagaacaugcuucccuagcugaggaauauuauuuagaacccuguagagggcuagagacggcauuuccuaucgguuuaucugaaaggaacucauuucccaccuguuaaaggauucuguuauucucaugucauauuguaaaaucaugcuuuaaaaaaccuaggugccacccuauuguauuccagcuccauuauuaauagaagagaauguaauugcuuauauuuuauuauaagauauguucuuuacuucauuuuuagcaaauguagagaaaauuuugggguaggaaguaugaaaaucuuuagaauuagaaaucuguaauguuuaguauuagauagaaguaguagugaaaaagacagcacacagugauuuugaaccaguuaaagugucagacauuuucaaauacacucuaguaaagcaauguuuuucaaguagccuuugcaguggaaggcacaugaggcaccgagugagauugucaagauauauauggcuucaucuccgauaugcacucucaccaguaugcgcagauaggaugggaacugaaggacaguaagcugaggcauuacaugacuagacucuguaacgugacucgccuaccucccggaagagucguggauguaguaauauaucacaguuggcuaggugauggucaccccagcacguaggaggcaaaggcagguggauaucugugaauuugaagccagucuggucugcagagugaauucuaggacagccagggcuuuguagagaaacccugucucaaagcuuaccucccgacccccacaaaaaucacauuuaaaggaaagaguuaccuuuuaauucaaaguugcuucaaacuaaguaccuugaccagucauauuuaaguauuuucaucucucauuauuaaaaauugaaagggaggaaaguuuaucuuugaggggauggaauguccagccuugaucucacuuaugaaauacaugagaaaacuugacaugaugguuccaccaagacaacuuuguggaugcuaguggccaaccuaggcuacauagugaguuccaaucuagccuacccuguaauagaagacucugucccaagaaacaaaauauaaaacuaaaucauucuagagaugugaugguguccugucaagcacucauuucuguguguaacacacauuuuuuaaaaaugccauucuccauauucuacuucagcagccuuuuaaccacugaauuguuggccacuuuaacaaauaaugccuccaagcuucucugauggauuuuccauguaccaggaagccuggccacauggguuccaguuagagcuggggguauuguaguaauugcuuuguuugauggguuuuuuuuccacuuaaagaguucuaauuuaauaauaaacuuugcugaaagaguuauaagauccaagaacaauagugugucaaaaauguuuuagaaggucucuaugggaguuuaauuuugaaaguaacuaugucuucuguuuucuuuuaauagauauuuggggcauaugcaacucaucccuucaaguucagugaccacuauuauggcacaggcgaaacguuucucuacaccuuuaguccgaauuucaagguaccuggaaggguggaauacuugaauggcuaggguuguguugucagcagucaggagguuccgggguguucagacacugagauaguggguguccugcaauccugccugcauccuuugcacgcagucucggucuccaugacugaagcauacagacagcuuagaaacccagcacaaggaguuucucagucugcgaugcagggagagauugaaggucagagccagcacauuaucgaauggucuuuacuauuucauaacgauuggugaucauguuguagccauucugucaaaugcuuuguuacucaaagguguguuuccuuuauacacaacaugacuauucaagguaucuucucugcuaauucuccgaauugaaauguuggugcucucuuuugugguuuugcccuuaggucuuuaaguggaguggagaaaacucauauuuuaucaauggagacauaaguucuuuagaacuuggugguggaggguaaggcucuuguaauuuuauuacuuggggaucacuuaggcccagcuauucaauuugcuuagauuaauuagggcaguguacuaacacaugccacugagaaccaaagauaaaugauguauuaaugugccugagagacugcaaccauuuguccuuuaagagagaccuguuuacacagcuugcucuuaguuuguaaggaguuuagaguucugucuauuuugucccaaaugaaaggaagccucucggaaaaaggcagaaagcaugucauuuuguaagccuugaccguguagugaccuuucuccuuuaaccuuguuacaggggacgauuuggucuguggcuagaugcugauuuauaucauggacgcagcaacucuugcaguacuuuuaauaaugauauccuuucaaaaaaagaagacuucauaguucaggaccuagagguauggacauuugagugaaacucaggcugccuuaaaauaaaacauggaaaagacuggguuagauuagccgucuuacuggaagacgagccccagcccuggcugccucauccuacagcaaugcuuucuuccugcgguugucucagagcaucauagcaaugcagacagauucuggaagguacuguggagggcagacacugaagacagaaaucucaaguccagguuguuuuaaaaaaacaaaacaaaaagacuuuguaccuccacugcuuucaaauucacaccaugagaaaucagaguguuuuuugauguaugaguugaaugcaauuuuuauuuuugguaacugugaaaaaauaugauacuguggaaauacauaccuuccuuguguauuuaucagcauaauuuuaccaaauauauacuuuuuguuugccauagaaagcuaaaucugauuuagagaaauugaaaggauauagcacuuaaagggaauaucugauuuuuuaaaaacuuuuauuuauuauuuuuaguauauugucugaaauauauugauuuuuuucuuuuaaugugucaaauccugaaauaaagaaauguauauguuuugugcuauugggaaacaaggcucuuuugauuuguauaguuuuuuauucauuuuuugcccugauuauuuaggguaauauaaucuuuauuuauuaagagagugagagagagggagagagagagagagagagagucaaaaagacagagacagaguuuucaaaagcucauuaccaauguuuuuugaucuauuauagaccaacuuuuuauuuaguuuuuaagguaaucuuugaaaacccuaagcauuugugugaagcagaauauagcuucucucacaguuguaagaugguguuuauugaaauacagaucuuuaugaacaugaauguacaaguccuacuucuacagaguguuuguuucuuaugaaauugugugaauuguauauuaauaacaguaacuaaguuucuuaguuuuuuuucuuuuuuucauuccuuuucuuuuuuuucuuuuacguuguuucuuuccagguguuuacauuaaugguagccaucuguuuuaaaagagaguauauaauuugugcauuuuuaauguuggauaaaagaugccaaguuggaccaacuuucuugguuucuugaaucuuacuggagaaaaaacaauucaaagaauuacauucauaucacaauugaaagaaaaaagaaaaucuauauuuuuuuaaauauaaacucauuuucacaucaguagacaucuuuuauuuuaaauaguaggauauaaaaucauuaauguuaaugauugccucccucuuaugaaagccaaagacuacuaauggaaaaaauuuaaauaauagccaaagcugaaaaguagucuaucgcgaauuauuuccccagagauuuuugaacagaaaaugagcaaaccguguuuacaugucuguuuauguuugucauauuuucaagucuuucuuccauuuuagccuccuuguaagaaaacacuguccaguggucuccaucaggccgaucacuauauucacugccaucccaugcuaguuuaaaggaaugcuaugaaaauuuaaaucuguagaccauauauacuuuucacccaaguucucccauugaggacucuugcuuaaaaauauacaauuugacuuuggucugcucacacacaugaguuggcgagaucccaggaaugucguguggugaugauguucacuguuuguaaccaugcuguuaaugaacaagauggucauuuugccucuagauuacucuugccuaguuuaguccaugaugcuauacucgugagagcauauccagaugcuguguucucuauuuaaaacaguauugucugaacaggaauguguggcccuuuauuauggauuucaacuacauguaaugauauuccaauauuuucaauaaaggaauuuaugcauucagugugaauuucuuuccuaaagacucauucauuggccauuuauauaguacagccugacuucagagacaugacaugauccauuccagggcagaacaacagaacaaucauacgguuuuccccaguucuguaagaauuaugauuagacuauagugcucauaguuuauugagcaugcacuggcauuaugauuaaaacaguguacuacuuuaauuaaaaauacuucauuuugcagcuguagagaugacucucuggcuaccagagcuacugugcuugcugacaaugugcaccauuucuuagcaggcauguugggcaguucauaacugccuguaacuccaguuccagagaaauugucuuccugcacaggcagcuguacauaugcacauacacuuacagccucagccucacacacaugcacuuaaaaaauaauaaaaauaauuuucaaaauacacuccauuguuaggauucucaaugauuaucugaacuauuugaaaguggugccuauagaccuguuuggcacagguuugccaugaaucuucuauugguaaagauuuacagugucuccaagguacaaugcauugaaguaugacaaggcauucgugucuggggguuuguagugagaagagguggaggaaauaaccaauaauaaacuggauuugguaagauacuuaacagaaaacuaccacuucauuuccuguagcuuucccccaguucucucaacaguucaugaaaacuacuacuuuuauauaguuacuggagacuacccuuggcuuuauaauaauaaauuuaguaauauuaauaaucuaaugucucauauguagacagcccucauuuuuauaccuguucuacccuacauacauuuccaucaaggauauuuugcacacuaauaaccuucugccauguaguccccacugaagaaaguccagggagucuuuauuuucucaaaauuucuccuuucauagguauagaugcaaaaucuuaggugagggcuggguaugguggcacacauuuuaagucccagaguacaggaggcagaagugggccuguacucacuauguagacuagaauagucuacauugaaaguuucacacuagcaaaagcuauauagugagacccucucuuaagcugucuuaggguuuuauugcuaugaagaaacccuugaccaugacaacuuuuugaaaaacauuuaauuggggcuggcuuacaauucaggguucaugcauggugggaagcaugguggaguacaggcagauaugguguuggagaguagcugagaguucuacaucuucucaacuaguaggaaggaagagugagccacuucugaaaccuuaaagucaaccuaugacacacuucuuccaacaagaccacuccaauaaggccacaccuccaaauagugccacuccauauggguccaugagggccauuuuauucaaaccauuacauacacaagcaaacaauagcaacaauaacaaaauugguuggaagaaagccaaggguacuuagagaaaauuuaaaauaagguaagcacacacaccuuuugugugacucaaaagugccuaugaccaucuccugccaaucagaucucuuuuucucauuggggagcucuuacccucaggguaacucaucaucuugcccccuuguuuguguccuugagacaugauuaucucccaauagauaguuucuuuaccaagaaaauuaaccuucacaauccauaccguacucuaaggucauauucucuuaccuuucauucuaagcugucuagugacagagaauaaagcagaugguccucccugcuuucgccaauggagacaucaaaguagugcuuguugaugggcucuuccaugcuuuuuaucagcaguguccaauggagcauccuacaaugcuggacuuguaccacaauuuucacuacuauauuuauuuacucauuuguuuauauucguacauaaugauggguucccuuaugacguuuuacaaauacaagucagauacuuugcucacaugcaccuuccacuggauggaaagaacucuuucuccccaugguuuccuuccacuuccuaaauaccucuccuccuaacuucaugucauguagugugugugugucuagauuacacauaugacaaaaaaaacaaaacaaaaaaaacauggcaguauuuuucuugcuuauuuugcuacacaccacaauuuuaucuuuuccugaaagaggaauaguucaucuuuaugacugaauagagugguacguucaucagaguagaaaagaugaugaacagagaauguaagagcaguaugaagagugcucacaaaauggcaucuaucaugacugcccacccaaagacccaacaagcugcugaaaaagucagaugcagauauuugcacccaaccaacggacagaagcagcugaccccuguuguugaauuagggaaggcugaaagaaacugagaaggaugauccuauagaaggaccagcagucuuaauuaaucuggaccccgagaucuuucaaacacuggaccaccaaacagacaguauacaccagcuguuaugagucccccagcacacauacaguagaggacucccaggucuauguucauucagagaugauucaccuaacucucaagagacuggagaccccagggaguuuagaggucagaugggguggagggugggggcauccauguggagaugggguauaguggggaggaggugugggaugugaggcagcuagagggcaggaggggggaaagggaauggaauauggaguguaaaaaaugaauuacaaauaaaauuaaauuaaaaaaagaacaguaugaagaaucaauauagcaaaggaguugauucuuugaaaagauaaacaggauugacagacccuuagucaaccuuaacugaaagagaaagagaaaaaccauguuaauaaagauaaaaagaaggaugucacaacaguuacuagcaguuugaauagguuuggccaccaugguuucaaguguuugaaugcuuggccaacagggagugauauuaggaggcauguccuuguuggaauagguguagccuuguuggaggaagugugucacuguggggcugggcuuugauggucuucucuuaacugccuucccaucaagauguugaacucucagcuccuccugccccaugucugccuggaugcugccaugcugguggcucacaaccauccguggcgaaaucugaugcccuuuucuggagcaucugaggacagcuacaguguacuuacauauaauaaauaaauaaaucuuuaaaaaaaauaaauaaauauuaggugaaaauuccaucuucacaacauuggaaacccuaacaaaaauaguuacuaaggaaauccagagaaugguuagagaauauuuuaaaaacgcacaucugagaccuaggaaucauagugaguuggguaaguuuccugaaacauaugacuuacccaaaaugaaucaagauaugauaagcaaaccuacaaugaacaauacaacugcagaaguacuaagucucucaacagagauagcccaugacuggacagauucucauauaaauucuaccuaauauuuauucucuauaagaaccaaauauauuacuaaaacacuuaaaaugugccuugaauaauggaagggcuuucauaauuuauaguauuguaauuaaaguugaguagccacauaugagcaguggcuaccauagugguuugcacagcucuagaccaaaaugguaaugguaaaacuuauugaaaguugaaucucucacugagcacaaacuuuaguuuagcacucugguguguuccugucauuguguauccuuguauuuuggugccacccaagguguuagugugucucccacuaccuagucgguucauuagaacaaaaaacaaaacaagagagucauguuccuugggagccuuuauauacuaaaaaaaagggggggcgucuuuauagaacuauugaccccuaucugaaaucaaagguaguuaaagccuucccuagugcccugacccauaucagauaguuuuccuuguguaaccauacacauguuuuggcccuauacuggacaugccaaugcucauagcagcucuguugggaugccauacucuugaucaggcaaccauccacaacaccugauggagcaugggaggaaaauauucacuucuuacgcugauuaaaugucuaauuucagaacugucaagaauaaugaagacccaaaaaugccuuauguagugcuauucaauggacaaucauccuuaaaaguuaacuagccuucaucccccaauucccacccccaaucacauguauaguuucuaguauuaacuguuacaugaauuggaaguagaugguguuuaauucagagacccacagcuggcacagguacagaaauuuaaagacuguaggauguucagcucuaaaugaauauauauacugcacaccuccucccaagucucaggauuacugcaggagcaagggcagaaaacuucugagagccugagguggaggcugacuacaaggagacacuaucuuuuggacacaccaggguaacuuuacauaugaaugaagaguggacaaggccugcacaagcccaggccaguccaaaucucagcguggagaggggagcugagcacgcauccgccuccaaguacaccuucuggugacuugaccacucucccguggaagaccacacacccaggaauauuugggcaccacaauugcccuuaggaguuuuaaaaagaaauagaaacuugaguggauugggaugaggaguggauuuuugaaagagcugggagagaugauuauaaugaaauaacauugcauugaagacucaaaaagcaagaaaaaauaaaacuaaauuuauaaaauuagaaucugauacauauguguacauagucaacaugauuuugcacauguguuuagcaaaauucauaaaagauaguuauuucuaaggucuugaagcuucagaaagucgguggugaaauaauuuuuagauuuccaaaauugcuacccugaaauggcuuaguggccauuuaaaugaagaucagacucuaucuaguuuugcacuuuugugccaugaaugggagaaaaugaaaaguauuugauuaacuagguuauccugacucucuuuuacuuagaauaaaaaaaaaaucagacaaaaacaauuuuacaagggauauuuuauuauaugacacugauuucauaggcaaaguaauacaguguacuuuguaagugugugauaaauguuagcuggaucuuaagauuuccaaaugcuagcaaaguuacguaaacuuucugccucggucccaucaucuauaaaacgagaauaauaguaccaaccacaguaaacaugaaaggaggugacacuggagcagugucugagcaucugucaucccagcuguucugcacaauaaaugagaagaucccucaagcucgggaaaccaaaaucagucaaugcaacacagcaaaauccuaccacaaaaauuaaaacgaaaaggaaaggucuuagaauaaaaaugucacuauuucacuagguaccacauagcaauacuuugaacauuaauaacgacauuuauuccagaagauucuauugccuuguaacacugcaugcaucuuaguuuggagaaauauaugcuacaguccugguguucccacaaugacaaugcauuucuuauaaaauaugcuuucaucaauggaucugcaacugugcaauguguuuuacuuguuagagacauagucuuucccuuccccuccaacccuguuucuuagauuuauucaugguacuguagaaauauuucauuuuuaugucaacauauagaaucaauauuccacuauguggacauacuguucuaccaguauuuauccauucuccuguuuugugcauuuuggaauuuaugaacgugcugcuacguaacaugagaccauggugguuuguaaugugacugcacuauuuacaaacccaucagaguccuccucugacacugguagacuuaacucucaagggcaugcaguguuagugcacuguguaauuugaauuucucugauuacaauuaaaucaagcaucuuuugaaaaaucuuucuuagcuguucuuauguucaccuuucugugacaccucuuugggccuucugcacauuaaaaaacaaaacaaaacaaaaaccuuggaaaaaucccaugacauccuugcuguuccuuuuaugagaauaaaagacauuagucagucugugacucauacuugguccugaugagaacaauaguuaaguggaaucaggaugucuugggcuuuacaaaguuauuuccuuaaguuugccuugaacuggcaauaaccaugaagaggauuuaagaggaggaucuauguuaaauuggggcuuugcuuuguuuaugcacauggguuugcaccaguuugguuuguggauuuggguauuuguugguuuguuggauugauugauugacuauuuuagaagcaucaagugguucacucugaauaagaggaaacaucugcugagcacuaguguguuggacaucauuuccagcacucugaaaacauuaucacaguauuuaaauugauauaaauagaagcaauagauacaauguuauuauauuuucuaaaugaagaaaugagagcccuugaaaauggaaugacuuguucaaguuggagucauacaaaauggcagaaauggaggcugggcaugguggcgcacaccuuuaaucccagcacuugggaggcagaggcaggcggauuucugaguucgaggccagccuggucuacaaagugaguuccaggacagccagggcuacacagagaaacccugucuccaaaaaacaaacaaaggcagaaaugggugucaauuugacaguccucacucucccaaugagcucucagccccacaucauaauuacaggaaguagcgccucauucaggagcacagcaggacagagggagagcaggugguuucccuggagaaccugggaggagugauggacauucaggguaugcucuguaggaagaaaucuggagggcaacugaaagaauugauagaaaaaauuaagaucagaaauuacugacagugaaaagaauggaaacaacccuuacaaagguacaaaguucacaauucauagcaccugacuggacacaauguuaggaguuugcaacaggagugaguugugucauagagaaauucaggcaaagggcacagggaaccagauguuugagaagcugugacucgugggucuggaagcuuucuuagaaagugagucauaaacuuaauguccauaaacauaggagaauaaccuagaagccaauagaagugaugauuuuguucaaaguguagcucaggauacaaaauggcagaugguuuggcgguaaugugacgugguagguaggcaggcaggcaggcaggcaggcagguaggaauugauagcagcuaagagaaugccaaucuugcuucugaaccucucucccugcacccugggagguaucaagaacaagcagguuuuguuuaucaagccucaugaaguacuguggcuauggaggaaagggagauuucaagcaaggucagaagaugguuugccucuuugaggcaguugaggauggggauacuugagaugaaaccuaaguagaaaaagguugggaaugagaaauaaaaggaagguagucacacuaaucucuauuccccaccuucccuucaugugcccauccuuuuauucucagcuaacauuuugugaugaaagcuaaggaaguccagagaguucagucgaccauuuaaagcucaugaacauguguugcaugugucugucaucauuuugccuuaaaugcucagagauauguucaucucuaaaggguuuuccuuuaugcugccugaacguagcuuucuugacucaagaaggaugcuuuugaaaaugccucucugagguggagagcuggcucguuaagaaugguuguugcucuugugcaagacucaguuugcaauuuuguaaugacaaucccagauugaauaucuucuuaagacuuaagacucuguggacacugagcacgcauaugauacacauacauacaugcaggcacgauacucuuacauauaaaaauaaaauaaguagaacaaaggaaaaaugcuucucaugcuuuccuugccucucacaggcaaucagcuugucuccauucuuuuaauuuuugcccauacuugguuuuggaucugcauucauuacaauauaaauuugagggauaugguggugcacugauuuaacccagaacuuggggggguagagucaucuggaucucuaggagucuaaguguaagacccugacccucagucagugguacuuacuucaagaugucccugagugaaacacugagacacagauagauccaaaagcaugagguuuauuuucuggugugucagggucaaccuucaauuagucccucaaggcaaguuacuaagaaggcaacccuaaauagcuauuacaagcacuuuuaauacuuuuuagggacacagguuacaucagcaagguuacaguucaaacuuauuggcuaagcauauugaccuuuaaaucuauuggcuagcaagcaugacaugcauuugaacucuaccugggacuuuccagagugucagguaacuaucagucaguacauucugagaauuuuuuuacucaagaauguuccugugaguacacaauggaucuuggccuagacuuugcugcaggugggagggggaagcuguaaggagggugugggacuggaaaaagcccuuagguuccuuauuccccccuuuuucuuguacaugcuccaauccuggagcuauacucaggagucuuagguaacuaacucauauucuucagguccuguccucagggucucauauugcuggcccaggaccaucagcugcacugcuccuacucucucuuuuaugaaggcucuaaucuuguucaguacgcagaguccaaaggucaacaacagcaggagaauaauuagggguccuaacaagguggcuaugaggggaggaguuaaaccaagacucaaaccagcccugacucuguucucuuucucucuucugcuuggcuagcccaucucucaccuuggccauugaaucuuuaacaaccccagaauggucuauauaaaagcaacacuccucagcuaaggcagcaagcacauagcccuccuugcuggaggaaaagguaagucuaauccccuccuagucuguaguacuacuucugauaaugaggucaaugauucuugaagaugacugauggaaguuucuguucucucuauaucuaaaucaauggcugcccucagacugucauaauuuuuccuuuguaagaccaaaauguagguaccaauggcuuccccggccacccuuaaccccagcacaagggcacauaggauggggaagaaucagaauacaaagguaccaucagguggucaugaccaagguugugagaucuugaguuugauuggauuguccaucuucuguaucauccagccagggucccuggggaggagagugucugcagguuucacaugagaaauguccaccuugagggcuugggagugguuagcagcaccaggaaggguuccuuccacugggauuccagugacuguaccugauggacugguccuuacguacacccagccaccagccuggaagcagugaggguucucuggcaucccugacacauugaaugcagauaguuugggcuaaaucucauguuguacugacugaagggcuuggagccucaagaagagguucuaaucagugaguugagaugccucuagggagggcccagugaacaccaagggaauugggguaccaagcagaaucucaaaaggggucagguuaaaagguaggggguguucugggcucagaaaaggccaggggaaggaacaccacccaguuaacgccaguuucuuuaguuauugucucuuuuaagguucuguuuauucucucuaccuggccugagcucuggggacaguacguacaauggagcuuccauuuaguccccaauauuucugccaaucccugacuuaccuuagagaaaaaagcaggaccauugucugauccaauuaccuuggguacuccgaaccucaagaaauuuuccucuaauaucuucuuggcuaugggguagcuauuuccugcuugguggggaaagucucaacucaucuagagaaaguauccacaaacacuagaagguauuuauagccauauuuuccugguuuaaauucuguaaaaucgacuuaccaauauacuccaggccguucucucccaggucuuuugcccuguuuacucugggccacauaagcauucacuugcuggcauaccuuacucuguucuacuguaucaggcuaaaacucugagguccauuacauauaccuuagaucccuuaacugcucagaugcacuuauccucuacaugaguccauuuacgcauuuggccaaguaagucuuuugcuugcuuuuuagggaauauagauuuuuuuuccuuuucaugugcaccauuacccuuccuucucuagguaauaguugguaggguggcuagcaaucugaguccugucuucuucaguauauuuuaagugaggauauuucuuaguccagucccaguucccagcagauaucucuugcaggcccauaaucaggauaggcuccugcauagccacuucuccagccacuugaucugccugguuauugcccugggccacugagucucuucccuucugaugucuugggcaaugaauuauacucacaguugcuggcuuuaucagggcauccaagagagccaagauuuccuuuuuguuaauucuuuucccucugaugugagcaguccucucucuugguauacaguccuguggacaugggcuauggcaaaagcauaccuacuaaccauguagauguuaauuuucuuaccagccccaagcuccauggccuuagugagggcaauuagcuccacuuucugugccaaugugcugggaguaaaaguuccgcccacgcccagaugacguuugugcuauccaccaauugucucugaccuucauggagaaaacugccccugucuguaaagcagguagccuuggcuucgguaggagucagucggagaggucuuuuccuccacccaugggcucuccuuuugggccaguuaguuguggccggucgagcaggaaguguauauugguccccaucuuggagaguaagucuugccccaacacaggguaggagcagucugagaugaccauaaaugaaugggauacucugcccaucccuagguccacuguucuuuggguaguccaugaauacauuuuggugccagugacuccuuggacccaaguuguuuacuuggaaauggggccacugccuuggaggaggacugaguguugagccccuguguccaccaagaauugagugcguuuccucuccacucucagaguuauccuggguucaaggaguggguaugaaccccaucuucccuagucgcugucuucccccagggauaacaccuuugccuuaugggggcacuuuucccaaggccugggauuuccugcccccugcuucuguuuguuagggcacugguccuuuucaagggguuuucugucucucuuugguuggggucucacuucucuguguucccugacucuguagccaauauacucuguaaauuccuuuccuguugccuuucuuuuuucaucucccuuucuuuuucucugcuccuucuccuccucugucucccugucaugguagacuuuaucagcaaucugcacuaaaucccucaacaacuuuucuuguagucccucuaguuucugaaacuuuuuccuaauaucucuacuagccuggucuacaaaaaccauagucacaguagcuuuguacuccuugcugcuggggucauaggguguguacuggcuaguuuugugucaacuugacacagcuggaguuaucacagagaaaggagcuucaguggaggaaaugccuccaugagauacaacuguaaggcauuuucucagugaucaagguggaaaggccccuugugggugggaccaucucugagcugguagucuugguucuauaagagaacagguugagcaagccaggggaagcaagccagaaaggaacaucccucuagggccucugcaucaguuccugcuuucugaccugcuugaguuccaguccugacuuccuuuggugaugaacagcaguauggaaguguaagccgaauaaucccuuuccuccccaacuugcuucuuggucaugauguuugugcaggaauagaaacccuaacuaagacaggguguauauugguagaaugucuccgugaguucuagagggcagcagaugacucauuugaucucugucuaacaucauguaccuuggucaaauuugugggucagguggcucccuggagaccugcauauggagccuggugguagaccuucagguaccccuuaucuucugccauauuaaagucccagccaggucuagucaggggaaaccagcugucgaugacagccuguucaaucaauggugccccuagucugagggggcauucuuucuggcuuccuacauuauucucucacucuucagccaugaagaacacucucaugaguuguuggauaucaucccagguggggugauaaguaaauaaacagucucaaagagauuaauuggccccuugugguuaucugaaaggggagggguugggccuuccaguuguacaagaagguugaagagaagggccaauauugaaaaaccugauuacccuuaucuagaggccuauaugcccucagugggagagccacuguaguaucaggagagguggcucucagacuuugggucuccaugaugggaucgggaaguugggggucuucuccugcucuucccuucaguaaagggggugugguacaauggcccuggugucauaugggcuagagauccuagagccaguucuggcacuggcggggccauggggacaaggauagguggauauagaagaggagggucuuggagcaacaggucugcuguugaugggucuuagaggaucaacuucuucuaaggucuggaucccuccucccauauuuucuauuuccugauggccagaaccugugaagugggucuuggggaaagaaaggcuuuuaucccuugggaggcgggagggggguguccuccacuagauucuuccagguaauuauauagagcauuuggucugagugcucaagggauccuggccucuuuccucuacuguuuugaucaccugcaagucaaagguuccuauagguagccacccuacucugaaggugauccauucggagaagcagggaguaacuaacuuuccuuucuuuacuacugcugacaaauuuucucuuacagugguuaauuaggauguuuaacaggguagauucagucuguccaguguccaagaacacagaaugagauaaccaauaccaacaaacucagagaaagacaaucaacacaguuugccccuuccuugauugcagaaaccagguuauagcaaggcucggucagcuucuguugauacugugucuuccugauuacagacagugcuccccuuucacaggugcagacaccagguuauauagcaugacucagcuccugccuuauacugugucuuaccauuuccaaaaggaacagaguccucuccacucccucaaggggggcugaagaguccuacagacucccuguggucacagccuuaaggcacaacugcccauggcaauugacagcaccagaccagagccuuuccagcugacaccuguucccuggagacaaacgugaaagcagaagacagagagacaaaacacugacaaacacagguuagcacuguuacuggcucggucuuuaucacucugaucagucaguguagucguggucacuaggggaaggggacuggggugggggugggggucuggaguggggugggaggguugggguggggggaagucuccuagaauccuggaugagcccccaaauguaagaccccccuccuuggucagugguacuucaagaugcccgagugagacacagagacacauaucgaugcaaaagcaagagguuuauuuuccgaugugucggggucaaccuucaauuagucccucaaggcaaguuacuaaaaaggcgacccuaaauagcuauuacaagcacuuuuaauacuuuuuaggggcacagguuacaucagcaagguuacaguucaaacuuauuggcuaagcauauugaccuuuaaaucuauuggcuagcaagcaugacaugcauuugaacucuaccugggacuuuccagagggucagguaacuaucagucaguacauucugagaauuuuuuacucaagaaugauccugugggucgagaacggaacuuggccuagccuuggccccagguauaaggaggguguggaacuggaaaacuccuuagggucccucacaaggccagccuggccuacauagugaguuucuggacagccaggaagccagggauauucagagagaccaugucuaaaaaaggagauacaaaucuccugcacccagcuccuuguuuucuuugacuguaaccagagagaaccaugaggacugacuuagagauggucuagccuugagauuaagaggaaauaucuacaaguaugaaguugauaagaagacugauguuaacuucacaaguuagaaguucugucuuauacaggaucuguuuacuuugggagauaaggguagugccucuggggugacagaauggacuugcagacagaucucccuagcuucaaucaaguaaauugucuuggccugacugguuccacucccuagguuccauuuucucuguuucuaaauaaugcgaacacuuuccaccucuuccuccucuucuucuuccuccuccuuuugcuccuucuccucuucuuccuccuaaaccaccaccaccaccuccuccucuucuuccuccuccuccuuuaccuccucuucucuaaaugguuaucaaaaucaaauaaauuuccuauacaaacaugccuccaaaauuauaaaaugacauauaaagucauguuaagacucuuagguaauucacaucacacuuagauuauguugcaaucuuuacuaugaaaagcaaaggacaaguacacuuguuucugacuuuuaaacaaggaauugcucucaauugggugguuguuguccuuugaggacuugaauuuuuuuucuuuucuuuuuuucauuuuuguauuucaggggaaaagcaucugcauugaacauguaucuacaauguauuuacauuguaaaauguaucugcacuguaugccagagaaaaguaaacaaacacuacucaucagggaaguagcaggaauugagaaacucuuggaagaaagaaggguuuuuguuguuguugcuguuguucuuccauaaaugauuuauagauuuacacuuaucaucagcucaagacuucccuuaaauuuuuuuuagcaaaucucaaacagcuacaacuuggggcuuugggccaccugccaauguuucuucaagagcauuauaauuggccuaaucaucagaaacuagaaauuucucucuuuuccuacauacagguacuccauacuuuccuucuguuacccacucauucuaacagaugagacuauauauauacacauauguaugagugugugcauguaugugcauacauaugcacuugcaaacacacuuaccaaauagcacaggcuuaaauauuucucuuucuacuguauuucuuaugcagagauagguucaugcuuauuuuucuuuuaccuugguccauauauuuauaagcuagagagugucuuuguguauguguucaggaaauuucuaucuagaacuggcuaaaaaggaauguugauauccaugugaugguuuguuuaugcucagcccagggaguggcacuauuagaagguguggcccuguuggaguagguguggccuuguuggaauguauguaacguugggugugggcuuuaagacccgcauccuaacugccuggaagucaguauuuugcuagcaguauucagaugaagauauagaacucucagcuccuccugcaccauggcuccuuggaugcugccauguucuggccuuggugauaauggacugaaucucugaacccguaagccagccccaaucaaauguugucuuuauaagaauugucuuggucauggugucuguucacccuaacuaagacaagcaggaacucacucugccuuucucucagcucccugcuucuuuuuaucuuuuagugaaagcauucagauguggcacacagaaugauguggagaagauaguuuacuacagaagacaugagacauucuugagaggugaguggauaaacucagagagaccauuauucaaaucuacaugcuuaagcagaccuuacacuauucucaaguuucuguuacagacaugucugugaggggcauucuccugucaggauaguuguuaggcccauuggauuaacucuuggggaagaccguaaauuguccuuguucagaaccagaaaggcuuuuuaugguaguaguccuccuggcaauacaaaaggucuugccuccauuaaaggccagggauacaguucagaugccacuauuauaaaccuaaaccauguaucagaauacauguaaaaaaaugaaccaaaaaaaaaaaaaagcaaaauuuaaaaaggagguaaccauguuucaugaggaggaaauaacccccguaugauaagucucaacaaaggagacacaaaagaauaaacugaaaaaguaaaccguuaaaaacaaaauucuacuccuuuaggccaggcuugggaauguggccuuugugacucaaugcuccaagguaugcuaaucauaaaacagauagcgacauuccuucacccaccugcuuccuggguuuaaagaguguucauucgaagaaagucguccugacucacccugaccauugcugaaacccgcuaugcaaaugugcuauuguuagggucucuuagaaacugucuugagaaauaacccucacuauuaccagguauuccucgugacucuugugacuuugcacuuccuugugacucuuaacugguauuuuugguauuuuccaacaacgcccuccccaccuccuugaguugugguuucuuccuuuaaauaccccuuauccagcuucucggggcgccaccguccucuaccccuucaccccuucgugguguaugaccaugggcccgagagcacucuugaauaaaaauacucuugcaguuugcagcaagaccuuucuuaugggugauuuuggggugucgccucuccugagucagaacgugggggaguccucacguugugggucuuucaaaacaucuacuuuccuccucguuguggauggcuauccuuucaugcaauacuuuuuuuuuaaaguuauuuaucuuuuucuaaauucuuuuuucuuuuuuuuuuuuacaguccagucuuuauccccccucccagucuguccuuugacuguuccacauccccaccuuccccuccucaccaacacacacaaacacacacacacacacacacacacacacacacacacacacacacacacacacacacacacaguuaguccagaccuggaaguucuuaaauuuaagcugggugggugguaguggggcaugccuuuaaucccagaacuuugaggcaggcugaucucuacaaauuugacaccagccuggacuacaccuugaauucuaggacagcaaaugcuacacagaaauacccugucccagccucaaaacaaaacaucaaaagagggggaaauuguaguguuuucucacucuuugacuuucaaauucuaagaaggugaggcaggaaaaaccugaacaggcuaaggcagugauauuagcauaugaaaagaacagaggaagcuuaagaccuuccccaccaaagccuggccugcugcagauacagcaugcaugagaagacuggcaccaugcaaaugccagaacuauuucuagcccuucagacaggaagccauugaucuucuagcucuggccugcuuccucucuuggaaguguguucuuucuuaacaaauuguuccugcuuccacgggucucugcccagcuuuuuguuccaggacacaauaucugaauauccccaaugguguauaaguguccaccacucucaaauauccaaggcuaacagaaguacaauucugauacuucucuccucauuaaaguuuuguuuggagacagagaagggguccugaugaugaaugagggucuacccacagugauuuucaagcuggcuaguuucuaacuagcuuccuagacaugucuacugugagugaaagguuucagaauuaagacaagcccaccaacucuuucuacauucuacuguccacugcaaacacaaacagugucagacgcagaugcaguagcucaagaguucaccuccaccagaaaugcuuagagauuucccugaaaaugacugcaaucuucuauaucaggguagaccauuuccaacacuuauggaaugagauuauucuuaaaagcagagacuuauuaaaugaaaugaaggaagcuuauaugaaaaucugaauugaaaaacuguuaagauguuuuucugaugacaaaaguaauuaauuuuuauugaugaaaauaaguuauauaaagaagcacauucuucuaaauuuaucuuuuauagagacugccauguaauacacccucaugaguccuuauguacuuuuaacauugcaucacacugagcuuaguuagcgucuuggaaccuacucagcaugggcuuuuaucauagcuuuuaucauaguugaguggauaaaagcucacacuucuacaaguugcuuagguuuggaucugacaagccuggcugggagggcacacuugcaagcuuuauuguuucacuauuaguugucucacuauuagugagcauuuuaaacagauagguaaugggcuuagcguugccauauugcuugccaucagacaggaucaaaagucugugacaaagaccaaggauuaacugugaaggacuaggagccugacacuuagaagggaaaugcaaagaaaacauauaaagggcuuagggacaacaagaaaaccacaguagguauauuaaaaauagagugaauaauuuaaaaaaauguuccaaaugcugccaauaggcucuucucacgggucugagaaaagaauagagaacuaaacauuuaguuugggugucaggaguguuggugggguaauaguucugaaaaggcguaaaaguugagaauggaaagaggaguggagaccgggaugcuuugcucaggaagacuuccugcugagggcuauggcaacaagcucaauugguaaagcacuugcugugcaugggcaagggcuugaguuuggauccccagaauuuacguaaaaucugcacacagugguggguacacauaacccagugguggugggcucugacaagaggauaccagggguucacuggccagagaguuuagcuaaaacuagacugaguuuuaaaacugagugagacucagugacucugucucaaaaaauauagacaguggcagaggaggccguagaacuugggcauccauaucugccucuacuggcuggcuacuguacuucaccauauaccuauauaaaaacaaaacaaagcaaaacaaacuuugugcaaauacagaaugugcuuuggacuagggaauagggguugcuggggaaaguaaaguuagaaaaaaacaaguaaacaaacaaaaaagagaaguuauaggaugcuugcaaguagugaugagccacugagagaacaaaacuaaagaugcccagcacaacgagagaauuucugaagugauauucuugagugggcagggaaggacaagaucuagcauguaaauaggaaauuaacuuucaugugaucacagacuguguuugaaaauagucaggaagccaaagguaugugucaucuguuuuggagggaguuugagcucuucuaauugcuuuaguucucgcugucauugcuccugucaguuacaggaaguggcauguccuucccucauaaaguuauauacucuccuaaccuuuccccucccaucagugcuccuacaucaggagugucacauacauuuuucuguauaugacauuuguuuaccuauaaccucacaauucugaaugcaguuauaaaaugaaucucucccaguuuugcugugaaaaauagcacuucagaauuauuugauuuuuaauaagucugaauauauuuccauagauuuauugacuauacuuuuuacuaauuauguucaucuugguugcuuagguuuguauguguguguguguguguuauauuuuaaauuuuauuaauauuuggcauuucgagacaaagucaugcaacacaggcuagccuugaacucauuauguagcccagguuggucuuaaauucaguguuccucuugccuuagucugccucuuuucucuuucccacuucccucucucucccuccccuuccuuucaucucuagcucaguuuaaucucuaauucaaaauccuccuugcuuagccuaaagaagccaggaaaauccacauucacaccauaccuagcuacuucaccgaaauauuuacagcagauuuucaauuugaucuaauuguuuccuaaaauacuguccuaugcuagaauuaauuuuauuucucaugcaaaauauauuuacccaaauuuucuuucauugaugguuuuggcauuuauagaaaccuaaaaaaaaaaaaaaagcuuuacuuuaaaucaguagguaauuuauuucauggacucuauuuugagcacauggaaaacacuuagcaucucucugagauaagaaacccaaggaaacucuagacaaagguuuggauguuauuuggacugggacuuucaucuuuggcaguuugccagggaacaguucuacuuagaagacuacuauuaauugacauuugaagcuauaauuagagaaaaacaaauuauucauuugcaguccaaugagaaaggugaaccuacaaaaaaguaaaguuuagauuaucaagaaaauguauauuuccgaacuguaaaaucuaccaucuagucauucaagcaauuaguguuuugcuacugugugccagaugcuccccugaauguuacagcaaagaaggccacaugccacauguaggcaauuugcauucuaauggcaggaggcacagggugcauuuacaaaguaucugucagacaagggcugcaaacugcauaccaccaggaaauaauauagcagugucugagcagaugaaugaaguucucuacacuagacuggaaacuagagcagcagaagauagaggaagagaaccugaggcacaggacuguucgcugugaagaauggaagucucucguagaugggcucagaugacaaguauucuuggcaacagucacuuuccucaaccaccccggccucucaccuugcguuuauuacuguaccucagucucugauauccuuuggguacugccucuuuuuuuuucuaaaguuuuaucuuuggucuauucauacuugcugcuuccaauugcuuucuugccuuucuuucuuaaagcaucuggaaucuggcuuagagaaagcuccacccuaaacuuuuuuuuuucucucccaacuuuuaucuuauaguugaucaagcucuccagcuuaaaacacuguuucagccucaggacucaguugauacucuccccguuucucauuauuuauuuacuuaucuuuguuuacuuacuuuugcacuuaaccuuuucucauuucuaugaucucauaaagcuucaauagcccaagcuuagucuuuggaaagguuuuuucuuggugaucucuucuaauuugguggauguaaguccuguacuuugaagauucuaaaacuucuaucucuagcuuggacuucucuuuugaaacucaaauauccaguuauuuaucaugucacuuaaaugucagauuggcauggcagauuguguuauuuuuuuuuaagguuaccuuuucagugcuguaauuauauuuauucugaugaggucagguucaguuaugcaauuuacauguggaugcaacuggcauaaugaauuucugagaagcgucuuaguccaucucauuugcaauaacaacaaucaaggcuaaguuuuuuuuuuuuuuuuuuuuuuuuuuuuuuuuuuuaauaagcaaagagauaccauuuaguucaaauaucuggaagugccagagcaugacaguaaacauccaggaggguguuaguacaugccuauauucccaguacccagaaggcuaagguagaaaaguuguccuggcucacaugcauuugagacuaacuugaccugcacaaguuccaggccaucaagagcuauauagcuagaucuugaaaaacaaggaaggaaggaaggggaggagagggagaggagagggagaggaaacacucagguguccagguagggaaggaaacccaaaaagaaaugaaaaugaaaaucagguuuaggagcuggcuguagagauggcucagagguuaagaacaccugcaguucuuccagagguccugaguuuaauucaauuauauggugucucauagccaucuauacugugauaugaugcccucuucuggcauauaggcauacaugcaggcagaguacucuauacauaguaaagaaacccuaaauaaauuuuaaaaaagaaagaaagaaagaaagaaagaaagaaagaaaggaaaggaaagaaggaaaguaaggaagaaaggaaggaagagaggaagaaacaaaggaaggaaggaagaaaggaaggaaggaaggaaggaagggaggaaggaaggaaguaagaaaggaaggaagaaaggaagaaacaaaggaagaaacaaaggaaggaagaaaggaaggaagaaaggaaggaaggaaggaaggaaggaaggaagaaggaagaaaggaaggaaggaagaaagaaggaagaagaaagaaaggaaggaagaaagaaaaggaaggaagaaacaaacaaagaaaugaaggaaggaagaauggaagaaagaaacaaagaaaugaaagaaggaaggaagaaaggaagaaaggaaggaagaaaggaaggaaggaagaaaaacagguuuagauugacuuaguuuaucuggaucagauaucagguagucuagugcaggugguucauugucagaauauuaaaacaguagaaauugggaaagguuuccagguaagaaucauuccaauuccagguacucaauaaagcuuaaaguaugacuacauagaaacgucuuuacaaaguacaugugaccaugaagguggguucuauagcugaauggccuagaaucuaauguggucucugagauagcauagagguuagcaggucauaaagcacaggugacaucuccccuaaggauaggguuuauuggguuuguuucaucauuacaguucaucgucuaaggaagucaaaacaagaacccgaacaagaaccuggagcagaggccauggagaagugcugcuuacuggcuugcuccacauggcguguucagccuuucuuauagaaacuuggaccaccucccugcagugggcugugcccuuucacaucaguuacuaauguuaaaauaugaccuacaggccugccuacagaucuuauagagggauuuucucaacugaggcuccauuccuuggugggcugcagucaagucacaaagucacaccaugcaucugauuuaaggcaugaguuuggggggugggggguggagauugaaagucuugaacuggggacaugagagagagagauagacagacagaaagaaugaauaagacagagguguaaggggaggugccgauacuaaggucuauuucccuaauugguuguugauuuguuaauaaagaagaccaggagccauuugcugggugaaagguacaagugggacuuccgagucccaagaagaaaggcauaugagggaagagaggggcuuuucagcuaugccuuggaggaaaagggacacugaaaucauguaaggccuugggacagcuggucccugcuaugggaggguagccaaggauguggaggagagauggggauaauuaauugaugagggcaugccuuuuuaggcaggagauucugugugugaccagaaacugucacaaaaggcaagcugaaaagugacaaacuguauuuuuuaugcucagaugcaaugguggggcugguaaugcaacccauccugggacaagggucaugggagugggcugguggugcagucuacucccugagcaaggaggguagagagugagagaugccaagucagugcuggcagccuggcagaagccagaaggaacaaagggagccaggaggggucagagccccaucgcagcuccugggcaaaggcaguauuguguuucuaaaacuaccggcaacacagagggaaugagagagggggagagagagguguggccagggcuuuauaugugccauaccuaguggaagugggugauggcauaaacuacuguggcugaaucacuuaaaggcagguugacaaagcaacuaauuuacaauacccucuucuccaaugauucuaggcuguguuaaaaugacauaaaacuagacagcacauauaccguuccuuuauauaaauaccagaaacagcuggccugcuauguaugcaaacaagaccaagacauuuauuuauuuauuucaagacagagucuaacuaugcagcucuggcugcccuggaacucacuuuguagaccaggcuggccucaaacucacacagacccaucugucucuaccucccaaguguugggaauaaaggcauguaccacuaagccuguaggguauuuuuaaaauuagugauugaugugggagagugcagcccacugcaggaaggugaucuauaaguuucuauaagaaagcaggcugagcaagccauguggagcaagccaguaagcagcacuucuccauggccucugcaucagcuccugucuccagguuccuguuggguucuuguccugacuuccuuagauaaugaacaguaaugguggaaaaaaaaaaccaauaaacccuuucuucccaaaguuacuuuguucauggugacucauugcagcaguggugagcauaacuaggaguguauuuauauaaaggaaaccuuuuuggucuaagacauuaagcguuuuagaacucuuacaacgauaaacagccuauacccaucagcucaguugauauagcaucucaaaguaacaugcccagaacaggaugccugaucuucccugaccaucccacaucuguuagucccacaguuuuucaccuugguaaauggcagcuucagccuuccaguuauuagaccaaaaauucuuauuguaguccuugacuacuauagaguagcagaguuacugcugguacauauaugaacaggaacaaaagauaauuucuguagagacugcacucauuggagaugaaggaguaaaaauaaauauauacccuaaguuaaaugcauaggguuaacauauauguagcaugcuacuauauaauuuuaaguaugugggaaaggacuugcaauagaaaaaaaauagagaaagcuaaagaggaaggaaggggcuagaccacgguugcaagguuagucagaguuggccuuacugaggaagaaacauuuugucaaggaagagagaacugaaaaacuuuugcccuauaauaacugugugcaaacaucuaucccaagacaacacccauauggaagcauacagacagggcccuaaaugcuuaauucacaauaucaggcucugguguuuguuauagccauccccaccugcccccauacaaggcuccugacccuuaccacucauagccuuuacuaaaaaagcacuucuguuugugacugugcaacucucauaacucaaaaguguuuucccgugggaucugaaaaucauucuuuuauucaucagacuguugugaaaugucuaugggaacauuuccacuaugauagcaccaagaauaaaggaugaaacuccuguccuuaccaaagccaaagucaacucaaaagcuuucaauaucaaacaagcaguuaugaaaggcaucuacagaucacccccccccccaccauggcccaagaggcagcccaaguacucaaguaccuacauggauaaagacauacagcuacugugugugugcaugcauacacacaccauaaaaaagcagcgugauaugaaaguguaagaacagacauggaacaugauaauauuuaaaugugucaaagucaaauuuucugcuucugaguccugccucaaacuugugaugaucugagaagcuauugucaugauugcacaccauaugguuaacuacaaagggaauuaaaugcaacgugaaugugcauguacucuuacuuaacuuacguuacuguuucagauuacaagauaauucacuuaaaaucacuacugaguuuaaagucacacuaaguguuauuauggguucuagaacuagacauuuauuugaauuuuaucauuuggguaagugguaagaaaauaagucugaaucugucucuuucuguagaccuguaauaaaauaaucaaccuugggaguuuucacaauuagagaaacagaguauuuggugcucagcaaaugccauguauuguaaaaaggugagaucacaucauacuuaagaacugauacuuuuccgcgcaugauuguucccaaaggguuucucucccucucuuuccuaaauagccgggaauacaagagaaaauuguuacaaugaaucaggugaccuggcagggaauuucucaauuacuaccuuuucucuccauaugacauaugugugauaggagacccuuucgauuuacauuguacuauaaacaaaagcaaacauguagagaccaauuuggccggguuuguuuguuugguuugguuucagauccuaaaauuacuguggcugaacaaguaaguacacaggaaacucggaaauuucacuuugccaaacaaggcucucuauacguuugacucauccucucauacccuuaaaagaaucgaauuucuauacucuuuuucuuuuguaacgggaguguaauacacuauagggacgugaaagcaauauccuuuacacuuuagaugaauguuaccaaccccuggauaggucuucccgucagaaaacgccuuugagcagugggcuccugcggcugcgcugcuuucgucaucacggagcgccgggcuugcccucugaucgucgcccuuuuagaggccgagcuaucuggugugucccauacccagagucuggcccugcgcgugcgcagacuccgugucacuaggcgggccacccuagggcggcgauuccaggugcauccgcccgaggcgggccuugcgcaccucagcugauccugacgucgccuuucggccgccauggcugagaagcaagcgggcuuggucggagagccggaucccgagggguccucgccugggaccucggaguccuggaacuaugacagcaacugcguguucugccgcguggcggcgggucaggaacccaaaacugaacucuuucacugugaggugggcggcgacaggccggguggguggggaccaggcauccaaucccugcucgcaggcuucugucucugcagacgaacuaaacagugacugacuucugucagggacccagaggucuccaguguugccuuugcuguucaguagggagagauagcagugauagagcccagcauucucgccucccucgcaugcauuugcaacacagcagcauccugugucuuuacuuuuauuuuagggagucuuccucuucucuagauaguaauuuuaaaauuauguauucuuccaguaucguuagagagcguacaacuugcugaaaacaggucuuggacguggugaagaagugugaauuugacugaaaugggcuggaaugggguuucaggacugggucugaagucgaacugauacuuacaguuaauagcuuguaagaaucuuccuuaucuaccgugagagccucaugaacuacuccccuuuucguuacaagaucucgacaggguucaaaccugugcagaucaaguguaguuaaucauacuugcugcgagaucgggagagcaacagucaugucaugccuggaaauuccagaaaacucucccuuuccccugggucuaacauuuuuacaucucaucauccuucauaaagaguuaaucuuuugagagagauuuaucaucuugcauuuaaaauucuuauuacacauauauucauuguaaacacaggaaaugauugcacuuauauaaguuguugauauauaauuauacaaauaagagcagaggaaauuauuuguuuugguauaaucaggguugccagcaucaugaagaauuuguuugaggaaucuuuccaacaaaagucagagaugauucuuugccucacagaucucuguaugguuuucuuacuguauuuuuagaauucauuuaagcaaagggcauaucacauauucuuagcagggggcuuaccaguaccaagggcagugucuuacucuuuguguaugagucucauggcauugauacgaauuauuuuuaaggggcucuuagaaauagcugagugguagugguacaugccuuuaauuccagcacucagaaaggcagaggcagaaagaucucucuguuggaggccaaccuggucaaugcagugaauucaaggacagcuaaggcuaugcagagaaaucccuugaaaaacaaaacaaaaacaaacaaacaaacaaaccaaacaaaaacagaaagaaagaaagaaagaaagcuagcuagcucuuagaaucgaaaaaugaaacaauguuugagaacccacagaaguguugcuaugccugaauucauacuuagcaauauuagcugauuuaauugcucuuuugcuaauuaaaauuguuaacaccuuagauaccauggcuuuaagaugcucuuucaaauggacuugcuuguuuuagauauaaggggacaguuacugggaagaaauuauuguagcuauauaaaaauuaacuuuugagaauuauuuguuaggaaauauuggaggaacuguugaagcagguccuagaauagucuauaaaaauuacaacuggaacagcauaguagaacauuacacaggguagcuuuuucuguuuugugcuuuaaaaaaaaagacuagccuagaaauaauuucauagcaguaguaauucuuuacauuccuuuuaauaggcauucagugcuuuauuuuauaguuuuaccaacauuguuucugaguuagagacaauuggcuucucuucaguauuuugcucugggaagucauacuguaaagaagccuggugguggugacacauaccuuucaucccagcauuugggagacagggacaggaagauuucugaguuugaggccaacaagcuccaggauagucagagcuacacaaagaaaccuuguuuugaaaaccccaaaaggaaagaaaaaagaaaaacuggccagagguguagcucagugaacuaccagaacuugccaggcauguaagcauguuaggcccuggguuugaccaccagcacuaccaaaggggaaaaaaaaaaaaaaagaaaagaaaaaaaaaagaaacaaacacacacaaagauuuaaaaaauacauacauguauauacacacauuauuuuuggcacucuaucuuugggauuggauuuuuuuucuuuuuuuuuuuuugggggggggguugguuuuuugagacagggaaaaaccagagaaaguguagcccuggcuguccuggaacucacuuuguagaccaggcuggccucagaaaucugccugccucugccucccgagugcugggauuaaaggcgugugccaccacgcccggcggauuuuuuucucuuaauaaugguucaguaguacaauagaaggcaguaaaaucacagaaccauuuucaguauuuuaacaucuuaguaaaaaugcaauuaaaagcuaacugaaauauccaguuucuuugccuuuaaauuuaaaaaguuuaucuaucauguugguuuaugugaacaugugcauauguaaaggccagagaugaguguuggcugucucuuccuauugguguucaccuuauugccuuagacugaaccugaagcuuguagauuuggcuagacauaguggcugaacaagcccuccaggacccucccaccucuaccuucuagcacugcuaggccacagacucuguguggugcugguucugaacuugaguugucaacuuucaucagggauucaucucuccaucuggaggcuggaugguuucuugaccuuuucuaaagcaucccauugaauggaucaaaauggagucucugugcuugggaucuuugcuaauuaugguuaauaguaugggcuugagguucgcaugacacugaauuuuguuuccuggaacagagaauugaugggaagagugcaucuaggaaaauuugcugaggaagaaaacuguguuuauugacuuaacuuuugagugaaaaaagcuuaaaguauggaugagaaaauguauaauaaaauuuaggagugagauuucuuuuucuuuuuucucugugcaggguuuuuuuguguagccugugggcugugcuugaacucucuauaguccaggcuggccuggaauucacagagaucucccugccucugccucuugagugcugggauuaaagguguguaccaccacugccaggcuaagaauguuuuaaugaauuuuacuuauaauuguucuuugaaaucagcuuaauauaauauagcucaugacagaaacuaaagcuuauuauugugaauuuaaguauggcacaguuauaaaauugcucauuaggccuauauuguaacauaaaugcaauuucccagugcuuaagucacagcacagcagaauaauauugggagauugguuuuuuuuuuuaauuuacuaaccaauaugccucucucuuuagaaugaagaccugguuuguuucaaagauaucaaaccagcggcacuuuaucauuaucucgucgugccaaagaagcauauuggaaguugcaaggaucuaaacaaagaucacauagaaauggguaagaagauaacagggguaucaaaagauggccuacucggccaucacuggaaagagaggcccauuggucaggcaaacuuuauaugucccaguacaggggaacgccagggccaaaaaaugggaauggguggguaggggagcggggggcggggggagguggggacuuuugggauagcauuggaaauguaauugaggaaaauacguaauuaaaaaaaaaagaaaaaaaagauaacaggguucuuuguugcuauaucacauugaauucucuuuaaauauggcagugacaauuaaaaaaggaaaaagucuauucaaauaaucaagaauaaaguaagacuucuugaaacauucuaguuaagaaaaccaaauagaauuuuuuaaaaaaaugacaguauacuuuccauuuaucugucacacagacuuuaauuacuaacuuguggccauuugugcaugaaugaccaugcuuggcuuugcuuuguacuuuuaaaggaugguuuucuugacuuugaaauugaaagauacuguggaaaacuauaaguugugauguauuaugagcuuauauugcuugauaauuucagaugcagaugaauuagcaccauaguuuaauaaugaggucuugguuugaacuuuuagcuucugaaaaggagauuggaauuuuguuucuuugagaauuacucuguaguaccuacucagugcuuucuuugacuucuuucugauaccuuuucuuguugccuacucuccggccccacugggccauguucccccucuaguacuagcaucagugggucacaacacuauguccuaggagggucccacuggcucugucccacauuccuguaaccaaacagaucugucauccuugcaguuugauaacacaauacccaguaacccgguaaaaacaagacucaaugcuuauaguuaaccaaucagauuuauauauaaaaaaugccaauauaauaauuuuagaaccaauugauaaucauaaaagcugcucaccuagguuagacaaauuaucccaauauucuaaccuuuaugauaucauaacaaccuguggcuggcuauagccacucugauucacaucuaccaucuuccuuucuccucccuacccagagaugcucccugucucugcaacucuuagcgcugccucccuuuucccuguccauucacaggccuccaacugcccuaauguaauuggcaagggaaaucuugugacguaucacccuuucuguuuaaucaaaucaaaucaaaucaaaucaaaacaaacaccaacucuuguacucccuacucuggagucagccagcauauccuuaagccaguaaucagagauuuuucaguuuauuccaggucuguuuuaguggccguuuucaccagggucuggguuaguuuggcaguacuguauggcacucuacaacggauaaaugagacuagacucuuuagagguaagaaaaggcguaggaaaaaucuugcugauacagcacuauuguucacuagcuucuaggugacugaauuaccaguuugaaaguuguuuccaaauaauacaaaauucuguacuuauuuguucuaaccaugugcuuuagaacaccuauuauuuauaaacauaggcuaacguuuaugcuuauagacauaauauuuacccuaugacugauugguuguguaucucuuacuaaaaguuucuauuucauucuuuggauauuuacuagagaucauauaaucucuuaggaaguuuuauuuuaucuucaagguagaaguaacuucauagagauuagaagcucuucucauaacuaguuauuauagcuggugcauaucagauguuauaaauauugaugcugcugucauuauuaauuucauugucucacccccucuacgcuucuuaugugaauauuuucguaccaaaaucuuaaaaguuguugcacuuaacuuuuacguaauuuauaaagugagaaaaauauguccaugcaaggauguaguaacaaugucaaguccacgcacuguuacugauacuuaauagaauuccacuuacuuaaagaguuuugaagcguuuuacagguuuugaagagcauauguccacccagguagaacauauucuaagcuucaaaauaaaguuuguagcacuuacugugcuugaaaucuuacaaaauagauuauuugaaggcuguggaauuaaauuacuuagcauagcaguaaauauuuuauguuaagcagacuuauaguuaaguaaauaugccaaagaagaauuuuuaaaugaaauaacauguuucuaaauaauuccaaaauaagaggagaaaauacugaguuuauaaauaaaugaaaagagaacauauuaaaguauaaggaauauagcuaaaguacuagagggacauuuguaucuuggaugcuaauuugagaaaacaaguguuaaggagcuggagaggcagcacacucaguagguaagcgugcguccugcucuuccagagggcuagcaccucacaauugcuuaccuguaacuccagcuccaggggcucuagcuuucuccucuggccucugugugcacuuucccucaugcaguacacacacacacacacacacacacacacacacacacacacacaaauaaaaauaaaucuuuuuuuaaaaagagaagaaaaugaguuucaaaauuaguaacuucaguuucuacuuaaagauaccagagaauaggaggcugaggagaugacucagagguuaaggacacuuacugcucucggagaggucauggguuugguuuccagcaccuacauggcaucuuauaacuguguguaacucgaguucuaucggaucugacaccuauucugaccucugagggcuuuuacauaguacacagacauacauuuggacacauucauacacaaaaaauaaaaguaguuaauuaaaaaauaccagagaaacauagguaaauauagaauaaauacuccaaaggaaguaaaguuuucgugagcuuacuauaucccguaguauaauacaguuucuguccugguuuacagucgagagcaugguggcugcugggaaaaccaugcuugagaggaauaauuucacugacuucacagauguaagguauguacgcugugaguagacgcuaacacugguucuugacuuuucugaagugugugucucaugagaaaggaagcaguggcagaguugugcaucaggugcaccacguccuccuggacgugaggaugcaguucauugaugguaugaacuuaaugaacccuguuuucaugccucaccaucuucccuaaacuucccuaguagcuuggacagacaagucuauacauacaaucgggagguaaaauaggacaaaagaguccucccuuuuugucauucuauauguuaaugccuauaagauuggguaaacugaauuuacuucugcagaccuacaugguuuagaaauacauuguugggaauaaggaguugauuuggugagcaagagagcuugcagugcaagcccagggacccgagugccuagaaaucaagucaaaggccagcauggucuaagcuugccugaaguccaggaugggagcagagagaggaacuucuggggcuugcuggcuucugguauaccuccagauucagagaaagauccuguuccaagauagaugaucaauaaugacagccagccacauauguacacacauacauaccaucauuaggcuucuagccuaaaguuaauuugaauuuauuguuugcugaucaauaauuaaaugccuuucuauuuaaaagaaugagcuuauaaauguuuuauaaauuaggaaauuauggacaaauggcaucuaaauuguuuuaguauuuaacaagaaccuuuucugaugacaaaagcuugguuuuuuguaauaauugauacuacuauggaaguguugguuagugucuggguauugaauuaaaggcaaaagccugacaucuacuggcuaugucuuaaggucaaugaccgcugccugaaugucuaguacguuuauauugaggcucauuuacaggagcauaucguugcagaauucugcuucuuaugguaaguaccagugugacuggaaauaaugcagcucgacauucuagagguugcacaagacugucuuggauaggugcugugaauuguccucuaugaacuucagcgugaaggacuuuggcaauacuuuagcagaaagcagauaguaaaagaucuaugacugggaauugauucaucuuugaauaauuuuaaucuuauuugauuuacauauaaucucagacaccuugagaaguaagucaccaguaaacucuuguguuucagaauggguuuccauguuccuccauucuguuccaucucucaucugcaccuucaugugauagcaccagucaaagaguuuggcuucuuaucaaagcugguuuacaggcaggauuccuacugguuugucacaguaaguaguccugccacagcaacagcaugccaacagauuuaaagugucugucccuuuuuguuuucuuuucuuuuccuuuccuuuccuuuccuuuccuuuccuuuccuuuccuuuccuuuccuuuucuuucuuuuuuccuuuuuuuuuuuuuuuguuuuuuuugguuuuuugguuuuuugguuuuuuguuuuuuugagacaggguuucucuguauagcccuggcuguccuggaacucacugugcaccaccagcugugcgccaccacugcccagauguuuuuguuuucuuuauuguuuucuuuauugcacuagacaaagaguucuguuuggcuugaccacuuaucuuaauaaacugaacccagaauauauauauauauucagaaauuuauuuauuuauuuauucauuuauuuuacacugaaccagaauugucuuaugcuaguaggcaauauuuucuucuggugauuaucucaaccccugaaaugugugucauuuugauaagccuugaaauugggaucuuuuuaccagucuccugagagaauugugauuacagugucaugcuauaauuuccaguuccaaauaauauuuuuaauuugaggaauuuuucugggcaaucugauucuauaagaugagaagcaggacaaauauagaaaagcagagcuuuaagaauuuagaucugggcugguugguaguggcacaugccuuuaguucuagcacuugggagacagagacagagguagaggcaaauagauggcucugugugaguuugaggccagccuaauuuacagagcuaauuccaggagagccagggcuacacugagaaguccugucuccaaaaacaagaaaacaaaacaaggcaaaacaaaaaaaugaauucagaucuagauaaaaauucuggcuuuucuuaauugaaagaucauauacagauaguuuuaaaagcucauguucuuuuugcuuugcauacuaggggacugagugugguucaguuuuuuuauauuuucucugcugguacauauaugcacaguguuucuccuuaccacauccccaccauuguuguaugcuuauuauaaucaaagaaccaauacugauacaucaucucuucccaagguguuagcucacuucaggugccucuccuguugccauauuuccuguagguuuggguagaugcaugacauggaucccacacuguagguccauacagaaucaucuuacuuccuacaaauccucugugcuuugcuaucuguuuuacucuccuucuguuucuuagcuaccacugauauuuuuaaugucuccaaaauuuuccuuuuuagaguuccuuccuuccuuccuuccuuccuuccuuccuuccuuccuuccuuccgucuguccguccuuccuuuuccccuuucuucuuuccuuuguuuuuguuuaugguuuuugagacaggaucucacuguguaggucugacucuccugaaacuuagacugggcugcccucaaacucacagagaucugcaugccucugcagaucccccagggcugggauugagacaugugccacaacacugggccuucagaauuucuuauaauuggaaucucacauuuggauauaacauuuucagagugacuuaugccauuuauuaauaugaucuuguuucuuauaaaucuaguuuaagacauuuuuaauauugcauuuguuuuucuuguagcuuuuuaauauuuaacauuacuuggaaucugccaguuuauauuauuuuauuguaauuuauagaacucuucuauuuucuuuuuguaagguauuuuuagaacagaauaagacguuucucucucuuugguguuacaaggaaaauuaucuaacagguacugauaacuagaaugagccauauauucaugguuuuaaauuuauuuuuuauuacagguugauuacuugcuugaaaaacuaagaaaauaaaaaugugaaccauggacaaguuccuuaccugauucagaagaacuguugguuuguucucuuugcaggcuaauugcagucugagguuugcugacucauacaugacacuaccacugaguagccuuacauuuuuucugcauaucuguuuucugacauaugccauaguuacgugaaaauuuucucacugacuucuuuguuucuuuuuuuuuucuuuuuaaacauuuauuuguuuauuuauguauaugauuacacug

SEQ ID NO: 5456 - RNA, 113588 nt, Mus musculus
gguugcgcuguguagccuagguggauuggaaggggcggagguaaccagcagcggccagugguggccgccgccaguaccccgcccccuccacgaaugcucgcgacacgcgcgccgggagagggcacgggcggcggggcuagcugucuuccgagcucgggaaucgcuaccaucugcugcucugcgaggaguccgcguguucuccgcggugcucagcuccaaaccggccaccauggaggcgcaggcacaagguggguggucgccggucgcccccgaggucugguccucagauguacagagagacuauuuuccuucaguaccuaacuuuacuccgggacagacagggacauccuacgcagacggaacucugcgccuacgcgcgccuucgggauccuuugcuugacucagauuuugcgguggggcuggggaccagggaagggcugaggacugaaaacagaguagcgggucugcagggauuguguccuugucugcacuaucccuuccagcagucagugggccauacuuccucguccuggaagguguucaaaggaccuguuguucaggcuccggaugucugcgcuguucuucccggggaggcguggggagagccggaucuucuggacuccggccuuggggcucaccucuugcaguucacaaaugcgggcgggggugacgcggacccgagagguggugguuuuguggagacucagugucccugcuauucgagggcugcagcgugggaggauuggccuucaaaggcaagagagcuucacauuuccccccaacccccaaccccgcccccgacauccagauugauaacccuaucccaguuuuucguguucuuagaagagucgcuuucccaccccaccccaccucaccccccaccccagccgcacccagugccugccuuaauugaggguuggucaccugcucuccgugcucaggguguucgcuggaggaauccagagaacucuaggaucauucaaaauaagaguaaagggaucuuagaaaggaucagagauugccuuuauuauuauuauuauuauuauuauuauuauuauuauuauuauuauuauaccuaaguucacuguagcugacuucagacacaccagaagaaggugucagaucucauuauggaugguugugagccaccaugugguugcugggauuugaacucaggaccuucggaagagcagucaguuuagagcaggcccuuuaccugccgagccaucucaucagcccagagauggucuuauguggagugagggacagggaggacgaaagcucucggaaauucacuuuggaagcagcacucagaaggaaugguuugcauuaaugccaucaugaccaccuuuccucgcacugaggaauuuuguggugcccuuuuaaauacauaaugcuuuuuuuuuucuucaaaugaaguaaagagauucacgaccucaugcauucuaagggcaaaagcagcucgaaugagggcaguuugggcaguguauaggacuagagccacucaguugguuugcugccaggaucacaauagucugaacagcaugaaccguacuccucuuuggucguaucagccaaggucccgccuggaagcugcagcuuaauaggaaaggagugugcaauuaacuaagcaguuccagacccuggaguuaggcucaaccccaaaacccaaaauggugaacaaguccagauagaugugugggcagugugcgggucaguggaugcagggucacucaaagaagcauuaggaaggaguaagagggauucugcaaaaacccuucuggacuaagaaaaguucauugaggcaggccacauggucaaacaugcguugggggugagagggagucuguggaggaugaggagacugcccagauccugaagaugaggaguguguguggcuaaacugauagagcagaguucuuugagaaaaucuacauguaacaaaagcuuacagauggcccucaggggaaguuccugcugaccuucagcaagcagagagccuugguugcuggucagauucgaaagucgagguccagcaggugccuuugugucugaacugaagcagauacugacaauacuggaguuuucugaccugacuuucagacuagaugcaguuauuucuaaguauugauagagaauugacaccaggacccuuaaaaagacaccaaagucucugcuggagagagagcucagugcuuaagagccuguacugcgcuugcaaaguuuggucuucuacacaacugccaguaauuccagcucuaguggauuggauguccucuucuggucucuuuggguaacacacacacacacacacacacacacacaccacuuacuugaaaaaauauaucaaaauccaaggaucucaaguguguuguauaucugccuaggaccucuuauacauauccagcacacuuucaauaguuuuuggaucauuuauuaaacugucaugcaaauaauuauauuguauuuuuaaagaaaauaaugacaauagagaaaagucgguacacauucagauagguuuuuuucaaguauuauuuaucuguacuuaauuauguccaaguuugaagacccccauggauauggaguuaaguggacugggcugaucccauagcugucauuuuggaaccccuggggccugagccugagaauacuugaaagcuauccacauaauucuauuauccacugagguaggaaaagaauuauaauagcuaaaaagcacccaccugaauucuaaaggcuccugaagacuaagagcccguguaacuaguuugcuuuaucuuugagcaaauauuugagugcuuuugucuucuagacagagcauuaggaacagcgaaaccaggcuugauuucuauuucaugaaaugcacagcagaggaugagaugguuuuauuaauguggcacuuacuucauacacugagauguaaaaccaccacauguuacugacaggagagugagcugcauacgccaaugagagaaucauagacuucagggccaguuaucaauagucaaaguagcuuagucuguuuauuuucucccugucucuacucucaaugcuuuauauguauugauugacaucacgguagcgcccgaggagguaaguugagcugucuuuuccauuuugcagaggagaugagacagaagcuagauuauagauaaacagacauugaguaacuaaguugguacugcgagcacccaucccacucagacccuggaaagauaaaacucuuaaccggaaagauaaaagucuuaacugccucuccagccgcccugcaucacucuccccuugcccucacagcuggauggaacuggauugaacccuaaaugggcauuugcucuuagauucuaaaauaguccugugauguccaagguguaagcuucuaccugugguuuacuugacaguuuucugagcuggaaaugguucucuaccuccucucuuugugccucuaaaucuaaagggaaccaaauguguacaagauuagaccugcaucugguuacuagaggccccuuguugcacuaaggggcguagauauggguuauccaaguagcucagaagugcagaagcaggucuuugaaaggccucccgaaagugaaauucuccacacgcauucuuuugcuuugugaaaauacuaaauuauuuccagcaaaacaagaagacacccuaaggaguuuggcaggauggggacagggggauuaugagugggugaguuugugaaaaggggcucuugaacagcacuguggaguuuucaacccacaggaggccagcacugcuagcugcuuuucauuggcccagagaaguuguccuucacauguuccuggugaagggguuucaaccuuacaauagugugaaagagaugggcauucaguacuguaucacaagcuuaauuuuuaucucagacuugugauucaguauaguauuuauuauggucuuguuaugaauuaucucccuguagucuuguauauggaaugcuucauuucucuauagugauugcaaucauuugagaggugguucagucaugaggacugggcccuuaucaaaguguuaaucuguggaugguuucauaauuugaugacaguacugggaguuggugggaagugggacccagauaaggacauggguccuugagacuuuuccauugaaugggauccugcucuguuuacugcuugcaaugaaggaagcaacugugucccacaggagcucuaacugugguuagagcugaaauugcugaaacuguccauuacagcccaacagcaacagaguaagcuggccaugggccaaaguuauggaaaccacaaaccugaauaauauuuucaugcaacaaguuguuuccucaaguauuuugucauagaaaggagugcuaacuggcccaaaguauuuugaugcuagauuauggcagccagcuacaguuucuagucaaccacuuggugauauaugaaacagaugagcaaugaccuagcuacagugagcaauggugcuaagcucugcuguuuaauaguuuaaauugcuucagacucuucucaugcuauagcauuuucaguuuaugaaauaugcagcagccauuuaaaaaugaaaguuccugaucccagucaacuguuucuugauguuuuuuuccucguaauuaaaauaaccucauuguuauguuucucaggguguuuuauguuugcuuuuaucuuuuguuauuuacuguuguuuuuuauuuguuuguuuuggguguuuuuguuuuugcuaaaaggaaaaccuugcuguuguuuaaccuuugcauaucaaauuacuaguggcuuuagcuuccuauggcuuacaaauugcugcaaacauugcagcugaaacaauacaauucuauagaccagagagacauagugacugagucaacagggcaugucuaugaauccaugcugaaccucuacuggcuucagguguccgaagaagucuugucugguagagguaccgaucucugcuucugaggacgcaggugcagcaugucccccauucuaacuuauaaaaauuugcacuggcauuaagggcucaccuggcuaaaccuggcuaaauuacacagcucaagagccucaaauuagccacauuuguaaugauaacuuuuucauauucauuaauauuugcagguuuuugaguuuagaauuauucagucuacuacaguauugccauuuuucaguugaccacuuagcccaggagaaugcuaaaaguccaugaaugacaugaaauaauaaauacuggauuauuccuaccuguuuccaaauccuauuaagacaacagugucuuauugacuuacucaagacucuugugccaggaaggacuuacaacaacaguuuauauggauauagauaaaacacaaugggucaguauaaauuagaaacgaaugaaaggaaauaaagaaggauaugaacagaaaaugagggcaggaaugaugaugauaugugacauauacacaguuguauaguuuuuacuuuucagaaagugaguaaaaacuuuuuuauagcauucauuuauuuuaugugugugugagugcauguaucagaggacagcuuucaggagcugguucacuccuuugaccaugugaucuccaggggcugaauucaagucaugagacuugcuggcaaguaccuuuauccauuagucaaugaucuaguuccccaaugagugaggauuugcuuuguaaacaacugugccauuuuauuauagaguaauuucuuccuucccugcuaaauaacaaaaggcuucuauaugauuagauuacauuaggagaaauuuaacuuuuuauucaaaaauuucauuucauuucaggcaauaaaauuguaaguuuagaucaauggaauuuaacuguuaaauuuuguaaauaaauuuauuuauuuacuguugggggaugcauauauuguacaguaugccuguggaggucagaagacaaucucugggaauugguacuccuacuauguagauucuagacauccaacucaguuuaccaggccugguagcaaguacuuuuacugcuaaaccaucucauauauguauauggucauauugcauauucuuguugaaauucaagaacaugauaauacagauccuguagacagaugcaacccaucuuaaauuguucuccauaacauuuacuuaguuucuuaauauucugaauaaacagacuuacaaauuucuuccaaaaaaccccuauaaacagagaguccauuuuggcagauaagcuaaacauucuauagcagcuaaugauaauaagcauuucagaaaauauugauuugguuaugagaagcuugaccagauccugucuaauagagaugcgaaugcucgcagccaaccaucagacugagcacagggaccccaauggaggaguuagggauaggacugaggagcugcaggggccuuaucuggcaucaaugggaguggaggcccuugguccugugaaggcuugaugccccaguguagaggaaugcuagggcagugaggugggggcagguggguaggugggagagcacccucauagaagcaggguaagggcuguaugggagaggggguuugcagaggggaaacugggaaagaggauaacauuugaaauguaaacaaauaaaauauccaauuuuaagaaauaaaguagaaacuugcucuuuugaacagaaaaaaacuauuaauuugguuaaauaaauauuccauaaaauauguauugauugugcuaguaauaauacauauggcaaacccuuggcuccaguaggcauuggggcaucuguaguuguuaugauccuggaaucaaggaaaccuguccaaauuuuaauucuaccacccuaaccuuaaaauucagcugauucuggugacguacugguuucucugggccucaguuucuucacauguggacuaaauauaauaggucuaaugugcuagggaccugaggaagcuucagugaguuaacuuaugcgaggcguuugaauggugcucuguacgugguaagcacuguguaaauguuuuuuguggccucccucccaugccaagaccugccugugcauucaguaucuuauggaaauguguaguagcacuguaagguagggauauuuaguuuuaacucauuugcauacaggaaaacugaggucagaaaugaaguaaaaaagacaaaauuaacuccaguucugcugaacaugcgcuuuccuggggcacuccacugucucucaguauggauucaagcacgcuccaaagcuuauagaaaugagagguagcagaguuaagaauucaucaccaugaguaauaguucauagagcaaaaagauggcuuauuuccaucccaauggaauuuuuagaacuaauucacacugaagcuaauaauauuuuagacuuguuaugcccaguucugcaauguacacgcugaagaugagccauuguguuauuaaaaaguuguagaaaauauuuaaucucaaucugaggcuucuauccugucuuugaucauucaguuccuggauaaaagauacacaacuuuuauuauuuacaauaagccuuaauuagcacuaaugcuggacagauaucuacccacuaugcuauuagaaucugcuuucuuaacaauaaccccgaguuuuacuuacuauggcuaaucugggcugcucuuaacucuuaacuggauaacccucuuuggccaugcuuucuugacuccuaacccauguuaucuucucuuuccaccuucuuuuuuuccucauggucuacucugaacucaaggccuguaacaagaagccuaucucaauucugcccagcaauaggcuguagacaucuuuauucaccaaucacaaauaacuuggaagcaagguuacauagcaucacuugagucuauguggcagacucaucucuggagcaacuugggucuugggggccugcauuuaguauuaaaauauauagcaacagaccaaaucucaacaaaaagcauauucaacuuacaaggaugguaauacugcuuucauuuucuagguaaggauauagaauuacaggaugguuacuuaacuguccucaucucaggaaacuuuugaaguguuggagugugccaauguggauggagaaauuucacagggcccuacuucuagcugaagaaauacaggaaauacaggaaaucaauggaugcugagaggcugagaaucaguucuccucuaaggaugagcacucaguggaauguguguauauauauauauauauauauauauauauauauauacauauauauauauauauauauaaaaugcaaaaauuuugaaaggcugugaaagacagacaggaaaggagugggaauggggagauguacaaaugguuuagauacagucacaauguaugaaauucucaaaauauuuuugaauuuaaauaaaaaaugucagagccuggauuugaaaugagcuugagucuguacccgaagguuuaguuacuuucugaaccauccccucauguuggcaugcagaacagucagccagcgcaccaaauugcaauagugaacucacuuuguaguccguacacucagagcuuuugaagggcagaaguuaauugcacuauucguucuguaucuguuuagggccuaggucauagaaucuaaagguaauuugguaucccugagaccucugagaauauucuucauaauauggcugagguuaucagcuuauugcccgaugaaaaauucuguuaaaucgcccaguacgugcuucacagaaauaguacagaauuuuuaccacuagaucuaggaauagucaguuuaaauaguuuaaauguuccauuucuuuaucuaagaaugucaguguuuuuaaauucucucucucucucucucucucucucucucucucucucucucucucucgugugcguaaaugaauguaugcauauuuguguguguguguagcccagcagucuuccucuauucacuguauuuucaaagacagaccucaauguaugcagauggucaccauuacagcuguuucggaauucucaaaauuauucuuggaagccacuugcuaaacacacugaguuaugauacaguuaagaacacaggaaaacugaagguguaauguagagauuccaagcaugccauuucaugcuguagucuaucaaaugucuacaaaguauuauguaauuuacuuaaaauauauccauucaauuaacaauuauuacaggggcuggagagauggcuaagugguuaagagaguacugacugcucuuccagagguccugaguucaguucccagcaaccacaugauggcucacaaccaucuguaaugagaucugauguccucuucugguaugugugaaaacagcuauaguguacucauauaaauuaaaaaaaaaaaaaaauguaccagggaaggcaggguuucuccguguagcccuggcuguccuggaacugacucuguagaccaggcuggccugccucugccucccuagugcugggauuaaaggcgugugccaccaccgaccugcaggcaacaaaccucuugaugcaucugaauaaagcugaagcuaaaaggaagcuuccugucuuucaauaacaauacauuguaaagagguucucaugguguguuugguauauaaauguugcacuuugauauauaagaaguaaaauucccagaauaaaaccacaaaugaacaauacucuuagucaucaacaaacuguuucuauuuugcaagcgacaaaacugguacuuuacuguaaccagaaaauauacuugaaaaugugugagagcgucagaccugucuccaaaguugccggugguuauuuauacccuagacaaacugcauuuucugugacauagauuuaaaaugugggauccucuucaacuccugggaaauugcaaaauaggguuuucuuucaguuagaauuguuuuuucccuguggguuugauagcaagggcaucuucucaggggaucuaggaaguagaaucaauucguuugaaaggaaaggaaauuuugagaugaagggagugagagggagugcuugcagauagcucuguuuuagagucuggguuuuaguuuuguuuuuguuuuuguuuuaguuuuucuuuuacacauacacggacugagagcagcaaugguaggagcuacaaccagacaaacagacaaauaaccaccauacuguauaauucucaacauuccagcuuccaaaacagauuccuuucuacauaaugaccucacagggcaggccaggaggaaaauauaguugcugcccccuguuguuucucuuuaacugcugaaggauuucaggacauucuaggauauuuauguugccugcaaaguuuguuucaaacaacuggaagagauucaaggguugaaaggagugagagacaugguauuuugaauucacuuguuuauaaaguuguuuaucuccuuccuuaagagaucugagcaagaauauuaauuauaucaaggacuacuccuuuauaucuuaccauccagcaucuuagauguaaauugagauuuugauaaccuuuuucuaguaggagaaaguaaaaacccauucauaucuagcuucaucccauguuuaguauacucacuauugaaucuacuugauugcagcaacugaagaauuuguaacaugaaaauaggcaccugcaucgcagaggucugacugugggguagacacagagcucagagccauuguucugcugacucuggacuagcacagagcaugucacccauuccccucagaugaagcccuaaagcaccagauagaacaacacuugucuucucagauacugagagaugucuaccuuggcagagcuuuguucuaguucuguccucagaauucaguguuucauaauaguuuccuauaauaauuacaaauuugguuucuauuugauuuggaaauaaagaauuaguaccugugaugguuuguaugugcucagcccagggaguggcacuauuagaaaguauggcccuguuggaguaggugaguaugggcuuuaagacccucaucauagcuacuugaaagucaguauucuacuagcagccuucauaugaagauguagaacucucagcuccuccugcaccaugcuuuccuggauauugucauacuucuaccuugaugauaauggaccaaaacucuggaccuguaagacagccccaauuaaauauuauucuuauaagaaucaucuugguccuauguugcgguaaaucucuccaauccaguuaugcccccgcaaugaaaacacaacacaauuaauaugaauacaugcugugcgccuagauugggcagaccuaccacuacacuaccaucuucuccaucuaagagaccccuuagaacuugugguuucuccaggccuugugcuucugcucugcuuuucuucuuccuccuccucugcguucucucucucucaaaccuccuucuuuuuuuuucucucuuucugcuccacuuucccuuuuaucugaccaauaagcagcucuccuuuauuuuacaaauuaagguggaaagaagguuuagaggaaaucaccugagugcugacucauuccuuguucauagccucucacaggagaauggaauugacaucaaauauaauuagccccagggcuauccacaacacuuuccauuuucuguccaauuaaaagacuauuuuaucuuagauauaaaugaacauaacuauuacaguuuuguaauuuauaaaguacaagagaccuaacacccaguccaccaucuuuguuaauuaaacagaaccucugucaucuauccuuacuuaaaagacauaauucuacaucuggcuauggcuuggcuuuagauugaaugccaucuggaaaccauccucccagagcuguucuucucaaagcaaaaaagccuggguugacuaggagauuauguaguuuuccaaccccaucagaaauacaagaacuacugauauuaacugaaaauauauaggaagccuaacccagcuuccaaaacuuagucaauguauagagacuacugaucacuuggacagucccuuacuucuacacguuggaacauccgucuuuagccuacuggccagggucaucugacagacuuagagaaauaggaauacuaaggacuagccuacucugccuccacagaaucaagcuguccuagccuguaauuguguccuuucuuuggacaguaauauaucuguagaugaaaugaggcaguucuugcuuacuggcuguuucaccacaacuggaguaacacaaagcuacucaguuucuucuuugaauccaagacagggaaaucugucaggagcagacuagccucaacaacaagugaauaaauaacauuaaaugucacuucuguggacuucugguguuuuugaaaacuaacuaucuauguaaagcaaucuagucuauucucuguuaccuauucucagcuguuucugacuaaaauaacugaaaacacccuaacaauaaucuuagagucaugaauuuccuauuugggcuuuaacucacaggcuuaaaaucucagaucuguuucuaauaacagcaauagaaggacuuggccuuguacuucaaauuuuuuacuaucgaagacaaccuauaauaaccaccccagccccaaagcccggggaacuggaauaaagacucuucauaacuucuucaagcugauuauggacauugagguauuuuugaagagaggggggaagguagggaaaaaugggggaauucauuggccuuaggaaggccacaccaaugauugucucugaugucuguguccugacuggaucuggaugaaaacccaagacaucaggaguucaggcagguccguucagcaugucugaugaugaaauucaccaaggcuguauauucuguaauauauaaaucuaaaaacaaaacaucaauaucaucaaauaaccuuuuuguuuuauucucuggaaucuaguucuucacggggucuccuucuaucaaaucugauccauaugacucuggaaguguaaauacuuuaauuaccuuuuccaaaaauacaaagacaaacccuuuccuuaaauuagcauauccuucaacugguaaccaggaaaaccuguagcuugcccucugucccagaggaacaauaaaacaaccgcaauacucaaaaucacacacauuuuagccuauuuagaccuuucuaauuugucaugucaggauuuuagcccaaauucccuuggaguccacauuagagaauaugagucuccuguagacuuuauuauaccaucuuuaagacauuugauucacacuucuaucuauaccugcuuauguuagaauaugaguauccuguaagacuuauuagagcaauauaucuugauaccaucuuuaaagcaauuaauucaaacuuccacuaauaucuguuauacccucuaucuguuguguucucuacaaggagccacagacauuuauuuaauuaauaccuauuauaauaucuaucuguuaugcucucuaccuggagccacagacuucuauuuauuaauaccuguucauagcaggugauuaucacugcucucuacuuggagucagugacuaauauucccugucuaggucugaaccacaggugaaauuucccaucuuuaaguacuauaccugcuuauaagaggcagcuugucaaacccaaaauucccauggagcccacauuagacagaaugaguaucuuguaagacuuguuagagcaauauaucuuuauaucaucuuuaaaagccuugacuuagccuugucuagucucagaacaucuguuuuugagguagugacauuuaauuguccugaggaagagaacucuucaugucuggcauuggggccugagagaacccccacccccaccccuccgggagguuuuuuuuggcacaguguugucccauuuguuuguggcugcucuacauucccuaguuaaaugucggccucuggcacacauuuaacauauuccauaaggaauaggucccccuuugguauuacuuugguuuuuccugcaauccuuucugagaugaccuugaucagcacaauuaaaacaucugaaaucuuggguguuuggcagcuucuccuauuauagucauaucaggugagugagauccaacaucagcuguauaucuaauccacucaucuauugaugcugaccuugcccucacaguggucugauuacuuccuugcauuuaacauuugcauuuucaaagacuaaagacucaauuauugccuuucuugcugaugaauaugauauacuccuucccagagcugaaguuaaccuuuauaaaaagucagggaagguuucuuguggacauugucugacuugaguaaaugguucaagucuuuucccugauucugcuacuuugucccaggccuuuaaggcugauaaucaacacagugacagaguuucuucaucauauacagccugcaucucuaccucagcaaagugaccuucaccaagcauuuggucuguggaaauuucucuaccccuggcucuauuuuuccugcugucucccucacuuugucuuuccaccauucaaaccauuguaaauuugcagcagguucuaguacugcucuugccauauccuuccagucuugggggauuauucucuuuuuaauagcccaagaagucaggauucauuuuacaauuggcgaauguauuucaaaauuagugacacuuuccuuaaauuuucucagaucuaacacauccacagguugccauucaaauucuugauaacccuguggaggucuuuguuguauauuaacuggguagacuaaaguuuguuuucuaauaaccuuugguuggcuuucucuaauuuuaucuucugccuuuaccugagcauuuuccuuaauugaacauuuaaauuccucccuuaaggucugugucaaagcuucauaucuuuccuuuugucacucuuccuguuccuguauucucuguucaaguuucagccuccacauuuugauuuuuuucuuuauauugcaauucugauagucugcugccuauuuuauuuugauugauuaauuuuaaaagguaauucuccaagucugacuuccaauucucauuauuuccucucugcugcucagucugaucugugagcugcugaauccuuuauucuaguaucuuuucuagcuccugucuccagccaucauucuccucuuucuguugcuuauuucgacuuaugaaauccugaaccuuuaguucauuuucaucuuuuugucucuuauuuuggucaauaauuuccugugucuucaauucuaguguuuccucuaagcuauguugccaagucuuaaacuucucuuucuguuguucaugcuguucuauaauuuccuguauuuuguguucuaaaccgugcuuccauaaucuuagcuucucuuuauguuguaauucuaauauugcagcaucugccuuauuuugauuugcuagcuuuaauaaauuauccucuagacuauguugccaagucuuaagcuucucucucuguugcucagacucaucugugaacuucagaaauuucuguucuagcaucucuuccagcuccugucuccaacccucagucuccucuuucuguugcuuauuuugaccuaugaaauccugaaccuuuaguucuagugcuacuuguaaucucuuuucuaaggcaaggaauuuuuuaucuaggacccggucuuuugagaagacauaguaaaucaagagaauaaauauugccauacugauaaaugauaaggugucuauuuccuuuaaauccaucccugucaaaccauucaaaauaucaucacauaaagucaaaaagauauuuauuguguuucccaucuuuaaguaucaaaagguuauacgugucucuuuaugucaauaaauuaccuaguccggaguccuuugugccuuuaucuccacagggggcugaguguagaaagacccuggugguccucugggucccugguuuggguugcagcuggcagcgugugcuugugugcuaauuucaggcaauccgcagcauaaacaagcagucaggagacccagacaggcuguccucacaggcaguuguguucucuacagguccagggugaggugcugccccuggcugcucucugucugggauuugggggaaggagccugccauucucuauaggccacucagacucagucaauuugaaauccacacugcugcagccuauaucgcugcccaagcccuauucagggauuggaggacagugagcuuuuauuucagguuaauugaguucaaaucaauacguuggcgccauuuuguuuugauaaaucucuccaacccaauuaugccccggcaauggaaacaacacauuaaauaugaauacacgcuuugcaccuagauugggcagaccuaccacuacacuaccaucuuaaccaucuaagagaccccuuagaacuugugguuucuccaggccuugugcuucugcucugcuuuucuucuuccuccuccuccucugaguucccucucgcucaaaccuccuucuuuuuuuuuuuuuuuuccuuuuuccagaucaccuuuccuuuuaucugcccaaucaucagcucuccuuuauuuuacaaauuaaggugggaagcagguuuacaggaaaucacccgagugcugacucauuccauauucacaaccacucacaggagaauggaauuaacaucaaauauaauuagccccagggcuauccacaacagucauggugucuguucacagcaguaaagcccuaagacaguacccguuccuuuuucuccuuucuuucucuuuccacacacaguccacauauuacaccucagcccuaucauauuugacuauuaccaacauuucccuccuuugaguuucaguauccuagcaucccucccucuccccucuuucuuucaggaaccuucuguucuucucuuguuuacccuaagacccuugguuugugguuuuuguuguuguuuuugucguuuguuuaugccuauacucauucuuuuggccaucucuucccgaaauacaguucuggauucaaaguguuaaccauucccaaguauaguuuuuccacccaggaccuugcuccucaguuucaaauguccucuugcuauguccgcaggagugucuaacucacaugcaacauguagacuuccaguguguaaaacucuguuuccaaaguaggcuuagacuugaguagcuuucuuuaccugccacugguuaucccacucuggaacagagcaguauuucucuccuguccucucagaacuccuuaacagguaguuucuuugcuaucucucaggcuguucuuugcucuugaaaucucgacagacaugaucaaaucaaugcucucgcucuuugcuccucuuuugaacccuugaguuuucccccucucucuuccucagcuuuucuccucagugguuuucucaccuucuuugaucccuuuccaguccucucagcaugaccugcagaccuggcagcuggaccccuguucuuggggguggggugggggagagaagcucuccauugguaugccaagcuuaugcccagcuucuaagaauuuaaggcucuuucuuuuauucuucuggacagguuaacuagguugucccauugugugcaucucuggaugacaaaaacuacuuuccuuaagggcaggcuuauuuggagauauggaacauauuuguagcccuuauaugaaucaagacuucccaguuucagugguacucuccuguaacacacaccacuguauaaacagauagccauggccuucaucaauugauuacauuaggcuuuuggagucauagcucagggaacuagugcagugaugcuauuuugacaacugccauugcuagguguagugaauugucuuuuggcuuuagccaaccaagacauuguguuguuuuuaucagcacccacaaagcuagacagcuaauuuucaacuuguaaguacaguaaaauuuggccuuucagaaucccugacccccguccugagcauuuuuuguuaguuccacauccauguaguucuggaugagcuguuguuuaagguaagaacuuuauuuguucaguuugagucuauguucucucuucuagauugugugaaucccauuuccugguuaaacagcuuugcuguguggucaggauuacaagugcuucuauacguagagccuccuggugaauggcccauucauagguuugagaggaaaugacaaacugacugauaugggguccuagaaggaguugacugaacuaaucuaggaauuaguuuucaaaguauguucucuugaccaguaucuuaggcuucaccaagaaacuuguuagaaaugcaaucgugaagguccuuccccaggcuaacugaaucagaaacucaggguacaggucacugguguuugaaugcaugcucuaugcaaguucauccauccagaaccagcccacaugcauauggauagaaugucagccagugcaagacagaaccuugcugaauccuagugucuuuugacuuguguuuuauuugcauauaucccacccugcagagcauagacaaaauauggcuuccucucagccaauaaaacuaacaggccugcugagaugugguuccccuguuuauauuauauagaguaaggaguccagcuuccaagacuagagguccuccuugugagcagaugaguagcuauacuguagaaauuuaccugccaaggaaccccugcagguuaacuuguagaaacuauggcaauguuucuaggaucuaacuaagaaauuaaaaaccugggcccuucaaguagcuuugagaaaaugagucugcuaacagccuauaugacccuugauauagucucuccaaguuaagcugcuaggugaucaugcaaacccuggcagcuguuaccucuagagagacucugaacagagagcucugcuaaguuguuccccaauuucugaccuaaagaaaugaaaaaaaauauauauguugcugcaagcagaagcagcaaccaggaauguaguguaggaguccaugugggaagagagggcaggcugggaaauucccuugagaaccagguuugcauccuguaagcaugauugacaguuuuguccuggcauuucuaggucccacacauuguuuccucccuacacccaggcacauucaauauauccuacccugcccuuuguaguugcccugcauuuaaugugcucuguuuuuaauuuauuuuguucauuuuuuucuucccauaccucccacagguaaguucugaaaggccaagauaauuugauuugguggcugcugucuagucucuaguuucuaaagcacagcuugagcaucucaucgggguucaggcaguauuuguagaacagacgaagccaugguuuucauuugaaaguuagccaguuccuccaagcucugcuaaagucagcuggcucuuacugcugucuuugcaguaucagcgaauugcaugaauggaaaaauaaaugugaggaaaaaaaaauaauuuaaacaaaauccuuaaggagggguuggggauuuagcucagugguagagcgcuugccuaacaagcgcaaggcccuggguuccguccucagcucuggaaaaaaaaaaauccuuaaggaaauggaaaaauuggauuccauucuuugaccucuuuccauuaaaaaaaaaaaaaaauucccaguuuugcuguucuugugagacaaguguucaccugccagaagucuuauugcaugcaacacuucauuucucugggucagucucuugauggugcgcaguagccugggugcccuguguguguaugugugagugugagaacacacuuauagaaggaauccgaaaggaagaaagugaaguguuccucaguuaaucugugcccaguuuucuuuucucucucccuuuaaagacaagacuaugcuuaguccuuuuaaaaugguaggcaucacugccaagagaagagaaggcaaauaaacuccuggcccuuaccuggaugucuguuaagccugacguguguguucugcuucccacauccuugugcuccuucagcagccuuguuuuggaaugacagauuaggcuguaaggccaacauguuugcagacuaugguaauguaucccguaugauuagugagauuucagaugguugcaagugacaaagggggaaaauguuacuaaagaaaaacccucauaccauaaaaugccauuggaagaucccagaaucaagucagaugugagaucaucuuccagagcaaaaucauagcccuucauaacaacccccugucucugucaucucuacaucuguuucugucugucucugucucucuaucugucugcaugucucucuuuccuguccuagcaaaacaaaacaccaaacaaaaauuaauaagacaaaauaucccaacaacauccaaaaccacaugccaaaucccaaguuccucuugcuuugcuugcuuuagggagcuuaaacaucacugauuuagugggugucacagcugaaaaguacacuauuaguuuccccuucuuuuacugaagauaacacaccugacacaaggguuuugguaacugcugccuugauuguuguuguagauuugaaauuucuccuccuauucagccauuuccucaguauguuuuaacuuaccaugucucaguuugcucaucuacaagagagaacauggcaguguuccuaguggguucugaggaaggagcacaaggauccaagagaagugcuugugaugggcugaacacugucacagcaaugaaagaugaucuuuuauuaauuccccaugcaguguuuauugaacagcuucugugcuggauccuaaaguaggugugagauggcauuagacaguugugcgcugccaggugggugcugggaauugaacucaggaccuuuagaagaguagugaguguuccuuaccuuugagccaucucuccagcgucccuuccuccauuuuuguuguacacacuauguauuaagcuccuguuuuaaauaauauuuuuucauaagaaaacucccuuggauuugcauacucuaccuaccccaaugguaaggggguaguugaaggaaaaaugaauagauugaagguagaaauagauacaaaugcuaaugaaguucagacauuuggccucuaugcaagauuucuuuuuccagaacauuaauuuuacuuauuaagcccauugaaauuugcuuauaagaucauuuuuuuaacaugguuacuacuuugggucuuuuauuuucuaagaugcuaaagauauaguguucaucguuuagacauuuugugcgagaaugggcacauuggauguuuugaucacauuauauugcuuaucuuacaaaaauugaauaaugccggaguggaacagccagagaugcucauugcuuuccuucacaguucccauuucuacucucuccugacucagguucacccaaucagugugcugccuacugaguaaggugcaugcucuggaugguaggacaucaagcauccugguaucuguugcuuagcagcaugcugaggccucugaguguucugagaacaucuaaugacaaauugggaaggcagcucuggcuaugucagauauuucaaaucuaauuauaguaacacaaaccuuuuaauauguauguuugcacacauagguauauguguauguaguauauaauguaugcacauacauuauaaagccuuugcucugacuuuuucuuucauuaguuggugauauuuuauauuauauacaauuauguguuugccuuuccucuuguauagaaaauaggcucaauaaguauagauaauuuggcaguuuucuuuuauugauauuuccucaauuuagcuagaacaaugauuggcucguggaauauacuuguuaagugcuucuaaaaacaaacaaacaaaaaaggaugaaaugaaaaaugaaugaaugauccuuaaaggacagaaucacaaagaaucacaguagcuagggacaggauaagaaucuuccaacuccugaauuguuuaaaacauuauuguaacuuuuuauacaaagagcuccuaaaauuaaagauaacaaauguuauuaaugugccacaauaguauuuagagucuuaagggcuguuaagguggcucaguggguaaaggcuaccaagccugaucaucugguuuugauccauggaaaacaaaugguagaaggaaccaaaacucuuaaaaguuguccucugacguccacaggcauguacaacacacacacacacacacacacacacacacacacacacaaucucucucucucuaaauaaaaacaaauaaagaaugaaaaauuaaacuacagaaaaggaggcauguacaacacacacaugcaugcacacauauacaaaauaaauaaauuaaugguguaauaacaaaauuaaacauucuagaaaaggaacuuucaggaggugucuaguggugcaggcuuucaguccagcugcuuguaggcccagggaggagaaugaggcaggagguuuuguuauagagugaauucaaagucagcuugggcaacuuggaaggaugcugucuggaaaucaaaacacaauuggcauauuagauaauuugccuagcaucuacauggcucuggguucaaucuucaguacuugacaaagacaagaaaaaagauaaaagaaaggaaaaauaaaagaaaaguucaguauucuacuauuacauguuccugauagugaaaucuugaagacaauauaaguugggaguugggauauuaggauaaacccuauccaagaaacaaaacaaaaaacaaacaaacaaacaaacaaacaaacaaaaaaaccagugagggugcuauguaaaaguuaagagguaaauauaggaaauggggagagaaaaaucugcaaagaugccuuugugggagaaaaagaaacagaggaaauaggucaagcuaccucaagacugaaaagagaaauuugggcaagagaugauaugguggucucugggaaacucucugggcugacuccaccuuccucuugugauguuaguaaauucugauguucacuugagcaguugugggcuuagagucuaagagcacaaaagaaaucacuggagcgcuguuguauaauuuacuaauaaggguaccucugagaccuagggagguauuaaugaacuuauuguagcuguacuuucuagagagcagcuauaaauauuaaccaaaaguaugagaagggcaaggagacagacaggauguuugacuucugcagugagguuuacuugucugggcauuguagaaaaccauucagaucggaucaggaccuucuugcaagugggguacugaaaucaagaagcaccgacgggcuugagggaagcaugaaaauguuguagaagcacaccacacucucacuuuucaugacacauaaggacaagcugccuucuuccagagucgugagcugaaguuauuagccacuugugggcguugcauuuucggggagaauggggugaagaugagugaguccuccucuaauaguagcagaggagugcugagggagugguugugggagcuaguuuaagguagaaagggaggggaccugucaacuggaugugagacuguauuccaggcauuggauacagcuucuucauuuaaaaaaaauauuuuauuuauucuuauguguauugguguguuagcuacauguaucucagugugagguuaccagauucuauugaacuggaguuauagggaguuaugagcuaccuuaagguaccaggaauugaacuugggucuucuggaagagcagccagugcucuuaaccacugagccaucucuccagcccuggcuauagcuucuuaccuuuggcuuuuuuuuuuuuuuuuuuuuuuuuuuuugccuuugcuucuggaguagauacaauggcagauacaguaaccucauugaagaaucuuagggaguuagguggcuaagagcccaagauuagcucucagagggucuacaacccuuuuggcucuguggucuuggacaaaagcuauguauuguuaucuagaacucuauguaaccuccaagacucagcuaucuuguaggcaaggguacuuuccauuuuacacauuccuauagaaugugaguuacaugugugagaaacacucacaauuuacuguauauguuuauuuagcauguaauuacacaaguauuuaugugauagagauuaagaagauaugggaugccugugugcucuuuuuauguaguuuaugccaaugacaguguuagaaacuuaggacaaacaagcagacaaaguccccuuuuaaagagaauuuccaauacaaauaguucuuagaaaauaaagccaaaauagaaaggguauuuggauaguaauguuuuaugagcauaaaacuucaguauccagaaaauucuaggaaggacagcuaugauuagggauauacagaaaguguacuucgaugccuagaaaauuccaggccagcacacuaggggaaggauauuuaaaaaguggaagauucuaugauggccagcuggggucagggauauggaagagaaaccuugacaaggugauuccagagguggguuuguagugagaaauggucgacuauaaauauuugaaccagauggaugaaaugugaccagcaaaguaccuuaaagagagcagcagugugguugcuuuuccucugagucacugaaagaccuucagagaaagacuuugaauaaaaccaaugaaugauguuucacuggguugugugagauuaaaauauuuuaaaaagucugugaggugacuaauauggaacaauaaaagagaucucauaucccccaccucucacaaaacucaauaacuagcaacuugguuggcucugaaauguugauuaaauguaaaugaaugcugauagugauggagaagguguaauauaaagccauguaagcacucaugagucuacaacuccaaguacuaaguuauuguuuugguaaagccuuagagcaauggagcaguuuucaaccuguggguugcaacccuuuugugggucacauauuagauauccugcauaucagauauuuacaugacaguuaauaacaguugcacaauuauaguuaugaaguagcaacaaaguaauuuuaugguugagggucaccacaacaugagggacuacaaagggucucagcauuaugaaaguugagaaccgcugcauuagaaaagucugugaggagaaaauaggaaacaucuaucagucggucucacugcuggggcuggaaucuaccuagcuguuuuaaacaggaaguaaucuguaaccaagccauccugaauggucucaggaucauugcccaacugaaacugaagauuuagauuaaacuuccaugaccaguucucagugcuagucuacagaauuaggacccucuguggcugcuggcauggcuguuacaaagcuguuaggaucagcaagucauugucugcaggaucugccuaguucccaaguggcgacuucugccacuggcuccagaacugugcugugucuccgugucaguacuagaaacugagagaucacaccuuaucuuuggcaucuauugcuaaggucaagacacuggaaacccagccacagagcauugaugucaacuucagugugcuuggcuguaaaaagagcacacagggcuggcgucaagcaagucacagagaaggaaucccagcugaaauucugaaggugcuaauaggaaagcugguuggcaauaauguaccuggaacaguuagaauuuuguuuauaugugacaaccauuaguuucacuguagugcuaauauuugguguuuugauuuuaggagauuuuaauuuacuuauagccuaguuuguuuucuguugcugugacaaacaccaugaccaaaagcaacuuggggaggaagagcuuuauuucaucuuacagcggauggauuucccuuccaucgugaagggaagucaggguaggaacucaagucaugaacuuggaggcaaggacugaaacagggaccauggagaaagucuucuuacagacuugcuccccauggcuugcucagccugguuucuuccuuuuucuuuucuuuuuuuuaauuaacuuauuuauucucuuguauauuauaucucaaccacacuuuccucuucuuucucucccucaaguuccucccucccaccaaucucuccucuucccacaauucacuccuucacuucccuucagaaaagggcaggccuuccugggaucccaaccaaacauggccuauaagguugcaauaagaguaggaaucuccccucauauuaaggcuggaagaggcaacccaguaggaggagagggguuccaaaagcagacaaaagaguuugagauauccccugcucacacuguuaggaaucccagaagaagaccaagcuaaacaccuguaacauauauguaacauauauguaacauauauguagagggccuaggucagacccaugcaucagccugcuuucuuaauuuuuuuuuccccuuguuuuuuugagacaggguuucucuguguaguccuggcuggccuggaacucacucuguaguccaggcuggccuugaacucagaaauucacuugccucugccugccaaguacuaggauuaaaggcguacgccaccacugccugcugcuuucuuguauaauccaggaccaccugcgcaaggguggcaccacacagucaauccucaaccaaggaaacauaggaaccugagacuaacaaacuagaacaguccaagcuuaagaagcuagaaaagaauaaaagaaauggcuugguucauaaaaguguguuuugaggauauaaguuugaucuccagggcccauguaaagagaagcugagcuugcugacacacauaauuccagcacuggagagucagagacagggggaucacuggggauagcuagccaggcaacguagccuaguuggcaacuuccaugaaagccaaugucucaagaaguaaaguggggguuauugagauaccugccauugacuuaugugaaugcauagguaagugcaacccuauacacacauguguacaugcacucauauacacaaaacaacuuguaaagcguggcucggguagggcacagagauuguucagugguaaagcauuugcuuggaaaacauaggaauuuggagcuuuaguagccacauaaaagccaggcaggaauagugacucucugaaaccccagcacuguggagguagagacgggauuccuaagcuaagguaaguugguuagcuagacuaguccaguuggcaggucccagguucagugaaagacucaacaagagcuauaugggaaggagaccacauguucacauguuaaccucuggucucuacaaucacccacacauacacaaacacacacacacauacacacacacacacacacacacacacacacacacuaucaugacagggauguugcucaguguuacugugauugcauaauaugcgaaagcuguggauucagucucaagcaugucaaaaaauaaacaaauccagacaacagauuagaguugacggcagaccuuagauugccaacccuugaacuagaguaagcauacaaguauauaaacuaccaaaaugaugaccuuaaaccauagcagacuaaucaguaacuuuacuuaguauagucucucuuaaagcaccaacaaaaguguuucuguaguuguauuaagugcgauuagacugaggaagacaaauugugaauguaaacagagcaacuaguagagauuguccugggggcuauugauauguauuguucuagcuucacaucugacauugggauaaaauaucaugaggaaaagcaacugaaggcgaaaggguuuuauuuggcuuauccuuacagguugcaguucaucauugaggggaaguuaaggcaggaaaccaggcauugaaucaugacaucuguuggccauggaagagagaaugaguacauauacacucuugcuucugcuucugcucagcuagcuguccuaacucuuaugcaugccaaggauuagucuauggaaucaugccaccaacauucaacauuccugccucaauuaacucugagacaugcccauaggccagccugaugauccagauaauuccucacugagauuacuucuuuucaggugacucuagcuugugucaaauuggcaauaaaaacauaccagcacaagaguagucauuaucaucaaaacugagacacugacaccagaacagucucugaauuugcuagaauagaauguauguaauagagugggaggaaauucuagcuuuaucauaacuggcuggaaaaaaucaguuugaaguuuggcaaagcaguacaugucuguaaucccagaccucaggagaaagaaacaggaggugcaacaugcucuagggaacuaucccaaaagcuaaugacugucuacaggauauguucuucuaguugggcugccuugucuagcuucaguggcagaagacgcagcuagccccacaaagacuugaugugccaggaugggggaauacucagggggcucccauccacucaaaugaaaaagggaggggcguggagggaggauggggggaacagggagggggcagugagugggauguaaagugaguaaguuaaaaaaauaaaauaaaagcaaaacgccaagcaaaccaacauucucaagucugucaaaggaaaaaaauguuuugaacuaaauaacaauuauguauauuauuuuaaugacuccccucuuugggcaaauugcuaacauaauucguugggggccacuagagaccauuuguacacucuguccaaauacaggaguugugugggucguaaacucaaagaugacugauguuuaaguccuuaaaguagaaagccugagucacucucaggccucaaaggaaagugauguauuuuauguuuaaccagauguggagcaaagauuuucagaauguccaggugggacaguggacuuauccacucuaccuuuuauaguaugccaaauuuaagaaacauuugugaauauucacuuggaagcaaaaucuauuauaaacugccuuggauuuuaguuuuuaaucuaacauuuuuucccugcugauugacaucagugccuuugaucucgugggcauuguccaaagugaauccaucacauggugagugcaguugagaaccucucccugcuuaguauuuuuccacaagcuuccuuucaguggccuaugguuauuuccuuuccacucugaaguccuuccaaaucugauacuggggcaagguauuuuuauuuccucacuguaugaauauuugaaguaaaauaagccauuaaaaaaguuauuuacugagcacccuucauagaagaauguaaaguagaaacagcagcaauaacauucaggggcaaaaugcagaacaaagggcacagcaaggugcaaggaggcaagggauuaacccuaaccgcaagccucccacuguuggucccuuucuagaaaucucuacauaauugaaguauuauggauuagaacaaauagaacagagaaagcucucugcuccuaggucacuugccguuuccaucuguaacugaauguuuaacuguggugucacuuacaguaccagaauagaaauagccucccacuguggacggcacucuggucauaauuugaacuuucugccagcugugucuuugugaguggcaggacucaaugugcuuucuuugguugguuggcuuggugugugggacucuacaaauauaacauauuaaacuuguuaaaguugaccacccagagugaaguaaacuauucuugcuauuucuccauuucuguagugcaguuuucaguugauuuccuggguuauacuguuugaaaacaauacugaauuaaaaugguacaugggagucacccccagaaguuguuagcaggcagcccaugaaaccaacgcggucaguguauaucagcauggcugaaaguaucaguugcucuggucuagcauuuucuuguuaaggaaucaauaugaaacuauguauccuuguucccucuaccuacacacuggauucagugugucacauggaaucuugcuaugaccuuaaauucaaauuauggguuucucccuuuaaguucuucuuugcaggcuucagauuuuguugguggugacuuuugcaccauuauuauuuaguucagucacauaucuugauuuucauuaauauucugaguuguauuuccuacugcauggauugauagaaacaaacuccccuuugcuacuuggaucuguuaccuguguauuuaugugugcgcacagguguguguguacacaugugcauguguguagaacaccuacauguaaaaauggguacauauaaacaauuaaaacacauguagcuauaagauauaauuaguaaaauauauguaaaaguguacaucuaggcauagauggccuucucugucuucugagugcagcaugaguguuggaagaacagaaaguggugugcacucguaauauaccaccuucucuuugugcagcugcuaggugauuuucuggggggaacugagggucugugguagaggauuuguuccagcucugacagagcuuuccaggucuucgcuuuucuggagaacccugucaguguaguuuagagguggauacuuuagauaucacaacucaaacucagaauucaaagacucuuuuaaauauuaggggaaagaacaacaaacagcuaguaacaaauuagaacagucugagaccauuuauggacuagguuuuauaaucuauuauaagauuaauaguaagugugacauuucuuuuuccauugcaaauuucaaccucaugaucaguuugaaauggcagcugaaguuacauucuuggcauuucuucaguaugucagauaagaaaguguguguuugggggugaggggagucucuuuaaaacucuggaaacuguuggcauguuagugaaaauguagucacaacuauccagggagcugaggccagagauacccugagacccaacaguucugagcaacauaaagagacccuaucucaaucaacaacaacaaaauaaacaaaucuccauauaugucugaagcagggcaguugagcugauucuaacuccucccuaggaagcuguuuuuuacugggguuucauaagggcagagcaacuggcucaacucaaaagagcucugcaggauuucucaaaucacuccuggucuugaacugguacagaagucucucugcugucacccuacuccaguguccugauggcacuguggcagcuaaguaaguugaggucucucuguuuuucacaucucucuaacuucaagagcacuuggguccugccuguuauaauguggacugugucucugagaccuaaaauaaugcugagccaaaagagguacaucauaauauuuuuauauuaaaaucagugaucuugaacauuagcugaccaucagugucacccacagagaugaaaacacaugcaucuuuaagauugacccucaaagguuccaauuugguaggucagcaaugaugcucuuaaaguugguuucacauggaugagucauuaaagacuuuugacgacaaggcaaacuaagcuuucuauagcuuccaaagcugaggauauuuugaagguucuauguuuuauguuuucaucucauauuccuugugacuguugaagagagaagaauaaaugaaagaugaaauugcacugaccccagaaauuucuagggcagauccaaacuuucuuucuuuucuuuuuuuuuccccaaaacuauccaguuauuagcuggagaauucaaacacaguaacuagaaaauaaauuuggaaguuuuauauacauuuuagguacaaaaagggaucaauaaaaauuauuuuuaaauugauuuuuuuauuaaacuaaugaaauuuacuuaaaaauauacaacucaguauuaacauuuuuaagucaucaaaauaauuuauaguaguuaaaugccucuuaaauauacaugauaucuucugaagcuaagacuaauacacacucaaccaguuuuaaaaaucuauuuggaacauuaaacaugauagaaguagaaaaaagcggcuggaggaaccuguguugucgcaucggugaggauggcccuggagacgguaccgaaggaccugcggcaucugcgggcuuguuugcugugcucguuagucaagacuauagaccaguuugaauaugaugggugugacaauugcgaugcauaccuacaaaugaagggcaacagagagaugguuuaugacugcaccagcucuucauuugauggaaucaaugcgaugaugaguccagaggacagcugggucuccaaguggcagcgagucaguaacuuuaagccagguguauaugcuguguccgucacuggucgccugccccaaggaaucgugcgggagcugaaaagucgaggaguggccuacaaauccagagacacagcaauaaagaccuagcuaggugcaggccauagcaucuuguucuucacuucuguacuuguuuucuuguggaacuaaaccggugggaccccaaagacuccccgcccuccaucuccgaaucagcagacuccucgaaagcagcacaucggccuuaagucaucucacuuucucugcccacuggugaagugggagugucugggcggauucucagaggcugugucaacagaggaagaugcugauuucccaccuguguucaggguuuugccuuugucuaugggcaggacuuugguucaaauaccaauaaagcgagccuuuggaacauuaaaaaaaaaaaaaaaaaaaaaaaaagaaguagaaaaaaaucucuuaugaaguucuguaugaaagaaaauuuugacaagauccugauuagacagaaaccauuccaucuccaagggaaaauacaguguaaauggguaauguuccuuguguuucuaucuuguggaaaaguuugaugagaagugguauuaggucuucugugaagguuguauagaauucuccacuaaacccaucggguccuggauuuuuuuuuuuuuuuuuuuuuuuugguugggagacuaugaaugacugcuucuauuucuuuagggacuaagggacuguuuagauggauuaucugauauguuuuaaauuuggcaccuagugucugccuagaaaauuguccauuucauccagauuuucgaauuuuauugaguauaagcuuuuguaguaggaucugaugauuuuuugaauuuccucaguuucuguuguuguggcucccuuuucauuucugauuuuauuaaauuggacacugucucugugcccucugguuagucuggcuaaggguuuaucuaucuuguugauuuucucgaagaaccagcuucugguuugguugauucuuuguauaguucuuuuuguuucuaauuaguugauuucauuccugaguuuaauuauuuccugcugucuacuccucuuggauauauuuacuucuuuuuguucuagagcuuucaggugugcugucaagcugcuaguguaagcucuauccaguuucuuuuagaaacuggcaguuagagcuaugaguuuuccucuuagcacugcuuuuauucugucccauaaguuuugguaugaugugucuucauuuucauuaaauucuaaaaagucuuuaauuucuuuguuuauuucuuccuugaccaaguuaucauuaaguagaguguuguucagcuuccauguguuugagugcuuucuuuuguuuuuguugguauugaagaccauccuuaguccauggugaucugauaggaugcauggaauuacuucaggguuuuguuuuuuuuuuuuuuuuuuuaaucuguugaggccuguuuugugacuaauuauaugguccauuuuggagaagauaacauaagauguugagaagaagguauauucuuuugcuuuaggaugauauguucuacacauaucuuuuagaucuauuugguucauaacuuguguuaguuucacuguguaucuguuugguuucuguuuccaugaucuguccauugcugagaguagggugguaaaguuucccauuauuauuguguggguaugaugugagcuuugagcuuuaguaaaguuucuuuuaugaagaaacuuuuuuuaagggugcccuugcauagauguucagaauuaagaguucaucuuaguagauuuuuccuuugaccaguguuugugugacugucuucuuuugguuuuguugaaagauuacuuucuugcuuuuucuagggcuuuguuuuccuccuuguguuggaguuuuccauuuauuauuccauuuauuauccuuucuagggcuggauuuguagaaaaauauuguguaaauuugguuuugucauggaauaucuuguuuucuucaucuauggcaauugagaguuuugcuggguauaaaagccugggcugauguuuguguucucuuagggucuauaugacaucugcccaggcucuucuagcuuuuguagucucagguaagaauucugauguaauuuugagaauucuaccauuauauguuacuugacccuuuuccauuacugcuuuuaaaaaucggucuuuguuuugugcauuugguguuuuaugugcauaugguauauuaugugaggggaggaguuucuuuucugguccagucuauuuugaguucuguaugcuucuuguauguucauggguauuucuuuuuuuuuuuuuuuuuuuuuuuuacuguuuuuuuuccauuuuuuauuagguauuuagcuccuuuacauuuccaauacuauaccaaaagucccccauacccacccaaccccacuccccuacccacccacucccccuuuuuggcccuggcgcuccccuguacuggggcauauaaaguuugcuuguccaaugggccucucuuuucagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccauuagcugacugugagcauccacuucuguguuugcuaggcccuggcauagucucacaagagacagcuacauuuggguccuuuugauaaaaucuugcuaguauaugcaauggugucagcguuuggaugcugauuaugggguggaucccuggauauggcagucucuacaugguccauccuuucaucucagcuccaaacuuugucuuuguaacuccuuccauggguguuuuguucccaauucuaaggaggggcauaguguccacacuucagucuucauucuucuugaguuucauguguuuagcaaauuguaucuuauaucuuggguauccuagguuuggggcuaauauccacuuaucagugaguacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccaguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauauuggauauuaguccccuaucugauuuaggauagguaaagauccuuucccaaucuguugguggucuuuuugucucauugacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucaauucacauucuucuacacgauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcucuguaguaaagcuuuaagucuggcauggugauuccaccagaaguucuuuuauccuugagaaaauuuuuugcuauccuagguuuuuuguuauuccagacaaauuugcaaauugcuccuuccaauucguugaagaauugauuuggaauuuugauggggauugcauugaaucuguagauugcuuuuggcaagauagccauuuuuacaauguugauccugccaauccaugagcaugggagaucuuuccaucuucugagaucuucuuuaaugucuuucuucagagauuugaaguuuuuaucauacagaucuuucacuuaguuagagucacgccaagauauuuuauauuauuugugacuauugagaaggguguuguuucccuaauuucuuucucagccuguuuauucuuuguauagagaaaggccauugacuugguugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaaguggguagccuugucuagucccugauuuuagugggauugcuuccagcuucucuccauuuacuuugauguuggcuacugguuugcuguagauugcuuuuaucauguuuagguaugggccuugaauuccugaucuuuccuaaacuuuuaucaugaauggguguuggaucuugucaaaugcuuuuucugcaucuaaugagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguugggucuuucugugguuuagguaucagaguaauaguggcuacauaaaaugaguuggguagaguaccuucuacuucuauuuugugaaauaguuugugcagaacuggaauuagaucuucuuugaaggucugauagaacucugcacuaaacccgucugguccugggcuuuuuuuggcugggagacuauugauaacugcuucuauuucuuuaggugauauggaacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguauuugcucucucccguuucuucuuggaggcacucagagcuaugaguuucccucuuagaaaugcuuucauugugucucauagguuuggguacguuguggcuucguuuucauuaaacucuaaaaagucuuuaauuucuuucuuuauuccuuccuugaccaagguaucauugagaagaguguuauucaguuuccaugugaauguuggcuuuccauuauuuauguuguuauugaagaucagucuuaggccaugguggucugauaggauacaugggacaauuucaauauuuuuguaucuguuaaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccauugaagaaagugguguguugaagucucccacuauuauugugugaggugcaaugugugcuuucagcuuuacuaaagugucuuuaaugaauguggcugcccuugcauuuggugcguagauauucagaauugagaguuccucuuggaggauuuuaccuuugaugaguaugaagugucccuccuugucuuuuuugauaacuuugaguuggaagucgauuuuauccgauauuaaaauggcuacuccagcuuguuuauucaguccauuugcuuggaaaauuguuuuccagccuuucacucugagguagugucuguccuuuucccugagauggguuuccuguaagcagcagaauguuggguccuguuuguguagccaguuuguuagucuaugucuuuuuauuggggaauugaguccauuguuauuaagagauauuaaggaaaaguaauuguugcuuccuuuuauuuuuguuguuagaguuggcauucuguucuuguggcugucuucuuuuugguuuguugagugauuacuuucuugcuuguucuagggcgugauuuccguccuuguauugcuucuuuucuguuauuauccuuugaagggcuggauucguggaaagauaaugugugaauuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaggcuucuuguauguucaugggcaucucuuucuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugauuaggauccuuuugcauuuuguauuuucuuugacuguugugucgauguucucuauggaaucuucugcaccugagauucucucuuccauuucuuguauucuguugcugaugcucgcaucuauaguuccagaucucuuuccuaggguuucuaucuccagcguugccucgcuuuggguuuucuuuaucguuucuacuuccccuuuuaguucuaguaugguuuuguucauuuccaucaccuguuuggauguguuuuccuguuuuucuuuaaggacuucuaccuguuugguuguguuuuccugcuuuucuuuaagggccuguaacucuuuggcagugcucuccuguaauucuuuaagugacuuaugaaaguccuucuugauguccucuaucaucaucaugagaaauguuuuuaaaucugugucuagauuuucgguuguguuggggugcccaggacuagguggggugggagugcugcguucugaugauggugaguggucuugauuucuguuaguaggauucuuacguuugccuuucgccaucugguaaucucugaagcuagcuguuauaauugucacuguuaagagcuuguucuucaggugacucuguuagccucuauaagcagaccuggaggguagcacucuccuuaguuucagugggcagaguauucucugcaggcaagcucucuucuugcagggaagguacccagauaucugguguucgaaccagacuccugacagaaguuguguuccacucacuagaggucuuaggauccccuguggaauccugugugggcccuugcgggugucaggcgacuccgcuggcaagguagcccggggcucgaguggagcauuaggggcuugugccccagaucaggcccggguagccugcuucccuauguacauacagcagucucagguuccgcgcgauuggauuggggcaggcgcuguguuccacucaccagaggucuuaggaucccguggggaguccugugugggcccuugcggguguugggcacgacucugcuggcaagguagcccggggcucgaguggagcggaaggggcuuguuuuuuuuuuuuuuuuuuuuuuuuuuuguuaaaauuuauuuauuuaucauauguaaguacacuguagcugucuucagacaccccaggagagggcaucaggucucauuacggaugguugugagccaccaugugguugcugggauuugaacucaggaccuuuggaagagcagccagugcucuuaaccacugagccaucucucuagcccuagguauuucuuucuuuauguuagggaaguuuucuucuacaauuuuguugaagauauuuacuggcccuuuaaauugggaaucuuugcuuucucuuauaacuauuauccuuagguuugguguucucauuguguccuggaguuccugaauguuuugggugaggcacuuuuucuuugacuguugugucauauuuuuuuuuauaguaucuucugcaccugagauucucucuucuaucucuuguauuuuguuuguggugcuugcaucuaugacuccugaugucuuuccuagguuuucuaccuccaguauugucucucuuugugauuucuuuauugcuucuauuuccauuuuuagauccuggauaauuuuguucauuuccuuccccuguuugguugugcuuccuguaauucuuuaaaggauuuuuguguuuccucuuuaagggcuucuaccuguuuaccuuuguucuccuguauuucuuuaagggaguuauuuauguccuuuaucaucaucaugagaagugauuuuagaucuggaucuugcuuuucuggugugaugguguauccaggacucgcuaugguuggaaaacugaguacugaugaugcaaacuaaccuugauuucuguuguuuauggucuuaccuugccuccucccaucugguuaucccuagugcuaccugcccucacuauaucugacuggagucuguccuucuugugauccugguugugucagaacuuuucagagucuagcugucucuuuaauccugugauuuugagauucucugguccugaacuccugggagucaagcugccccugcaacccugagauucugguguggccaagcuccugugauccugugauccugggcauauuagagcuccugggaguggagcauccucugguuguugugggacuggcuguggaguuugugcccaaggucuacucagggcacuggccuggaccagaauuauauccaaacuuucaguuaaugcuucauuaauauaggggauaacuuguguuuuaugcaggaaaaaccuuugcugacugucugaacagugaccacaccaacagacaugcuaauggagaugggggagcucagaggaccugucauuugcugugauaaaacacuauaaccaaggcuaucuauaaaaaaaaaagcacuuaauugggcuuaugguuuuugagaguuagaguucaugauagaacagcaaagaaauagcugagaguucgcaauugaugcacauccuccaggcagagaggccuaacugggaaucacacugggaaucuuuuagaaccucaaaaccaauccccagugacacaccuccuaaucauuuccaaauagaucuaccuacuggggaccagguauucuaauacaugagucuaugggggccauucucauucaaacuaccauagggcuuuaccucuagaugcauagcuacagacaauuaacuacugcugcaagggggggggagagagagagagagagagagagagagagagagagagagagagagaaugaaugucuucccugugaugagcccacuaauuaguuauccaauaccaaaugcucaucccugaaauuguauauacauauaagcaacacuaaauggauucagccaguugcauauuuguguguguguguguguguguguguauacauaucaaagaaaaauaggccaugaauuugagauggaauguggguggauguguaaggaauaggaaggaggagaggaagggguuuauguaauuauauuucaguuuuuaaaaagcugugaacccccaaaagguuuggcauauuccuuaccaauaaagaaaaugcaaauaauuauuaucuggacuuauuucuccauguaaaauugauaaucaucuauugcuuucacguauuguguguuuguauguguauuguauacauguaugcauguaugguucaggaagguugcuugugcauguuaguauagauacuaaaggugcuagaggacagcauguguguguguguguguguguguguguguguguguguguagagagagagagagagagagagagagagagagagagagagagagaaagagagaugccuuucucuaucauuuuugagucagauucucucacuggacuuggaacucacuacuuuggcuagacugugaccagcaaaccccugggaucuaaaccaguacaaacccuuuacccauggagacucuugccaucucaaccauagacuaauuacuucuaggaaauauacagccuaaugaaugaaaauugaguuauauuuucuguuggcuuauauaaaguacaugauauuuccuggaaaguggauggaacugaaaaucauccaacuaugcaaauaugcgagauucaggaagauauauuuuuuuaaucuuuguacagaauccucccauguacagaauccagauuuaauacacacaugggguaugaaaauagaaauaaaaugggaagcuagagggaggaagaggucuuaaggaagugauggaggaagaacggaagcggaugugucacauucuuauauguggaauguauguuaaaauauuuguuugcaugaaaucaggaagaggacucuguggaagagaaaagggaccaaugugcugggacaaggcauggugauguggaugaauuagagcaaagugcaauuguguacuuauaggaaaaugucaagggauuauuuuguaugcugacuuuuuaaaaguuccugauacuuaacaacuugaaauaggugcucgcuuuuaccauaagauauacuuuaggauuuauuugauucuguuaaaauauaaaacacauuugccuugaaagagaauuccccuuuucccugcacuuuuucauugguaucagacuauucuuagguucugcacaucucuugucaccaugguaucgaagcagacuucgagcuaugacauguugucaaccugauuugacaccuaaggcacagaggugagaguugguacgaaucacucucagaaccauuuagccaaugaguaaccagguguagccuucucaucccuuccccuuagcauuacagguaaugccacaucccaaaaugauuagcaagaagaaacaacaccagaaaagaaauacgccucaaaaauagcugaccaggucugagcuuucaugaacaugcagucucucacugguggcagaaaaagauguccucaaucuuuucugugccacaaggagcuauguuuaauuuauaauguggaaauguuuccugaaacagacucauaauuguucccacugaaaauuuuagcccaccuuccucauuccuuggugagaaaagagcugggaccuuuuucuuuaaguaagccuucuucacagaguccccagcugcagcccuuuuccauaugaagaucuuccuccguccuaucacuuuggccuuccaggccuuuucauuauuuccucuaugugcaguccauucuccuccuaauaguuaauagguauaaaccccacaucuuuugugccagccaacucaacauggagcaggacugaguugaguucagaaauccaaaaguauaagaaaugucacccuccuuccuuacccuucuccuuuucccccugcagcuaauuuuuauugcugacucauuuucccacuagaaagaacuucaggaaaucuuugccuccaaaucaagagacauuccuuucuucuugucugccacauacaaaaguaaagacucuuacaaaguguagaugcagaacccuuaagugugagaaugaguaaaagagucaaauucauuuuccucugagaaguagaauauaauaggugcuaaucacuguauaaaauagaauauaauucaauauuucuuauaguuaguccacuuucuauaaacaagguccccuugucaaugauuggucucaacaaagugaucuccccauaagacuguaaccauuuauguaguugcuuucucugacaugucaaugcuaaaaggucagauacagcagauggcaagaacuaaggagaguaugcaugauuaagaaaauggugguuacagucagagggaaugcaaagagcaacaaacccuggagauuagccguugccccuucaguucugagaauuugaauaggcaugugggugccuacuaccugaaauagcagagcuucugguaucuccagaggaagaaauccaagacaggagguacaagauauuccacacagcaggguaacuggcuucacugauauaguguacuuagguggcgcuggauacuuaccaguuucagaucauaugcacggggcaaucuacagaacagauuagcucugaagccucugagugaucccuugacuccugggguuaagaucuugggagauuaauacaaucaaagcuuucauagaaaggaggcuugcaugcugaacuucaagccaagacuagcaguacacugggacucaacaguaaacugggacucauccgagguagggucaacaaugccgaggcaauggcacaccagcucccacuaggcugucaaaaucuaaaaacaaaaggguggaaauguaggaggaauggcgucuguugccucugcauaaacuccagugcugugcagucacaaaggcauguugaugccugcuugaggaccuaauugaggacugcuugagagacuaaggauugcugacacagacaaugccagccaaucaggugccaggggccagcuuucuugucaguuccucuugaggcaguggagggggaagaacuggaggguaaggcuuugucuuaugagauauuuaggguugcuguauaauaauaaaaaguuuacuuaucuaagucuaaauuacuuugcuacuguaacugaccugccuucuguguuucucugaggccagaaacugcagucucuggcaguaaguaccucauccuaaaacagcaguagauuaaguaaagaauuauuuucuagagccuauucccuuuuguccagaugccucuugcuugucaggcuagggggaaguuuggagcaauaaacuucuucuucuuuuuuuuuuuuuuucuugguuuauucgagacaggguuucucuguauagcccuggcuguccuggaacucacucuguagaccaggcuggccucgaacucagaaauccgccugccucugccucccaagugcugggauuaaaggcaugagccaccaccacccagcaauauguagaauuuguuuuguuuuguuuuguuuuguuuuguuuuguuuuguuuuguuuuguuuuguuuuguuuuguuugaggcaggguuucucuguguaguccuggcuguccuggaacucauucuguagcccaggcuggccucaaacucagaggucugccugccucugccucccaagugcugggauuaaaggcaugagccaccaccacccagcaauauguagaauuuguuuuguuuuguuuuguuuuguuuuguuuuguuuuguuuuguuuuguuuuguuuuguuuuguuugaggcaggguuucucuguguaguccuggcuguccuggaacucauucuguagcccaggcuggccucaaacucagaggucugccugccucugccucccaagugcuaggauuaaaggcaugcaccaccaccaccuggcuaggagcaauaaacuucuauugaaccaggagaauagaaaaaugcuugcagaaggaaaaacuuuuacauaagcaaauaugcauagacacauaaauucauauaaaaauucacauacauauuuauacauuuccauucaaaccaguugggucuagauugcauguauucucuuaauuacauacuuacaaacacacaugcaucaugcucauaauuacauacuuauacacacacauccauacuugcauaugcauagggaggaaaagagcaagcaccagugcaggaagaacucacucauucuggaugaaaaaugagcuccaaucuuuauugcauagagaaagaagaagcuucuacccuuuuaaugcuaaaugaauuaaacacaaguuuguaagaagaaagcuuuguuccuuuaguaagacucagccugccuuguuauuaagaaaagacauguucuguuccaugguaaggagaagccugacugcuccuucugcucucugcagcuuccuuuuuccucuuucccucuguauucuucacauugcuuucuuaguuuucuguuaccuuugguuucagaguuacuccacucugcauucuccuuccaaucuugcucucuccuccuguucugaugucacaguaauguucuuagucucaaugucuuuucucccaaugcucugccuuuacuccuaaguucuucuugaguucaguucugucuaaaacguucuccucagcucaguucccugacuccuugcccucccuguuuauacauuuucuucaggcuacaugaucacgugguaaaaaguucaucacauguucacacauaaaauuucaugucaaaaauugaaauaaaaguuuacaacagagaauguuuauaugcauauccauuagaaguaauuaucggacaucaccugucacagcuccacagguucucugacagugaaaaaccagaauuaaguuauuaaugaaguuuuguauagauaaacccagucaauacuuuaucuucuguccuagcaccuauaguaaaucauuaguucccuuuuuaugaccuuugguuaauuauuuuacaaccucuuagaaugugcucuaacuaguagaaaaucugguuacuaucuagaagcaauuaacuggugaaacauggaugacugacagaggucucauugcaguuuugacuaucagaaaaggaucuaauagcagucccauuauaaaagagcuuaauaaucacugcuauaauuuuaggaauucuuauaggaucaccauuaagaauuaagaagucaucuauugguuuauauagcaucacuacaagacaggacaucuucagugaucugcucaaaaggguuggcaaauaccuagugauuguuauauauguuaaauaauaacaggacaaaaagcauauuaauagcagggaucuuuccuaaagugaauuucuccugggccuugccaaugaagcaaaucuguuccagaauaaaauccaaggcagaccaucucagaacgaucacuuacuaguuauuagcuuguccuaugguggcuccugacaaucaggaacugcuuuuuagaagagaugcuuuuuugggaccaauagggcccugguggaggauauuaaaggagcuugcagcaguguucagacaagcuugcugcuguguuucucaccugcuccaagagucugugucauugauuccacuccaaccccaaggacaaguggggucaggcaguggauggucuagggcacagugaguacuuaacuaaagaccauagcugucaaucucccagaacugauuaguagccaauaguucagcagagagggcuaagucucugugaauccauuucugaucuugacagaauauugauaggcuuggucuucugcaggcucacagcaacuucuaguuggacuccuauggcauuucacugagaguaaauuaaaaugaagaccucucaacagcgucugagacugcuauuccuggcuuuaccuccaucauguuuccagugagguccauuaccuuggaugaggucuccuaguggauuccugccucacugcccuugcuaggucccagaacucagggaaagaccagugguuguuggcacaguuagcaguuucuaggcuccuccucuuuugaugugaugccuuuguaugggagugcaugcacauuugugugugugugugugugugugugugugugugugugucucucucuguguguuguauguucauagcacccauucuguaaagcucugcauucauucacugugucagacuuccauuguugaguuauguuugaugucagggauggauuuugcaagagcacuuagaccuuuuccugcuucuaugcauuggcugucguaaauucugaagaaaguuuaagcuucucuuuuuaaaaaaguacuucaggauucagucagugaaaaaugcacucaaaauugacuacagcugcauuuacaacagauucacugauguguuuuccuugaaaaaaaaaccauuugcaaugcagaaaguguuuucagaaaauagacacacacacacauacacacacacacacacacacacacacacacacacaaaauagaugucauuucucaauaacucaacaugcccuagcuuuaaaaugcuccucaauagucauuuacuuccagcaugagugaagacuuuaugucugggagcccgaucaggcagcagaguccaguggcaguaggaauguaugugcacuuaguuucucaagacaaugucuucucagccacccuauaaaaucugagcccaccuuaacugacccuuugugggagaaaaugacauuugauucugaugucaaacuuagaagucucucuugcuuaggcuucuaggacacacccauuuaggaggaacucuguguaccuucuucguuuuuuuuuucuuuuauuugaugaguugaggauaaggacuaucauaaauauucaugauaucagacaauaaaauauugucuuuuauuuuuauucagcuauacauugacuauuuaccaaauacuuuuuauaaaucuuuugagauuauaauauaaauucauuauuuaucucuucucucuccucucucaucccccucccauuuaucccaccuuccuauguauguguauauguacauacacacauauuacaugcauauuccuaaacacauaaguauauccuuuucauucuuuauaauguuacugguauguauauguuuucauggcucaaauacuuuuucacaccucagguauacuccaacuaugagagaugauuaaggcuaugugucuauucuagcagagacuaugagaaauuccugauaauacccauuaaucauguuuuaagugcugcgaggaauaaagggugggguguaugggaggaagcagucaguucugagaaaaagucgguuuggaaacuauuggauuaugcuuuaaagaugaagugaaguuaaacacaaauaaaauugcaggaaaguguacaagcugcugcaagggaggacaaggugucagaaaaaugaaguuguauggcuggcagugggcuccugauggagaauguuugcaggcacccagugcagagacacucauggcucagaugcuguugacaagacugcauuucaauuuacucucagugaaaugccauaggaggcccagugggaugcugcagagcauacgguuacuaggugagaugggaggacugaggacccaaggguaccagcuccacaaaaaucuguucauucuuaauacauauuuauuauagacaaucugaaaaauauaagaaaaacucacuuagggcuucaccucccaauaauauuuccugugaauuuucuucuuacaaucuuuuucuaugcagaggaauauacuugauauaaauauuuuaaauacacaugguauuuugaguuuugucuucucauuuguugcuuuccuggauuaguauauuuuaugacacauggauuuacuguccucuaucuauguaaucuauuugaaggauuaacgauuccauauuuacauccacaucugugcuguuaugagcucacauguucuuugagaccacugaaaaguugaaagaacaagucacugcuggaaaugaauggaaaugaugccuuucaaaggacacugucaauaggacaaaaugacaaccaacaaauugggaaaagaucuuuaccaacccuacauaugauagagggcuaauauccaauguauacaaagaacucaagacauuagacuccagagaaccaccaaauaagccuauuaaaaaaugggauacagagcuaaacaaagaauucucaacugaagaauagcaaacggcugagaagcagcuaaagaaauguucaacauccuuaguuaucagggaaaugcaaaucaaaacaccccugagauuccaucucacaccagucagaaugacuaagaucaacaacucaggugacagcagaugcuggcgaggauguggagaaagaggaacacuucuucacuguuggugggacugcaaguacaaccacuccagaaaucaauuuguugguuccucagaaaacuagauauaguacucuuggaggacccagcuauacuacuccugggcauauacucagaagaugcuccaacauguaauaaggacauaugcgccacuauguucauagcagccuuauuuauaauagccagaaguuggaaagacccauaugucccucaacagaggaauagauacagaacauguugugcauuuacacaauggaauacuacucagcuaguaaaaacaaugaauucaugaaagucuuaggcaaauggauagaacuagaaaauaucauccugagugagguaaccacaaucacaaaaagaacacacaugguguacacucacugauaaguagguauuagcccagaagcuuggaauacugaagauacaauucacacaccaaaugaagcucaagaagaagcaagaacaaaguauggauacuucaguccuucuuagaaaggggaacaaaaugcccaugggaggaaauacagagacaaaguguggagcagaaacugaaggaaagaccauccagagacuagggauccaucccauauacagucaucaaacccagagaguauuauggcugccaacaagugcuugcugacaggagccugauauagcugucuccugaguagcucugccagugccugcaaauacagagguggaugcucacagccauccauuggacugagcacaggguccccaauggaggagcuggagaaaggaucaaaggagcugaaggaacuugcagcccuauaggaggaacaacaauaugaacuaaccaguaccccuaagagcucccagggacuaaaccaccaaccaaagaguacacauggagggacauggcuccagcugcauauguggcagaggauggccuuguuggacaucaauggaaggagaggcccuugauccugagaaggcucaaugccccaguguagguggaugccaggacagggaagggggaguugguggguuggugaacaggggguaggaggagaugauagguuuucaaaggggaaaccaggaaaggggauaacauuugaaauguaaauaaagaaaauaucuaauuaaaaaaaaaaagaaaugaugccuuugcuacagugguaugugaguacuuuucugcuaaaaguuuggaaagacuuucuuucuauacuguuuaugggaccauauuaaaugucucauuauuuggauacuuaaaaaaauucaacagcuagaauuuaagcacaaccuuuuaucauaauugacugcagcaucucaugucuaccucugaaacgguuaccuaaaaucuuuucuuauuuauucauuuauauuaaaacuuucauuuaaaauauacacaaaaaguuaauaauugugugccuauuauagcaagucauaauaggcuuaggguuuucuucuuccuuccaacaucaucuuuugcuguugccaagauuuaguuauuuacugugcauuuuuucucacuguugugcccugaguccauaggaaacccagaggagcccaagaauugcaaagucugcugcaacucgaaaaagagucuuuuauuguuucagguuugaacuuggaucacccaccuugcacucaccacgugaaugcuggcaagcgacccugaguccagaaaacacuggguuuauauacagaauaguuagaaauccccugaauguucacagaaaaggggcauagaaguaaucauuugguggaaugguacugaagugggagggggguuaauggaugucuguucugggacuaauuuuauggccaguuguaacugucugugaccugaccucugauuaccuuuucuccaugauuuaaacacaagccccuagucucccuugagcuuguuauuucucuaaagucucuaggacaggcaccuggagaguuaucaggaggagugcugguuuuuggagacacaaagguggggaggaugucucuuccugucuccucagaauguccuccuuaagagggaguuuuauggguagggucauucuaacccuaggggagggggagggagccccaggcugcuauaggagaaggcagcacagaaaccagcugucucuguaucuugguugccaggcuggagggaggaugggagccccuggugggggugggggcacgcagaggcaaacugucuguacacaacacugaaguaauuuggggguuacaacacuaaccuuccuuguuuucauacagauuaguaauuauagagagucauguuuacacaucaaagguauuuucauuccucccagaaauaggucauaugcaaacaacccaguaacucccccuuuugcauccaguauauaguuauauauacuauauauauacauacauacauacauacauacauacauacauaaauauauauugaugguacauaugcauuggugguuuuccuguauguuugucugugugaaggcuccagauauucuggaacuagaauuacagauaguugugagcugcuaugugggugcugggaauugaacuagggucuucugcaggagcaaccagugcucuuaaccacugagcuguucccccagccccucaauacauuauuuccaauaacugaaaaaauaauaaccauugaauggaaggugcuugguuuaauuuuguacuucuuucacaguuacaggcaguacuuuaauauuuuauauccaucuucuuagaucuauucccuuuuuacuaacagauucauuuuucaaaagcaggaauguuaggucaaaggcucuuuaagcccugucacagugcagaaucagaugaugcacagagcccucucaguauaaccuguuguccugcuuugaacauuuaauaauggcuuagauguaaauucacauauuuuuugauguuaacauucuagucaguggauugucuuuugucucuuguccauugcauucucauaucuaagacuugccguaaacuuuucuaacucuugcauguuuuauuccugcaaaacauugcacaguguagaaauguuuauucucauguccuuucacauugguuuuucuguguagcuuaaaaggggugaaaggaauuaucacguggacaugcucaguagcauccaucaucauggagugcuaugcuccuuuauccuuucccagccaugccguugcuuaagaacuaguuuuagaaagccuggcccaucuaagaaggucucccuuacuaccuaucccuuccucaauuagaucauggaagaaacuuauauuuuauccugccuuaugcuuacaauggcuaucuuccaugggcaauggaaugcuguuauuguuuuuuccugaacugaguugaccccacaguuaaaaaggugagagaacauucaaguaauggccuaggguggaauguagccuguccaugcauaggcuugucucugcugcgcucccucaggggauguaggugauuaaaaaaaauacccagagcccauuucuguugacuggauaucuuggaaaaacucauaucaucaaauuuauaaaugggaagaccaguucugaagucuacauuugguauacuuuucuuuguaaaggaagaaauuggaaagacaagaagggauuucuuuuuuuaaguagaauaggugcuagcuuuuauuagugaguuuaaauuaaaaaaauauauauauugcccuggagacguuuagaauauaaauaagauauuugcuugggguaaaauuacaaggcuuguugaaaucagagguuuaucuucuuucaggcuugacuucccuuucuagcuuugaugggaaaugauuagcugguagagagguauguuugggggcaaguguuuugugugugugugugugugugugugugugugugugugugugugguauagaccugugugugacugcggguguguuggugcaggcucaaaugugugugugugugugugugugugugugugugugugugugugugugugugugcagaggccaaauaaggauuaugggaguuuagcucugucaccuugagacaaggucucuuguugaaccuagagcuaaacuggcagccagcaguugugaaugagauuccuggcuucacucccacaguggagagagguaagaggcacagagacagccaagcucaaacugucauauggcugcuaaagauuugagcuugggcucucaagcucacauagcaagcucucuuacuacagagccaccccuccagccccauuagcugaucuugacuguggaggguggguuuugugaaauucgggugggauguagagagaaggcacaugauguacaggcuucucggggucaucuguucugcauugcuuaguacucauuccugaaauaguuuauaaccuuuccccggggcaauaugaggguucauucagaaggaaguuccuggagucuauccuucaggagcauuaaauaguuuuuuucuacaguuguguauuuacauuuuagucaucaacuuguggcugcugucuuccuaugacuuuauuuuuggguuguuuuggucugacuuguaguuuaaucuagugugcuucuauuuuuauggaugucaaagauuucuuuccagaguagcaaauaauacuucaaaaccaaaaaacaaugucuaaaaugacuuaaucuugccuuugaaaugugggagauuagagaagcuuggguuuuugauaaauauuuuauaauaccuccuaaugaaaacugauucagugugucuuccugguuuugagugugguuguuggaauacuaacaucagcagacaaggucacgugaccucacaucaggcauaaaagcuagaguucaggagcuuccacugguugugugucaagucagucgcaccaaagugaaggucagaggcacuuccuggacgaacacccaucacacuaccuguaagagacugaaagucaucuguucugacuuuuguuuuuuucauuuuuagaaaauuugauucuucuauacuuguucccuugaccucauuguaaaacuuuauuuuuuuuuuaugucaacaguuuucacagucaauuaaagcuuuuaaaagaaauggauagauuaucauugacauaaaugauaaauaaggguugaaagcuuaauacacuguggucuuaagauauacaaugauucuaaugcaaaugguuccagacaaauacuaggaugcaucuuguuaggaucuuagauaauaucuugcugugccugucuccuguuacugaauggaauuaaaauuccaagguugucaugugguguacagccuuguuuaguuuaauguuaauauucuuacuuaccuggagcuuucucaagggugagggaggacuuugguuuuauauauuauaaaugaauauguaguauacauuuauauucauuuauauauuuauauacauuuacauauucauuuauaauauauauuaauauuauauauuauauagucucucucuuauggaguuguuuuuguuuuauuguuugccuuguuuuguuguuuaucuuuucuggucucccuuuucucucucucucucucucucucucucucucucucucucucucucucucucacacacacacacauauguauguguguguguguguguguguguguguguguguguguauguaaauugggcaugcuucagagaaagaacacucucccccuaaaguuuaagaacaaaaauugccauguuguuuuuuuugcauuugacaggcuggggucucuggggucucucacuaacuuuucucaaggccagugcauuaucaguagaaagccaugaaauacaaucugauagcacuauaauagacaucuaugucuuuauaagaaaagaaagggaaacccagggaagagaagaaagcuaccaucuccuagcauucucaguaaaauggcagaaacuauucucaugagagauucuagaagguuacagaaaggacugguggaagaggacguucaccuuuguggguaucuugaaauucuacaggcaccuauugucuccuugugacaucuagguauggaucuuagguuacuguguuuggagaccuuuugccaucaguggaugaagcugcugcugggagcuaugguccccuacucuuauugucguucgaggaaagaucaccaugcuaaacuaauguguugugaugcuugagcaggaaagcagguuucugcucuuuagguguuuauaaucuagagaggggugccagaugugaaaucaauuacacacagcauaaggaagaaaguagaaagaaaggcucgagagagguacaggugcugggugauaaugauauugcucagaaagcuuuauuuaugaauucccuacaaacaauuuuaggcuacuacaaccagacaugaucugcuuguagcuaacuaguuucuuagaaaaaaaaaauuguuugaggaccugagcuucaagguuuaauccugaaugacuccuggcaacaacuugaacauauaacuaucagcugucacuuacaguaagauaaccaaacuugaacccuuguuuuuugacuuggccugugcuaucagguagcccccacuaugaaugggcaggcaagauaagcugaguccucaaaagugguauagagagccagguaguggugguucaugccuuuaaucccagaacuugggaggcagaggaagguggauuucugaguucgaggccagccuggucuacagagugaguuccaggacagucagggcuacacagagaaacccugucuugaaaaacaaacaaacaacaacaaaaugguaaagagagaguauucacacgcugcauuuuagaacaagauaagaagaaucacaauuccuaaggcaaaguccucauuggugaagucuguaccaauuuucccaaauagagacuccccagagaaacucccaaaaaaucuauccuguaacuuccugguuggucucucaagcaguccgaaagguugcaaaaguuuuugccuccauucugaguuagucaggauaccuggaugucuugguuauuucucuauugcugugcagcaacaccauaaguugucuuaacuuauaaaagauggcauuuaacugggggcuuauguacagcuucagagagugaguucaugaccaucaugacgaaauacauggcaguagguagguaggcguguuacuggagcaguagcuuagagcuuacaucuuaucuacaauuuagaggcagagauagagauagaaagacagagacagacuaggaaugguguaggcuuuugaaacuccaaguccaaccuauuaauuuaucuccuccaauaaggccacacuuucuauucuuuuccaaacaguucuacuaacuaugaacuuagcauuuaaauauaugagcuuaugggggccacuggcuuucuaucuuccacacugggauuucucuacuaugcaugaauuagauguuuccagauauacugcugaaauccuuaaugguaagaucuuccuucacaauucacauguugaccacagaucaaugacuggcaacugcagccccgucugucuuugaaaauuaaaaugccuggaauguugcuuccuuggagacugugggacagggcagugacugacugcuuaucucaugcaaagucaagggggauggauggacucagggagaguaaagaagagaaauauuguuuguuguucaagaguaguuuaggcaaauaggccauuauauuagaaaagaucuuaaagucuauaaaaaugacuaacuggcuuguggaaaagccaauuuguugccugauuaacuaauuuaauuugaggucauggcuagacauuggcaguaaagagcuaaauacagaaaggaguucacgauuauguuguuuuuuuuuuuucuuuccuagauucugugaugcuaugccucuguuuaacucaguguugcuuuuucuuucuuuucuuuucuuuucuuuucuuuucuuuucuuuucuuuucuuuuuuucuuuuuucuuuuuuuuuuaagucuuugugacuagcucaaaugaaaacugagguuuauuuuaaggauaaaggaaaaacccucagacccuuagaaguuagacaaacaggccucacagcaaggaaggguaaguacaucuagugaaaggagcagccugugagcuuaguuuucucuaauguuuuguucaaaggaaagggcacagggcagcucugcaggagauuuccaccauaggagaauucuagcauugugcugguaccagagucaaccuuguuuacuuagccuuuccaccuuaguucagaacuccaagcauggauaccacaggcuacuuaaauguccaucuaguucuggaagcaaugaaugaccaggaaggguaguacgcaaugaacaaagagcacccuucucaggaucagaugaugaagcacagugugauggaugagggcauugauuugugaauuaauucauugauccuacuauguaaugauuuuacuuagggacaauauguuaguaaccuauauccauaguaaaaauuuuuaaaguaacuugaagucauggcaagaacuccauuuuuacucuuacaacaccugaacuuuuuacaaugauucaaauaaacauaauauauauuuuuauuuuaacaaauuggaaccaauguacuuacugauuaucaugugccaggcacagcacuggaccuuuggcaaaccuguaaucccucauaagcuacccucaugaauaacauuauuauccuuauguuccagaugaaaaggcagguuucaaacauuaugguacaaaguugaaaaguaguuuguuuugcagcaguguguuccccggacauagacucuuuccaguuacucuguugacuuguagucacucaauaaaccauuaauuaagauguugugaugaaaucugcagaacugagucaauucucauucaggacuuauuagagguccacagagauaccuaaaaaaaaaaaaaaaaaaaaaaaaaaaaaaaaaaaaaaaaaaaaaaaaaaagccauagcaaacagaugaauauauuguugugacaagguugagaaaagucaguuuuacauugugggaccaacugagcaccacugauauggucaguuuucaagcaagaugacuaagaaugagaggagaaaguuauauggaaagaaagaucaaauuauagaacagugugcuuucauuuugcaauacaguuguggauuuagauaguuugcccucuaugucugcuuguuucuuacagauucaaccaucugugcggugguuuaaaugagaauauuuuucaugggcuccuguauuugaaugcuugguccccauauuguuggaacuguuugcgggaggguuaggagguauggcuuugcuggaggaagaagucaguagagucuagcguuaaagauucucacuauucuaguuuccuuucucugccucauacuuggggcucaagcugugaguuuucaccuugcacuccucccaccaugcuugcuauggcgcugauggauucuaaucucucuagaaccauaaaccuaaauaaguccucuuaugucacauugggcaugaaguuuuaucccagaaaagaaguaaaugauaaaaacuguauuuaaaauauuuuuaauuguucugaacauguaaaaccauccccuuuauuauuauuuccucaaugacucaauguaaaaacuuacauuguguuauauuuuauagguaauauaacacguacguugcguuauauuuuauagguuauucagagauugacguaucagggagaacugcguugguuacaugcaaauacuaagucacuggaacauauaacuccacaaagagugccccaugauugcaugagugcugcaugauuuguaagaucuaaaaugucaaagauguuaggucaucuaucacuuuauacacacuaagaaagacuagaaugcuaucaauuaacacacugccauuaaaaggcacucggauaucugaaugggaaggaagagugugcacacuguacaguauguggaaaagauauggugauauuauugaagauuucugagaggcaaggcucugguuuauuuauucuggcuacuuaugugugaguggaaauuccccauaugacccugucucucugcccgacucuaaccccagucucaaaggccagagugagugauucucagcuucagaaguaccaguuuuaagaccucuuggcauuuucugcaucagguuucaagccuugaauucaggaugugaggcuaaagguaaccauuguaccucuccuggcauuugaagccucugccagaacuccagggcaauaguaaacacaauacaggagcagauuagauaagagcuaugagcagaugaaagaaaagcaguugaguuauggagguccaugaaaaauaacacuucagucugcgggacaaauuaaguaaaugugcagagcguaggguacuaauaaauaaacauguuuuauaucauuaauuuccaugcaucacuuuauauuagauucuuuguacauuuaaaugcaaccauaaauucuauaguaaugagauuagcuugauaguuuaucccuuugauaauaaacauauuuuaguuuuuuuuuuaccacuguuaugaagaaaauauaauuaaguaauaaauauuacagucugaaaucuauuauuuaugacaugguaaguuuucuuuuuuuucuuuucugagacaggguuucucuguauagcccuggcuguccuggaacucacuuuguagaccaggcuggccucgaacucagaaauccgucugccucugccuccugagugcugggauugaaggcgugugccaccaccgccuagaguaaguuuucauuuaagcuguuuuauugcauuccuucuuuuauuaagucuugggacaauuuugugcuuuuucugaaagacuauaccuuucuucccuugcugguuauauaguuagauauauucacuucacucauauaguacaagguuauuuuguauuucaaagaaaucugcaauucccuaauuucugcuaccaguguaucacugauucaaaaacaguuuaugaucaucucaccauaucauagaaucuacugucugcagagcuucagucaguggaggccacaaagucaguaccaaauccacaggggugguugaaaagauacucagaauaugagagugccaauagccaauuuccucacgguguugaaggugacacuuuaaccuaaaucucaucucuugauuuaaaacuaccaacagauugauggcuccuauuccagcagauacauggaagcacuggucuccugagguggucguaguaguaauaguacuaauucuaguaccauaggacuuagaaguggugagggcacaagggcucugucaucauacacugcuauugcugaagaaguuuaguacauguguuacugaauucugcucuuuccugcccucacuaucucaugggauaaugcugccagaaggaugcuuuccagaugugagccccauuggcuuuugauuucucagccuuuaggaccauaagacauaaaccucugucuucauaaauuaauuuaguuacuucccuccccacauccccugcugccccagcagguaggagagcuggagaguuggagagcugguccuauccauaacuagcuguagcacugaggagagcgggcccuauggcauuggcugagauagccaguccuggagagcucacucugguagugcagguguaggaaagcuaguggacuuacuaacccagcuaccucccaggccccaguccagggcuuugaguugacccacuccaacaucuaccacaucuaugaucuguuggagcacaaacaaguguaaaauacagacaaguacauaggcuuuguagcuagacuaaccuuaauuugggccacuaacuuggcacuguggggccaaaacaguaacucuucagcuggaucaggauucauuuauaugugugacuuaaauguaacaucucagguuaguuuuugguauuucaaaagcauacauacagccauuugacugcugcuuuacagucuauuuggauuccaaaguucucacaugaccaacaguacucuauuuauucugacugagguauccauuucuuauauugugucuucgcuguccgagauuuucuuccaucucuuuuuaaaaauuaaucacuuuauuaauuuacauuucaaaugauauuucccuuccuaguuaccccuucacaaacaccucauugcauccccugcccuccacuuggcuucuaugaggguacucuuccacccaggcaccuacucccgcuucacugcucuagcaucucuuacacuggggcaucuauccuccacaggaccaagggccuccccucccacugauaucagauaaggucauucucugcuacauacauaucuggagccauggcuccauuauaauaaacuccagaguauguaauauuauuugugacuauugugaagggcauaguuugccuaauuucuuucuuggcugguuuauccuuugaguagaggaaggcuacuaauuuguuugaguuaauuuuguauccaaccacuuugcugaaguuguuuaucggguuuaggaguucucugguagaauuuuucaggucacuuauguauucuaucauaucaucugcaaauagugauaucuuaacuuccuccuuuccaguuuguaucccuuugaccuccuuuugucauuuaauugcucuggcuagaacuucaagaacuauugaauagauagggagagagugggcagccuugucuugucccuaauuuuaguuggauugcuucaaguuucucuccauuuguuuugauguugacuauuggcuagguguauaaugcuuuuauuauguugagguaugggccuugaauuccugaucucucugauacuuuuaacauaaggaaguauuguauuuugucaaagguuuuuauaccaucuaauaauuugaucaugugauuuuuuuucuuugaguuugcuuauauaguggauuauguugauagauuucuguauauugaaucuuccaucucuuauauucuuuugguuagucuuaccugugaguuuuuuguuuggcuucuucaaguuuuuauuucuaauuuuuccucauguuuuugauuuugucuuugugauucuauuccuucuuuuguaucuucaucuuucucaucauuuuauuccacuggucauauuuuuauagacuucauuaaaugauuauucauuucuucuaacauaucuuugaacguauccuuuuuuuuucuucaagagaauaagacuuuauugaaauauuagguuuaaaaauuugggggcugggaagaugagauggcucagugguuaagagcacugguugcuuuuccauagcacuuugguucaguaguacccacauggcagcucauguuguccaguuccagggaaccugaugccucaucuggaucccaaagguacucauacauaccacacauacaagaaggaaaaaaugaagucaacugugcuugacaaaccagcaaugaugccuggagacccuagauaggcaucucugcccugggcacuuucuuguaugccagcccaacagggaaacuaaccuggccauguugguucuacugagauaccacaaccaaagaagcccaagagcauugaucuaacaauuguuuacaauuugaaggcuaauccauuuuacccagagcacacaggcauggugcuagaaauauuauuuccuccucaacuggggacuaagcaaacaugaaccuuuagcguuaaugcacauuacuggcagaccuguaauaucagcuucugggcgaugagagauccacauccuuggugugcuaacagccaguuuggguugacagccuguuaaaaccaaaccagccugcagcuggaauuuauuauccccucccccaaucuaauuauauacaguaaguaggcuugggucuauuacaguaauugauagggaucuggugaguaauugauagggaucuggcaagugaacauauccuuaauagcuauuuugauguccuuuucuugugcuuuagcuauacugcauuucucagggccuacuguaguaguguugcuggagacauaugucauggguauaaaugauuauguuuuugugcuggugucuaggcaucuggauuuggggugauugugauucuauguguugguuuauggucuugucuauauugaaugggucuuuugcuccuuguuuuuuguuucccuuucuagaucuuagaaacuuguacuggcuguggcuuguuugguaagcaguacuucuaagacccugcaggugugucuccugggguuccuggaaggaauauauuucuaugcauccaacccuuacauaacagacuaggacugggccagaagagcuugugugaaaugguccacaggaaggaggaaaacugggucugccaugaggucuggcagaguccccagagagugcagucagacaggagauaccggccccucuaaggaguuugcuugagggcuggagaugagacuggagaguuuuaaauguaggacagaaaagacagugaagacugcugagccccauuuuuuucuaaaauaaauaaauaaauaaacaaacaaacugaucuacauauucuaggaccugaucuuucauuaaucauuuacacagaagauacauucugaugugugacuugccucucugucucugguaguguuuaggagagacauucuuaaucgcucuuacauauuuugcucugugucuuguuagagaaaucuuguacuuuccaaagguuguuauauaugaacugguugucuucugggauuuucaguuuuguccugugagucauguagaauguguauauuauuguuuccacagggauaauauuauuggcaggaugguuauuacaagacucuccuauuacugcagauguauaaaugguagcucugccacauaccauuucaaaaauaaguaaaguuucugaacauauuuguguguaugcucuggguucuccaggcaccacaggccagugaaagugucagccagauggcucaaggcccucccagguauuaagcaucuuaagcaugaaggccucuuuaucacaugaaaaaguuauagauugaguuauugugggguuaaucugugguacaaggacagcaucaggaccccaaaugcuucccaccuuuucuucucuggagaaccauguauuccuguguuuccuugaagcauggcuguucuagccucugcauguuaucagaccaaaaauagaaaauauuuucuggccucaggguguuuguaaucaaagugcaucuaagcagucaggucccaugccucccacuaaagauuauaaguucucagugaaagguuuuguuuuaauuguauucuuucauccauuuuuccauucauauuuauuuauguagucugucauucagcucugaguuugaaaaauagucaaguugccuugagacugugcugggaaggaaggcuuaucugaagucucacaucaugucucucucccugagugggauacagacucuacucucugaauccaugagacagugaaaggugaacuuauaugacacaggcaaauucuaugacagcuuacuuuguucacauuuuuaaaaucauguauuuuauuuucagaauuauguguauaaguaugcauuggagagggguguguacaugugaguguauguacccugggaguccaaaagagggcaugggaugcccucaagcuggaguuuacagggagcugugagcuaucugacucgaacugaacucaggcccuccauaagagugguacauguuacuaaccgcugggcagucucuccagccccuuguuuacauucuggauaccccuuuuaauucacauuuuuuaagaaaauuguuucuuuuguuuuagacuuaucaauauuugcuuucuuggagaucaucacaaguuuaggaugagggcuuuguucuuaguuuuaguuuaguuuuguuuucuuuuguuuuugguuguuuugggcgggggucggugucagaauuuugguugguuuucagugugaggguaaaucaguauauggagucuuuaggguugcagaaauggacaauggcugaaugcauaauccuuacuuuaugcguugucacuuuugucugaaggcuuguuggagacggaaccgcuacaaggaagagauggggaugcaguaggcagugcugacuucucuagcaugcucucugaggaggagaaggaagagcuaaaggcagaguuaauucagguauguuuagcaaucuucucuuucuaucuuuaguucacaacaggacccauauugcaauugugcuaucuuuccuguaauaaaguauaauaaauggauacacugcagaaugauucauuuucccaagguguuuuuguaaugcuggucaugugcuaaaaguaaaguggguggcuauacugcuuucauauuguuauacuaacaauaacaguuaguguuaaguaugugcuucuuguuuuccuuaguauggagauguugugugaauguuaaucacuuaugaaccagauggaauguauugaaaaccauggcacagaucaguugugugguugcacaugcuugcuaaucuugcuuucaggaaucuggggcaagaacaugaagaacuggaggucagcuugggauaugggaugaauucuaggcuagcuugggcuacauaaucagaccuugucucaaaaaacacaaccaaaguaaccauaacauagguguaaucuccuuaagaggaauucuucaaaauuuuuauuauuuuaaugaaaauuccaaucaugagagcaucuaguugggcucuuuugcacaagaauaagguucugggaguggggaaauaagcuacaauuaauuaggguuuaauuagaacuuuagcagcuguuguaggagcccauccuagagaaaaugccaggcucauccuauauacaggucuguagcgggccuuuuguggguggucucuucucaaccauugacucacugcguuggguugggaugguuuguauauucuuggaccagggaauggcaccauuuggagguguggacuuguuggaauagguaugaccugguuggacuaggugugucacugugggugugggccuaagacccucacccuaguugccuggaagucagucuucugcuagcagccuuugggugaagacauagaacucucagcucugccugugccaugccugccuggaugcugccaugcucccaccuugaugauaauggacugaaccucugaaccuguaagccagccccaauuaaaugguguuuuuuuauaaagacuugccuuggucauggugucuguucacagcaguaaaacccuaacuaagacagaaauugauacaaggagugggguauugcugugauaguccugaccaugauuuuauuuaaaagaauguggacuuugggacuuuggauuuggaacucagugggaugcuuuaaaugggacuuaauggaucauccuaguaggaauauagaagacuuuguugcugggaguaauuugaacuguguugaccuggcccaagagauuucaaaggagagaaauuucagaacguggcauaaagacuguuuuugugguauuuuggugaagaauguggcuacuuuuugcccuugucugaaaagucugucugagacuaaggugaagagacucagauuaauugcauugucaaaggaaguuucaaaaaaagcccagcagagacuuuguucucugguuaaauuuuaugaagagaagguugaacaaguauaucaagcuuagaaaggaaaaauguaaaauauaugcuucgaguauuaaagggguaccaggaagugaaauggaccaaaauacuguguucuaggagauaacagauuaaggaagugggacuuugggguaagauccuauccagcuaaauuuagauccaggcauggugguauacaccuuuaauaccaggagauaggcauacugaucuuugcacucaaggucaaucuacagagcaaaauccaggacagccaagcauaggcagugagggauuuggaaaacauaaagccagugauaauguauuaguacaagggggucauguucuaguuccugcaagcagcugaacuuggcagauucagccauguggcucuggcucuagaguuaagaauggaaggaacuacugggacaauugaugcugguuugcugcaacuaagaaacuagcaaugauuaagaagagaccagcaucacuaaggugaaaucuucuagaaguuguuuucugggagcacaaugaagcuguguuccagagauagccaagauuguaccucccacugcagcuguacuugguaaugggaaagagucacuaaggugguacugguuuuuaaggcaugaaggugucaugaagaacagcugagacuuggcacugugauaggucauggaaggccauuggagguguagccucagcuguaguugauggcccaggacugaaggggucaugcaaaggagguuugccaccaugaagagagccuauuagaagcuauuggugaagccaaguuggagugaaaaaccccaguguauugaagaugucaguaccaugaucaccaagaacaacagccauaguggaguggaucaaccugagcuuagagugcuacagaaggcagagcuggagaagugaugccagcccuuacgaggagcagaaaagaucaaguggaaucucagacacuuaaacaagcuguaacauugaaauugccuuggagacgcaaagauguuaaagaugccagagccaugggauacaugcugaggaaagcugcuaacagggaguggaaccagcccaggagaaagaagucuguugcagucaacaaagaugaaaaaggaguggagaucugaagaccgcuuuaacaucagccauggagaugcagaguuuggaguuugcccagcugguuuucugccuugcuuuggggaugacaguuaaguaaguuucuggauggaucucagaagauaccuugaacuuuggacuuuuaucauugagacuguuauagacuaugaggacuuugaaaguuggacuaaaugcauuuugcauuaugcuauguuuaaguauggaucccccauagacucauguguuugaacaaguccaugggggccagagagugaaaugugaugguuuguauauucuugggccagggaguggcaccauuuggagguguggacuuguuggaauaagugugucacuguggguguaggcuuaagacccucacucuaguugccuggaagucggucuucugcuagcagccuuuggaugaagacauagaacucucagcucugccugugccaugccugccuggaugcugccaugcucucaccuugaugauaauggacugaaccucugaaccuguaagccagccccaauuaaaugguuuuuuuuuuuuuuuaauaaaacuugccuugauuguggugucuauucacagcaguaaaacccuaacuaagacagaggugccucuucuuggagagggcuacagaagggcuccuggagcagaguaaggcaggaggauaggagagauucaacccuccaucccuuccauaucugguucacagggaaggaagcacauugcuuucaauuuuauuauuucauuauuuacauuauauuuuguugaggccaagucuugcuguguaucccaggcugaccuggaauuaauaauccuucuggccaguuuucugaguuggguguauagauguuuaccaauacacccugcuauaaguuuccauuuuauguuuaugggguacagcaugauauauggcauccauguaaauagugcaugguagucaaguagggauguauuauauaugugcuaccucacacaccuagcuuuucuuuguggugagacaauuuagucucuuauuucaguauuaucgcccagugggauaucagaacuuaacucuuaccuaaaauaauuuuuacccuuugaucauuuugucuucauuucccucuucagccuccacuaaaaacauuuuuacucuugccucuuugcuuuuuggaucaaauacagaugagaucauguaguauuuguuucugugugccugccuucaaaauaauuucauuucaaaauagaagagcaacuugguccucuaacagaacugccaaguauuucagcaaguauacgcugugccucaucaaacagaauauucuggcugucuuugcuaguucuguauauggccacugagugaucagacaugucagagugcagaacacagguggccuuaguggauaacaggcuaaguuuacacaguuuaaugacucaagagucuguuucacaaccugugugugucaaguauaauaucaaaaauuuacuuucuguaaacugggauaggcuaauugauuugaagcuucuuauguguauacauccuucacuacacgagcucucaguaucaguucaagaaggcuucuguaccagagcgaccauuguaaagugccuugguuugucuggguucugggauuauugggcugugcauucauauaucuaucaaaucacuauguucuauaaaucugacaguggacauucuuauuauucuuauuagcaaggaaaccauaagcauugauuuuuagaaggauguuuccugaaugcaaacugccagcaacaacauucucagaauucccugucuucuuggucauagcaguaagcuuuuaguaaguuucauuuccaagacuuuggguuucagaauccugaugguagcaucaaaucuuuuguaacugugcucauguuacugggucucaugguuccauccuuuacugugcacuggccuuuaauacuuucuguuuuacuucuggaugcuucagagauaaucgcccagagugggacauuuggguuguuucccucaugguaauaaacagugcugcuuugaacauacagauucucauuuucuuggggguaucuguguagaaauagcacuacuagaccaaauggcaguucacuauuuaguuucaagaaaccagacaguuuucuacagugcugaaaccaucuuuuuuuuucucacuuuuuuucuuuuuuauuggauauuuucuuuauuuacauuucaaauguuuuccucuuuccaggucuccccuuuggaaguccccucucucaucccccucccugccucuaugagggugcuccccacccacucacccacuccuaucuucccaucguggcauucccuuacauuggggcaucgaacacccucaagucuaagggccuuuccuuccacuaaugucuaacaaggccauccuuugauacauauguggccagcgccauggguccuccauguguuguuggugaucuuugguugguuguccauuucccaggagcuuugaggggugggggugggggggucuggccugcugauacuguugcucccuccauggggcuguaaaccuuguaagcuucuucagucccuccuccaacuccuccgucugggaccccugagcucagugcaauugcuggcugugagcauccaccucuguguuugucaggcucuggcagagccucuaaggagacauaucaggcuuccaucaguaagcacuuccuggcauccacaauagcuuccgcguuugaugguuguuuaugggauggguccccagauugggcaaucucuggauggucuuucuuucagacucugcuccacauuuugucuccauauuuccuccugugaguaauuuguucacaugucuaagaaacacugaaguauccacauuuugcucuuccuucuccuuaggcuucauauggucugugaauugaaucuuggguauucugaacuuuugggcuaauauccacuuaucaaugaguacauaccauguguguucuuuugugacuuaguuaccuuacucaggaugauauuuucaaguuccauucauuugccugcgaauuucacaaagucauuguuuuuaauagcugaguaguacuccauuguguaaauguaccacauuuucuguacccauucuucuguugagggacauuuggguucuuuccagcuucuggcuguuauaaauauggcugcuaugaacauaguggagcauguguccuuauuacauguuggagcaucuucuggguauaugcccaggagugguauagcuggguccucagguaauacaauguccaauuuucugaggaaccaccagacugauuuccagaggguuguaccagcuucuaaucccaccagcaauggagaaguguuccucuuucuccacauccucaucaguaucugcugucaccuacguuuuugaucuuggcuacucugauuagugugagguggaaacuaaggguuguuuugauuugcauuucccugaugacuaaggauguugaacauuucuuuaggugcuucucaguuauucgaguuuccucaguugagaauucucuguuuagcucuguucuccauuuuuuaauaggguuauuuaguucucuggugucuaaugucuugaguucuuuguauauauuggauauuuguccucuagcggaugucagauugguaaagaucuuuucccaaucuguugguugcuguuuuguccuaaugacagugcccuuugccuuacagaagcuuugcaauuuuaugaguuuccauuugucgaauuuuuuuuuuuuuuacuuaaagaaggcagaguuuauuucagccuacauuuccacgucauaauucaacacugagaaaaguuggggcaggaaccuggaaccagaaacugaaggagaggcuauggagggggauccuuaauggcuugccccucaugcuugcuuaggugucuuuuucauacaagucagggccauuugcugaggaguggguggcaucacggacagugggcuggccccucccacauuaaucauuaaucaagaaaaccaccuauaaaacugacuaaaggccaaucuauggaggcaguuuucucagcugagguuuccuauucccagaugacccugacuuguaucaaauugacacacaauaaaauaauuaaaaaauaauaaaaaccaacaaaaauuugucccagcuauguauacaaaggugacuggauaaagaaccugugauguacauacaauggcauaguauucauuuguaaaaauaaggugugcagcagcaaagaugaaauuggaagauauuguuguaagugaaaguaugaacauauagaaggcuacaaguuaucacuuaugugcagaaguuuaaaaguugaucuuggaacuaggaaaguggcuccaugagcagcuccugccgagacccuaaauucaguucccagcacucauggcagacagcucacaacugccuaacucagcucagaaaaucugacaucuccugaucucuguaaguguauauacacacacacaaacacacacacacacacacacacacacacacacacacacacacacacacacacacacaauugcauacaugcuuauucacaaauaaaaauuuaaaaaugucaaaaauugaaaucauauaaauacauaguugaauagcaguuaccagaaccuggaaagaaauaaagaauagauaacucugcaaggguucugaugcuuaggaaagacuaaaaugacucuagaagcccaagaguggcaaacauggcucuggcaggccuugcccuucuuugccauuuccucugccuugcuaaaauaucauuagcuuacauuccuaaagcuagucaccaaagcccauccuuuuuuuguuuguagaauauaauuuuaauauuucaacuguuaauauucaacaaagaauaauuauuuuaauguauuuuucauuuuuaugucucccuucauuuuugauuuuauuaauuagaauacugucucugugcccucugguuagucuggcuaaggguuuaucuaucuuguugauuuucucaaagaaccagcuccugguuuuguugauucuuuguauaguuccuuuuguuucuauuuaguuaauuucagcccugaguuuauuucuuguugucuacuccucuugggugaaauugcuucuuuuuguccuagagcuuucagguguucugucaagcugcuaguguaaggucucuccaguuucuuuuuggaggcacuuagagcuaugaguuuuucucuuagcacugcuuucauuaugucccauaaauuuugguaugauguguauugauuuucacuaaauucuaaaaagcauuuaauuucuuuucuuuauuucuuccuuggacaaguuaucauugaauagaguguuguucagcuuccauguguaugugugcuuuccauuguuuuugucaauauuuaagaccagccuuaguccauggugaucugauagggugcaugggauuauuucaaucuucuuguaucuguugaggccuguuuugugacuaauugauuauaugguugauuuuggaaaaaguaccauuaggugcugagaagauauauuccuuuguuuuaggaugaaauguucuguagcuaucuguuagauccauuugcuucauaaccuguguuguuuucacugugucucuguuuaguuucuguuuccaugaucuguccauugaugagaguggagugguaaaguagucucccacuauuauuauguggggugugauguaugcuuugagcuuuaguaaaguuucuuuuaugaguaugggugcccuugcauuuggagcauagauguucagaauugagaguucaccuugguagauuuuuccuuagaacaguaugaaguguccuuccuuaccuuuuuuugauaacuuuugguugaaaguguauuuuauuugauauuagaauggcuucucaagcuuguuucuugggaccguuuuuuuuuuuuugaaaauuguuuuccaaccuuuuacucugagguagugucuguccuugucucugccacugagguguguuuccugaaugcagcaaaauacuggguucuauuuacguauucaguuuguaauucuauguauuucauuggagaauugaguccauaggaaaagugauuguugcuuccuguuauuuuuguuguuagagguagaauuauguauguguggcuaucuucuuuuggguuuguugaaagaagauuauuuucuugcuuuuucuaggguguaguuucccucccuguguugaaguuuuccaucuacuauccuuuguaggacuggauuuguggaaagauguaaagggcugcaaucuacgugccgccacuagaugguucuaaaccucauugugcgcagcugcgagagcacagccagccaaagucaccaguccaucuccagggcuuuugcccaaccccugggggcuuuaaccuauccccagggugcaugaggaucauggguguugcuaccaguccuaguuuagacacgucaccaaaaguauuuaagccacacacuuucugagcuuucuuugucuaccucaauaugauauagaaguaaaaguuaaccguggaagaaucugguguguccuguguuuauuucccgcgggacggggauaagcucgggauagaaagauauuguguaaauuugguuuugucauagaauaucuuguuuuuuccaucuaugguaauugagaauuuuacuggguauuguauccugggcugacauuuguguucucuuagugucugcauaacaucugucuaggauauucugauuuucauagucucuggugagaagucugguguaauucugauuggucugccuuuauauguuacuugaccuuucucccuuaccgcuuuuaauacucuuuuuuuuuuuguuuguuuguuuuuuguuuugugcauuugguguuuugacaauuauaugaaaguuugcggggucaggggcaguuucuuuucugguccagucuauuuguaguucugugaacuucuuguauguuuaugugcaucucuuucuuucuuuagguuagggaaguuuucuucaauaauuuuguugaagauauugacuggcccuucaaguugagaaucuucaaucucuucuauaccuauuauccuuagauuuggucuucucauuguguccuagauuuccuggauguuuugcguuaagagcuuuuugcauuuugcauuuucuuugacuguugugucaauguuuuccaugguaucuucugaaccugagauucucucuucuauuucuuguauucuguuggugaugcuugcaucuaugaauccugaucucuuucguagauuuuucuaucuccaggguuaucuccuugugggauuucuucauuguuucuauuuucauuuuuagaucuuggaugguuuuguucaauuucuuccccuguuugguuguguuuuccuguaauucuuuaagggauuuuuauguuuccucuucaauggcuucuaccucuuuaccuguguucuacuguauuucuuuaagggaguuauuuauguccuucuuaaagucuuuuaucaucaucaugagaugugauuuuaaaucagagucuugcuuuugugguauguugggaaguccugggcucacuguggugguaaaacuggcuugugauggugacaaguagccuugguuucuguugcuuauguuccuguccuugccucuugccaucugcuuaucucugguguuauguggucuugcugucucugacugugacuuuucccuauugcaauccugugugucaguacuccuggguuagcuccagguuguagacagaaaccagaaggaucuuguccccagcuguuccuuggcuccugugucaugauggcucugggagguuccaucuugggccaagauuuugaaccuaugauuacagguguguuggcacuccugggagaccagcucucuccugcugguauuugaguaggcagcacugugguauaggaucagcuccaggugcagagggaaacccgaaggcuccugucccaggcuguuccucuuuuccuguguccugagaguucugagcaggucccucagcagaagugguggucuuaccugcacucacagguuugucagcauuccugggaggccagcucucuccuggugguauuuggguauggagugcuguggcauaggaucagcucucugcugaaacucucuuaguauuuuaucagcaacaaguaaaguuuucauucauucauucauucauucauucauucacuagugcuuaugguuuucuugcuaaccauauuuaaucaguuaaaauuacucauuuuagucguacaugcuucucacauggagauucaugugaauauauauacacacacacauauauauguauaugcauaugaauaugaauauguauauguauauauauguauauguauauaucaaagaacccuaaauaguuaguuccaagccagccaauguuauauagugagacccugucucaaauaaauaaauauuuaaauauuuaaaaagaaaucaaagaacaaauuauccauuucuaaugaagaauaauuuuaaacugagggagaaaauauucuuuuuuuaaauuaaaaaaaaguuuuauuagguauuuccuucauuuacauuuccagugaugucccaaaagucccccuuacccaccuacucccacuucuuggcccuggcguuccccuguacuggggcauauaaaguuugcauguccaaugggccucucuuuccagggauggccgauuaggucaucuuuugauacauaugcagcuagagucaagagcuccgggguacugguuaguucauaauguuauuccaccuauaggguuacagaucccuuuagcuccuuggguacuuucucuagcuccuccauugagggcccugugauccauccaauagcugacugugagcauccacuuauguguuugcuaggccccggcauagucucacaagagacagcuauaccuggguccuuucagcaagcucuugcuagugaaugcaauggugucaucauuuggaggcugauuaugggauggaucccuggauauggcagucucuugaugguccauccuuuugucucagcuccaaacuuugucucuguaacuccuuccauggguguuuuguucgcaauucuaagaaggagcaaagugucuacacuuuggucuucguucuucuucaguuucauguguuuugcaaauuauaucuuauaucucggguuucugggcuaauauccacuuaucagugaguacauaucauuugacuucuuuugugauuguguuaccucacucaggaugaugcccuccagguccaaccauuugccuaggaauuucauuaauucauucuuuuaaauagcugaguaguacuccauuguguaaauguaccacauuuucuguauccauuccucuguugaggggcaucuggguucuuuccagcuucugguuaucauaaauaaggcugcuaugaacauaguggagcauguguccuucuuaccaguucgaacauauucuggauauaugcccaggagaguuauugcaggauccuccggugguaguauguccaauuuucugaggaaccgccagacugauuuccagagugguuguacaagcuugcaauuccaccagcaauagaggaguguuccucuuucuccacauccucuccagcaucugcuaucaccugaauuuuuaaucuuagccauucugacuggugugagguggaaucucaggguuguuuugauuugcauuucccugaugauuaaggaugcugaacauucuuucaggugcuucucagccauucaguauuccucaggugagaauucuuuguucaguucugagccccauuuuuuaaugggguuauuugauuuuuuucgagucuaccuucuugaguucuuuauauauauuggauguuaguccccuaucugauuuaggauagguaaagauccuuucccaaucuguugguggccuuuuugucuuauugacggugucuuuugccuuacagaaggcuugcaauuuugugaggucccauuugucgauucuugaucuuacagcacaagccauuucuguucuauucaggaauuuuuccccugugcccauagcuucaaggcuuuuccccacuuucuccucuauaaguuucagugucucugguuuuaugaggaguuccuuuuuuuuuuuuuuuuuuuuuuuuaguuuugugacuauuuuauuuuauuuuuauuagguauuuauuucauuuacauuuccaaugcuaucccaaaagucccccaucugcucccccaccuacucccccacacacccacucccacuucuuggcccuggcguuccccuguacugaggcaguuauguggaauuccuugauccacuuagauuugaccuuaguacaaggagauaggaauggaucaauucacauucuucuacauguuaaccgccaguugugccaacaccauuuguugaaaaugcugucuuuuuuccacuggaugguuuuagcuccuuugucaaagaucaagugaccauagguguguggguucauuucugggucuucaauucuauuccauuggucuacuugucugucgcuauaccaguaccaugcaguuuuuaucacaguugcucuguaguaaagcuuuaggucaggcauggugauucccccagagguucuuuuauccuugagaagaguuuuugcuauccuagguuuuuuguuauuccagaugaauuuggagauugcccuuucuaauucguugaagaauugaguuggaauuuugauggggauugcauucaaucuguaguuugcuuuuggcaagguagccauuuuuacuauauugaucuugccaauccaugagcaugggagaucuuuccaucuucugagaucuucuuuaauuucuuucuucagagacuugaaguuuuuaucauacagaucuuucacuuccuuagagucacgccaagguauuuuauauuauuugugacuauugagaaggguguuauuucccuaauuucuuuuucagccuguuuauccuuugugcagagaaaggcuauugacuuguuugaguuaauuuuauauccagcuacugcacugaagcuguuuaucagguuuaggaguuuacugguggaauuuuuauggucacuuauauauacuaccauaucaucugcaaaaagugauauuuugacuucuuccuuuccaauuuguauucccuugaucuccuuuuguuaucuaauugcucuggcuaggacuuuaaguacaauguugaaaagguaucgagaaaguaggcagccuugccuagucccugauuuuagugggauugcuuccagcuucuuaccauuuacuuugauguugacuacuggccugcuguagauugcuuuuaucauguuuagguaugggccuugaauuccugaucuuuccaagacuuuuaucaugaauggguguuggauuuugucaacugcuuucuccccaucuaaugaucauguaguuuuugucuuugaguuuguuuauauaguggauuacaucgauggauuuucguauauuaaaccaucucugaaucccugggaugaaaccuacuuggucaggauggaugauuguuuugauguguucuuggauucaguuagcgagaauuauauugaggauauuugcaucgauauucauaagggaaauuggucugaaguucucuaucuuuguugggucuuucugugguuuggguaucaaaguaauuguggcuucauagaaugaguuggguagaguaccuucuguuucuauuuuguggaauaguuugugaagaacugggauuagaucuucuuugaaggucugauagaacucugcacuaaacccaucuguuccugggcuuuuuuugguugggauacuauuaaugacugcuucuauuucuuuaggggauuuggacuguuuagaucauuaaccugauccugauuuaacuuugguaccugguaucugucuagaaauuuguccauuucauucagguuuuccaguuuuguuaaguauggccuuuuguagaaggaucugaugguguuuuguauuucuucaggaucuguuguuaugucucccuuuucauuucugauuguguuaauuagaaugcugucccugugcccucuagugagucuggcuaaggguuuaucuauguuuuuuauuuuucucaaagaaccaguuccucguuuggcugauucuuugaauaguucuucuuguuuccacuuggucgauuuugccccugaguuugauuauuuccugcugucuacuccucuugggugaauuuguuuccuuuuguucuagagcuuuuagguguguugucaagcugcuugugugugcucucucuaguuucuuuuuggaggcacucagagcuaugaguuuuccucuuagaaaugauuuauugugucccauaaguuuggguauguuguggcuucguuuucauuaaacucuaaaaagucuuucauuuccuucuuucuuccuuccuugaccaagguaucauugagaagaaagaguguuguucaguuuccaugugaauguuggcuuucuauuauuuauguuguuauugaacaucagccucaguccauguugaucugauaggaugcaugggacaaucaauauuuuuguaucuguugaggccuguuuugugaccaauauauggucaauuuuggagaagguaccaugaggugcugagaagaagguauauccuuuuguuuuaggauaaaauauuuuguagauaucuguuaaauccauuuguuucauaacuucuguuaguuucacugugucccuguuuaguuucuguuuccaugaucuguccauugaugaaagugguguguugaagucucccacuauuauugugugagauacaauguguucuuugagguuuacuaaaguuucuuuaaugaauauggcugcccuuguauuuggagcauagauauucagaauugagaguuccucuuggagcauuuuaccugugaugaguaugaaaugucucuccuagucuuuuuugauaacuuuggguuggaaguugauuuuauuugauauuagaaaggcuacuccaggggcuggugagauggcucaguggguaagagcacccgacugcucuuccaaaggucugaaguucaaaucccagcaaccacaugguggcucacaaccaucuguaacaagaucugacgcccucuucuggagugucugaagacagcuacaguguacuuacauauaguaaauaaauaaaucuuuaaaaaaaaaaaaaaaaaaaaaaaaaagaaaggcuacuccagcuuguuucuucagacuauuugcuuggaaaauuguuuuucagccuuucauucugagguaaugucugucuuuuucccugagauggguucccuguaagcagcaaaauguuguguccuguuuguguagccagucuguuagucuaugucuuuuuauugaggaauugaguccauugauauuaagagauacuaaggaaaaguaauuguugcuucccauuauuuuuguuguuagagucggcauucuguucuuauggcugucuucuuuuugguuuguugaaggauuacuuucuugcuuuuucuagggcaugguuuucguccuuguauugguuuuuuucuguuauuauucuuugaagggcuggauuuuuggaaagauaaugugugaauuugguuuugucgugaaauucuuugguuucuccaucuaugauaauugaaaguuugguuggguauaguagccugggcuggcauuuguguucucuuagugucuguauaacaucuguccaggcucuucuggcuuucauagucucuggugaaaagucugguguaauucugauaguccugccuuuauauguuacuuauuucccuuuaauauucuaucuuuauuuagugcuugugcuguucugauuauuauguguagggaggaauuucuuuucugguucagucuauuuggaguuuuguaggcuucuuguauguucaugggcaucucuuucuuuagguuugggaaguuuucuucuuuaauuuuguugaagauauuugcuggcccuuuaaguugaaaagauucauucucaucaacuccuauuauccauagguuuagucuucucauuguguccuggauuuccugaauauuuugaguuaggaucuuuuugcauuuugcauaaucuuagauuguugugcugauguucucuauggaaucuuuugcaccugagauucugucuuccaucucuuguauucuguugcugauguucgcaucuaugguuccagauuucuuuccuaagguuucuaucuccagcuuugccucacuuuggguuuucuuuauuguguccacuucccuuuuuaggucuaguaugguuuuguucauuuccaucaccuguuuggaugugcuuuccucuaucuuuaaggacuuguaacucuuuagcaguguucuccuguauuucuuuaagugaguuauuaaaguccuucuugauguccucuaccaucaucaugagauaugcuuuuaaaucugagucuagcauuucggguguguuggggugaccaggacugggugaggugggagugcugcugauguuuugaugauggugaguggucuugguuacuguuaguaagauucuuacauuugccuuucgccaucugguaaucucuggaguuaguuguuauaguugucucugguuagagauuguuccucucuugguucuguuagccucuaucagcagaccugggagacuagcucucuccucuguguuuuaguggucagagcauucucuacaggcaagcucuccucuuacagauaagguacacagauaucuggcguucggaccucccuccuggcagaagaugaaggccugaaacaggaccugucccauaagcuguguugcuucggccugugacagaagcuguuagcuucuguaguccacacucucaccugcacagaauagucucagagggauccgggaacuaaggugguucccccaggugcucuggccaagcccucccgggcagggcagacuccucuccucuggcagggaaggugccuggauguuugaagcucaaaaaggggucugucucagaagcuguccucuagggaccuugggggugucagccaaccuugcgcccaaggugacccagugcuggugcagaccugaaggaacuugugacccuagucagaccggguuuccugcuucccuaaugcugucucagguccugugcaauuggauugcaacagaaguuguaguggucuuaagaucucguggagaguccucuacuggacugguacucuacugguguccgcugacucugugcccaaggugaccuggugcuggcgcugacuggaaggcgagaaaauauucuaaaugcuuuggucaaagugauuuaccuucacuuaaucuuuauuuuaugugacaaacagaaauguagacuguacaugucgccugcagcagacuauuugcggguacuuauuagauauaaaaugucugaccuugcuugacuuacuucaagauauuugagauaaugaaagugggcuacauacaugggauccuguauuuuacauaugcccucaggguaauuuuuaugagcugcuguuaagucacugcuaucauugaacccccaauccucagggcuaucagggcuaugcuauuuggguuuauaguuucagaaauuuuaauccaugguuguuugaccauauugcuauaggccuauggugauauauauauauauauauauauauauauauauauauauauauauguguguguguguguguguguguguguguguguguacacaaucuucucuuccuauauauauaguggaagagaagauugcucacaucauggugggcuagaagccacuggaagaagccagcauuccaucauccuugagggcacaugcagacucucccucccgauaggcuuacaaauuuuccauccucucccuggcuggaaaucaugaugcugacauaugggccuuugagggcaugcuccagauccaaacuauagaaacugugagugauaacuagugagaaggguccaaauuuuauuaagaacuccaaugcaaauuuucuuuuacccuuuucucucccuuaccacacaauaguaauucacugugcuucugcagcuuuaugggaggcugaaauagcgagagguuagcccuuucuccuucccuacacugguaauuuauuucugcaaguucaauuguuccccaagauuuguuaucacacaguagauacuacagaaacauccuacacaucaucccaccccaagaaagaaccaguaguuucaguaacucaaaacaaaaaagagcaggacaccugaagcucucaaagagucaaggaagacauggcacucaagcauuuucucugguaaaagaacaguaguuucuuaagcagcagaugacauacaggaaggcacuuugacaaagaugaagauguagaauauaucaugauaaucaagaacagagaaauaugguuuugaaauagcagcauguucuaagacacagggagaauaaaguauaugccccccccggggggggggguccugagcauccuccuucuguagcuaucugccuaagcaugcauacauacagaagacacaaucaucaagaaaaagacaugcuacugauuaugaacacauaugaaaugugugauucagucucuuuucuggaaagguuucuaagaacauucagaaacauuuaaugacuaugucaauuggauaacaugaaaugaacccuucaagaacauuucccugauaguaaaagccccaagcuauugcucuuucauagugugcuauuuaagaugcuucuaaucuguacuugugcaucuuuuccugaagugauuaucugugucaggcggcuuccuaucaggcagagcaacucaguaggacgguacauguuuaucaugcaugagucugcaaguucaauccucaccauggcaaaaacagaagaagaaagucagaacaugauucccaccguuuagcacugggaaaaagucuuccugugccagagaaaagacagcucguucuccaaugaugcaaugaaugugcuugcagugugccuggcagggcuagccacaaguuguggucagagguucagcaauauuuugaauguaaaugagaugaagcuccccauuuuaaaaauucagaacucuaaggaucuggcagaucuguuaccucuguacacguggaggacugaggacauccucaagaagacuugccuugcugaaggaaagcacaaacaguuuugugcaccccagaagcagagccgggagaguaaugcagagccaggagaguaaucacuaauaucagagcucuccccauaguuguaauacaaaguauagcauguaguuaagucagacuuugggaagcuuaaauuuaugugauaggauauuguaauuccccaaacucugaguauuuuaaguaauuuuguugcuagaaaauaacuugcaaagacaacuuuauaguggucuacuugugcacagcugggggguguggggggggagaagaaauauguucuccauacaaagcuguauguagguagcuuuuguagugguuuuauuuaagcaaaggaaccguagcuaaugcagcaacaugggucaguagcaaauaauugugcuaagugaaagaagccaaacaaaaugaauaagcacagcauuauaacgugauuuuauaacauuauugaaacugcaaauucaacucuagugaaagaaggaauguuagcaguugccuagugaggccaagaguuagggggacugggaauaauggggaaagggaacuacaaagaauggcuaggagguuuuauauauauauauauauuuuuuuuucaggcgccaguaguaggggaugacagcgucgauacauauauacguacauacauacaaacaugcaaacauacauauaugcauauguguacauacauauguauauacauauauacauauguauauauauauauguaaacauauauuacauguauauauaugcuuauacauagacauaaauugcguauuuagauacaugcagcuuacugugugucagcuccaugccaauaaaucguuaaagagaacauaaccugaaucauguucuugcaugcauucuuauccuucuuguuccuccguuuauauggcacuggcuuggaaaaagcacaguguuggccagauuuauuuauauuaccaguaugguaacaugucucgcaaaacuaagcaaacauuagauaguaacacaugaaaagaaguuauuuuguuaaauaguaugagagcuacaacaagacaucauaguagggcagugagguggcuccaucaguaagggcagcacgggcaccagcuacaaggugacaaccagacucagucccaggacccacauauuagaaggagagaaccaacuuccaugaauaauccucugacuuccacacacgagccuuagcauguuaacacccacaggauacagcucaguucuccaaauaugcacauuaguaaaucuaauaaaaugccaauuuccuaguaggcuuccuggugauuuuuauuuucuuguauaucuuggugcccaaucuaaaccauucagaagggacacugaguacccugggaauguuaaaccuaagcauucuauaaccagucauucuuuaaggucacuccguggugaggucacuuugaaaagucaauccgcgaggucacuccauggaguugcuuguugaggucacuuagccgaggcauuccaaucuguggaaaugcacuuuucacccucucugauguuuucaccccaccauuuuuuucucucaccucuagcuagaagacgaaaucacaacauuacgacaaguuuugucagcaaaagaaagacaucugguugagaucaaacagaaacucggcaugaaucugaugaaugaguuaaagcagaacuucagcaggagcuggcacgacaugcagaccacgacugcgugaguaucuuccagaacuugaguuaaguuagggaguuuucagucccgccccgauuccgcuuccggguuuccucuuuggcuucuccuacaagguugauuuggugcuuguagcaugaagaugauauuuucuuuaggagcaagguaaagaaguaugagugauuauuaaauauauugcguguacaguaaacuauaaaagaacucccuucaauaaaccguuguugaucaaaacucuuaauuccaggagcuaaggauggauguagcucagcuggugcuugccuagauacgggaaauucugggcucagucacuaacgcugcaugagggugugaugggcguucuuucccuucuaacacuggagaaguagagauaggaggaucggaaauucaagggcauccucagcuacaaccaauuuagacaccagccugagaaacaccagacuuugccacaaaaaccaaccaaacaacucaauuuagacuacuuuuauuguuguuucauuuuuagauuuuauuauaaaaauuuugcaaaagauaauuauacugaaauuaaccugauccaaagucuauauaucacaguuaccuucuauccaauuagaauagucauuugaaaaagaugcuguguacacuggauuuuauucuuucacuaucaaauauauuuuuauacacauauccaccaccaaaccccaaaauccugugacagaguuaggacuaccaaaacaaguagcuuuauauccucuuucauaauuguguccauuauccaaauucagucccucuguauccucuaacauucagccuuucuuguucgucuuucuacauguuaugcccccccccacauauuuauuuguggguagauuuuguauaagaggggaguaugaaauauuuuuauuucagacauuguggaaccucacuuaauauuacacacucuaaguccaucuauuuuucugaaaauuuucugauuacauuuucuuuagaguuaacuagauaguauuccauuaguucaugggucuguauuagauuuucauuauccauuuaucuguugaugaauaauuagcuuaauuccaacucauugcuauagugaauaaagcagcaauaaaccuggggugcaaauaucucugugguagguagugggguucucuggauaugaaauagcugggucauauguagguucuauuuuuuucuucauuauuuuuuuaauuagguauuuucuucauuuacauuuccaauguuaccccaaaagucccccaaacuccccccccccacuccccuaccccccacuccccuaccccccccacuccugguucuauuuuuaauauuuggaaaauaucaaaacagauuuucacaauggcccauuaauuugcaccccaccaauagugaauaaauauucuuaucuuuccacaucuuuuccaacaucugcugucagauguguugauguuagccauucugacuggagggaauugguagcucauuaucuucugggaaugggcagaagcuucccaagaaaucaggagcugcccuuugcacacuuguuaccguucugucugagccuauaaccgugguguuugcuaauuaucaugggcuggcaagaccaggugacuuggcauugggaugggacuucuuguuauuuaaacuauuuuucuuguuaggugaucuuauaugaaaaagguuguuaccuaagagguuuuucuucuuuucuguguauugaguauuaauaaaugauaggcaaucagagggacuuccuguccaaaaccuuaacuuuaaccccaaguucagccacugagacucuuugucuuugacuuauacguuucuugccugcuccauucagugaaauauaaagauccugucuucaucuaugucugauaccugugggaaucagucaguaaucugagcuucugauuucaccuuuuggugaccaguaccaccgaguugcccugacagugaaugucugaacaacuuccuucugagguauaggaaggauuguuucaucugaccuccauaaucauuucagggguuagauaaccaaauauggacggaguauuuuuguggcugaagauggggaggaagaagaggagggaauaguuguguacgguguauccauagagucaagcugugauggaggcagcaagagggagaggcauauguaucuugaauguggaauuacagcagggagguuguaagagaauuguucuagccuagucauaugggaaagaauggguagucucuguuucuugaguuugaagaagaaauugguguagccaagcagucuacuugguguauaaaaugaauagcacagauucagugccugggguuaaggaguuuacaauacaaucaaagagauaagaguuuuguuuguuuguuuguuuuuucaugaauaauaaauacagagcacuguggggaugugaauugggauaggaguuuugccuggcgauaauaccccucuagggacaaagcaggguuuccaaggaguccuuaaagguaaucagucugagagaggcaggugguagcucuugagagugacacacacugguuaugguucagaagaacuauagguucuaccccuagggagagcaucuaguuagugugcuugcucaguuaauagaguuaccuuccuucugcagggaauagagaucgucaaaggguccuauccagucauuuaucuaacaagugcuaaugaaugucuacuguuaggcauauauuaccuacgggcuaaucuagacuccaggauaauaggaguggcauggugccuacuuuuaauucaguguugaaaggggaaaagaaaauugagcaaggaacaaguaaugaaauaagcaagcaaggagcugcccgggaggaauugccaggaugcgcuaugacaaagccagcauccggugauuugccagugagcgacagaggagaggguggaagcugcugggauggagucccagucaagaaaaucuuucuugagacccugauuucagcugagacuugaaagacuggaaaugcccaguguuaaaugcucuagggaagaacuuucagggugagaaaaaguugauacaaagacucugaggcaggaacuagcuuuucaguuuuagugagucaaaaaaaugucucuuaaaaagucuagacaguaugucuguaguguauugagacuagagugagaauuuaaugccaagggcuuuagaugcuacuggaagauuuggaacaggaaaugaccuagguugauguacauguauggaucauuaacauuagauuauguaguagaucauggagggguaaggguguuaggauaaagugauggaaaaguaccuuugucagucacaccaugcaacagaccuagagcaggagguuuauggggggaaggggagaacuaaagggugccuuggaguagcuagagggaaagagagagagcaaacaugacaaagaaaagaggagggugagggagggugggaacacaugagcaagacugaggugacccaggccuuuuaugugccucaccuggcaauggcaguugaugacacaaacugcugcugcugagucacugacgggcagguuggcagagugcauaauuuacaacagugggugggaguugggaaaucauuucugagacuguuguaagagggaggcauggagcaggggaaggaucuggaggugagucugacaagaagucccaaugguuuggagguaaaugcggagggaagcaguggucaaaugagacccucuuguauucuuggauuacacaguacccauuccacuugccucagugucaggagagcauugcucucaugggcugcagauaugucagcuuggauucuguguacacagggaaagagacccugucaguaccagggugauauggagugaggauuuaaugaaguuaaauauuguaggaagaugauguccaaugcuuuguaggccugugguaacucuaugcuaucauuaggaaaacugagacacagagguagaucugacacucaaugauuguaucaaacauuuugguaauguuugaacuaccccauaagcaaauuucagacagagaggauaacuugaccaaaguuaaagccagagaugugugugugcauacaugagugugugugugugugugugugugugugugugucugugucugugugugugugugugugugugugugugucugugugugugugugugugucugugugugugugugugugugugugucuguguguguguguauuuaguuauuugcucauggguaucauuguuagacuggccuuggagauuauauaauaaguccaaugucugugguuucacuaaccuuuaagaaugaagaugaacuccucuuaguagagaagagccaaccuuaucagagccucuucuuaccagugaagagcaaaaaguuuaucaacuguauaauuuuaggagaaagucuucgacuaacccuauuuccuuggcugcugagggauaguugaggagggagcuuauaauauguugggaagagaaauaacaaaaauauuuuuuacccugaauuaauuaaauaccacucuuuaguauucaugacucccauccuagcacacauucuguuggacacaaauguugagaugagagaaugaugagcuguggugaguuagcugcggaaaaauuagacuucaaagcacugcaaaggguuucagcucucagagaacaagugugaugcccagaggugauacuuugcauaaugauuaggcaaucacagucuauuuaauuugauuaauaaugaaaagaaaaauccuuguaugcuaaugaaagaucuuggcauguuuuccucagcaauaggauucaaauugccauaggucccaagugaguaagaauaauuacauaauggacucagaucaucuccuuuauagaaauaguucaggaauacagaagcaggacaagggguuaucuguguauaugugugagggagggggcaauggcagggguaguuguucucauucuugcccauuuuguucauaucuagacuucuuuuauugucuuuuagggucaaggaggcaggguacauguagguggcuuagagccaguaaaccuguuuauuuauucaauguucugcuuugugaacccaugaaauucuuccaccaaucaaccucugugcauuguaccaaaggccuaaugguagguccauagaagguaggagguuuucaaaaggaauuuuaacuccuccauguuuuuuuguuuuguuuuguuuuguuuuuuuuuguuuuuuguuuuuugaaaagcacaggaacuaagcuacccagaaagaauucagccuaaccugcagccuuucagagacucacagugccugaaaagugagguucaguuuaggacuuaguuacucuuugcugcugggcuugauuuuuuugggucaccauggucugaaugacaauuaucucuuugugaggagcacuuuguagcucugcugcauucagauguaucaaugaagauuaaaaaccuuauuuuaaaaguugugcaugccgaaucucccuuggcuuuaguucucuuuaucuucagggugcuauuuauuacacaaaccuggaaguagauucuuuucuuccagacagaaguguuaaauuaauauuuuaauaacauacuuaggaugccuugaaagaaaauuauccuaaauaauuuuguaaguccuuggugagauguuaaaaagacagucauuaagggaaugaaguguuuuaaaucucuucuuaggagacauauguucaugcuguaaaauaccuuguaagaaaacaguugauguuguaguccuuucuucuaguuauauguagaaaaugcuuaaguccaaaucacauacuguuuuguccuuuugauuauuagcacugccuuuuaaaaucauaaaucaugugaucuaugugaacuaccaagggaaucuauguaaaaagccaauaaaauucuuuguauuugucuuggagaaggucuucaaaaaguucuacagaggaugcccuguguaccggcaaaccagcucaccuggcuguuaagugcuuaacauuucagcagagcucacucaguuugagaucaaguucaaccaggacuccacauaaaauuacagggggugaacaauguacaaccugagguacccuucauguagacuaugcuguaaguggugcuccuuagagcuucuaaguacugggaguucaaugaccuauuucucauaggcccuugguugcuaugguguugguaaucacuucccacauauaacuucuucucacugccuacaccuggagaucuuuuuugguuauugacucuaggcaccauguaaaugacuacuaacuauucuuaagaaacaguuugccuaaugaagagauagaaaacaaaacacacacacauacauauacacacaucuuagaauugugugugugugcacgcacauacacacaugugugugugcacgcacauacacacaugugugcauuugugugcauaauugcuugugugcauguuuacacuuguauguggaggccagaagaccucaggugguguuccucaggcccuguucaccuuuauuuugagacagaauuuccugcacaucauaaaauucuuaaaacauggucuuauuuucucuacaugaaacuguugcuauaaaaagcuggcccaacucaucuccgugucaucuccaaggugaaaggacauuaugggggaagggagucaccaacucugucaucauggagcuaccacacucuuccauccuaccauucaucauguguaaucugaaggacucgguucuaauggccuucagaauuaacauuaagggcucaaggcccaaaauucaauucucaguacuacacaugagcacaaggaaagaaaaacaaauaauaaaaagaacaaaauggaguuaccaguuauuccucagaaauaaugaguccuggaaucuuuaauacugcauugagacaagcauaggcugcacugugacuuugaaauuaaaaguggaaauaaaugauaugcauauuucauuguugauacauaagugugacuaacacagaaguccacagaucuucaugugcaccuaacucucauuauuggaaaugacuuuaaagcaauguaauacuuacuguuuacaauaugacugcacuggcuaguuuuaugucaacuugacacaggcuggaguuaucacagagaaaggagcuucaguuggggagaugccuccacgagauccagcuguaaggcauuuucucaauuagugaucaagggggaaaggccccuuguggguggggccaucucugggcugguagucuuggguucuauaagagagcaggcugagcaagccaguaaagaacaucccuccauggccucugcaucagcuccugcuuccugaccugcuugaguuccaguccuaacuuccuuggugaugaacagcaguauggaaguguaagccgaauaaacccuuuccuccccaacuugcuucuuguucgugauguuuuguccaggaauagaaacccugacuaagacaaugaccuuauuucuagccaguuucaaauuaagccaucaaauucagugucauacauauaugcaaaaaagucuauaucacaauucaaagcccucucaaacacacagggcuaaacuacauagaccagcccauagaaguaguaaaaaugcaggauaauugcaagaagcuguuaaagcaugcaaaacugacacaucagaaggaaucaucuaggcuaacucagcuccuugugaugaucacccuugucaccguuuucuucuguguccuuugaaguaucuuucgggccacucaagucggggcugagaggcuucccaaagacauuuuucucagccuuccaggacugccuuuucuuuccuauuccagccuuccugacuagggcuuaaucuguuuauacugccuuucacauggucaaggcuccaacaagcuauggcccuauugaauagagaaagguggguucuagucuuccuuggaguacaggcuuuuuauuccuuccaaauagaacauugccacuaaccugaccucuuccuugccaaauuuacagauaucacaaaguggaaaaaguagagcagaguaccccggguuugacagagccuggaauccuugggagcaguggggcagcuagggcagcugaagcugggcaaguaggaaagaggccgagugaguggguuaggcugaaagaccagaggggcugggaguaugggcuuuggacuucucuauacaugaaaugaaaagcuagugaacggugucaagaaaauugagacuuggcuugauguuuuaauggcucuuucuggcugguguguggaagagacucuguagggagagaaagguagaaaugggaagacaaguuaggacauuguugcuacaagagcccagguaugugcuggugcccgguagagaguggagguggugagagaauuggcagguucuaguucugcugugaaaauugaaauaagacacaaggguuccuugcuggauuggaggcagaggaacaaaggucaaaagugaugcuggccuauccucuaauggauuguuucauuuccccaccacugugcaugagagauuuugcacagaaaaaaauugcuucucgauuuuuuucccagaauuguguuaucaguauuaguacagaguucuccaauaaagcuaacucuaaauccuagucucuagugcauggauaugucucauauacauauugugcuuuucuuuccuccacggugcccccauucugucuuuuaaucuacuuuuuguagauaugguuucaugacccaauuacuacauuaugaaaagucuaucagcauccuagaaaucuaaugggguaggaauuucagauuuuuugauuuguugguacauagaaugucuuuauuuucauaauuuucuuuuuaaaguauuuucaagugugugugugcauagaacuggagaacuucuaggcgguggugagcagccugaugugggugcuaccugacgugguccuccacaagagcagugcaugcuuuuacccacugagcuaucuacagccccagacucuuuauuuuuaaggccaacgguguuacauuucaacacugcugaguccaguccauuaguguucaguauacuacuucuggauccuuuugagugguuaguuuguucuaaagaauuucagcucaugccauuuggugauuggagagcucuaaaaucaugugacaaugcuuaacauucuuauuacuaaucuuuuauagucaauacuaugcuaacugccuuauuagcagcaacuuguauuuuaauauuuuaucucaaguauaaacugccagguuuauguuugguuucaauuggucauagcuuuacuacaauuuuuaaaaaguuauauguguaaaauguagaaaguaaaauuagacuuugaauaugcuaucuucagaccuuuucagaaauuaaauaaauaaaguuagauuuuucuggacgucccuuucuuccaucuucugacuacuccuuagcugugugaccuguuaccagccagggcucaccauacacacaaucuguucuucagagacauaaacuccaagucaaugacuuacucgugaaauacuuuugaaauuuacagguucacagccaggaaagaaguaagguuaaacuccaaggucuuaaguguggcuuguugcuauuuuaauguuuuuccuugaaauauaaguaucuaaaaggaguguugucuccacauagcaaccuucacagugaauuuuguuaauugugaaagaacuuuuggcuccaagcuggcaagagacuucagccgaacucuaggaugaaguaggggucuccuuucacuucccacauccccauaauucgucuuguccuuuuuuuccuuaagauuuauuuauuuuauguaugcgacuacacuguuacugccuucagauacacuggaagagggcauuagaccccauuacagauggcuauaagccaccauguaguugcugggaauugaacucaggaccccuggaagagcagucaguguucuuaacaaucugagccaucucuccaaccccuuuuucaauuucaaccuugccuuucaauucuguuucauugcuuaucauuuacagcucuaguugguggcuugcaccugggaaaguggagaagcuaaaagugagguagacuaaagucucaugcaaucagagcaugagacagcuuuacucagcaucagauaacuuauacucugaggguuaaguagaguaaguugaguaaaguguacuagucacaaggacaagcuguacauggcaaaaacauguuuuuccacagagaaacauuaauaacaacagcuggaguaaacucacuccaauccacuacaccugggaggaguaugaaaguacauucgaagaacaauucuguguuuugaagaaauugagguuauaacacugacuugggguuuuauugcuaggaagagacaccaugcccauggcaacucuuauaaaggaaaauauagagcuggggcuugcauuagucuaucauccaggugggaagcaugguggcauguagauagacuuggugcuggagagguagcugagaguuccacauccgguuccacaggcagcaggcaaagaaugagaugcaguuguccuaacuugagcuucuuggacuucaaagcucauccccagguacucauuuccuccaacaaggccacaccuccugguaguaaaacucuaauuacaguugaaguccaccaucauggguugauugccucccuuccuuagcauggcuucuccuucucugaccuugccuggggaauucuaaacccacacuuaugccucuaccugaggaaugucacauagccucaauuagaucaauuuccuuucuucugacaaaaccuguucaucuggcaccuaagauuccugaagugcuuccccaugccaauaaggcaucucagguacccuaagcccccaaccaaugaccuuugcccauccucaauguuccuaccgucagucccucaaaacuuuaaaaagcuuugagucacucaaaguaaaguugauuugccuccugauagcuggucaaggugugguuuauuuaccuuaaguacucauaggacuucugaacacccuucaucccaucucugccugccucugccccccacauagugacacauccuuauaggccccuggggccauuuucuuucaaaccaccacacgaaucucuugucaucuuggaguuuuuucacaggaacucagaauucucacaugacuccacucuuggacuguguucugacucuuaccaugauucucuuuucauucuagguacaagaaaacgcacgaaacccugagccacgcagggcagaaggcaacagcagcuuucaauaacgugggaacugccaucagcaagaaguuuggagauaugagguaauucggcagaaaaacacgggaacgcugccaaaaagcacuguguguagggaggguauuuuuucuauaaugguuaaaugacauugaugacagaaauacauuuucguguugggauauuuucugucuaaagguugauuuagaagccuggcuccaaccauacucuuucuaccaauaaaagcaaaaggcagagggaaugaggagggauuucaaaacaacccagugcacagagaaccugacugauuuuauuaaccuuucccuuuacugugaacagaaaagauaaagccaggaagaauucauuuuguuucauaguuugaagguguagucuauccccaucaggaagucauggcggcagcgguacggguuugaggcagcuggucucaaggcaacuguagucagggagcggagagcugugaaugccaaagcucuccuuuuaguccuggagcccaugggcuagugaauagaaacagccuucuagaugcaaccagagacacaguaauccagacacauuccauaguaauucuaaaucuaaucaaauugacaauacauauuaagcaucauaucucuuaauuuaaaugauacaggaaaauauuccgugggauauguucugguaaauuauuauagguuacauuuuuuauucaaccaucuggcuuauuucauauuauaaaaugguauuauuugucuuauacuucugguaguuuucuuucuuuccuuuaccagaauaccaagauauauuaaucauuuuuacaccuucaugcuuaauaacugaaucaucauauaugucauaacagcaguaaaaacuuuaaguaacuacccuccaugggacauuugccaguuuacagagcaguaaggaggacuacaccgaacauccuuacuguagaacaagggaagccuguuguauaggauauuuuuacuuuuuuauauuauauguaugggaaagguuucacaauauuauuacuguucuauuuguauuguuuaaaugccuguugacuuguuuggaauuugacugauguggcuuaggugauccuucuuuagaaaucaauuuuauuuuucucuuagaccaauuuuuuuuuucccagagaaaagguugcucuguauaucccugcauguucuggaacucauucuguagaccagacuggccucagacucagagauccaccugucucugccuccuaagugcugggauuaaagucauguaccaccagugcccaggccaaauuauuuuuuuuaaguuggaaaguuuuacguuucuccucuuaaaaguuuaugucauaaauuucuuaaacuauuauuucuuugaagcuuugauaccuagaaacaaauauucaugucuuuguauuuaguguuuuacaucaaaggugguuggguuaugcaucauagucaggaaccauuuuagugaaguauucaugcggauaguuaauuacagguauggauguggacacucuccaguguuuugucuucauuuuuaugaauaccacauuaucaaaagacauugacaucuucagaggcagcaugugauuuuuguauucuuaguuauuucuaauuuuauuaaguuugaaguuguaucaguggauucaaacuauuuacuugaacaaguaucucuuauacaagaaagauccuucugcccauuguauaugagaaaauauauuuggcuauguuuaugaaauuuggucuuuacaugugcacuugaaaucuuucucuugaacacuagagcauuacugccaaguagugucccuccaucuccaugaguccauauaaacaucucucaagcguuuuaaaaauauguuuuuccaaauugcacuucuucaagauugggcucagaggggcuuggguggagguuaggaaucugccucuguaucaggcacguggggaagugacugcuucagauguaauugauccaucuucuaccuggauguguucccucaugaacugaggaggagaggagggugggcuaaggcuguaauucaguaguggacaguuuacuuuacauacaugagggagcucuuggguuucauccaauaaaaucaaagugagggaaacccaaguagcagcaucauuaggguauuauagagcauggcauguacugugcauuuaaauguuaguuuauuauaugaccaucucaaggugguccuuaacaugaaggaaaucaguauucaucuaucaucaucuuucucuaaauagugagaaacaaaggcuguugcgagaguauguugguauacucugguucauauuguaacaggauaugauaaccaguugucaacugccuuuucuccuguuuuaagguguuuuguuuuagcacagugccuaacucuugacccaggacuuccacgcuagucauuaauuacaacuucacauaaagacacacaguuuucauugugaaguggcuguucaugugcuagaguuaugucaguaguaaagcaauugcauuggugagcccugggacucuagccucauugcuuucaaacgaauagugacuaaaaauccugggacacguaguauauguuucuagagauucaaauauaauucugaaaauuuuuauaaaguuagaaaaagucagagauauauuucuaguuuuaucaaguuuuagaaagacuuuuuaguuuuaaguuuuacuaaacaaguaauguguagaugccauuuaaaaguuucuucagguuaauacccucaaaugagaaaaaaaaugucuuuauguuuuguucaaacuaaugugucaauuuauaaaacaauccaaggaaauguuaaaauguacuuuccuuuaaacuuucuguugcuuuaaaguaugcuguuacccuauauuuguauccauuauacuauaaaauuccuuuguguguucuaggaccaaauucaugaccauggucagucuuuuucuccaacugugaacagcauuaguagugcuuggcccacguguauguuaaagucaugugauauccaugaggugaagucugaggaagugucacccguucggauaguucuuauaacauuggaauccucucagaaguucucagugaaucuguccaaaccaugauccagugggggccaaacguuaagaggaagcauaugauggaggcuugccaucaauauauuguuguggcaaaaugcaacuugaagaaaauuuuaacaguguuaaagaaaaaucuuuaagacaaguuaaaaagucagcacuauuagcuguuguuucuacauugguggguuccaccaaccacagguugaaaagguuuuaauucaucuuuauugaacaugugcaaaguuuuguacuaacauucuuuaaguaacaaggcauggcaaaugcuauaugauuuuuacccuguguuagguaucacauguaaugcaaguaauaaguauagacgcugugugcaaauacugaaggacucuauucaaggacuuaaacauccugugauuuccauaucuacucaguccugggacccuuccccucagaaggcaaacugcguacucaaaagaacagcaaaaggaguugcuuaaaccucucuuuuuggccucuuacaaaggagugaaagccacagggggggcauuucuucacagucugcuaacucugccccuuucuuuucucccaugcugccuggcugcaggucucacucuuuuggguaagcacacuauguugagucugugaggcugugugacuccuccuccccugccuauccguucuacucauggcccucagcucccuucacucugugccacaaccagaaaaacaagaccauuuucucuagcaugcguguuaacaaggaagaggccaguuaugcagcacuacguccacuaguguucauucaaccacacauucaucucacuugugaauuucccuaucaguuucauuuucuggacagucucuuagcuugagaucucuucuguaagcaccauuucuucugacauugacuugguccuuagaauacaaagacgugaagaaauugagguucuuuguuuuguuuugaauaaaacuugcagaacacagaguugagaaacagagaaccauuuuccaccuauauuuccggagaacagugguucuucgaguauuuuuuuuaauuugacacacugaugucugaacuuccauucccauauuuuuacuggacaauacuuauguuaauaaguuaguggcuuucagccugagugacaggcugccccccaaaaaccugcuuuuauauacuuuuaaauucagcuugaauuggcugauuucaucagugaagaaaaccuaucacugaggacuucaacauaagcucccccuuuuuuucuggaaucacaguaugaauuuaaugcacccccaauccaccgcagcccucacccuagauuguauuuaaugagaugagcagaucaguaauacuugauuuccugaagcaguguguuuuaaaugcaauuucuauauauggucuuuggaagacuacaaaucugccugaaugacuuuugacauuucaguagaagguugcccaucccaaugaccuuaggugauaguuucugggauacgugaucuaaaaccuguuagcuucuagggcagugguuuucaaccuuccucauguuguggugacccuaaaccaaaaauuauuuuuguugcuacuucauaacuguaauuuugcuguuguuuuguaucauaauauaaaugucuguuucuggauguucauaggcaacccagagaaaggguuguucgacccuagcaagggguugaaccccacaaguugaguaccacuguucuagggagaagagaaagcaggauccguuuaaaauguggcuggagaacaaucccuagcccaggacaacggaauccaguuugcuuccucccacugccuucaccccaguuuuggagaaaacucaguagauaauaccacacaaugagaggguagaugacaagucagcuacucuaagguuaagauccugaaacucccaggugugguuauauuuauaccaguuguuccugacaguuaguuuagaauggauguagaaguccucuccuuccagcagagguguguguguguguguguguguguuuucguugugggggcgaacuguauuagccuagcaugugcuuccuaggaugccuuuucuuagccaucugcaucccucuggacaguuucuguacaauggaucauuagcaucuacccaccuggcuguccuuccuggcugcugcucuucacucuuccccagugugagaaggaaguggagaccagggucaggcugagggauuccaacccuuucagauuuccugcagggccccuaggaaagaggggaggcuuuggccauugcucgccuauuuuuccuuauacccucagaagcugacuguggcuacuuaugccaagggaaaacaaauaccaucuugguugggugggcaaggaauacuguggauauuuaaaauugcugcuuuagaacuguuaaaccaggacuuuuccacaaaccuaaauuaugcuaucuucuuaaugugcuuuguccugaagguacuccauccgccauuccauaaguaugccugccaugagguaaugugcacaaaauauugacaucacuuuaaugcagaauguauugaagcacuuauuuuuacuuguagguuccuuccccauauugcuuuaugugaaaggaguuagcugaaguaaccuauuaugucucauguuucuuuccgacuaucuugcucuggacuuggguuucugacacacucggccuuaaauucaauucuucuugagaccagagacaagggcuucaucuauaucaacugccauuuccuuaccacaugcuauaaaguauuaagagcugcucugcaugaauuuaugaggccaaaacauaauuaccuauauaagcacuaacaagaggccuggaacauucuaaacacauuugcauaauuaaaugcaaacacaggagaaaaaggagagagagaaagagaaugggagacucauaggguggcauuccuguuaaagaugucauuaaaauuugagaucaguugucugucaagaguuuaacaaugacagacgacuacaauccuggauagauuacugaugagaaacauggcuuaugauuaaaacaaaauuccucgugguaauagucuggagacaugggaaugaagaaaggcaggcuguagcacaguucugacaacaaucaauguuacagaccugcuaaaaccauuucacugaucaauuguacuguauagaaaaaaaggaagcaggaaccagauuugcugcucuucccauguugccccugagggaugcuccagcagccugggcuccugucauuguggcauaaaggagcacaucaagccucuaggaccuucccacacuucagucggaaucuggacacccuuugcuucauaguguacauuaugauuuagagucaucgcggagggaauucaguuucagagacccugggaaccaaauucuccuagggucauuuguaguaccaagaguuuauaguuguacauggguaauuaaauuugcuuaaccagcucucccuguccuuuagcaugcauucugguauaauuuaauuagagaaauguuuauucuuuaaugucugaugaagucucuucuaugcuggggauauuuuucaauuaguugguugggaaauuuaaccacuguguuugguuuuccauauuugguagaaauaagauugcuuaauucaucuucaaccaaauuguuagcagcucccauaagguacccaggcugauuaguccaacacaaggcauguagcucuuggaaaggcuaaguuuacaucuggguguccgaaggaggauuggagaaaacaaaagucccacucugugaaucaaaucagaaauccaucuuguggccuaaagggcaaacgcaaucucaugaauuuccugaaguuagguuugagaggaaauuaaguuuacuaaucuaacuuagauccacaaaacauccaucuuaccugccuacccacuguaggaccacauaacugauggauaucauguaggcaggcucagccaaauaaaacccaaagagaaaaugaagugccacacuauauaauuuugagccauacaaauauaauuucaccaugaaacaggguuauuaugaagaauuauuuauaggaacuugacuaauauuugagucaugagcaagguacaaagcuaugcccugcagcuggaauggggguacauuucuugccauggggacugacaaaguugcagaaacaauccucaacaaagccaaagacccagagaauauauuuuguacgaugacugccucuugaccaucuuagagccauggcucaucccacaccuuaaagcaaaacccaaauguccuagccacacucccuuaucaagauucucuaagucauuccucuuacuuuauuauccucuguacucaagaacaagcagcuuaucaaauauaauaaagucuaauugaaauauuugacuugacuauaaugacaauuguuacugaaaugugauaugcaacauuuaagauauaucuuuuaguuuaucuucuauuucuuuaauuagguuuaguaguaucaguguaaucagugugguguagagauacuuuugugggcaaaugcaacaaagaaagcaccaaaugacugaaacccagaagauggaagacaggugauacaauauuugagucauaaauaaaaugccuaucagguaggaaggcucuaucuccuaagaggaugggaaaauaauauaugaagcuaacaaagaaaugauuuagaggugguggagauggggcauccaccauauaacaagaagaauaucaacuuuuagaaaugcuauuuccuacaauuagucaacaucauuauuuuuuaaggcacagaaagagaaaagccaggaacauuuuuuuuucuccuugagcuauuuuuuguccuucuugucuccuauuuacuagaagcaaacaaacaaacaaacaaacaacacuuuaacauuccaaguuggaaaucuuaugcaugacauguaaacagcucuuccacugaccauuaaaacaaacaaagagaagaguuaggaaaaggacuguuguggcagaaaacaauacauuaacaaauauaaaauuagcuaucagcccauugacuccaugaaaauaacuuaaggaggacuauggaguucucaugaaagagaauuggguuuucauucaccacuuaauuuccuaacacuacuccccucccccaauauaugaacuuauuacaguuggaucauugccaugugcuauguuauuuauugcacaggccgguaucugaccauuuuacuuugaaauaugcuaugcuguuucuggaccuucaugagcaggaauaaacacuuuaagacacaguugguccaggucacaagccgagagccagcucuggugcagaagugcuauuuauuuacaaauaagagcugaaaaccaaacaacaugguagcuaaggcacugagccuuaagagcugaccucuguuuucuuauuuuaggaauucuucuacuuucaaaucauuugaggagaggguugagacaacuguugcaagccucaagguacagaugcagugacuuauguaugauuggguccauuucaucaggacagccuagucuuagcaccauuauugcuacaggcaagguagggccaucacccuucuguguggcuagggugguagaugugcuuaaagacaggccauuuccucccauagagaucuauugauaaagucagcagccacgagucuuccugcauccuuagaguugauuauaagccacucagggauagagugcucaugaaagugaauuggguuuucagucaccacuuaauuucauaucacuuaaugaaguuucuauaauaacucacagaucuucugauuuggacauaagucaaacaguuugccaugugucauaaugccaccguauaccaucaaccucccagacuauuuacuaagcuuacauacugaccacagcacaguauggugauuacagugggaaaauuaagcaaaugcauuguuuucccauaauguauuugcucucuggguaguaacugaaauuaugcccauuucaugcugggugauaaacuuucauaaauuguccaagcacaugugcuaaucuacagaacgaggguggggcggcaaaagaaaaacuagucuugacuuuaaacgcauaaauguaaaacaggaaaaucaguuauuacaagaaucuuuuggaagugccaccuaaauaaauauguaauaacaucuuauauaauuacuaucuuguaggcacuccguucauauauuuuacuauuacugggaucuauagauccaaaugguaaugauuuagcugccuccagacccucaccacaucaaucucacauuugcuacauggcugacaggauguccauuauuccuaaccacaggccccggguauuuucaaugauuuagaucugaaggcucuuucuaaaaccagggucuuauacaaggucuacuuuccuaggucguugaccagcuuuugaagaauaaacucucaucauucagugaugguuaugccuccauuggcuucuucacaugucagcauuguuuagaacuugccaacuuuuucucuuuguuaaggauuagaaggagccauuacggugucccauaaaguagggccuuuaaaaagaaaaguacaguguguuguguacguaucuuacguaucuuguaucaaaauaaaaggcccccaaaucccaagucacuuucucgacacuugcauuuaagcuucacaucagcucauaaguacagauucucuuucuuguuagaggaauucugauauaggaggaguucuaguuuucaaucuccucuagcagaaggggauauaaagaagccaaggaagaaaucaagaacaaccugcuuucuuuugcuuuuaggaaauggguaaggucacgguucccaugcagugaaaggguccgaguucacaaucucagccucuuacuguuuccuccucauggagccagaaggcauacugcuccacuccuccuucagacaggcacauaaccuauuaaggcuguacuaugcugagaccuccugaaagcagagucugugccugugcaacugcucauggcuuuacuaauacucacacccacauaucugcgcucucacagccaaagaugaaucagcucuuucugcccagccaggcagaggaggagagugcaucaccagguguugcaugaagccucccacuucaucaacagaaacuucucauucacuucccgcuacucauaccaaauaauagauaucguaaagucuccuuuccuauagccuacuuccugucuauagcuucuuuucguucuaaaucuuuuaagcuuccauaucagucucuacuuaugagccuugaggcuguuuucucuggagggacugaguaguuuaauaaggaagaauggaugucucuguugcauuuccagguacaaacuccacuuuauguuuggauuuuaaacuccugacagagaauuaaggucaugcuuauggucuaggaagaauaaaauguccuacugugaaggauacaagcaaccugcacacuccacagggcauuauuccaagccaguuuuucuccucucuccaguucaaugaacacuuugauauuccauggggaacuuuccaguucauuauaaucauaaagaauuuagugcugccaacauacuggcaauguauauuacucgaggacaccuugucuggugucaccuguauguccagccagcauucuugcuauuccacccuaaguagacagaugcagagccagugucugcgaaagcauauuuuguguauccaaccauguucugucucaucacaaaccccaacacccagcccacccuuccucucuguggcgcagaccauggcuuuagugugcuuacucuuaaugaauacaucccauggacugagucagacccucaaaaacugaagacagacucaguacaugacgcuuguugaugccuuguguucuccuagacaguuauguggacagaguaguagcccaacccuacaguucaaaugaaauuggcugcaaagagcaauuauaauucaggggacaaagugaugaauccuuagauguaaaaaauaccauagagggguacaaaagagguuuacuguuugagucuuuguucaaacuaagaauuagucugccacccagagcaugguagugugcaggcauuaaaaacaccugguuaggaaaccugcagcccacucguuugccagagugaguuuuuaaaaagcaccuuuuuaaucuuacuauguugauuugagaaagaaaaaaaaacuagauaucaagaaaagucuaaaggggaaacaucaaaauucaucugacauaauacuaugugauuucuauuauuaaacagaagcuagaagaaaauuuaaauugggggugggagguuaagacagcaucuauuuaugcagcccugacuguccgagaauucacuauaugaaccauccuggucucaaauucacagagauuuaccugccucugccuccugaguguugggacuaaaggcaugugcuucaaggucuggugagaauucaaaauuuuaaaaccccaaagcaacuaguacuuuaacacaguagguuauauuaaauuaauccuacuuauuccucuuaggaaagaaaccguacuaccagcucaggcaggaggaaguaagaguuugaggucagcuuggcuuguguagagugauaggccagucugggguacauagucuggggaaaauaaauauauaaauaaaaaguaugaucuaagcaauguagaaaagucaauucaauuuaauaaccgaauuuaaaaggcaaaaugauuuuuaugcugaguuaagagguguuuuuaaugagugaacugcuuuuaagcccugguuaaguuuuuauaaauguccuuuuaauuuuacuuucuucuauaugugugaauguuuugccuguauauaugucaaacaaguaugccuggugcccuuguuggucagaagagugcuucagauucuuugaaacugaaguuagugaugguuauaggcugccaugugggugaugggauccaaaccuggguccuuugcaagaguaaugugcuccuaaccacugagcaaucucucugcaagggcagggcagacagcauggagcccuucccaugcugugcacaugucuguauuacuuuggcauagacaaugagucagcaauagcagaguuaucuauucucuacuuuccuuuuccuugauguuuuuauacauuguggaugcauaaggaaaggccagugugaguacugagacuugcauuacauauuuuagaauauaaaacauugaucugaagagcuuuuuaaugaauucagaauacuuaagcacaaauuuaaaauguaaauugacuucuguuucuacuuggucauuaaaaaaggacaaaaaagaggcccaccacauagugucugaguuaggauugcuauuaagagacaccauggcaacucuuauaaaggaucuuauaagccacauaauuggugguaaauggaaacucuuauaaaggaaaacauuuaauuggagguagcuuacaguuucagagguuuagucauagguuaccaucauggcgagaagcauggcagcaggcaggcauggugcuagagaaggagcugagaguucuacaucuugauccacaggcagcaggagacugcgucacacugaguauagaguauaagagcccucuaucuacucuacucuagaguguaagaguauaaacugcccccccccccccgugacauacuuccuccacaccuacugcaacaaggccacaucuccuaauagugccacucccuauggcucuauuggagccauuuucuuucaaaccaccgcauauaguauucucaaggauuuugaugaaauucguauugcuuaggacaaaacaaagcaacaacaaaaacccagacccucaaaaaaaaaaaaaaaaaaaaaaaaaaaaguagggucagagguaggcuggagagagaagucaguagauaaaguacuucuugacuuugcagguaccaugaccagauuucaguuucaagaacuccuguuaauaauucagggcauagugauguacaauuauaauucuuacucagggaagguggugacgaauacaucccugaggguuucuugacagccaggcuugccucuggagaauuccaggccaaagaaagacugucagaaagaaaagggaugggguuaggggguaggggcaugguaccugaggcaaaauaccugagguuauccuguagccuccacaugcauacacacaauauguacaugcacaccugcacacaacuuguauucacgaccacaugaagaugcauacacacauacaaacaaaggaaagacaguuucagaaauuaggauuggcuucuaguuaugucuuaaauagaaaccuaaguagaagucacauagggauguuuauacauuuguaaaagaauuaaucuaagauccaauuucaauuugauugaaugaauuucucuagauaaauagggacagauguugcacaucugcagaucugauuauauucauacagggauuggaauuuuacaaguagaagggauaaagagaagaaugccaaacuugugugaaauuaaaguucgaaaucuuaucccagaaccgagauuaauacuauucugacaaauaaaggaaacuaacaucggcuaacuucaugugccucugaagaaaauugguuaugucuaaacucaaaggaaauuaaacuuuuggcacuuuuauuuuuaaaaaguauuacaaaaauuauaaugaaaaaaacuaacuggauuuucaucuaccuguucauuucagacgaaaguaggugggacaaaccacggugguggcaguuuugaggagguccugaacuccacagcacacgccagcucacagaaugcuucagcaggcucccggcagaccaaggacgaggagcugcagugcuaggucccgccugggcugcugcuggucaaucugccugcucauccucugauaugaagaccaaaaucccacugggaaccccaaguuuugacauugauauuuaaauggggucuccaaaaagcuuaauaaaaugauuucuuuuugcauuuguguugaugaccacuacucuggaguauuuacaaaugucaucuuuaaaaauagacaaccuggagcagggucauaauuguucugaauucuugucugcggaacucaauguauuucccaaucaugcagauacugauuauuagcuuugguuuugacuuggucuccaaaccaauaugcaugucucagagugcaccugccagucuguagaucgacaggugacacuauuuaugacggucuccagcagggcgcaaauccuacaaacuucaccaaauugcuugugauuuuuaugugcauuuauuuaagucauuaaaauaauucauuuuaacgaugg

SEQ ID NO: 5457 - RNA, 1282 nt, Mus musculus
acaguuuuucuuuuuuuugggggggugcagcgaacuuuauugaugguauucaagagaguagggagggcucccuaggccucuccuguuauuaugggggucugggauggaaacugugagggagaugcucaguguugggggccgaguugggauaaggccucucucuugcucaguguccuugcuggggugggugguccaggguuucuuacuccuuggaggccauguaggccaugagguccaccacccuguugcuguagccguauucauugucauaccaggaaaugagcuugacaaaguugucauugagagcaaugccagccccggcaaagguggaagagugggaguugcuguugaagucgcaagagacaaccugguccucaguguagcccaagaugcccuucagugggcccucagaugccugcuucaccaccuucuugaugucaucauacuuggcagguuucuccagguggcacgucagauccacgacggacacauuggggguaggaacacggaaggccaugccagugagcuucccguucagcucugggaugaccuugcccgcagccuuggcagcaccaguggaugcagggaugauguucugggcagccccacgaccaucacgccacagcuuuccagaggggccauccacagucuucuggguggcagugauggcauggaccauggucaugagcccuuccacaaugccaaaguugucauggaugaccuuggccagcgggggggcuaagcaguugguggugcaggaugcauugcugacaaucuugagugaguugucauauuucucgugguucacacccaucacaaacaugggggcaucggcagaaggggcggagaugaugacccuuuuggcuccacccuucaagugggccccggccuucuccaugguggugaagacaccaguagacucuacgacauacucagcaccggccucaccccauuugauguuaguggggucucgcuccuggaagauggugaugggcuucccguugaugacaagcuucccauucucggccuugacugugccguugaauuugccauggguggagucauacuggaacauguagaccauguaguugaggucaaugaaggggucauugauggcaacaaucuccacuuugccacugcagauggcagcccuggugaccaggcgcccaaugcggccaaauccguucacaccgaccuucaccauuuugucuacgggacgaggcuggcacugcacaagaagaugcggcugucucuggaacagggaggagcagagaccaaacac

SEQ ID NO: 5458 - RNA, 32130 nt, Mus musculus
caccgcaacucagacggaucugcagcggggcaugcugggaucucuacccucucuggccagugaggaaggucuguugugacugcggaggacucuuggaggccugggcucucuuuugggucgcggcgcggcagucucgggaggucuguccuuggcgaucgggcgggcuguguggggcgcgcuuucgggcgguggcuggcuccugcgguggggaggagcggcggucuagccguggguccgggucugcaggccggcuccggguggccgcagguccgguucccugcgccccaccggugcgacguuggcucagaacuuugacagauucgggccuuaccaccuucgccaucccguacccaggcuagcccuucgaagguccccccuuacuuguaguguguccuuuaucugcagugccccaguccuuggaagaaacgaaacuagguaucgauagaacuuccuucuagaaacagaaacuuauuacugucugaagagaaacgagaaaaaggaaaauguagaaagauuuuguaaagcugaaauuagaugaagggaauaguugcccucguuuuuccuuccuauuacuaaaauacgugacagccaggugauagucuaggggaaggucuggguuugugauugcguuaaaagguuuuguuuuguuuuagcaccucccuacaaguaguccaucucccauuagcccaucaaucucauaacucguuugaaaaugaacuuccgaggguugagcuguuagcuaaccuaaugaaaccagcgucuauaccccaguuuccuagaucuuggcgguaagugcuguuuuccuacaaugcucacagcuuuuaccuuugggcucugcgguguuuaccuuccaucguuaucugacuguagugaccugucugguccaggguuuccauguauguaaaaccacagcagugguauuaaguuugacacauauaaagcucugaagugaacuaagguggauuuacccuccucauucuacuacaugcaaguaaauauguugaucaacauuagccuucuguuuuacuuuauuuuacauggacaacuuauuaaauauacuuuuuuuucuaccuguuggacgaaaugccuuguauuauuguuuuuugagauggagucucacuaugcagcccugaaugguuuggaacucagcuauggcuggccuccaacuaacagauccaccugcucucugccucaggagugcugagauuaaaaggguguaucaccaaugccuuguugaaauguuuuacucauaaauuuucuuauuauuaccucugauaucuugacauucaggcacaauauccuuuaucuagaauauguagaaauacaauacuaaacauaaaguuuguuugugucauauauagcuuguauuuuaaaacauauuucucuguauguauuucuauuuucagugugccaguguuuugacuguccuacaucgugugaucaggcauagauccacuugggaccugucugcucagaagguuugagaucaggcauagauccacugggacaugucagcucagaagguuuggauuuuggagcauauggaguuuaaauuuuuggauuaagaaugcuugaccuguagcuaggcuuucuuaggacauauuauaaauaaguguguuuauuuaaggaaugauaaguacagugaauuuuucuuugccaaagcuaauauagcucuaaauacuccacagaagagucccaaaucauuuuuaugaaaugugcuuuucuucaacuuugacuuucaaauuuacaauuuuguuuuacuucuauucuaggcccaugcucugccaugcuuuccugcaacauauguggugaaacuguaaacucagaaccagauaugaaagcucaccuaauuguucacauggaaaaugaaauuaucuguccauuuugcaaguugucagguauaaauuacaacgaaauauguuuucauaucgaaacuguucauuuugaacaaaaugcaccagaaaaaaacucugagaagcuagcugcagugcaauauggacauucagaccgaaagaacaccaaccugcagaguacagcggaaguuacuucaggcauucauucagcuugugcaucuagcuuuccaaaagagucaucugaaagccuuccuaaagauaggacuguaaagcaugaagcuuuuuauacagagaacauaacugaaucuagaaaguaccaaaagagcagagaaaagaagccuggauugucugaggcccaaggaucaauuuaugaaacaacauacaguccucccgaauguccauuuuguggaaaaauugagggguguagucaagauauggaaauucaugugaaaacaaagcaugccagucuuuuagaaaguccauuaaaagguaaaguacucaauuuauuuaaauuguuauaaaagcgguagucucaguuuaauaugugguauccaaugaguuggcuugucaauugcuacaauugugcuuuuuagauucaauuuacguucauaguauuuuucauuugcuaucauuccaauauaaaaauuauaaagaguuugaugcagauauagaaugcuuuagcuaaaguaagagcaguuuugguaacuuucuaguuucuagagagcauuuguacuaccacuagcccagaacaucucaauuguccuagacuguggguugguguuaaugaauuuuaguuugcacuccaugauguuuauuuaacaaaacacacugauacugagccuuuuggacuugcugagacuuauuuuauagcuggagauagagauacggacuaucuugguucauguuucaugagucucugacaaauauguuccauuuucuugaguaucauucaguacccaucacuuggauugugauaauuuucacaucuauuuccagggguuauuuuccaccuggguuuuaugagcuuguuggaauuuuguguauuuuuccuuucagcucuuucaguuuuauuuuugucuuuauuuuuaugaacacgagacuguugccuugcuuacauacuugcauauggaauccauuaugugcauuugugccugcugcccagggaggccagaacgguaauuacuggaacugauccuggguucuaugcaagagcagcaaguacucuuaacugcugagccaucuuagcagcuucuuguguuuugagacucuguuguuggcuacagagguugagcauauuaagucauuuucuuauuaagcuuuaggggcuucauguauuuuggauauaaggguuugguuuuuguuuuucauacagggccucucuauguagcgcuggcuggccuggaacuccucccuaugcagacaggauaucgucaaacucaacaagacgcaccugccucugccucuggaguccuacgguuaaaggugugcgccaccacacgugucuagauguaauucuuuuaucagauaagcucuuuggaaauauuuucuccuguguauguacaugacuuguauuuuuauuuuaaccaccuuuuuuuuuuuuuuuuuuacaaaauaaacauuuuaauuuuaaugaaguuuauuuuuaauuuauuccuuauagaucuuuaacaguuguauuugaaaacucauugccaguuucuaaaaguuuuuaaaguuuugcauuucacacuuagagcuaugacuuuuuugaauuaauuuuugcaaaaaaauuuacaaauugccuuggaaaaggccuaaagucaauguauauucuuuuuaaauauauuuccaugauugccaauaauuuuaguugacuuucucuauugcaauguauauguuuuuuguucucuuuuuucuuuugugcauuuuuaaaauauuuuauguuuauauucacuuccaucuaucuguugacguaucuuacucaguugcuuugaacguauauucucaguaguaauucuugacuuaagugguuaucuaccccuauugcguacccuuuuauuucuguagggcuuaaaucugaucugucuuugcucucucuguauugccuacaguggcaauuuuuccucugaagucauaaaauaucaacuuacauucauucuucuucuacagauuguuauguuuggguuaugaauauguuguguguacaguauaucgugagaauuuggaauguaaaaauuauugauuuauaugacuuuuuaaguuauuguaucuuaugagucagauacuuagauauuccuuacuauuuugcuauuuuaauaacuguaauuuuguaucauuauuuauauuagagagaacaguuuuuugaccuuuaucuuuauuauuuccuuagguaucauuauuuauuuuuaagauuuucuuuucauuaaugguguguguguguguguguguguguguaugugugcagauauccauggaauuccuguggucuucuggaggagcugagacaucgcuccaguuguucauuauuuuuuuuauuuuuauuuuuuugcuuaauuuuuaggacuauuuuguuaaauuucaugaaaauucugugaccuguuguuugaucuuaaguuaucguccauuuucacauuaauucagguuuucacuuauauaaaguuuucucacauuuuucauuauacuuguucuuuuauuuaauuagcuuuugcaaguuuauagaaacauugucaaccuuuacauauaauuaagguguuuagucuugugcaauuuuuauuuugauaguuuuccauugauuuagcucaauaaucucuguagaugauucauuacccacucacuacgcaggaaaacugcaugagccaaaacaggagccaccccugaugaagacagcagacauuugcuguguggguacacugauucucagccaccaagugugguuugcucugaaaaaagaaccugcucgucaugaguagaguugggucagcucaauuuaauuaaccuuucagcacaggaaagugagagauaaauaaugagaaguauagugccuauguauauauuuaauauagcagauuguagucaggccaguugaccagaauggaagaaucacgaguggugagguagaaggcuagagaaaaguagaucagggauguuaugaauagacuucagagguugacagacauugguuaugauacaucagggauauaauuacacaguuggcuagauuggaguaaaggaaaagauuaguguggugaagauaagcacccauuucaauucauaaaaaggcuaggacaggauauugguccaggugcugacauuuuaaguaaaggaaaauaaguauccaguauuuaagagaagguuagcuaaugaagcuuauaguuccaucguguagagacagaaacuugcagagcaguggugcuuuugaagaaggaaaaacagugguuugaaagggagugaaggagacauguucuccucuugggauuaugaaaugcgaaauugaaauccuuucugugugagaaaauggggccaaccagagccuguuaacaccggaagaggaguguacagagacuacuuugcagcugacugguggcaugcugugauuucuagggcuugaggcaggaggaggugggggaugagaaagggugauagcuugcaucagaguagugaaaggaaugccuacaguuaaacacugcuaagacucagauguugacuacugaugguagccaaugaucugagucauugaugcuguuggugcuuaugccagccuuggaugaguccauugaacagugauggcuaaccugguagauuucuggcggccaaagagagcauaggcagaugugaacgaggcaccugaguuaauuguuaauaggcugaugaugaguucaaacuggaaguaaugaggacuuggucuguuguaauauagugaccagagggagaagcaaagaguucuggccacuagcucugggaccucgaauacccuacagcauuguuuauggaugccacucuugucucuuagugauguuuuggaacaugcuugcaaagauucagcucucuucuuucuuucaguaauuuaguacucuauugacuuuauacacuuuagguuauauuccuuuacagcuuuccauuagugucuucaguuugcacuuauuuucagaacuguguguauguguuauuaaggaguaauaauauguguucuuaacauguaauucuacuuauugauauuuuaauaauuuuuauauaaauucccaaagaugcaauuacuaaguaaaagcacacuuauccuuuuagauuuaguagauaugauuagcuuuccuguuuuuauuaaauuaauuuagaaauauggucugacuauguagcucaagcugguacugaacucuaaaucuccugccucagcuucccaagcagcugcuggauugugucagcaggugcuuagucuguucuggacugccuuucuugguacuagaacuccuacuguguuucauaauugaaaucuuacuauucaucuauuaugaaaguuuuuaauauuauccuuucccacuaaagcuuuaugguuccuucaacauggcauuuuugcauucauguuagacuaggccuuauauguauaaguugcuuagugcuuucuuucugugucuguauauaauucugagccccucuucuagagcuguuauugcgaggcucugaccuugccuauuggagucaucucuuuaaucuccuguuccuaagcagucaguaugacuucagagcugaacuuugugcacuuggguuuagugucugucuaccuggcauggugaauacugggaauuuagcucccauacuuucuauccagacuuguaaccacuuuguuuuaguuuuccuuuuuacuuggcuuacuuaaaccacuguugugaauguuuauuauuuucuuauucuggagugguaagagagaucuauacuauuaaucagucucucauuuugucuauagaagaagaaauguaauuuuauucguuuaaaaaaaaguuagacauuaacccauugugccuuacucacaucauuuaauacucuauuuuauuaccaaaacccaaagucucacagauuagcuaucaccauccaguguauucaucauccagggccgacauaagcaccaauaguguucagacaauauugugaaauuaguacaaauauuaaccucaaaguuacauauauuuauuuugcaucuguuguauuuuugccauagcgcacauguggaggucagggaguugcuuacgucacaaugugggucccagauaucaagcucagguuaucaggcuuaauggccagcaccuuuauccacucaccaaucucacuggcccccaaagaaguagcuuuuaaauccaauuauaaagggcuuuuauuuuuuaaaacaagaguaaaauguauuagaaagucuuugauguguuugguuuauuuauuuauugaggcagggucucaguauaggcuuggcugaccugcaaguugaugucggaccagacugacuuuaacucacagaaaucugauugucucugcccccugagugcuaugauuagaaguguguaccacuaugccuggugagauguuaaugcuaacuacaaaagcauucuacucauaaaguugauagcccuugacauggggugagaagucuaaaaauccagaaaauuaaacuauccuaccuuuguuucuaucuaauacagacugucaucaaccacucuaugacugucccaugugugggcuugucuguacaaauuaccauauucuccaggaacauguggacuugcauuuagaagaaagcagcuuucagcaagguauguuuaugccuagaaauauuucaguuucugcuuccuagaauacacaucucucagguuaauaccaugaauaaaguucuaccauuuaaacguaaaucugcucuuuagauaauucucauguagcugcacuguuuuccuugacguuauuuugcagaaaaauuguaaaguaugaauuguggcgauccucgguuuugcucugcuauguggagggcuccuuguuuaagguaguacuuuuuaaacugugugccuuucuaaaguuuucauugacaaguugaggcuguuuuuucauugguuuaaaauagugaaguuacuuuaacauuuagccaucaaaauuuuugagcuaagaagcugcuaauuuuaaaaacugugaauuuauguggacuuuauaacuguugugugacaauaugauuucuggggagauacaacacacacaucuacuuaccgcagauagggagcccaugguagacccaaguacuggugcuaccaaagcccacuuuggugaacugauaaguuuuauuugcauuacuuacaggaguauggaugagggguuacuuuacaguugugcguaugacucaaagacagauguaucaucaaggcccauucaguaaugggugaauugcucacaaaaucuuggaaaccuggagcagacugcacagccuguaagcugcucaggugguuggaguuuucuuuccaaguggcucaguuggucuaaaccucuucuucaacaggagcuugucugagagucugcagcuuggcucgcuucugucaacuuuaguuacuuacccuagcagggaaggagccuagugcaucuagucaguuuuagggacuuccuaaagcuuuuuuuuguuuguuuguuuguuuguuuguguaucuuucuguuaaaagagcuacugugcagggugaaauguuucaaucucaaggaaauuguuccacaauaauaauuuaaaagucucacuauguguuuccaguugguugccuucuaaaauaaucaguguaauaauaacuuuacagcauuuuucuucuguuuucucucuucuuacauuguauguguguucaugugugucucagugcuugcaaguggguaugugccuguguggacaccauaugacaaccuuggaugucauccuuaggaaugcuauacagcuccuuuaagaugggucucuuacuaucuuggagcacacaaauuaggccuguucccagguuugcuccuaucuccaccucccuaaugcuggaauuacaaucauggacaaccacacccacauauuuuacgugguucucgacacugaacuuagguucuuaugucugugaggcaagcccuuuccugacugagcuaucuccugggccuguugucuguccuuuuugauaguauuaaagguguaggguguuguaugagucucuuagggccacugaaaaauaagagaccucuaagagaaguuguuuauauuuuuauuacucugucaguauuugggaguauguaaacaacuacugguaaagugggagauuuuaguguuccggugacuuacugccaguaaucaugagcucugcaucauguaccugcuuugcucauaaccacaagaggaaaaaccacuagagcauugauggaagacuauuccauaucaguagucuuuuacuguuuacuccaguuggcaugucguuguuguuuaggauuccuguugcuguaauaaaacacuaccaauauaagcagccuggggaggaaaggguuuauuuuaucuaaacauuuucagauaaccgugugauucaugauauuuaaugauguuuucuaccacugagggaagucaggguaggaacuuaaggcaggaaccuguaggcaggagcauaggccaugaagugcuucugacuggcuuguuuucucuuggcuuguucaagucuucuuucuuagagcacccaggaccaucagcccaggggugacaccacccacaauggcugaaccuucuaacaccagucacuaugaaacacacuacagacuugccuacacccaaucuuuccuuauuguuauuguuugguuuuuuuuugagagaguuucacuauguagcuauggcugucuauguguaaacucuagcuugugucaaguugacaaaaacuagccagcauagcugucuuccuuugaauaagauuguaagaggauguuguggaagggguaaccuuuucaaagcagaaucucugguaauucuuacuuuauggauaggcuuuguauugguauucuauaaaccaaugaaaauagucucagggcaugcuaaaaaucaguuuacaugaugaauuuacuuggugaauuacaugaccaagaauggaagggagaaccuaguaggaaguguaacaacagcugagagguuuguaagaaagaauauucaguuuuagaauuaaaucaacagcuuuguggauuguacugucucugaauugaggaauaccuagaagacuccauaacuguuucuucugggugugacucugaggguguucccaagaaaaacugaugcauguguuggcaaacagaaugaagaucugcauucagugugggcagguagcaucuaauguaacuaggauucuagagggaccaggaaaucugaagaaggggcaaacucacuuuggcucuuccuucuggauugggacuuuuucuuuuuccugcagcugcuccuugccuuaaacuccaggguauuuggcuuuugaacucugggacucuucugauaaucccuaccagagaauuugagccuuugaccucauacugggaucacugauguugccaaacugguucugccacuuucaacuuucucacuacugguuucucugccucucaggcuauaaagaauguaucauuauguaauucauuccugugugauuuauauuuaaugauguuuucuaucuuucugucucuuucucucucucucucuuucucucugugugugugugugugugugugugagugugcauaugcaccugugugugguguuuucuuauuuugcucucaguccuguuuuacuggaggacacuaaccaauaaagaaucuaggaaacaagauacaguacagaagccuuugacuaaagaaucugagucucacugagagaggaagcauuaagcuauaaaauuauucagcuuguucggcugaaaacuuaacuguagugaaacaguuggagguugggaauauauauauauuuuauauucuuuauuacuuucuucauucuguccauuaguuguuuucagagacaccaaugacaagagucauucacccucucaccuuuugucuuucucagcaggugauacuuccuaaagguguuaggauguucacauccgcuaguuaaggagaaaugcuuguuagcgcauaagcacugacuggaucuggguuguugcucuccaauaggcauggacagaguccaguguucuagugauagagaauuagcucaccggcuucagcaagaagaagacagaaagaggaaaucugaagaaucaagacaagaaagggaagaguuucagaaguugcagguacaaggauuaguuuuauugaauagaguucuuguucccuaaaugugauugugagauguuuaccuauguuuagaaauaugggucugccauuaaaagcuaagguucacagucaaaacaauuuuuacuagucuguccauguuauauaaaaaauauuuuuaucuguguacguuauauuuuauugggguggaggguauguuugaaaguagcucuuuuccaaagauggagagauggcucagugguuaagagugcuuacugcuguggcaaagggccuagauucauuuucuagccccuacuucaggcagcuuauaacuaauuauaauuccagcuccaggcaaucccauucuugcuuguuacccacacaugcacaugcacauacacacacacacacaugcacaugcacacacacacacacacacacacacacacacacacacucacaggcaugcacaguaaaauaaaaaauaaauaaacaaaguggugauucuugacuaauucuaacacuagggagacagaggaaggugaaucucuugaguuugagaccaaccuggggcacauuacaaacaaaaauccccaaaacaacguucagauuagaauaaucauuucagauaaaguaugugaaugucuucacaggaaacccacaggguuuuguuguuuuuguuuuuuucuuucuugucuuuaaaugaagaaggaaaauaaaguauuuagugauuuuuccccuggauuagacaaccauuaggugguaaagugugccuguaaagcuaugcagauguuggguugaugugagguucauauggguugaugcacuguacugagaaucuguuuacuuaaagcuaugguguaucucuccuuagucuuagauuccuuuaaagaauacaauuaagacauuuuuuauuuuaguggcuguucagaguuuggcgguuuaugauguuugagggcacguuuuccuuaugugaaggaaauaucuacuggacuaaaguggcagcaucugagggguuuuaaugcauuacaaauuuuaauguuucucccuuuucauuucuggcuugugaacuaugguuuuuguacugauaauauuuguagaguuuuuaaugucauuuguaugugugaacaggauaguauaguauuaauauauaggguuuaugaacauaccuaaaaauguuuccagauuuauguacaucugaaagccuuuaguauuguguacuauacauacacuuuucuucugauuuuuuuuuuuuucagacaucuuacauaggacuguuuuuccuugaaaauuguuuuggaagaucuaauuuaggauccuccaucccccauuauuuauugauuauuuauuuauuuacaaauuuuuuuuauauuagaauucagacaagaaaaauuguuuuuuuucuaagucuuuuuuuuuugccauacauaugaguuuuuuauaguguugugauccuacuugucuacagaaacauguaagggaggaauuauuuaucugaacucacaguuucaggcuaucauagugggaaacacuuggagaggccauucacauuacacuggaacaaacaggaagccaaugguauggcaggaauuggaccugguuuuuacuggccuguuuuugccagggaagcacaacuuccuacagguucuauaaaagccucccaaaauagcaccuuugugugagacacagguauucaaaacagggucuguaguuucauggucaaagugcaacaccauaaaaauauaugaagccuuuugaguaucaacaacacagaaagucccugacauuuaaaaagguuuauuauuauuguagauacguguagcugugaucaaauaccugacaagaagcaacauaaaguggggaguguucauuuggcuuacaguuagaggggauacaaucugucacaguaccaaaggcauggcagggagaauaggagguuuuucugcauccacaguuaaggaaacaacagaaugguuacaugucucaguacacuuuguccuuucuauucagucuggaaggcuaacccaugggauuguccuguacauauucaaaguagguuuaccacuuuaacuaaccagauuuauaagcucucucauauuaauuucccagaguuuguuuccaugaugauuuuuauuuuauuuuauuacuuguguguacuuguguguguguauuucuugcucaaugccauagagcauauguggcaaucagagaacaacauuggggaauugguucugcccuucuacuauggguuucagagauuuaauucaguacauuagccuugcaugauagacacuuuuacacacugagucauuccaccagaucuccaagcuuauucaaaaacccaucaaguugacagucaaaauauacuauugcaacucuguuuguuaccuugacacaucacauuuuaaaaaaagauuuauuuacuuguuuuaugcauguaaguacaugucgcuaucuucagaaacaccagaaaagggcauuggauccaauuacagaugguugugagccaccaugugguugcugggaauugaacucaggauuucugcaaggguagucagugcuuuuaacuacuggccccaaaacucacgacuuuuaaacuauagucuuccagcacuugucuccauagacucauggcuaucucuucauggacagagucauucaguccaacuacccauagucuuuaauggugucacuacuauucaaaauuauaaauagaguaucuuuugauacaugagcacuaucuuaacuauaaauuaauauccuguaacagaccaaaaaaaagaugcauacuauuucauaaugcaccuuauauucucuaugacuucaaaggauuucauggucuuuuaauacaguauaagugcagagucucuugugagguuuaacuaaucucuuagccuguauaauauuacaaaacacauuuugugcuuuuacuauaugauggugcagaguggggguccugauuccaaaaaggaagaaugaugacauagcaaaagaaauaugagaccaaugcaaaaacacagugcagcugaacaagcaccaaacccuguggcuccguguuagguaucugcgacuuuugauggaacaacagggcuccagggagcuuggguaguccugccuuuccugcuuugcugccuguagcacaaauagccuuccuuugggccauuuuuacuuugugccuacuuuccucagcacauagacuacuguuaucgccaguacccuaggaucucuauuacaauuucugcuuuaccuucacagcuuuacucccugaccuuggggccuccuuguugggacucggcuauuggaggacucugcacauucauggccucaguggcucucuagaaucauaguguaaaauccaaugaaucaugcaucuuuccuacuugcaaaaucaguaccacuuagauacuagucaaguucugcuacuaucuugggagagagccuugccccuuggagcacaguugcaauuaaccuaguauuccaaccaugggaaaacacuuuccuauaugauaggguuuuuuuuuuuuuuuuugcuuuuguuuuuguuuguuuuuagagaacccuucaguggcagucucaguuuuggcccccuccuuucuaaugaauugcccuuuuuuauuagauggagccuuuaguggauggaauaaagguuccucugaucucagugcauagugccccuuucucuguuaauguccauaucucuuuuacaauuaucuuaauguucuauuauugugaagagauaccauaccagcucuuuaaaaaggaagcaacuaauugggcuugcuuacaguuuuagagccuuagucuauuaucauuaugguggaguauguguagacaggcuggaaggcauggugcuaagagcaggagcugggaacucaccuugccuccugacaccugcugagccaaacuuccacuguuuacauucuuccuagcauucugggcuuuccacucuaugugccuggcccuauaagcccugaucacaauauucaaggacuuuuugagccugaaguuugaaacuuccacaauucucaucacaaaccaguuccagaggccuaagaacuccauggucaggcuuauuacaguagaggcucacuccauguaagcuuccuuauaucuuuuuuguugcuuuuauuagauaacugagcagaagcaccuuaagagaggaggguuuauguacagugugaggaagugaggaagguagguugcugcucauauuguauucacgaccaugaaacagggggacgaauaacuuuauccucuuauucagcucaccgcaugggauagugccauauuuaggguagagagauuuccuaucgcuauuaacccagucuagacacaaccacacagacauggccaaaaguuuguuuucauggugauuuuaaaaucguuucaacuugguaaccaagauuaaccaugauaaugauguaacguuguaaguagucuagaucucaggaaguuuauccauaaaggcaguuuauauguuugagucucucagucuguuuuucaaaaacagcucauuuaugaugaagcaugauugagauggagugauguaugaacuaaguaggucuuacugggucagugaugggacaaaauagcaaguuuccauaaguucuuuuguagccaucaauauuguuggaauuuugccuuucucaguaccuuaacagaaaggcggaucuuucauuucuauacuauaaggaaagcaacuaauuauuuguaagaguuacagaagcuuacagaaauaacuaauuauuaaguuauggaugaaugguuuaauuuucacuaaaucuuuacauuuacuuguauggaaaaaaauacauaaaccagacuauuucaacauccauuuccaaaaaaaaugagaguuaaaaguuuccaugugguugaaguacagggacauaaaaauaaguuauuuguuuuuauguucaauagcggcaauaugguuuagauaauucuggaggauacaaacaacagcagcuacgacauauggagcuagaaguaaauaggggaagaaugcauccaucugaauuucauagcagaaaagcugacauguuggaaucaauagcuauugguauugaugauggaaaaacaaaaacuucuggugagugcuuaaaaauccaagccacaguuuuaauauugcauauaucacuggaguaauaaaaccacuugaauuuguugaauuuucagucaacaguuuauauaguuggaggugaaauuguauguacacacauuuuuuacaaaacauuuuaaaacuucuaaacuucuauuuuuauaguaaauaauucacuuaaaauaauuuggcuuaaauuguauuaacucacaacaacgggaaaugaaccuucuggauuuuuaaaaauuuaauagcauauauuaauuuauaugauauuguuucaauaugauauuuucauauauguauguaguauauuuuggucauauuuaccaccaccaccccauuacccucuuuuguucccuaacuucugcugcucccauuuccuuuucucagcuaguauccaccauuaccccuugaccccaucucaucccuauuuccacauguuuuuuguuuguuuguguuuauuugguuuuggugaagggaugauuacaagaauaugaaugaacaggagcauggguaagaaaaaugauuuuucuucaucuccaacccccaguuaaugguuaauuaacuucagauagcuucuacggaaggggaaggaccuuacuagcucucaucuaaucaugguuuaaugucaguaaauccacagagauagguggguccuugugaauaccucucaucucugugacaaacuuagucuuguuaagauagucauugcugcugaguuugaaaaccagcagccaugccaugccuauaagacagcauucuacauuuuccuucuuccucaggcucugcuguuuaacagugcccccuuucuugauauuuccugagccuuggagggauuaauguagauaacccauuuaggacagacuaucacauggucauuuauucucaguucuuugagucguugcugacacccacuaucaaagaaucucugaugaaaauguacaaccauacuaaucuauggauguaaauaaaacacuuagaagacaguuuaacaggcauaucauguccauuugguaaaacuauaguagcuuuccuauggggccugugcuuauuauauaccuguccauagcucaggaacacuucagugucaaguaugguuucuguugaauauauugcuuuggcaguaaaauuuauaaaacuucugaugaacuaucagguguugaacuaucaggagucuaaaucucuucuucuaauaauuuaaaugcagugucuaugguaccauuuuaaaaguugucaguaucaagagggguuuuuccauaguuuuguaguuagcauguuccccucacaaggauuauuaauugaaauauuuuauauccuuuguaaaauauaccaacucuguuauuauuuuauacuuuacaggacauuucaaauggaaacacuacaauucaaagguucaauaaccucauaaguauaauggccaccguauuacucauuucauuuugaauacuaaaagcuuuauauacaguguuucuucugggcccaaaugaacacuguuauguacuugacacuuagaguuuauauaacauucuuaagacuugcauaguuggcaagcuaauauuaauaaucagaucugcuuuacucaagaauguaugccacuuuuucugguuauuguuuuauuuguuugcuugucuuguuuuuuuuuuuuccaauuauguuuuuguaucucuguuaggguacuaauacauuuuauauggaaacaguugcauucuuaugacuagccuuuuuauuuuuuauuuuuuuauuuuucugagacaggguuucucuguauagccguggcuguccuagaacuuacucuguagaacaggcuagccuugaauucagaaauccaccuaccucugccucccaagucugggauuaaaggugugugccaccacugcccagcgacuuuuuuuaagacaugaucucacaaggauuaacuuguugcucuugaagagguuuaauuacuagcacgaaucugguaguucaccauagucugcaacuccagauccaggguauaaauggauauuuauucauauaaauacacacacacacacauacauauuucccuuucccuuucccuuucccuuucccuuucccuuucccuuucccuuucccuuccccuuuccccuuuccccuuccacuccuuccccuuccccuuccccuuccccuucuuccccuucuuccccuuucccuuccccuuccccuucuucuccuucuuuuuuuuuuuuuuggggacaugaucuuacuguauagcccagguuguccuauaauucucuuuguagauugagcuggucuuaaacucacagagaucuacaugccucugccucucaagugcugugauuuaaagucauguaccucuaugccaggccuguguaugauaucuuuagauaaaaauuuuaaauuugaauauauuuucuaaaugucucauguuuuuuggagggaaguuugagacucuguagcacaggcugaccuggaauugauugguuagcacugacugucuuuagacacuuagcagaccucugccuuagccuuuaagugcuaggccaccacacacagcaaaucucucaauuuuuguuuuuauuguguguguuuuggauggaagguuuuuuuuuuaaagaucauaaaugugcauuucuuaaugauucuguaaguaugcuguuuuauauuuucaccugcauauauguuuguguacuauuuacaugcuugaugcucaugaaggcuaaaauugggcauuagauacuccagaccuggaguuacaaauguuuuuaaccacugcaugugugcugggaauagaaccuguauuccuagguuuuuacuuuauuuuuauuuuuuuccccaucccacccuaugauuuuauuuuuaaucuacuugaugucuuuguuuaugaggucaggguaggguugagauuggaaggaaagagggaaucugggguuuuguucuuauuuauaacaguauuauauuuguaugcacuuacauauauauacauguaguucuuuuucugacaccauuuauugaguuugcuuuccaucugcaaaggugucagaugcccuggaguuugugucggaguugaguugcccaaugugggcacugggaacugaacucaugaccuuugcaaaaguagcaaguguccuuucugcugagccaucacaccaacuuuuaaauuuuuaaauuuuaauuuuuuuaaagauuuuaauuuuuuuuaagugugcagguaucuauuagaauagucauuuaacacucuuuuauauauuuauauaaaauauauuuuaaacaggaaaguauaauuuaguaauagguagcuuauuuggaaaacaucuaaggaaauuuaggaauuaaaaauacuucugggccagagagauggcucagugguuaagagcacugacugcucuuccagagguccugaguucaauucccagcacccacaugguggcucacaaccaucuguaguggggucugaugcacuuuucuggugugugucugaagacagcuacagcguacucauuuaaauaaaaauaaauaauacaaaguaauucuaagaaaguugugugauauuauugcuaagaugguuaccaggaagugagguauuccugucuuauauguaacaagcauggcagaguauacucaaauauauaccaauuauagauuuucccccuuucauucuuaaaggacugucuuaaaucuugcuaucauucaagacaacguucaucauucucuucccagaugccuguucuguguauaaacuuaagauacuuagucucuuccaugucacuucacauuuuuuccuccauauaugaacuuaguacucacuaacaagucauuuccauugcucuuuuucuucaaugugaaucuuauuuguuuuuuuuucccccuuaauuuauaacuaacuucuguaguggguauagcuauagcuauugguuacgugauuguuuuuuuuuuguuuguuuguuuguuuuguuuuuaucugucccccuaaagacauuuuuuuuuuguauuuuauucaaauaaaauacauauaaugacucuccuuuuuuccugccacacacuaggagacagcaugaacuacauaacagacaucgcugcacugagcgggcugcuucagaguguuuaaagaagacuaaauauacacaaaacccuugcuuaaccaaauucuagcauuuagucuagugacauuuuccagggauguugucacauuuaucuuuuuauggcuuagaacuuacuauccugauauguauacaaaguguaauacugaaauaaaauuaaaacccauugcauacuuuguuuuuugaaucaaacaauuuuaugucaagaagaaugcuaaaaggucagauggaggccacauugcaaucggcuguauaugcuguggauuaauaugaaacacuauaggcugucagcagguacuuuaagguggaagaaagcagguugaauaagacugaacaagcucuaguagugcaugcaauaaauggaaagacaagaagaguauucauucuguaaguaaacuuuugugucucaggcuuugcagaugaagagcuuaaagaugccggaaacgucaaugcaaguaguacuauuuuaguguuagaaagcuuggguuguggggacaguacaugagcuaagguuguaacaaugagaauaaauuaaagcugaguugcaaggguuuuucuuuggagcuugaggucgauguuggauguauaaacaucaauuuaaugaugauaaaugaaucuuucuaaugaagugcauuaaaugucuuguauuuuaggaauuauugaagcccuccauagguauuaucagaacacugccacagauguaagguguguguggcuuucuacagugguggaucacuuucacucaucuuuuggggacaaagguugggguugcgguuauagaaacuuccagaugcuacuuucaucauuauugcaaagugauguauauggugacugcuugaaagguauguaaaguacuauuaaccucugaguuuaugauauacagaagguauuaggaauaacugucuuagaaauucaugugaguuugucuaguacaguauaugugauugaauuauauuauuguucaguguauuaguaucuugccuucugacuuauuugcuuacauaauuucagguauggcaguuccuuguauuccaaaaauucaguccaugauugaagaugcauggaaugaagguuuugauccucagggagccucucaacuuaauaacaaauuacagggaacaaaggccuggauuggagcgugugagauuuauacacuucugaccucacugagaguaaaguaugcaccuguaaacuacagccaacauuauuguguucauuugcaaguuaucaggauuaaauuuaauaugacuaaaguuagcaacugucuuagauauauuuucaugcucauauuucagugagaaagaguuugcuuugacuuacaauuucaaaggauacauuccaucaugguaggaaacagugaaggcauaguggcagaauguagacuuuugucacagugcaauggcagucagaaagcagcgccuuaggaaauguaaaccugcugaaaagguucagggccugccuccagggaucugcuucuucuagugagaugacuucuaguuuccacaaccuuuccaaauagcacugcuagcuuaccaagucuaacgugagccuacgagggccauuucacauuugaacuacagaagaaaccuguaacaguuuagaauauuuuguauauuucauugcugugagagacgaggauggucuguguucacagaaguuuguaauaaucaagauacuaaaugcuucuggcuauacuuuaaaauaguuuuggaguaacacagaagugagcuuaccucaacaaucucauuuagucaagaugacuccacuguagucuggggccaaauaggagagacauggauguagaaauguuuuccuauguucuucccuauggaauuaaagaaaauugaacauguucagaauuucuuuuuacauuuauuuauuuauuuauuuauuuauagaagaaaacauuuagauaauuuugacuaguacaaaugacuucuacuggggauuaaaaccagaauuuagcuucuuuauuuuuuucuuuuaaauaaagauauacaaaaauuuacugauugaauuuuaauguguuuuucuguuuauacuguuauaaguuugcagaauaauccugcaagaagucaguuuucuuuaaaacuuuaaaaaauauuuaacuauuuuuguuauauauauagaugcauguuuguguauauguacaucugaguacacaugccuuuggauccccuggagguggaguuaucagccauuucugacuaaaugugggucuuuugcgagaguaguaugugcuuuuagcuucugagcuauuucucuaagcaccuaacuuuuuauuacuauguguguguuugagugaguauguggaggucagaagacaaauuuguggagcuguucuuccaccuugauguggguucuggggauggaaugcaggucaccaugcuugcacagcaaacaacuuuacucguugaaccaucuugcccguagaaccaugaguuucuaguugaucaucaggccuagauacauuagaauaaaggugauaaugucccagguuauugcauauaaguuuuaaaagucaagcauagucuuuauuugcuauucuuggauauuuuuuauguuaugaaaucuuuuuuaaauuuuagcucauuuaucagucuuauuacaaaugauuugaauaauuugaauugcuaugaugauuugaauaacgauuuuccccauaaaaugaucucgagauuaagaguaagaauuuauguuuacuuuuuucuucauagugaaguaauagaaacacaaauauauucuacauuaagauuaggauuuuuguuagaauaauuacacuuaugcaaaaauuuguaaaauauucuaaauuaucugcuuuuugaauuguuuaggugccgcauuauugauuuucacaagucaacugguccuuuggguacacacccucgcuuauuugaauggauauugaacuauuauucuucagagacggaaggaacuccaaagaucguguguacaucuaaaccuccuaucuaucuccagcaucaggguuaguagaucucacauacauacaacugugauauuuuuaaaauagcagaugaugcuugcuuaugaacagguggaggguggggggugcuguggugauuaucagagcuacuuuucauucugguuccuccuggggaacccagcauucugggccuuugcauuuccugugcacaguuucuaguucacugcucugauuauucauccccguccuuuucuauucuuugcccuguugucacuuaugcuaagccuuuucagacuguacuuauuuaaaagugaauguauacgugcaugcauguguguguguguuaaacacauagaagaaaaagucgaauguauauauaguaauaucuguguauggaugugacauauuaacuguuauuuaugcauugaauaggucacagucgaacaguuguuggaauugaagagaaaaaaaaccgaacauuaugcuugcuaguauuugauccuggauguccuucucgagaaaugcagaaacuguuaaagcaagauauggaggcuaguagucuuagacaacuucggaaaucugugggaaaucuaaaacauaagcaguaccagauaguagcaguagaggguguucuuuccccagaggaaaaaguuguaaguauugggugaaguaguuuaaaauuuuuaguuaaaaucgguguugucuuuaucuccucauaacucauucuauuucaugaaaugacaaauauauuuaucuuuaauauugaauuucuagaauagacauuuuuaaaguuagauggccuuucaguuguuuaacucaucuucauaaaaauuuuaauuuuauaauuuaaauuaauuuuugauauugagugauaaauaacaacaauaugguugacaggccgcagaaguggcagagcagcugugacaggcccuuacaggccuacaucugcauccaagagguggagcugauccucaguccucugcgcacuuacccugccaaaggagagcuugccacuggggagugcucuaacacugggaaacagaugagaucaucauuuucucuccagugagagaauaucagcuguagaagauuccauagauaauauggacacaacaaucaaagaaaaugcaaaaugcaaaaagauccuaacucaaaacauucaggaaauccaggacacaaugaaaagaacaaaccuaagcauaauaggugaaugaagauuuucaccuuaaaggaccaguaaauaucuucaacaaaauucuagaaaaaaauuucccuaaccuaaagaaagagauucucaugaacauauaagaagccuacagaacuccaaauaguuugcacuggaagaaaaauucuucccaucacauaauaaucaaaauacaaaaugcacacaacaaagaaagaauauuaaaagcaguaagggaaaaaggucaaguaagauaugaaggcagaccuauuauaauuauaccagacuucucaccggagacuauaaaagccagaagauccuggacagaugucauauauacccuaagagaauacaaaugccagcccaggcuacuauacucagcaaaacucucaauuaccauagauggagaaaccaaaauauuccaugacaaaaccaaauuuacacaguaucuuuacaugaauccagcccaucaaaggauaauaaagggaaacuacagcacaaggagggaaacuacaaccuagaaaaagcaagaaaauaauuuuucaaccaaccuaaaagaagauagccaaaugaacagaaucucaaaucuaacaacaaaaaauaacaggaagcaacaauuacuuuccuuuaauaucauucaauaucaauggauucaauucaccaauaaaaagacauagacuaacagacuggcuuuguaaacaggacucaacauuuugcugcauacaggaaaccuaccucagggucaaagacaaaugcuaccuuagaguaaaagguugggaaacauuuuuccaagcacauggucccaagaaacaagcuggaguagauagauauagaauaaaauugacuuuuaaccuaaaguuaccaaaggaacaggacagggaaggcauuucauacucaucaaagguaaaaucuaccaaggugaacucucaguucugaacauauaugcuccaaaugcaagggcauccacauucauuaaagaaacuuuaguaaagcucaaaacacacauugcacugcucacaauaauagugggagccuucaacuccccacucucaucaguggacagauccugaaaacacaaauucaacaaacauacaaugacacuaacagaaguuaugaaacaaauggauguaacauaucuauagaacauucuauccuaaaacaaaaggauauaccuucuuagcaccucaugguacauucuccaaaauugaccauauaaucagcaggcuucaacugauauagaaauguugaaauaaucccaugcauccuaucagauccccauggacuaaggcugauauucaauaacaacauaaauaauacaaagcccacauacauguggaagcuaaacaauacucagugauaacuuggucaaggaagaaauaaagaaauuaaagacuuuuuagaguuuaaugaaaauaaagccacaacauacccaaacuuuugggacacaaugaaaccuguauuaagaggaaaacuuauagcucugagugccuccaaaaagaaacuggagagagcauacacuagcagcuugacaacacacuuaaaagcucuagaacgaaaggaaacaaauucacccaagacgagcaaauaauuaaacucaggguugaaaucaaucaaguagaaacagaaagaacuauacaaagaaucaaacaaacucggaggugguucuuugagaaaauauauaaacccuuagugagacuaacuagagggcacagggacaguguccuaauuaacaaaaucagaaaagaaaagggagacauaacagaaucugaggaaaucaaaaaaaucaccagauaccagauaccaaaguuaaaucaggaucagauuaaccaucuaaacagccuuauaucccuuaaagaaauaaaaucagucauuaauagucucccaagccaaaaaaaaaaaaaaaaaaaaaaaagccuagagcagaggucuaucauaccuuuaaagaagaccuaauuccaauacucuucaaacuauuccacaaaauugaaaugguacucuacccaauucauucuaugaagcuacaauuacucuaauaccuaaaccacacaaagaccaaacaaagaaagagaacgucagaccaauuucccuuaugaauaacgauauaaaaauacucaauaaaauucuugcaaacugaauucaagcacacaucuaaaugaucauccaucaugaucaaguaaguuucaucccagggaugcagggaugguuuaguauucagaaaucuaucagcauaacccacuauaaaaacaaacucaaagacaaaaaccacaugaucaucucauuagcugcugagagagcaauugacaaaauccaacacccauucaugauaaaagucuuggaaagaucaggaauucaaggcccauaccuaaacauaauaaaagcaauauauagcaaaccaguagccaacaucaaacuaaauggagagaaacauaaagcagucccacucaaaucagggacuagacaagacugcccacucucucuguaccuauucaauauaguacuugaaguccaagucagagcaaguagacaacaaaaggagaucaacaggauaaaauuggaaaggaagaagucaaaauaucacuauuugcagaugauaugacauauauaagugacccuaacaaauuccaccagagaagaccuaaaccugauaaacaacuucggugaaguagcugaauauaaaauuaacucaaaucaguggccuuucucuacgcaaaggauaaacaggcuaagaaauuagggaaccaacacccuucaaaauagucacaaauaauauaaaauaccuuggugugacuacaauuaaggaauugaaagaucuguauaagaacuucaagucucugaagaaagaaaucgaaggagaucucagaagauggaaagaucucccaugcucauggguuggcaggaucaauauaguaaaaauggcuaucuugccaaaagcaaucuacagauucaguguaauccccaucaaaauuccaacuaaauucuucacagagauagaaaauacaauuuucaaauucauuuggauuaacaaaaaaaaaaaaaacuaggauagcaaaaacucuucucaacaauaaaagaaccucuggugaaaucaccaucccugaccucaagcuguacuaccaagcaauugugauaaaaacugcuugguacugauacagugacagacagguaugucaauggaauagaauugaagacccagaaaugaacccacacaccuguggucacuucaucuuugacaaagaagcuaaaaccauccaguggaaagaagacagcauuuucaagaaaugaugcuggcacaacuggcaguuaucauguagaagaaugagaauugauccauucuuaucuccuuguacaaagcucaacucuuaaguggaucaaggaacuccauauaaaacuagauacaguuaaacuuauagaggagaaaguggggaagagccuccaacauaugugcacagaagaaaacaucaguagcuucuacuguaagaucaagaauuaacaaaugggaccucauaaaauugcaacacuucuguaaaacaagggacaccaugucaauaagauaaaaggcaaccagcagauugggaaaauuucuuuuccaaccccaaaucuguuauuuggcuaauauccaauauauacaaugaacuggagaaguuagacuccagaaaacucaauaacccuauuaaaaaaugggguacagagcuaaacaaagaauucucaauggaggaauaccgaauggcugagaagcaccuagaaaauuguucaacauccuuacucaucagggacauacaaaucaaaacaauccuaagauuccaccucacaccagucagaauugcuaagauaaaaaacuuaggugacagcagaugcuggcaaggauguggugaaagaggaacacuccucuauugcugguggaacugcaagcugguauucaguuggucauuccucagaaaauuggagauaguacuaccccaggauucaacaauaccacuccugggcauauaaccagaaaaugcuccaacauguaauaaggacacauggcccacuauguucauaguagccuuauuuauaauagccagaagcuggaaagaacccagauguccaucaacagaggaauugauauggaaaauaugguacauuuacacaauggaguacuaugcagcuguuaaaaacaaugaauuuaugaaauucuuaggcauauggauggaucuugcagauaucauccugagugagguaucccaaucacaaaagaacacacaugauaugcacucacugcuaaguggauauuagcccagaagcucggaauacccaagauacaauuuacaaaauacaugaaacucaugaaauaggaagaccaaagcaucgauacaucgauccuucuuagaaggggcaacaaaauacccauggaaggaguuaacagagacaaaguucagaguagagaaugacggcaugaucauccagaaagugcccuaccuggggauccaucccaaaacaaccaccaaacccagacacuauugcagaugccaaaaauaacuugcugagaggagacugauauagcugucuacugaguggcuaugccagugccugacaaguacagaaguggaugcucacagucauccauuugauggagcacaggauccccagugaaggagcuagagaaaaaguacccaaggagcugaagggguuuucagccccuuaggaggaacaacaauaugaacuaacccuuaccuccagagcucccuuggacuaaaccacuaaccaaagaaaacacauagugggacucauggcucuaguugcauauguagcagaggauggccuagucagucaucaaugggaugagaggcccuugguccugugaagguucaaugcccaguauagggaaaugcuagggccaggaagcaggaguggguuuguuggugagcagggguacggugggggggggggggggggagauaggggcuuuucagaggggaaacuaggaaaggggauagcauuugaaauguaaauaaagaaaauaccuaauaauaaauaaguuaaaaaaaacaccaaaaaaccaguaacaugguuauaaaaacaguucauagccuaacucauggggucuuauuguguauuaaaauaugauucugaagguauauuuuaugcuuuugccuugucuuuaucuccucauaacucauucuauuucaugaaaugacaaauauauuugucuuuauuauccgugaauuucuagaauagacauuuuuaaaguuagauggccucucaguuguuuaauuuaccuucauaaaaauuuaauuuuauaauuuaaauuauuuuuugauauugagugauaaauaacaacaacaugguuauaaaaacauuucauagccuagcucaugcggucuuauuaaaaugugauucccaagcuauauuuuagcuuuuuccuuuacccuuuguacguaagugaugaguuucaauuuccugagaaauuucuggguauuagcauaacuccacucugguaacaagcugcaguuacaucauagcacuccaaaccuggaaguuccuaagaccguauaaucuuaaaguuuuaauuuuuguuuuauuuuuaauugucuguauuuguguaugucuauauuuaguguuaugcaugugacugcuguggucacagaagccagaaagggcauuaggucucauggaacugaaguuacaggugguugggagcugcuguauaugggugcuaugaaaguccuuuaggcccucuaagagcacugugcccucauaaccauuaagcacuucuccagcccaaggucuggagauuguaugagaaaauaaaaaaagacuauuuauuugaguagcucauauuuguuucccucuaaagaugaaauagaauacuugagaggaacaugggaaauaacagaaucaggggggggaagaaccagugugugaaaugggagcgagcuacagcuugaaauagagagacaggguagucuacuaggcuauucuauuuaguuacgcuuuaaaagauuucucuacaaauaucuugaaucuucuguugcuggcuucuuuuuaauccuauuaucaguauggccaaaugauauuaggguucauuuaaauuauuuuugauuauuguuaauuauugaugcuugcuuaccaguacauaguaacuuuugaaaguauacucgugauaaaauguugucauggguucugagugaacaaaaugcuauuugacuuuaauguuucuauuuugguaagugagucacuauugcuguuagaauacuagacaucuuuucuuuacuuuugucauuguuccuuuggggugagggaguguuagauaguagcugugucuuuaaagaauuuuuaaaguagaaaaaucggaucugcacuuuaggcaguuucauccagagcuuugcccuguuguugccucuugaaggaaacuaaggaucucuccagcccuaguucugauacuuuuuaauaaguuuuauuaauuuauucuuuuuuuuaacugugccauacauguauauaacacauucugauuguuucacuaccucuacccuuuucugccucucucccaccccuaucaauccacucuuaauuuuuccaaaagaaaaauuuuuuuggagacaagucuuacaguccauaacuguaaccuagaacucauuauguaaaccagggugguugaaaaaaaaucacaaagaucagcuugccucugcuucccaagugcugagauuaaagcaugaugaaccacaauauccugcauuauuaaauuuuuaaaauuuuuaaaaauuuuuuaucauuuuaaaauuuucauuuguguauguguaugucagaggauagcauucagaaguuguuacucguuauuuuuuucuuuuuaccauaugagucccagggcuuaaccucacuucaucaggcuuggcaggaagugccuuuuccauacugagccauucacuggcucccuauuaugguauuuuaauaacugugcaccuauuauucacacaaagugguugguauuugcaauugcuuuuguucuuuaaacuguuuuaugguugccaugaauacauugaguuacuauuuguuccagaaccugucuagauguguaagcacuuucuaaugaagguuaguuaaaaauuuuuuuuuaaguuuuaggucauacuuuucacuaggaauuuucauuguuauguuggaaaaaauaucuggguuuuauuuuccacauuaaaauaaugaggugcaggguugacaagauggcucagcagucaaagguacuuuaccaagccugacaaacuugauccuuagcaucuacaugguauaaagagaacugacuuccagaguuguguucugagauccaugcauguguauuaugguauaugugugcucauacacacauacacagauauauauauauauauauauauauauauauauagagagagagagagagagagagagagagaggacaauaaaugauacuaaauguuguaaagugaugauauagaauaauuaauuucuagauuauaauuugucuucucaauucuuuuucaaggccaggaaacaagcuucgcaaguguuuacagcggagaagauuccuugacccaaauauuuucaugauuuuguaauuauccuuuuuuucccugauaaugaacucugauagaguuugaagaauuuauuucacuuaaguccuugauauguuauuuaaguuauaaugccuauuaaguuauacuucuuagcauuucauugucuaguaauuaguugaauaaaauuccuuguuugcuuuguug

SEQ ID NO: 5459 - RNA, 1950 nt, Mus musculus
cuuuugacauaaugcauuuccuuuacuguaaguaaggaauacuugcuaauuaaacacaaaacaaaaaacucuuucuguguaacuggagcacuguggcucacaccuacaaucucagcaccacugaggccaggguagggguaacacgaguucuggcaauccuggcuaguaagcaagauacaagcaagcaacagcaacaaucaccacaaagccaaagccaaaaaagcccaucuauggaaccugcauaauacaaguaaagccagcuuuaauacacaaggaagguagagaaauuuggggaaacauuuuuaguauguuugggguauucuucccgagguacauuuccccacauuuuguuuaggcuaguacguguuccuuuauuauaaacaaauauaaaccaaguaacuauuuaguguucauuaaaaaagaagacauauuuaucuguuuucuuaguuuugccguuacggcauuugacauuuugguuguagugauagacuugaagcugucaaaucuaucagcagaaguagagcuaaaucaaagguauuauuuuccgguaucuuauuguaguuuuggcaaagucaaaucugucacuaagauccgccccuuuaucuguucgcugaaauaacaacugaacaagucuuuaggucaauuuuuccgccucacuuauuucacaacuuuaaagugaggugcaagaaccucugguucgacuuucagccuuccucccggguuccuccugggacagaccucuggacgaaccccgaccccaagucccagcucggcuuccaggagucugcacagaucaggccauugaaaguuccaagaagccgggcuggcugucgcccacaggcugcucugggcgacaaacgugguuuaggaacgcggaaaagcggaagcccuuggaccuccgcgccccgcccucggcgccacuaccacgcccugcgcgagacucagaccagacacaucgagcgcagaauggcgaugccucucugccaggcgucuccaucagaagccagcaaagcccagcagcgggcaguagcuguccuucccgaacgccgggcgggcugcggucaccccccagccaaucccgagccgucgcagacaggcagcgaaucggcggccggcauuccaggcgcgaugagucgaacuccgacgcggggaucgggcggcccgcggagccggggcuguuucucagcaauccgugccaggcguggcuccaggccuuuccacuccgacucugcgcgugcgcccgcccggcagccggcggccgcgguguccgcugcagcccgccgccagggagucgcgccgaugcacgggcaacaacgcgggccacgaugacagauuacggcgaggaacaacgcaacgaguuggaggcucuggaguccaucuaccccgacuccuucacaggugacuuuggcggccuccugcuccggggcggaggccggggccccgcggcccuuccugccgcucuccagacaguuuccagcacucgccugcuuccuuccccacuguccugaaauccgaagguccggguggcucugcggaggcccuggaauugguccugaccgcuuugguuucgcguaaccuccgucauccgagauucacugaagcacgcgggggguggggggaacuagcagugcgaugaguuucuccagagccgcuuaauguccccccuuuaccuccuauuuuaagcucuggugaaguagcagcuguuuucccugcugagaagauugggaugcuggcuuuugagagcagcacacucggggaugucuuauucucucuauaagagugaucaggcauucugcagaaugccugaugaacgauguggucgcugugguucuuagguaucuuagacgucgucgagguucuggaggcccagggaaggcaaguggcuugugcucucccuccuccagccagagguccuuaguucuuacauccugaagacuucgguuaaggauu

SEQ ID NO: 5460 - RNA, 7484 nt, Mus musculus
aaucaaaagcacgugcaaagacuauuaaaaggaacuugcguuuacuuuucagcuucuuuggcuacccucaagugucagcaaccaccaguaggaggcauuaucugaacguuguugggaaauaaagcauuccuggggaaugacauuguuuccuuaucuggcucgaugcagacugagcaggauugcuguuuugaaagagcuccacccucagccucagccacaguugcugugcuaaaaccaaggcaaacgucuuucccucuucgcgugugugugugugugugugugugugucuccaacauggaugccuuucagagcaucuuaaaauucuuucuuaaccaaaaaacugcuauuggcuacagcuucauggcuuugcucaccguggguagcgaacgucucuucucgcugguggcauuuaagugccccugcagcguugagaauacugccuaugggcugguuuuucucuucgccccugccuggguguuacugauccuuggcuucuuucugaauaacaaggcauggagacucuucacuggcugcuguaugaacccaaaaaaaauauuucccaggagacgcugcugccgcuucuucuacguccugggccauaucauacugaguucacugguggcuccggugauguggcucucuguggcuuugcuuaaugggacguuuuaugaaugugcuaugagcgggacaagaagcacaaggcuccuggagaugauuugcaagggcaagcccaaagagugcugggaagaacugcacaaagucuccugugguaaaaguagcauggccgcuauggagagugaagaagugaggcuaucccugcaggcccagucucagguaaggacaaacaugccuuuugcuccuagugggaacuucucuggcuuccuuucauccgucagagucugagucuugccaggauacuuuugacacuaaguggaaauuggaacaugauguagcauuaagagaaucucaggaaaagcuuuuuagggacaagauggcucaguaaaauugcugauuggauuguguagucuccauuuccaaagagaaaauauccucuggguuaugcauauguaaauacuuaagugcucaaaacucucucucucucucuggguugacucuaaauaaugcagaacacaaugucauccacugagugcuaaaccugagcuguaauuaagcacuacugucuccuaucaauuauuuauuuucaagccgaugucucagaaaacacagacacaucuuauucauccacugaaauagagcugagccaaaucagugaccacuuuucaaagucucuugggguauaauuagcauagagauuuccuugaguaaccacagugguaacugguauuucuaugcaugagugcugucaagauugagaguuccccgaauaagaugggacugaucagucuuuaaauggucuuugguaaagugugaccacauucccuggggcaguuuauggcuuuugcucucugugcuguaugacuaagucaauucucaugcuacuuuagaagcucagaauuuggagaauuguuuuccuugugggcaguaauuuccagcuucaacuaaucaauacaaugaaggaacuuguuaccuugccaaguauuugaacacagauccaggugccuaguccuagccuagccuugcagugaagcucauuucuuauuucgggggccaaaagagguaggaguaaauuaaaagagccauccuuucucaggaauaguguugguuucuggauaaaugcacaggcacauacuaauuuuacuguuuuugcaagggcuugcccuuacagcaaacacauuaaagcaaaguuggcuucuacaauauaggaugguuacuaguaagguuauauucuccauaagcuauuaaaucaaagaguuucccuaaauaaacuccuuuguuuaguucauaaagcauagguuagauggaacaugucaggcuccucugagugccuuccaucuuuuguugaaggaagguauucauuacuaauguuaugauaguguggaugacacauggcuuaccucuguaggcaccagcuccauucaaccgaugccaauccccaacacucuucacuguguaagcuccucuuuaaauauaaacucaaaaaaaagcaugcacacccaggcauagcuuagaucgaacacaaagaccuguugauaacucuaguagaaugagaaggaccuacaggaggaugcccaagagaugugacugaagggagguauagcaauagcaggugcugacgaugagguucagacagcaggaggcaucaaacaguccaaaacaauaauugggcaugugggcggagguggaaaagugcauucauucauggguggggcagagcaacaugaaacccagcuggaugaaucucugcucuuaaggaagguggauggaguaguggaaagagcucagucauggagucagcugguguugaauccugaugcugccacuccccagcugugugauauagaacucugaaccccaauuuucucauaaaaggggacaauagcaccuauuguggggaguuauuuagagauaauggacauagucauaaagcuuuuagaauguuccaaggugagaaaacugucaggauuugggggcagagacaaauagggcaaauagagacaaguaggcugggaugggcucaaucaccacacucuagcuagaguucuagggacugugaggagucugggaggaggacaagacucaccaguccggugagaaagaaaagaauaugaagcugaucauauaguuucuaacucaucaggauuaucugagguagaggagaauggauuuuacacaagggcccagucauagggaagaaggggaugcugaaagaaagaggaaggucugagggagucaaccacaaaccuacuggugacugaagaagaggaggaaggcucucacacaguauugacugugccccaguugguuauuguagaacagaaagagauguuugaaaacagguagauaacagguagaacugguuaacuucuugcccagcuucccgaaaaacacuuucuaaaaugacuaaccuuaauauuauaguagagacaggaaguacugcccauggugagaagaaauguggguguuugaccugaggaauggcauuuauacaauggcugagaccguuuggugucccuacuucugggccagaauuugggaaccacugagcuaaagcuaaaucucugaccugaguggacccauuauuagugcagauuauuguuuuuguugucaacuaagcucaugagcuaaggguccuuugaacugaaaucagaagaugcuuucaagaaauauguuagcagccggguguggaggcgcacgccuuuaaucccagcacucgggaggcagaggcaggcagauuucugaguucgaggccagccuggucuacagagugaguuucaggacagccagggcuauacagagaaacccugucucaaaaacaaacaaacaaauaaaaaacaaaagaaagaaagaaaaagaaauauguuagccacucgaauauaaaauuaauucaaauuaugaaaaguuagucuagagcaacaaauuuagaagauauguuuacuguagacuuuuguuuuaaaaguuuuuuuaaaaaagaggaucauuccuacuuaaaaaauaguucacuuuuucuaauuuuagaaauuaagaacaaauaaucuuuaaaguuuggaaugacccuguccuuuuuucucucucucucucaaccuuuagguaggcuuuaaauucuuauagcuucagcucauuacugcauuaugucuuuucuuucuuuacugugagcaauaaguuuugggacccagagaguggcugcugcugucuacaaaaaagucacaugggaaaagucacucagcagugugugcacgcacugaucaacaccuggacaccugucuaacaaacugaucauucauucaaaugaccaccaugauuccuuagaaagaauucuuucuucuaauaaugccaucuugauguacuuuaguaggaaguuauugaacaaucauucuuccuauuugucagccuucugguuuuuccuuugcauagcaguaauguugaguagaaaaugacuauugaguugacucucuauuuugacuaucaaaaaagcauuuaaaguuaagaugaauaauuucaagugugaaggcaguaaugacuauggggguaacaucauccaccuccccgagaugccauuuugcuuuccugugucuucaacauuucuuuugcucuuaagauccuaggauggugccugauuuguucggcguccuuccucucccugcugaccacuuguuaugcacgcugcagaucuaaagucagcuaucugcagcugaguuuuuggaagacauaugcacaaagggagaaggagcaacuggaaaacaaacuccuggaaugugcuaacaaguuaagugagaggaaccucaaaugcuuuuuugaaaacaagaagccagaucccuuucccaugcccucauuuggugccugggaggcugcauccgagcuacacuccuuccaucaagaccgugagcacuacagcacccuccacaaagugguagaugaugguauggaacaaaccccgcaagaggaagaaacaacaaugauccuuguggguacugcccagaguuugugaaucaucuaccauuccuggcucagauaucuagugguacacucauucggaguugaguuuucugcuguuuccaugacaaccugagccucugcauuuucucaccaucagagcuucuuuggaagauaacacagugggaaacuguucugaagccucgaagagcaaugucuggaugugcucagacugauugaugcuaagugaugacagacacuuugagcugguggaggguuguguccaggagguccaacaguugauccaagcucuuaagauuuuauaacucagcccuuagagucuggcaagauggucugccacuauuuguaagcaucugucaugcuauucugggagaggucugugcccagugguauccacauaguggccaucaggaaccuuucagaaauauauccaacaccuuuuaaguuggaaggaauucugccauuuaauuaacauuccuuucuauagaauaccucuauucccaagacucacuaaauugaaagaauauaauaucuaaaaaucagagguuccugcauuuaccccaauuucugaaagucugccuggaagagggcugccacauaacugcugugggugauagguacuuauaccaucacaggacaauuucuacauucaaaagacaaucacauaaggcauaauacaagacugcauugauauaaagacaaguauguuaauauuguauauuaaaguaguuuuucacaaaaaaauccauuuuuucugguuuuaaaauugaaaaucauuuuuauggauucccacuaaaauuucugguccaggacauggugucugcuguguuauagguaagucuuaguuucuuuggacuacuauaacaaaggccacagacuaugugacuuauaaacacauauuagugagcuguucccaagcccauuccuuucagaaaguuccuuacacaagcucccuaaguuugagguuccuucuagguaaccccaccuacaauaacaaacugccacacuuccaaaguucucaauacaggccaucuuguuuucccaccuccagagaccugcauccucuggacacuaaagaagauaccaauuugcuuucccagucuccacccauccccuccaaggcuuuugaggggauagauaagaugucuucaacuuguuugccuccugcauaaaauagcacuccauaggaccagaagucaggaagagaaccugacucaucucaaggugacuuguuaagaguaggaguaucagcucuucuucuuaguaagcaaaaaguacaggcugcuggcuugucaucuuggauauccuuggauagggcauccauaauccagaguauaagcuuguugaauauagaaaggcccggagguagagggaggcagagauaugccccagugauuuuuccuuacuccucagcuuccugcaacuaagcuacuauucuagaacugccucugccuuuggcccaagccaagaaaugcaugguuauuggcuggguuccaucugcuuucuuaguaaacacuuagacauagucaagaaggggcugcagagagaugcucauuguucacuguuuuauuuacccucauuuuggccucugcuuugucuugucccuguauucucauccccagcauacacucucaaugcugcuucuuggaaaccugaaggauguuguuuuuaaucuuucuguauuaacauugcaagccuacaagcauggguguuuccucucaaacugauauauucuccaauguaaauugagugucccauaauucaaauaauuucuaacauuaacugcaauuaagcauggcucccaagcugguuuagagcccauuucccaagaauguuuccuggcacuagauacaauucacaagcagaaggcucccaggcuacuuucaaguugugcuggguacagcuaccagauucaggccaaugagagaccaucucuggaaaaacaagccugaugccucuuuuuuugugguucccuguccucaugucuguucccccaacuuacccagccccagacaggguuucuuuguguagccuugguugcccuggaauucacuuuguagaacaggcuggccuuaaauucauagaucugccugccuccugaaugcugagauuaaaggcauaugccaccacaucaaccuaggccgaugacucuuaaggaaugacagagacguuguuaucuggccuuggcauauaugcucauaggcgaguacgcacccaugcacacaaaugaauaagcauacauguucaucuacacauuccuucaauauacacacuaaacaagucaauaaaacuaagaggccccuaugcaaaaugaggcagccuaguuuacauacgaugacauggaacauuuaaacuucucugcugagugaguaguaauacauaguaauagugucaaggagagaagaugccugggggagaccuaacuuccuguuguaaaaccucaccacaagcagaaagggaggacagacgauugccaguaaagugaaaggaaaagggacuuucagaauccacugaccaucaagccuuagcagauacuucucuaugacuaaaggaaaaacauuguucucaaacguaauuacuaaaauuuaaggaucauuucccugaaguaccucuuccucauauuggaacacuaacaaaagcugcucacaugucucuggguucuuccccagucuguaagaacuaucucuaagaguucuaaaaucuguagcccucaguuuuuuccuacuuaaugcgagaaauuauuuacaugguuacauauuuuuaaaguuuuuuuuaaaaaaauaacauaucuaccauauuuccaguccaaauaguaaaaauucuuaaacuauuucaugaguucguuugacuguuaauauuaucaucuuugaaauauuagaaauguuauaaccacaaaaaauuuucuuuccuuu

SEQ ID NO: 5461 - RNA, 3923 nt, Mus musculus
cagaaggaaaagggguggagcuaagcacucacugcgguuuugcgcugcgucugcagaggacaaggaaagcucugcagggcugucagcugccaaaaugaacggcguggaagggaacaacgagcuaucucucgcuaacaccacgacccccucccaugccuccgaagaucuggaucugaagcaggaccaggggcuccaagaggaaaccgacacagugcgggagauggaggcugcaggugaggccggugcggauggaggcgcgucuccggauuccgagcacugcggccccgagcucugcuuccgaguggcugagaauaguugugcugcggcagcgagaggucuggaggaugcuccgucuccaucaaagggcggggacgcacccucagccccuguggcagccgacgacagcaguaaaaauggcugucagcuugaagggccucacagcccugcuaaaccgaaagcccuggaagccuguggugcggugggccuggggucucagcagaugccggggccgaagaagaccaaggaaaugacgacuaccaagugcgccaucucuguggccaccggcaaggagggagaagcaggagcggcaaugcaggaaaagaagggguuacagaaggaaaaaaagguagcuggaggagggaaagaggagacucgacccagagcuccgaagaucaauugcauggacucgcuggaggccaucgaucaagagcugucaaauguaaaugcgcaggcugacagggccuuccuccagcuggaacgcaaauuugggcggaugagaaggcuccacaugcagcgcagaaguuucaucauccaaaacaucccagguuucugggucaccgcuuuucggaaccacccccagcugucaccaaugauuaguggccaagaugaagacaugaugagguacaugaucaauuuagagguggaggagcuuaagcagccaagaguagggugcaaauuuaaguucaucuuucaaagcaaccccuacuuucgaaaugaggggcuggucaaagaauaugagcgcagauccucaggucgaguggugucacucucuacgccaauccgcuggcaccggggucaggaaccccaggcccacauccacaggaauagggaggggaacacgauucccaguuucuucaacugguucucagaccacagccuccuagaauucgacagaauagcugaaauuaucaaaggggagcugugguccaauccccuacaauacuaucugaugggcgaugggccacgccguggaguucgagucccaccaaggcagccaguggagagucccagguccuucagguuccagucuggcuaagcucugcccucgugagaagcucuugcagaggaguccuuaccaccuccucagcuuggccagcagcaugcagccuucugucugcuuucucuuccuguuggauuguguucauugguucuucuaagucuccaguaguuucaagauuguggcuuucaagucuuugcucuucuuucucugggccaucacgauguucugcauauauauauauaaugguguuccaagugcauggccuucaaacugcuucuaugccaagucacgugcuguagucuguacuucguucuuugcauggcuuggucccugucugugacaugaucuuuuuuucauuuuuuuuuuuaagugguucucugccacaagaaagcuugacacauucuuaccaagaacuagccaggcuucauacuuucugcuguguucccgauaucuauguacugugaagaaccgugaguuucaccacugcaagauggaacuguaccccaacccagccauuagcccaacaggacauuccaggcuauugccaacugauccuagcugucuuccugggccuuugccuuuuacccugcuuguuaucucuacaacaagcagguggcugguggguaugagugaaguaacaggcgaggaauguuuucugucaccucauuggucuuguaccguugguugcugugcauugugaucagcuacuggugaguauggaagcuugugcaauugcccacuaguucucuccugguugagcuuugcacaggcccaagugguuccucaggaacuaucuaaggaccuaaguuccuaggcagcacacagauacccccugcuguaccaguucccauggcucaauuagcugcugggcaggaucuguagucucacguggcagugcccaaagcaaagcugaaguggcucccuuccagugguuaguucugagcccuaaccaacaaauuauuccuuauccaggcaccuuugauagguaacuacuccucuuccuguguucacacccacucugguuaagucaaaguugccuagguuuggguaguuagaaauuguuuguggcccacaggccuugcuauaccuuuuucucuuuggcucuucucuuuucaccuccccccaaccccuuuucuuuuuaaggcaguuacagcccagagacagaaaaaacaaaagacagcaggcuuuuuauuugcucuccccuugguuguaugcaggcugggaaagguacuguaaaguagacuccaaaucucucacugcccugacuauuccacccuucucauagcaagggagaccaccuccacucuucccuccauucuacuaggugcugugucuuuaagcucuaguuugggaaucugagagaagagaaagaagagucucaaugacagacccugugccugcccugagcagucugugaaugaaugcaccuagcccacguuucuaaaggacagcaguucuuuugugggccucagccuguagaaaugaccagagagcaacaaugugcgacaucuuuguuguuugccugaucuuggcccuuaccugucagguuuugaauguccuuccauguuuccauccuaacaaagaaggaagcaggcuguagagugcauugugggagggagaccccaagccucuucucagggauguggggaugugaggggucuggauuugcaggacaugcuccauugaauuugcaacagcgcuguuguggcuucugccgcugcagcccucaggcauucccuuucugauugaaagaccuuguugaaagcuucuccaaagcucguaggucuggauaccuucguuggaggcugggaauuuuaagaggaggacuagagggaagagccuguugcagagugaguuuuucuaggucugcugagaugauugacacauggagggagcaggguugggggcaggggucccugaagcacauuccagugcaaggaggugggggaagggaucaaguggguugggauuuaaaaagagacgcuuggaggauauuccuuaguuuguucuaauuuucaacuccaccaguagauguuaguaaacagauguaagucugagugagccuugccuggggagaucaauggugugcacuccucauuccacugcgcucgauccuaguccccccugucagcucacuggcaggauugauguuuacaagccugccuuuuacugaucauugagaacaagugcaaacauuugaauuucugucaguugcaguaugaagacuccugggaacacucacuacuagauuaacuuguucuggugucucuucauguauagcuguauucuuagaaguucaauccgcacaaugaucucugaagucugaagacuuuuugaaaacuguugcuaugucuuguaaaagugguuuccaaaagacaaauguaacuguccuacugauauuucuugcuguaguaaguaaguaacacuuggcauuaucuucuuaacccguguaaggacuagaacugcuaucaacuaaacgaggauauuaguccuuugucuucuccugugugcucaaaggaaagauaauguuacuguuauauuucucgucugcaccaaaaauaaauaaauaaauaauaaauaaauaaauaaacaaacaaauaaauaaaugugaauaaaaagcucuaugcugucugggugaauguac

SEQ ID NO: 5462 - RNA, 3923 nt, Mus musculus
guacauucacccagacagcauagagcuuuuuauucacauuuauuuauuuguuuguuuauuuauuuauuuauuauuuauuuauuuauuuuuggugcagacgagaaauauaacaguaacauuaucuuuccuuugagcacacaggagaagacaaaggacuaauauccucguuuaguugauagcaguucuaguccuuacacggguuaagaagauaaugccaaguguuacuuacuuacuacagcaagaaauaucaguaggacaguuacauuugucuuuuggaaaccacuuuuacaagacauagcaacaguuuucaaaaagucuucagacuucagagaucauugugcggauugaacuucuaagaauacagcuauacaugaagagacaccagaacaaguuaaucuaguagugaguguucccaggagucuucauacugcaacugacagaaauucaaauguuugcacuuguucucaaugaucaguaaaaggcaggcuuguaaacaucaauccugccagugagcugacaggggggacuaggaucgagcgcaguggaaugaggagugcacaccauugaucuccccaggcaaggcucacucagacuuacaucuguuuacuaacaucuacugguggaguugaaaauuagaacaaacuaaggaauauccuccaagcgucucuuuuuaaaucccaacccacuugaucccuucccccaccuccuugcacuggaaugugcuucagggaccccugcccccaacccugcucccuccaugugucaaucaucucagcagaccuagaaaaacucacucugcaacaggcucuucccucuaguccuccucuuaaaauucccagccuccaacgaagguauccagaccuacgagcuuuggagaagcuuucaacaaggucuuucaaucagaaagggaaugccugagggcugcagcggcagaagccacaacagcgcuguugcaaauucaauggagcauguccugcaaauccagaccccucacauccccacaucccugagaagaggcuuggggucucccucccacaaugcacucuacagccugcuuccuucuuuguuaggauggaaacauggaaggacauucaaaaccugacagguaagggccaagaucaggcaaacaacaaagaugucgcacauuguugcucucuggucauuucuacaggcugaggcccacaaaagaacugcuguccuuuagaaacgugggcuaggugcauucauucacagacugcucagggcaggcacagggucugucauugagacucuucuuucucuucucucagauucccaaacuagagcuuaaagacacagcaccuaguagaauggagggaagaguggagguggucucccuugcuaugagaaggguggaauagucagggcagugagagauuuggagucuacuuuacaguaccuuucccagccugcauacaaccaaggggagagcaaauaaaaagccugcugucuuuuguuuuuucugucucugggcuguaacugccuuaaaaagaaaagggguuggggggaggugaaaagagaagagccaaagagaaaaagguauagcaaggccugugggccacaaacaauuucuaacuacccaaaccuaggcaacuuugacuuaaccagagugggugugaacacaggaagaggaguaguuaccuaucaaaggugccuggauaaggaauaauuuguugguuagggcucagaacuaaccacuggaagggagccacuucagcuuugcuuugggcacugccacgugagacuacagauccugcccagcagcuaauugagccaugggaacugguacagcaggggguaucugugugcugccuaggaacuuagguccuuagauaguuccugaggaaccacuugggccugugcaaagcucaaccaggagagaacuagugggcaauugcacaagcuuccauacucaccaguagcugaucacaaugcacagcaaccaacgguacaagaccaaugaggugacagaaaacauuccucgccuguuacuucacucauacccaccagccaccugcuuguuguagagauaacaagcaggguaaaaggcaaaggcccaggaagacagcuaggaucaguuggcaauagccuggaauguccuguugggcuaauggcuggguugggguacaguuccaucuugcaguggugaaacucacgguucuucacaguacauagauaucgggaacacagcagaaaguaugaagccuggcuaguucuugguaagaaugugucaagcuuucuuguggcagagaaccacuuaaaaaaaaaaaugaaaaaaagaucaugucacagacagggaccaagccaugcaaagaacgaaguacagacuacagcacgugacuuggcauagaagcaguuugaaggccaugcacuuggaacaccauuauauauauauaugcagaacaucgugauggcccagagaaagaagagcaaagacuugaaagccacaaucuugaaacuacuggagacuuagaagaaccaaugaacacaauccaacaggaagagaaagcagacagaaggcugcaugcugcuggccaagcugaggaggugguaaggacuccucugcaagagcuucucacgagggcagagcuuagccagacuggaaccugaaggaccugggacucuccacuggcugccuuggugggacucgaacuccacggcguggcccaucgcccaucagauaguauuguaggggauuggaccacagcuccccuuugauaauuucagcuauucugucgaauucuaggaggcuguggucugagaaccaguugaagaaacugggaaucguguuccccucccuauuccuguggaugugggccugggguuccugaccccggugccagcggauuggcguagagagugacaccacucgaccugaggaucugcgcucauauucuuugaccagccccucauuucgaaaguagggguugcuuugaaagaugaacuuaaauuugcacccuacucuuggcugcuuaagcuccuccaccucuaaauugaucauguaccucaucaugucuucaucuuggccacuaaucauuggugacagcugggggugguuccgaaaagcggugacccagaaaccugggauguuuuggaugaugaaacuucugcgcugcauguggagccuucucauccgcccaaauuugcguuccagcuggaggaaggcccugucagccugcgcauuuacauuugacagcucuugaucgauggccuccagcgaguccaugcaauugaucuucggagcucugggucgagucuccucuuucccuccuccagcuaccuuuuuuuccuucuguaaccccuucuuuuccugcauugccgcuccugcuucucccuccuugccgguggccacagagauggcgcacuugguagucgucauuuccuuggucuucuucggccccggcaucugcugagaccccaggcccaccgcaccacaggcuuccagggcuuucgguuuagcagggcugugaggcccuucaagcugacagccauuuuuacugcugucgucggcugccacaggggcugagggugcguccccgcccuuugauggagacggagcauccuccagaccucucgcugccgcagcacaacuauucucagccacucggaagcagagcucggggccgcagugcucggaauccggagacgcgccuccauccgcaccggccucaccugcagccuccaucucccgcacugugucgguuuccucuuggagccccugguccugcuucagauccagaucuucggaggcaugggagggggucgugguguuagcgagagauagcucguuguucccuuccacgccguucauuuuggcagcugacagcccugcagagcuuuccuuguccucugcagacgcagcgcaaaaccgcagugagugcuuagcuccaccccuuuuccuucug

SEQ ID NO: 5463 - RNA, 2177 nt, Mus musculus
gcucuuagaaacuguuuugagagauaaccugaaccugguauuccuugugacacuugugacuuugcacuuccuuaugacucuuaacugguaucuuugguauuuuccaacaacgcccuccccacuuccuugaguugugguuucucccuuuaaauacccucuuauccagcuacucggggcaucauguuccucuaccccugcgugguguaugaccgugggcccuagagcgcucuugaauaaaaauccucuuguaguuugcagcaagaccuuuucuugugggugauuuuggggugucgccucuccugagucagaacgucggggaguccucacguugugggucuuucauuuucucucuuuagccauugugagaacuugcccaucuugacuagauuauuuauagagaaggcauguaggaccaaguccagcugcugccaugaagccuaccuguaguacccuuagcuuaucucugucuagaggaccaaacgcccugagaucacuggcagcagaucccugaguaggauggauguugcucagcguagcuguagauguuguccuguugguuagccagacuuacucaaagggcuccuagccaugaacaugggaucuucagagcugagcuuuguuuaaugaaacaguuaacacuuuagcucacagucaguuuuaaccucucagccuauauucuuagguaaauccuuuugcagcauucacaaauaugagaacuaggaaagauacucuaaaagguuaugggcaaauucugguccccugaacuguuuguuacucauugauuaucaagggggaucuuagggcaaacaccagaagggaugcuaaaauguaaaugagacugcucuauauagcaagacuuauuuucucaagcacauguuacuucauuaaaaggucuccuuuuuaaauguuucuagauuucuauuguuggagaaaguuuauguaaccaccuuuagacaaagcuaugcuacaugcugaagagaggacugagggaauuugcuuagugggaccauuacuuucuuuguacacaaaacacuguugggaagaaggucuguguacugccuaauuguuuuuuugggcucugguggugcuauauaagggcagggagcaugaaaaaaagugggauuaugguuagagacuuaagagacauaaguggaauuguaccauuuaauagaagacagagaaugggguaggggugugugacaguuugaaaugaaagaacuccaaggaaaugagguuuuaaugccaugggcagaaaugggaaagaggucggaauaaaugucucuacaaguuuuguuugaauuuucuuuacuuuagaaaaccauacauuugaaacauuauuuaacguauguguuuuuaaaaacauaccaccguuaugaaacugauguuauagaucccaaccucagaguucaauugacuuccucaauuaaggcuuuuuccugaggcuuccauuauccauaguuaacugcagcauaaaaauguuguauggaauucuagaaauaauuuccauuuguaguuauacaguauuuguauaacaaauauagcaaaacagacucauacuauuucauucugugcccaacccccauccuaccuaucaggauguaaauuauccuuuuguccagauauuuaugcugugucacccauuagaugcuuaguccugguugucugauacaaugucacagaaucacugugccugugcacaagucacucuuaauuguacuuaauaauagucaugaaagcaagagucagaggcacucaggcuuacaaccuggaaaggcacauuaauucucuaguagauggcaaaaauguggcacauguaggaaaaauaccuauugagcauucaauacuagugugacuucagguacccacugaggugugcuuuuccauggagaggagucagugucacaagugcacaaagaaaucugcuauggaacagaaguguaguguggugaguacaacagaggaaucucaggaccuccaaggccuuuugccacccauaucauuuacuagcuggauaacugacaguccaaccauacacuuacccaguagagaaaagugucuaaugguggaaugcucagaauccaggacuccuaaucucaggauuagguaagaaaauaaauauuaagauauuuggcacaggguucagauagaaaccuuagcugaaauacuggagcacagua

SEQ ID NO: 5464 - RNA, 27353 nt, Mus musculus
ugccgagugucgcgcgucggcgccgcugccuaucccgcucugugcccuacggcccucccggcacccgccgccgucccgcuccgggcugcccuugcuccgagggcugcagcaccggccguccccgucagcccucuugucuggccgccgggccgcggcgggcgggagcagccggaggaggagccgcagccgggaggcggcggccugagcccauggcguacagucaaggaggcggcaagaagaaagugugcuacuacuaugauggugaguggccgaggagccugcagccgggaugcggggagggcgcggcggggugucggggguggcagcccgcggggacaccaacacggccuacccagcgguggcgucucggggacgcccgccuucgcuccucucggguccucucgggcacacgcagguuuagggugcacugccucugaccggucucccgaggaaccccaguuggcacccugggccugacugcacaaagcuggcguccuggagcuccgccccacgucccuguccccucccccgcucucccgguccccccuucucgcccccgaucuguccgcgcugcgcuuccagccucacccgggaccccggcacccggguggggcugcggaggaguuacugcuggccgguggccaaguucgcagagcggcgcugucucgcugguguuuugcguggacuacaucccucgccuuuguucgcguucuucgagcuccacuuucucaggguucaaauggaagggcugcacuuccucggugacaauuaagggguuuugaguuggaaguagguaggucguugggaagugguaggagagaggaagcgugcaguuguucuuguuugauggguccuggcaugucucuaugggagguuauuaccucccccuucuuuguugcucuuuguucgaucugcuauaauacccugcucugggggguuaggaaagaacaccggcaucuugcuuaggaacucuucuacuguggugaagaccuugcugcaggaaacuuugagaaguggacuaaauauucacaaugcagugaacgguacaaggugacuguaaggauuuucuaauuuggaguauaaguaguaauagucucuggguucaguuacaccaaauggaauggugcccugccuauacagauuucacccaagacaucaauagauaaaccauugagagaaguaauaaggaaauuugacagaacuuucgaagcucauugauugaacgcuugaucuccacaaagcaauaugaaauugggagcguuuucuguaguuguauugaagucacaguguuuggagagguagauuagagaacuaggcugaaugaaacacuuaaacuuguuaaaauagucgugcauuuucuugguuugacagaaucuuuuaauacaagcuuuaaauaaaauagccaccugucauuggcuggaaaaccaaaaaccuuacagaaagcuaggccaaaauggaaaaggcuguuuuguuuuuugagacaggcucuaaguugaccuggcuguccugaaacucacuguguaaaugaggcucuaacucauagagauccaccugccucugccucccagauccugggauuaaagauaugugccaccauggccuggcuuaauuggaaguuugagaggacucaaacuguauugcauguuuauuugaaguuacaccaucauggagagcagagaugggagagcaugucgguuuaaacaugaguuacauuaugacguuggggucauagcaaagcccugaccugcauucucugauccauuggaaauuacagccuuucuaaaguaaaguccugcucuuguuagagucaggggaaagguugagcuguuggggaacagcucagucucuucagcugucagcuucugucaucagugaugaacucuaagucccauuaacuuucaccaggccugauggagaaccagagaggacucucugucuugaacagcuccuuccuggcuucaugcguagggaugagccuuugcugaggagugggauagacauuggucauggagauaagguguggagggaggcauuuuucagucaugugauuuucgacuuaugcccaugcagcugcuuuaccuaguugugagugaccaacuguauaauugaugguggaaaucugcugaguuaucuaucugugguucuuacuugacuuguuuuuagaauguacuuaacuuauuuuuauucugacuauuugcauuugggggacgcuaacaaaaauugaagauauauaaauuggugucauaguuaagcuaauuaacaugucauagcaugcuagacuacagagaauucucugcagagaauucccuucacgucugacuugauuacagaaacccucuucuuguuaguuuauaaagguagcagcaaucuuuaauugucuuuauuaaauucuaaacaagaggagcaaguaaagugacuuuuguaccaagaaagugcaugacuuucagacgcaugcaggguuggguugguggagaacccggccaguaggauuggggcucgaauaguauacuagucuuauguuagugcuuuuaacuugguugguaggggaggagaucaggaaaggaggagguuaacggggcacuaggcacccagagagccucuugacaacucaugugaguguuuuccugcuaagacugugugcuuagugaagaauacuucugaagauugaauaugguuuucuccgugugugcugcagucuucagaauuguacuuguagggucucugugccacugaucugugaacuuucagauaggagcguaugaacuaucccuaaaccucacaagagaaaucagaguuguucuuaguggacugugacuacugacuggucaucauaacucccagaaacacauuucagaauguuggcuaaucucuuacuaaacuaaaagacaaagaucgguaaaugauauaaagcuaauuaugugucuacacugagauccuuucugaccucuuucccguuuuucucaaaguguaauugagcagauggggcuacauuuaguucuaauugcaaggcucaggcuuuuaauacuuuaucuagaaauauaaacuuugccugguuuagagugaagcuugggaccaaucauguagugccuucuaauguauaguguauaacagaauugaauguaugcauaauuuauguaauuagacaccaauugcuuuaugcuuuguuuauuuucucugauagagauaaucagaaucaaaauguuuggagacauaguccagaggaaagcacguggcaacaaaaauauagaauauaacaauuacuauaauuauauuucccaguguacuccuaaguuucuuaacagauacaagaguacuacagaguggccaucgguugucagauuuauuuuacuuuuauuuaaaaugugugugcuucuuguguaugccuggugcccuugauguuuaggagugguugugagcuaccacguagaugcuggaaaccaaauuugggucuucuggaagagcaauaaaugcucuuaagcuacucuccagccuguccguucccacuauaacaguaggcaggaggaugguuaggcuucugccacuuauagaugaaaacagguggacacuucauauucuccacauggguuuucuuuccccacauagguuucuguuuuaaugucuaagaaagauucguaccuagaauacaaagauuuuauuuuucuuuugcagaguuuuguucuucugucccuaaaaaaauguauuaauaauugguuuuuuucuuagcaaaauuaaauguuaguaaauucuuaaaacacauggaguuggugaacaaaaggaaaauuucuuacauuagcaaaaugaaaugugaagucauuaaguaacgguuugggcuuuuuuaaggccgccauugcuauggauaaugacaccgagauuuauuucuguuuaguaauaaaugccuaggccuuaagcuaggccuacucccaacuagcucaucacucaauuaucucauuuauacuucucaguuuccuacaaccaacuuccuccgaguccgaauagggaauaccccacgccuaauucugaguuccucucucuuccagaugucccaccuuacuauccugccuuuugcuguaagccauaggcuuuuuauuuuaaucugucaggaggugccuuaggcaguuggggaaggauagagacacaucuucacacaguguaccgaaacaucacccuaacaccauuacauugaaguucuacucucaccauguugguuagucggucucacucugguuucaugguuuaugcuuguacaugaagucaguuugggguucagaaacauaagauuguuuuaagucccugcuuugucccauauagacaaagauuacuuaagaaggaaauggguguuuguaacagaguaaaagaggaauggaguaauaaaacaagcaucucuaggaagcauaugcgccagucuuaaaacaguccucccugugaaacaacaaaggccaaguccuuggaauguguuguacccaaaagaagggcaacccagagauagggaugcugggcugagccccaaggggccaggcacagcaagcuugguugaaagagaguuugacucuuagagggagugucuuggagcuuuuaaaguggaggcuagucaauaagagaauuggugagaaguagaauguaggcuagaggaaaguguuaaagugaaaggaaaugguugucuuuagauagaaucggguacauuugagagugguuuauaaaccaagaaaaaaauacaucaaaacuacuuguugguggcuuggacgagggauuagggcugggaguugugauuucuggacuggucaugagauggacaacauacuguccauugagauuauauggaaucaagggcucuauauuggcuauuauguauuugagaucuugauuuagaucaaaugaaaauacuuccaaaaauuaccuggaacccagggagaaguaguauuucuuagcugguaagugauaaauacugacguguuuguugaagguaaugguauggagagacacagacuccggaaauuguuccugagaagucauaggaugaagucacucuugguguacugcuuggccagugacaagcucuugacuuaugaggaaagugaagaaaagcugagauuuaaaagguuuggaggaagugagcuuagagaaggaacacaauggaggacagaauuguggagauccagacuccacaguguuucaaggaggagggagggucuaacaguguuaaaaccuucacagaacuaauguuguguggcagacagaaauugcacaguagucuuuuuauucuugauuuuuuccccucccucgagcccccccacacacacuacuuuuggcagcuucucuauguacagugugaaaguacauuucacaguccugaaauuuacaaugaucugaaauuuuguucacucagaaucaaaagcuuauccugaaauuaacgaaauuacaauuuauugucuuuauuccacuaacugugauaauuacacauuuuugcuuuagaaauaccuuugauuauagaauguugucccaguuuuaguacauuauauauuuuuaucuugagucaaacuuuucuggauauucuuaauugguaaaacuauauuuaaguauuugaacaaaaaaugggaucacauuuuaaaugcccaaauuauguaacugacagagacuauagguacaugaaauuaagaaauuauguaacugacagagacuauagguacaugaaauuaagaaauuauguaacugacagagacuauagguacaugaaauuaagaaauuauguaacuggcagagacuauagguacaugaaauuaagaaauuauguaacugacagagacuauagguacaugaaauuaagaaaagaagagcagugugagguuugaucuugcugugcauugcaauacuaagugcaggccccaagaucuggagucugcacacagaccugaguaacaguauguggccuugccuucaaguuauuucugacugguaaauaaagaugccuacagccaauagcugagcagaagaguuguauguggggcuuaggauuccuauuguaaauauaaagguuguguguaucuuuuaucuggaaacuaaauggucaaagccaggguagaaacgccagguugggauuaagcguuuuaacaacagggcuggauggcuuagcaguuuaaaacccuggcugcucuuucagaggaccuggguuggauucccagcacucacaggguuguucacaggggucauucacuacagccacaggggaucugaugcugucuccugcccuccauggccaccagacacagucauauguauggcaaaaucaccaugcacauuaaauaaaauuuaaaaagaaucaguucagaaaacauuuucuuaaaaaagaaaaaggcagaagguuuuuuaguaagaaauagaugacuucaaagucgccauguauaaaacuaauagugaacaggaaacauuagaaaugaagauucuucccucuccuccucccagaaucaccuacccucugcugcuagagugcugguuuaaaggugccuugcccacaaaaaugguucuuguuuguuuuugaaauuauaauaugaucacaccauuuucuuccuuccuuuacucccuccaaccccuccuguguagccuuccaccugcucucuuucaaauccauacccuuggauuucuuuaacuguugauacauauaaauacuccuaaauacauaaauacaguguuacuauauguuuuuagagcuggcuauuuguuauuggauaaccaauggguuggucauuaccuggaggagauucuuuguccuauccuuaguccuuaguugucuguaguucuuugucuaggcuugaggccuccugaccuucacuaacgugucuguuaaugaccuuguucaggucauguuuagccagucauguuggugagacuuuguggauguugcuucugacaugucucacugacaggcuuacaguaaacuccuuguucuucaagcucuuuaaacccucucucucuuccccaaugcccucugacccuaagguguagggguuguauuguagaugugucacuugguacugggcuccaaaacucugcauuucaauugugcuuuucuguaauggucucugcuacaaggagaacuuuuccuuuauaggggugaggacuacaggcuccuguguuuacaaggacaauuauguagaauguagaucgggaugcugcugcuuuuguaaaguagcaauugcauauuuuauucaaagauggaugacuucaguagucuugaguuggcuaggucuccaauacuaggcaugauuucccucuugcugaauggaucugaaauccaauuagaaagcuguugguuacuguaaaggucugcgugccaccacuccacauuuaugcugccauggugguuguuacugugguucagaggugucauaacugcguaggacuauugguugcuucccuccucuggagccuugcaugacuccuuuuuauaauaugaaggguaguccucaagaaggauuaggcucucaguucuguccagcucaggggcuucuugggcccugcaucucaagugcaugaugucuucagcaauaugcaguuaccucuagggggcaaccaagggcaauagcguauaagauuuugggagucucuuggauaguccugaccagcaacuccaaagacggcugcguaguuuuuuguuuguuuguuuguuuguuuuguuuuguuuuguuuuuguggauaauggcuccuggagggagccugugucuauuuauacacagucuuauguguauuauagguacaguagggcaauggcaugauugugcuugauccuugagacauccucacuguuccucuaccguccucauuccuuguccuguauuugucuuccucccuaguuagaagccccacuccauuccccuuacauuuccuuuccuuccccuuccuucucccccuuugcguucccgucgcuccccuuuugugcagaggaauuaaaccaaaagcuuguacaugcuagagaaauguuccaccacuguauaucucaagccuuuggagggauucggaaaaauucauauuauggcucagcugcccucgugaauaugugucuuuuaggcuaaaugaauauucuuacugagaauaaggccucaaaauuaugacagaaguuugucgaaagcuguauauauuaauauaacguuaggagucucauaguuagaagguaacucccuucauaaauuagguaagccauccauuuuguucauauucgucaaaugaacaaauucgaugcugagcacaagcauguauacuguauucuuuccucauucgccauuguccugcuauuacauugcugugccagugacaauacaaaagaauauucacugccugugcucucuucuuccuaaaucugaauguagcuccuaucugcuaguuguauaauuuuggcuacauuauuuaacaugcuucucggcaguuauaaaguugugguacauccuagaguugagaaauaaaagcugaugcugaguacuaggaaaauguucuugcuguuacuucucaaacacuacaacuuaaaguuggcugcauagggagaacaucuggaaggauuaggggaggggaaaauaggacaaaaauauauuuaaauuuaaaguuaaauaauaauauaauaaagaaaguuucuacuuaggucaacaagauguauuguuuucugguucugaaguuuucauuuaccuuugaaaaacuaguuagcauucugagugcuccuaaauuuguaaaucauuuugugaaaaaauugaacuaaauaaaucagagguacuauaccaacagauucauacuguuugaaggcagguuuuguaaaccugaauguucagcugggucugguggcaaaagccaguggucucucaguggaaucaugaauucaaugccugccugggacacauagcuagaauuuugucucaagggggaacaaaagcaaauguuuucuggauuauugucaaguagauagauaguaugaaaauuucuggauuuuugauugccccuauauaagugaaaagguacuaugagaggagaguuugaaauggggauguuuguguuugagagcuggucuugcuguguugucuggccagccuggaguccuguuugcagguagauaaggcuugccuugaucuuacagagacuccugcuucuguuucccucaguguuagauuaaaggugugcacuaccauacccugcuuaagcuuuguccuuauaagggcagauauaugaagugugggggcugucuuuuguuguauaaaccugugcugaaacaguaagaucugcaggcuguuaaagucaggucaacuguccuaacaaauuaugaauauuugauuuuaaacuauaacauuaauaguaauuucucauuucuugcuugauaaggccauuguaaaauuauuccuuauagggcaggagaaauuacucagcaguuaaaagcauuggcagcuccuacuaaggacccaggguuguguuccuagcauauagccaucuguaacuccauuuccaggggaucugacacaucgugaccaccacaggcaccaggugucaaugcaggcugccuauguauauauaggcaagcucgcaggcacauaaaaguagauagugucccucaccuuagaaaaaguaauacauaaguuuucuaagcuuguugacaagcuuucuuauugucuaaaaguauuuugugguugaaaaucagauuuuggcauuauucuguguguuguuuuaagacauuggcaucugucuuacuuaguuuggguuuuacugcugugaacagacaccaugaccuaggcaacucuuacaaaugcaaacauuuauuuggggcuagcuuaguuucagagguuuagcucauuaucauggugggaagcauggcagcaugcagguagacauagugcuggaagaggguucuacauccuuauucaaaggcagcagcaggagacuccuucacaggcagccaggaggagggccuuuuccauaccagguagagccugagcauaggaggccucaaaacccaccuccauagugacacacuuucucuaacaaggccccaccuccuaauaaugccacuucccaugggccaagcauauucaaaccaccacagcaucuaagauguuuuaaugcacaggcuacuacuguguaguccugagaaaugaagacaagagugucuuuauuacccugaaaaaugcugugacucucccacuuguggacacugaacauuuaagcccuuccauaauuccagcucgacuguaagguauuucuacaggauuccaauaaguuauccaagaagcacuacuagcugacaaauuagauccuacuccguacuucaagaauacuucuuauguaucuaaauuuacaaaaugaacaacaacaacaacaaaaauccacuaaaaauggauuucaccuuaaggaaccaaaccagggaaauuggaaaacuaaaagucagaaaaacuuucucucuccacaaagaaugugaauccuaggcauguauaaaaucugcauaauauauuagauuucuaauguaauuugaauguuacaaaaacaacucuuguuuaaauauaaauuuuuugauguuggguacaugucaguggugguauuuaauaagcaucuuuucucuuuuaggugauauuggcaauuauuauuauggccagggucaucccaugaagccucauagaauccggaugacucauaacuugcugcuaaauuaugguuuauaccgaaaaauggaaauauauguaaguacuaguuggcacuguguuuuuaaacugguauuugaaagcucuucuuaggcugcugugggagaugcaugugguagaugaaaagaucugaacgaacacagacaggucuugugguugugucccucagagaacgcuuaaggaauuggaguaguccucucuucccucugaucauuucaaacaccaaauauuuuugugacaauacuguuaaguugccugugcugcuagaaacaauuguccugggguuggugagaugacuuaauagguagaggugcuugccaccaacuggauggccuguuuaccuuccccagaacucucacaguagaaggagagaccuaauucccccaaauuguuuucuaauuccacgugggcaugaggacacaccuccaauaauaaguaaccacaguguaauuuuaaaaagaaauaaaagagaauugaccugaauuauugcaagaguuugguagaaaauuaaucauaaauauuuauuugguuaacauacauaugaaauguugccaaugauaacaagguaaguaaaaaaugguguaagauacacagccaccuaaaaagucuucgaaacaugggcaggagcauacauaaaaagugcaagguaggauaaggcuuaacuaacuacuccaggagaagagggcuagacaguguuauaggaagcauuucuuuaagauacagguauuuuagagaaaugggaagacuuguggaagaagucugugguaagugaagcugagcucuucagagcagaaguuagaauaaacgaaggcuaagggagaucucaagcugguguucuuagaaaccuuugaugaaagucaguggguagacagcagcgaggcuaugcugggaaagagccugaacaaacaggaguagccucgcuuggagaggggcugccggcugccugcugccugccacaaaugugugcauuugaauuagcauuguaacuugcuacucagguggaucugguucauuuagagagacugaucguggaaacuuacacauaucauuugauaauucucauuuaacaacugauacuuccaacauccugguguuuuucuuuucagaggccucauaaagccacugcugaagaaaugacuaaauaccacagcgaugaguauaucaaguuucuacgaucaauaagaccagauaauaugucugaguacaguaagcagaugcagagauguacguuauaaauaauuauuuuacuagugcugaauguaaaugaaucuuuuuaaaguuucugaucagaguugccucaauagguauuuuuccucauaauuuaaaauauuaauauaauuauuaauucagaaggucauugaaccaauauuaauguuacuuuagaaaacaaaccuauuuaaauuuguucuuuuacuuuuuauuuugcacccaugaaaaguuugggauugguagggagaucacagaguuacaagagaaaaauauauuucuuucuuuuuuuuuuuuuuuaauaauuuuuuugagacagggucugacuuuguaaccagcuguccuggagauugcuaaugcagaucaggcuggccucaaacucccagaguuccaccugcuucucucuugcauuaacaauccuccauuucaccuucuguguacuccagucacauuguucuguaauguaaagauguugccuuuuguuggcuucuuuguguuucuuuuuauucuucuacauguuuuugauuauaggugaaaguguauuguuauugguagucaauuguauuaacugguagucaaguguauuaaagaaauauugccaaguauccugaaacugugggcugcugucuuuugaagcuuaauaccggagcccauuuccucagugagagguggauuuaguucagugaugacgaaugauaaggauuucucaaguucacugaacaccauauuucccuaccguauguuaucgcauuugguugacucaagacuggaauaggacggacggaugcuauuacaucuauuguuuuuuggguuuuuuauuugggauuuacacaguaauggguagccagcccuuggguaaaugacaggauuuguuuaaaccauuauagugcuuguuuauauuaaauucuauuugagcauaaaaaacuaaaacuuuuuuuauaguaucuguaggucuguaaaaccccugcccucuugcuaacgugugaucugagaagugaagaaugacuagggaugggccacacacacuucuguuguguuuuuuccucucagcacagggagccaaccaugucaugaccaagugacaugucaucugucuuauguuccaugaaacugauucauucauggcugcuucugaagucaguguuagccacagaaaaaaaacaaaguaacuuaauauuuugauacucacuaaaacauguuucggagucagggacacugugugugagggucaguaagaugaguuagaaagggguugcagccacuuaaucuuuaacucacuaucauauuuaaagagaaaacuagauuugugccuauuuucauauaggcuuuugauuuauguuguuggugaugguggugguuggguagagugacuucacaaauuuccuaauaagauuugguaauggaauuacauagauaacaauuuaauuaucuuguaaaauaagcauuauauuauaaaauuauaacuuuuauaauacuaccuacauugaaguacuacucccugugaauuuuaaaauucauagguaauauuuuaaaauuacaaauuucacauugcuaccaugaaauauuauauuauuaccuaugauugccugaaacaaauauuuuuaauaguuuauaagaaaaagccuucaaugacuugauaauagauugacuuuaaugaaguucaccuuccacaguuaacgucggagaagauuguccgguguuugauggacucuuugaguuuugucagcucuccacgggugguucaguuggugaguauccuaaaucagucagccucaagaggaucugaagggguuagagugucuguagguuuugucuaaagcggaaguuguaaugguaguaagguuguguuggcuugauuuugcuguaucacccaggugggccuccgucucagccaccucuguggcuaccucccaaaugcuugcuuacagacaugugcuaucauuccaacuuaaugaguacccaagcugucuuguaguucacuguggggcccgggcugaccuugauauuguggaaauccuccccuggagccucucaaucauugggauuagaggcuuggaauauuaugauauugcuauucacucuucuguuaauguaacaaaaccugcgguaacuuuuaaaagaaugguuuaucuugguucacaguuugggagcuuaacuggcccuguccuuggggacugugauagcacauuaugguaugugcauuugggagaaggccaguuuaccucauggccgcugaauggagaaaagaggauuccaguaucccuuucaagcaagaucagaucuccaguaaacuaaaaucagaucuuggcucuuagagaguccacccccuuccagugguaccauacuggugacuaaauguucccugggguucuuagaaggcauuucagguucaaaguagcaaguauaauugucuuuaaaaugccaguguuuaacaguuuuuacuugaacacagucuuuaagcuugugucuuuuuacucagagaccuuuuucuccucuucuuucuuccgccauuuuuacuaagacuuugcaugugcacugugauuuaguuggguaaacuguaggaaaaugguuaucugaggaaagcuuaggcuccgaaguuauaauccuuugcuuuugaaugccaaaccuuuugugcuuacacauggcauauuuaauagggcuucgcuuauauguauuuuguguaaccugauuuuuuaaaauucugaguauuuuauaaauaacauagcauguaucuccuucuuagcuggggcugugaaauuaaaccggcaacaaacugauauggcugucaauugggcuggaggacuacaucaugccaagaagucagaagcaucaggguucugcuauguuaaugauauugugcuugccauccucgaauuacuuaaguaaguuaauucaaacugaauuuucccugugaucagaucucuuaauugaaagaaaaaaaugauuuuaaagacuaucaaauaaaugguaauagauuaaugcugagucuuccaggguuuguugugagccccugcagaagugugagaaauagaccacuacagugggagagcgagagggcagacagugccgugccugagacugccgguaaauggucucugcucauuuagguuugcagucgucuaagcugauuaaaaauggcugcuagagauccggaaaugugaaugcuaaaguaacuugaagucaagccuuugcaacuuguguuauaagaaguuugucuggccacuuaguagcguggcugaccccaguucucucauccauccucuacacagacacacagaacacauagauaauagacacacagugaugcccaacugcugaagggguuuuggaaguuauccuucacugcuuuuucagaagugugaagguccuuaggaguguggacacuugugaaacuagcuuauuuuccacuguuagcuauaaugcugcagugaguuguauuucagcuuugacugcagcuguguucugugggcuuugagagugaugcucuugccccgcauguacaucccaagaguuaacuuccugaccuuaaauaaacagcagcuaagugcugucaguguaacauaucugacucccccaaccgacagaaaccggaaaucuccuucauugacuugaagcuucuuccacuggcuucaguucuagagaucugcugcuuuuuccuucauagcuuagucuugaguaagcccaguucuguacaguucuucaccugguaaaucugaacaugauuugauugguuugguaagcagcucucuuugcucaucuaaacacauugggcauuugaucauguuugauuuugaacuuuaugaagaaguucugcuaugaugaagcccgcucgcuguuugcacuauuuuagauuuucuuaguguugcuuuucugugccuugagaacauaaaugccuggguuugaucaugccagcuuacguuguaugagcacaguuacagcaucuuuaaauaauaaacaaaauguuuuaagucagccacagugacaagauaaucauuuacuaccuuaaauggugaauuuaaauuucauuuuguauguauugguguuuugccugcgugugugucuaugcaccacaugugugcagugcccauggaggacagaagaggccgguagauccccaggaacugcuguaagagaugguugugagucaccaugugggugcuggggauuuaaccuggauucucuagaaggcagccagugcuccuaacuacuaguccaacuuuccaacaccaguagcuuuuuuuaaauacaguuuuuuucuauuugcacuuugacauagggauggaacugaugucauucuaugguggagugacuacagaagcucauuugaguaguugcugugacuggugguguacagagcaucagggaaugaugaaggcacuugugaucugucacagucaugaggucuuaguaugcuguagaugauguguaaaaugugcucaucucgcuguaaaagguguuuauggauauggacauuggacugucucagaacugucauguuauaaaauacucugaguuuuguuuuauucuuggaccauuggaaaccggggagugggguggcacaccggcaugccagaggcagguagguuugagaugagccuggaugagcagcuaucaaaauaaccacagggaaaaggaaacaaccuauaguucugcucacuccaaagcuguugaaagaauaaaaauaauaacagcacuauguugguuacaguugcccauagauuauuuuauaaugcugaaauuuuuuuaauugauuuauuuucacuuuaugucauuuguguuuuguuuacacaugugucuguguauguguuggauuaccuggaacuggaguuacagguaacugugagccugcugugugggugcuggggacugaaccugcggccucuggaagagcagccaguacugccaacuguugagccaucuccagcccucccucccucccuccauguugaguuguguuguuuguuuguuugagauaggguuccucuguguagccaugggucuccuagaauuuucucuguagaccaggcugaccucagacucaagagacccaccugccuguaccuccugauggcugugaugaaagguguaugucacuaagcccaacaauucugaaauuguguaauguagcccuuggcauacccuuuaggugugaguacauagauaaugucugcccguuuuuaaaguguaaagacaaggguagaccucagaguacaguacucgauugucuugguagcccgaggagacgugacgugcuggggucuggaugcugagacugcgggggaagaagggugagcauucgcuguaagaugaaggaccugcuuccacauuccggcuugcgcuuuccuuucagguaucaucagagagucuuauauauugacauagacauccaccauggugaugguguugaggaagcuuuuuauacaacagaucgcgugaugaccgucucauuccauaaauauggggaauacuuuccuggaacaggagacuugaggguaagacugaguucugucagaauaaauauaagaagagcauaggagguugcuaauuucuggaagagccauguugucuuagucauuuuguuuguguauuugugaugggaccucggcaucugguguguaugguuuuuuuuguuuguuuccggagauguggccucaccuuaguugagcaguuguugggaucauugcuuacuguuaggauuugucacauguggacccacugaaugcugcuuguuguucagcugugauuacuuugaauauguagaaacgagggaucagaaguggucucaacucaguuagguguaagugcugauccuaaaaaguuugcuguccucuccagguugcauagguugucuuggguagcagggguggggucacaaugggaauggacaguguucuauaggugugggguacagauuaucacacugucuugugguagguugggagaggucaggcagugucuuuaucugagaucacaggcauagagucccagggugucuuauuaggugguguugaagacugauuuugggcucccuaccugggguuguguucucaggacuccauguugccccagaguggcgcaguggauguagaagcucugaggaucccucccuaccuaugggucugggucacagggcuccucacuuugagaaugguggauaagugggcucuacuuuuacaucuuguaaaauuguuucaugccucaaacugagguuuguaagaacuuuuuaguuuauuuugugugguggggaggagcacaugugugcccuguuacaugugcaggaguccuccugccauggguggauccuggggaucaaaccguggggaucucacuuguugggcuuuaucuacccagguauuucgccagcccaaacuacagugcuuguguguuaucuaaaaacugccuuagagcuuaaaacguacuucuacaaccuagaauacccaagacacaauuuacaaaacucaugaaacucaagaagaaggaagaccaaaguguggacacuuuguuccuucuuagaagggggaauaaaauacccacggaaagaguuucagagacaaaauucagagcaaagacugaaggcauggccauccagagacugccccaccuggggauccauuccauaaacaaccaccauacccagacauuauuacauauaccaacaagauuuugcugacaggacccugauauagcugucuccugugaggcuaugccagucccuggcaaauacagaaguggaugcucacagucaucuauaggauggaacacagggcccccaauggaggagcuagagaaagcacccaaggagcugaaggggucugcaacucuauaggaggaacaacaauaugaacuaaccaguacccccagagcucgugucucuagcugcauauguagcagaagaaggccuagucggccaucacugggaggagaggcccuuggucuugggaagauuauaugccccaguacaggggaaugccagugacaggaagcaggaaaugggaguggguggguagggaagcagagggaggggggaggauauaaggaauuuuuggagaggaaacuaggaaaggggauagcauuugaaauguaaaugaagaaaacauuuaauuuuuucagaauuguguguuacuuggucuuuuaaucauuuuaaaauaugucagacuuuuuguuaugaaauagucuucuaagaucuacuuuuguguuuuaggauauuggugcuggaaagggaaaauacuaugcugucaauuuucccaugagagaugguauagaugaugaaucauauggacaaauuuuuaagccuguaaguacugcuuucagaaauaaaaugggaguuguaaauauccuuagauacuaaugugucuuauucuguggcuagaucaucucaaaagugauggagauguaccagccuagcgcgguggugcugcaguguggcgcagacucccugucuggggacaggcuugguuguuucaaucuaacugucaaagguaagcaguucacguucccccuggugugguguuucuccuccccaagaacuucccauaaaaguuuucauugcugagggcuggagagaugguuaagaacacauguuccuuuuguagaagacuuggguuggaucccagcuccuacauguuggcucaaaaucuagcacucucuucugauuugcaugcaugugguacgcaccauacauguuuaaaaacauauuuuuaauuucucauuguuaccuuuugcuugccaacucgaugccaaacucuauauuugaauuuuuaguggauuuuuauuuguuguuguuguuuguuuuuguuauguggcugacuaguuaauuuaguuccccaagucuuacauguuaucauauuuauguuuauguauuuauccaugaguaguuuguugccaugucagcgccagcaguuuuuaaucaguuuuuucagaagaccuguaccuuguugucugauucaguugcuguuacagaguaugaggauuuagcuuggcgcacuuuauucuaucaugguuacucucuuccuuacccaacccuaagaacuucggucgcuguggcuagugcucagcagcagugguuuuuagcuuagcagucuucucuacuggcaagacucacuuuuuuuucuucuggauuuuuuuguuugcuuaguuuccauauuccuuauuacuaaacuaugaauuucuaauguauucugcucagcuaucucaggugcucugucacugagcuccuccuguucggacuuaguguccucauggguuuaaugggacagagagcucucugcuucugcuuuauuaugucuccugaucagugggcacuguaucuaacuugcugguggaacacauaagugucuucaugaggaaagaagcccaaguguaaauguguaaggugguguugaaauucucaaguccuuacgaagagccgaaguccacaugcugaauacaagucucauauugcuguuaugggaugaacuucgaggguuucagaaugaagcaaaguugcauguggcagcgcaugcuuuuagacucagcauuagaacagcagagauggguccaggccagcuaaggcuuuauauauaguaaaaccuugucucauaaagaaaaagauaaauaaaauaaaucuuuuuaauaaaguuaauguuuggauuagaaaugacuuagcaugcacauugcauguuuuacuuuagacuuucugugugaacuuugagguaguaaguaacaucuugcuuugaguucucuuacagaacuuuuaagauaauuaaauauagauguuaagaacuucucaugauuguacucugcagaccagccucagcacuguggcaugcucugguacucuccuucguaucuaguugggucauacaaaauuaguuggccacucuccuggaggucagcauucaguuaacagcacuuucaugugggccauagaauguucauagauaucucguguuuccgagcagauaagacuuaaccggaagucaucagccaccagguaguuccuuucuuuuuaggagcuauauacuguuaguguucucuuuuguaacugaaaguuuauaaugcuuguauuuaaaaguaguagcuuucauuauaaacugcauuugacucuuuauaguacaucugcauuguguuucaacagguagaaguucauuugugaauuugcaauuccauuuucagacuuagaauacacugcugcgacuggcuucaacuacauugucucaggccuagugaagccaagcagccagcugcuguccaccuugccuccuuaauuauuucuucuugugguguucuuuuccgugcuuccucuuacggguuauagccuucauuguauaaaaccccuuuguaguaauuuuuccugcuguugggugguagaaugcuggucuugucugggcucuuucauuguacucugaaguuaacuucuguccuuaaaaauguccaagagacacuguuguaguagaagaugccugguugauaauguacaugaagaaaacagagaaggcacuauaaacucucacuagguaaugaggauuuuuuuuucuuuuguggcauuuucuuuuuuuccaaauauuuuaagcuuuguuauagaaaaguuacaaaaacaaacaacaaaaauaaaaucacacacugaaauuaaccagacccaaagauucaaugacuuuugugcuuagagcagccagcgucucaauaccaggugaaagcccacugcaaaaggaaaugacuuuguuuuuuaaaaaaaaaaaaaaucuuuuuuuuaauaaggcuaaaauccaugaaucucugcugucaucauugagggacuuucuuucuuuaaugguugaauuaugugccugaauggcaccagaaguuacuggaaacuuguaacuuguuccugugugaggcuuguaaucuguuuuguuuuuuuuuuguuuuuuuuuuuuuuuuuuuugguuuuucgagaaaggguuuuucuguguagccccggcuguccuggaacucacucuguagaccaggcuggccucgcacucagagauccgccugccucugcugggugcugggauuaaaggcggagguuuguaaucuuaaauaaauuaagaaaauuauccacaauaccagcaauaaggauacucuguggucaaacuuuuugguauugcuuuucgaaauuaagccacacaugucugugcgggagaaacaaaauuuagcauuuguuuauuguguucucucccuuaugugaucucucaugaacgucuucuaugguaguaaaauacaugugugcguauuuuaacacuuaguacaaguuauuaguuggauauacacccccccaggccccccacccucgucaucauccccugucauuguuccucccugccccccccaccccuacccccccccccccaccuuguguugaggugccugccuuguagucaugcuguauagacuggccucccaauucugauccacguaccuuagccucccaagagcugggauugcugguaugugccacucugccuggcugucuacagacauuuuuugguugaguaaaauuguuuguauuuauccuuuuuaagguccuauuuuaaauugcuaaagaauacauauuucauuguuacccaaaucuucuuugucuaaggucaugcuaaauguguagaaguagugaaaacuuuuaacuugccauugcugaugcucgguggaggaggcuacacaauccggaauguugcccgauguuggacauaugagacugcaguugcccuugauugugaaauucccaaugguagguguucagguugcaguaucuagaagaacaucugcuauguacaaauggaugcaugggagagucuacugccacaccccugaaaugugugaucucuucugauggaugagugguuagauugcaaaucugugugagagcauuccaugugcacuuucaagcuuuccuuugggaauaguucuuuuaucuggauucggauuauguuucugagauuauacggaagcuaagcuuuuaauguguaacuuguuuuuucauuguuuuuaauagaguugccauauaaugauuacuuugaguauuuuggaccagacuucaaacugcauauuaguccuucaaacaugacaaaccagaacacuccagaauauauggaaaagauaaaguaagaaaucacuucggcuuaaugaaacuucaggaggcuauagaaggucaaauaaaggaaguugguuuagcauauacaucagauacuuccuaaccuuaggcuauuccuguuuuuuaaucucuuauauuaauacaaauauguaaccuuuguaaauagaaacauucuuauuagaucaaaugcuuuaugucuacagaauguagaaacauugaucagaacgggcuguguccucucucccauagaccaguuguaugacauuuauaaguacaccucauugucaaauagaggugaaaagguacauguuugugugcuguggguucagucagcuaauauaugcagugaucugaugcuuagauagugucccauucagugguuaguaaaugaaagcucguucuuguuuaguuccuccuguguauaacagaaacuuuacauacaguggauuuugucuaauaaauugugucauuuagacagcguuuauuugaaaaucuacguauguuaccacaugcaccugguguucaaaugcaagcuauuccagaggaugcuguucaugaagacaguggagaugaggauggagaagacccggacaaaagaauuuccaguaagaaaacccuugcuaugucuucuugcauuuuucuuaugugucaaaauaagacuuaaaauugaagguacacagggaaugguucacagcacauguugugauuuuccuucucuccauuuuaauuacauauagauuuagcucccugaugucucaaagccugaauuaauaucaccaguuucauuuugugugacuacacagacauggcuguguccagaaaguaggcacuugauauaucuaucuaucuaucugucuuaccuaugcaaugauuguagaaccuguggcuauuaucaaauuuauaaaaucuuuuguguaucaguucgagcaucagacaaacggauagcuugcgaugaagaguuuucagauucugaggaugaaggugaaggaggucguaggaauguugcugaucauaagaaaggagcaaagaaggcuaggauugaagaagacaagaaggagacagaggacaagaagacaggucgguuuauguuuuggugaccauuucacuuucccuacuuaaggguugcacugugucucuuagcgauccugcagucacacgucucacuuuaggcagguaacuuuuccugguguaagagauaguuaguuaccgcucaugcuuacuguuuagugcuucagagcugacuuaaagguuuuacaguugugcucaaauuuucuuugugguauagaaaccuuccuuuuaauaacauaguaguaaacguuacaugucaugggaugggguuaaggggaugacaguaguuacagauguugggccucagaacauuuacuguagcuuagguggacuuagacucagugcucuucugccuuguccucuuauauacugggauugaaggcaugccaguacaccuggcuaaaauucuaaauaauuuauacugguuaaagcugacuucauguagcaaaaguuaagcuacauaguccuuugaaaaguuacuuuaagagugaagacucuuuaggaacugaagaaacuaaaacugaggaaagauaggaaggggcaguuucuggugucuuccgguauuucauucagaguguuuauuuagcaugccauuacagcaccucguuagcacucucagguuucucauugcuaugcugaacugugcagggguaaggagugggcaguagccucuuuaaacaugauaaugcugcaaguuuuaguugaccuacuagucaagugaggcugccuggcuuuacuaggccucacuauauagacauggcugcuccggcuacuuacuggguggccuuggauucacaccauuguccuuucucagaugccugggugcugggauuacagaaaugugccaccaccuccaacucaguuucuuucuauuuuaaaauaucuucugcauuuucuuuuuuuuuuccaaauaggaaagugauaaaguaaauugacucuugguauuuuagacaaaauaccacaauaaucuaugggucauaaccucaaauaagacccaccaccacccccucuuggcacugaguaaaaauuuagccagaauuauccaagacacuaaaaugugaaaucuccauugucggcauguagauuuguaugggaggugacagcagugcccugcagugucugcauugcccaagcgugcugcugucccugcaccucuccaugaggccauugcuucauaacuaauuuacacagagaaaauacucuggcuaaucugggacauuuacuuuaauuacuguauuuaaguuaugaaguucaguuuaguaguaauuaaaaauuuaagguuagaacaaugggauauugugggccagcaagguaaaggugcuugcugccaagccugauuacauaugaucugcauguuggaggaagacuccugacuucuacaagcugucuuuugaccucccuauggaagucaugguguggaugcccaaacauacacacacacucugaauaaauaaauguuaaaaacaaaaaacauaaucuagccucuugccuuuaggaucacguccuucuuacagugcagacacaguucucuugagcuccuucugucuuaccacugcuuccgugccucaguccuuuuacaguuuucccuggaagauacccuuuccucuuaccugagaguuuguucauucuuugggacccacauucuagagaacugugucugcacuguaagaaggaagugauccuaaaggcaagaagcuaaauuauuuuuuuguuuuuaacauuuauuauauauacacuauauacauacauauauauauugugugucuuauauuucaaaauagacaucaauauuuuucuucugucuuuagauguuaaggaagaagacaaauccaaggacaauaguggugagaaaacagaccccaaagggugagcgaugcuugugucuguagacgucaugcaugucuuggggguugggcgggggcaugcauacuugagaaauacuggcacagccugagaacauacaaugagugcaggucugcguguggguaacgugcuuaggcuauuugaccgguaacuuuuauguaugcaaucguguuuuucaugaugcucauauuacugugcuuagaauacuuugauguuaggagacaggcuaguuuaaggaaaaaacauugggcuaagugaaagccuauuggagaauuuuguuaucagaaugcauguauggcuagguaggugaaguguugcgguaaaucuccaacccaaauaugcccuggcaaugaaacacaacucaauuaauaugaauacaugcugugugccuagaaugggcagaucuaccgcuacacuaccaucgucaacaacugugagagcccuuagaacuugcaguuucuccaggccacgugcuucugcuccacuuuucuucuucccccuccucugcauccucacccuccccuauuuucuccucucucuccccaccuucuucuccaccuucccuuuaucugcccaaucaucagcucuccuuuauuuuacaaauuaggugggaagcagguuuaugggaaguaaaccugagugcugacucauugcuuguuuguaggcccucacuggagaaggaaguagcaucaaauauaauaaguaagccccagggcuauccacaccugugaagaggcuugagucuauaaucucaguccacuggagaggcugagcccagaggauugccaugaauuuaaauccacacuaagcuacauagugauuuuuaaaucgucacucugggcugaagaaugagagucuguguuagaagcaagcacgugugcuuggucacccaguuguuugcuaauuuugaaggauaacuuagaaugcucaguuguaaaacaacuggaaagauuaaggcuuuuauugcucagaaaaaaaagaaaaaacaacaacaacaacaacagugaauagcuuggugugaaucuauaagacugugcaaguagccaggucagugcuccuaaaccaagacuauuacuuuuaauauuucaugauccucuuucaacagagccaagucagaacaacucagcaacccuugaauuugacucuccaacuuuaggaaccucgaaaagugagacgauucugggauaagaaaccuucccuguuugaggacauuggcuucauuuuauacuguuuuggcauggacuguauuuauuuucaaaauggcuuguuuuuguuuuucuuggcaaguuuuauugugaguuuuucuaauuaugaagcaaauuuuuuuuuccaccaugcuuuaugugauuguauuuaaauugauguguuauuaugucaaaagccggaucuauuaaagaaacaauuggccuuucugagcugauuuuuccaucuuuuguaauuaucuuuauuaaaaaauuguacuuggaucguuu

SEQ ID NO: 5465 - RNA, 6184 nt, Mus musculus
uuaguaggcuugauuauaucaacugguaaaacuuuauuuacaagcaauaggaauuggaccaaaugauucuuauaauccagaguguucauaaccacagcaaaggccacugcacacacugccaauacagacuuaauaacacgauucucaacuguacaagaguuauuuauuuuccuuaaucucaaagcuauuuuuaguaguacaaaaaagccauauuaacauuuuuuuuuccauuagaaaacaacaggauguacaaaacuuuggaugaaaaguaugucaaauugcauuuagccacuuggaggaaaauccaccgcuccaucaauaccacccaaaguguuuuaggcagugauuaaaaucaaaauaaugcaucuuaauaaaucucagcuguuaaaagaacaaaccuagcaauauagaauacuuuucuacacaguauuuuuaacuacucaguucaggaguuauuuuuuuaaaacccauuucaguuaaguccuacuacauaccaggcaccauaucuggccaacuagggguucucaaacaaguugguuaaagcgggaacgacccaccacucaguccuuugguuaccagguuugacuuuaaucuuccaaaaccucaagaaacucagggucaaguuuauucuuucaaguguuacuugguuuuauuaucagggaggauauuuagaaagaaaaguauccauuaauuuugaucuauuauuucaauuagaggaacauuauugaaaggcuaaugcuguuaucucuuuuuuuaauacgauguaauauugaggugccaccagagugguucaacuuuacccugaacuccacccugcacucuacucaagaaaagagcacaacagguagacuauuuugcauuuaauaaagcaaugguaaaaaauaaaaagaauucaguuuaggguccaguaaaguaaaaauauccaguuaugagauggaaaauaagcagaaaguaaacuaguaagaguuaauauauaaaggauuaucuuuucauuugaauaaaagaugcuaacacuuugacuaaaaaacaaaaacaaaaccaagcuugcagcuaugcuaauggcccaaacugacaauaaguccauucaacaccauuacuuccuuauagaaaccuguccaugaaguauagcauaucaguucaagaacacuuuggaaacgagccaaacgcuaaggcuuauacuacauaaaccaucaacauuuaaacagguuuggccaucuuuucaugacuuaugugcagucugaacuccacauucuuccugauuauaaaauguaacuuucuggaccugcaaugacaaggaaacaguuuaugaaauagucucauaagacauuugaaagucuuagggucaagccacuuuugucuuaaaggacuuauucucgcaugcuauaacuaaaagcagguaaaugguaacaacugacacaguauaagaucuuccuacauacuuaauuugacacugauuaugaauuucugagcuugaaaacuucuuaucaaaaaccacagccaaauguacuuuugauggcaugcaaggccuuccuaaaaaauuaaucuaagaccuagaagucagccucagaacauaaaaaaacacaacaaauuuguacauuuuauucacauuuauuuuuuugcuuuuagugugcucacagaaaauuagaacaccuuaagcaggaguugaauagcaaugcuuguaagcaacguuacauuccagcucuaugucaaauuggucaaagcuccuccaguauuuacaaaacacgagagacgagaugcuacacaaaaccauugcaucugaagaucuguuucuccuuuauucucaaagacaacuggaaaggaaagcauugucugcuguaaucaaaaaacauaccacaguauaaacaguaaccauuccacguaucacagcuugguugaguuuaaaauuuuguguuuaaaagguccaagaugacugcaguuuuacaaaaaugggcaggguggagacuugcaaacuucaugugcuucugaaggauaucaagauuuguuuuuauacaauagucacaguuaaaaacacccugcugguaauacauaauuacacuuuauuaaggucauaaaccagcaauaaacaauaaagccuauacaacuuguaguucuacuuaaucacugacugguacagcuaacaugagauaagcaggaaguuccuaugguuuacaugaacuccuaagacuaugaucuuuuuuuuuuuuuuuaaaucuggguauugguguuuuuauuuuuuucucuuuccuucuuauucaaaacguguaguguuguaaaccugccucacaaaauacaucguaauaauuuuucuuuaaaaaaaaaaagaaagaaagaaagaaagaaagaaagaaagaaagaaagaaaggacaagaacccuaagccuuuacacccaccaccauuuuaguggcauauuaucuuggcaauguuaugcacugcuucaauuucccauaguggccccuaucacuucauuuguuauuccuuuugacccacccaucuccuucauauauggguaugucuauagaucugacaaagaaaguuuacacuuuuuuaauaaagaugcaaaguaugcaaaaaacauuaauacugaugccaaaaaaaaaaaaaaaaaguaaaaguaaagaaagaaggcagaggaagcugucuaacacguccucggccugucggaaugguggaaacaacuaucugagaugggaucuguggggaagggggcuuaaaaaaaacaaaaaacaaaaaauuugcugcuuaaaaaaaaugugaaauuuaaaaaaaaaucuuuaaaaucaaucccugguuguagacaaguucuccaaaaccaguaccuggcaccacuccaacaaacaaacuggggggaaaaguucuugaauugcgugagggcucuggagcuuacucggccguuggcgcggggggcgccuccggacugcacucgggcugcggcuccggcgacgcggcgggggcugcggacgccgcggccucgucgguggcagcgggcgccuccugcucaggcccugcggcggaggacgcaucgcccgcgguggcgccgggcgcgggcuccuccgccuucucccccgccgccuccgacugcuccuccgccugcggcuccuccgccgcgggcugcuccggcugcuccggcugcucgggcuccgccgccucggccucccggggcucuccgcccgccgcgcccucggcgcccgccccgccugccugcuccccgggggccgcggcccccucgccgcccgcugcggcugcagccucguccuuggcgccuuccgcggucgcucccucugcuucagcgcccucgcccgacuccuucuugcucuucuugaaggagaagccgcucagcuugaaggacuucuugaaggaaaagcgcuucuuuuuuuuuuucggggucucgcugcugggcgacggcgcggccccguccuccgccuugggcgacgacguggaggaggcggacgcgcccucggccucggcggccggggagcugggcucggcgggcucggccuccgcagccuccuugucggccgcgccggcgcccggcucgguggccgcggcagccucauccuuuucggccgcggcgggggucgcggcacugccgcucgcgggcuccuccuugucggcggccggggcgcugccguuggcuugcagcuccuccuuggcgcccggcucggcggcggcgggagacgcguccccguucacuuuuacguggccauucuccugcggggcagaaagaaaaagacgggggcgucacucggagcgaccgacccgcgcggggcaagcuuccgugcccggcggccggggaguggacacaagucgcccacauucugaggccugcaucagguucccuucccuccgccucgagcaacgggagcucccggggcugcgcguucccggguggcgccggcagggggcgcugcuccuccaccgcgcggagcgcagcggggcgcgggcgggagggcgcccaggggcggggccaccccacccugccuagccgggcccugcccgcaggccgaggcgcccccgagcuggggaucgcgcagcccgggaguccgcaaacaaagcucagguggcugccccggucggccucuccgaggcucggcaaccagcagggcuggggaaaacccauuaugucugaagucuggccuccgcuuccacgcccaccuucgcccaucauucugcaaauuggggugcgcccgggcagcuccuuuuugcauuuuuaacggguuuaaaggcucuugacagagcacgucuugccccgguagguuuagagcaggccuuuuuuuuuuuuuuuuuuuuuuuuuuuuuuuuuggcucuaggaaaagaggcguggugggugcucgcuguuuggaaagcagccacccauggccgaccucuugagcccacccaaccauggcucucugccugggucgcagcagcacugaggcaauccucgaggguggccaaggugccacucacacgaacaguccagaccaaaacaccagaacugcucccuucuuggcaggcaggaaagggucuucaaaaacccacugagaauucccaccacaccaggauaccauuugaaaagucauauggguguguaauuacacagcuaccaaagggggaggggaagggccaucgcaaaggcacuuggaaaagcugccuguccggcucuaaccagccaccuuuccaagaacccgaggcauacugccucuggauacaauaagacaagccuucucagcuugccuuucuccaccgccauccgcguuggcuccccccuuccuacacacacauacacacgcgcgcgcacacacacaaccacaccagaaaucucaaagacgacccaaucucgacaauaaauacgugagccacccaaacaccacuguggccccaaauacaaaugcaaccuggaggggcguuggggggggggugcaucuaacuagucacguucagccaaucuccaaaccacgccauuuuagacgauuuaucacucuuccuccggucuacucaagaauuggccaggauccuuaggaaccacuccuuugggguggggguggaggguacccuuccuaugaaaaauugacaauuuaggcuaucauuacccauucaacuuucagacuagaaucuggcuaggcuccccucccucgaaugcaucucgggcgcgaccagagggaagacgaggcguccagauuagagaaagacacccaagaaaugccaagaaccacagguagaauuuaccugcccauuugcuuuggaaggcgacgaggccacagccgccuccccgggccucucggcgguggcuucucccuucgcugcggucuuggagaacugggcacccaugcuggcuucuucaacaaagaaacucaacagauccaagagaggaaacaaagagccuucgguugguguaacgacggggcgagcagcagcagcagcaacagcggcggcggcacacacaccggagggaggggguggggguggcgaggaggacagaagagacccgauuaaauacuccggauaaaaaauuuuuagucgaagagaucaaaaaagcagcagcgcaggaaggagggaaaaagguggaaaagucgagcacaaaaaaggagcccaaguguaguuuuuuuaaaaaaagaaguaauaaaaaaaaaucccagauuuguagccgcacuguagacaagaggaaaauggagaaaucucccugguugcuaauaagaugcgggguccaacgcccaagugcacagaugaaugggcucgcgggcgcugacgcggcccccgcgcgcgcuggccaauccgcgcgccgcacacaaagcagggggcggggccugcgcuccgggcgaacaauggagccgcgcuuugcaaacgguuugaaaaucagccucagaccaagaauuaaugucuuccaaauaaauaaaucaauuaaaaaauacgugcuucucgucucccucggccugaaaauaauaaugcaugucuugauuggcuugcuuuguuuggaauuaauuaacgcgggaggggguacuuauggaugggggcggagaaagcuuuaacuugacucgcauugacucuugccggucuauauccgcgucugucucuagccauucucuccccucccccaucuuucccguguguuuacguguauaaguguguauacgaguguuaaagacaauggguaggauuugugugcuagcagcauuuuuucccuccgcacuccauaaggguuucaca

SEQ ID NO: 5466 - RNA, 6184 nt, Mus musculus
ugugaaacccuuauggagugcggagggaaaaaaugcugcuagcacacaaauccuacccauugucuuuaacacucguauacacacuuauacacguaaacacacgggaaagaugggggaggggagagaauggcuagagacagacgcggauauagaccggcaagagucaaugcgagucaaguuaaagcuuucuccgcccccauccauaaguacccccucccgcguuaauuaauuccaaacaaagcaagccaaucaagacaugcauuauuauuuucaggccgagggagacgagaagcacguauuuuuuaauugauuuauuuauuuggaagacauuaauucuuggucugaggcugauuuucaaaccguuugcaaagcgcggcuccauuguucgcccggagcgcaggccccgcccccugcuuugugugcggcgcgcggauuggccagcgcgcgcgggggccgcgucagcgcccgcgagcccauucaucugugcacuugggcguuggaccccgcaucuuauuagcaaccagggagauuucuccauuuuccucuugucuacagugcggcuacaaaucugggauuuuuuuuuauuacuucuuuuuuuaaaaaaacuacacuugggcuccuuuuuugugcucgacuuuuccaccuuuuucccuccuuccugcgcugcugcuuuuuugaucucuucgacuaaaaauuuuuuauccggaguauuuaaucgggucucuucuguccuccucgccacccccacccccucccuccggugugugugccgccgccgcuguugcugcugcugcugcucgccccgucguuacaccaaccgaaggcucuuuguuuccucucuuggaucuguugaguuucuuuguugaagaagccagcaugggugcccaguucuccaagaccgcagcgaagggagaagccaccgccgagaggcccggggaggcggcuguggccucgucgccuuccaaagcaaaugggcagguaaauucuaccugugguucuuggcauuucuugggugucuuucucuaaucuggacgccucgucuucccucuggucgcgcccgagaugcauucgagggaggggagccuagccagauucuagucugaaaguugaauggguaaugauagccuaaauugucaauuuuucauaggaaggguacccuccacccccaccccaaaggagugguuccuaaggauccuggccaauucuugaguagaccggaggaagagugauaaaucgucuaaaauggcgugguuuggagauuggcugaacgugacuaguuagaugcaccccccccccaacgccccuccagguugcauuuguauuuggggccacagugguguuuggguggcucacguauuuauugucgagauugggucgucuuugagauuucuggugugguugugugugugcgcgcgcguguguauguguguguaggaaggggggagccaacgcggauggcgguggagaaaggcaagcugagaaggcuugucuuauuguauccagaggcaguaugccucggguucuuggaaagguggcugguuagagccggacaggcagcuuuuccaagugccuuugcgauggcccuuccccucccccuuugguagcuguguaauuacacacccauaugacuuuucaaaugguauccugguguggugggaauucucaguggguuuuugaagacccuuuccugccugccaagaagggagcaguucugguguuuuggucuggacuguucgugugaguggcaccuuggccacccucgaggauugccucagugcugcugcgacccaggcagagagccaugguugggugggcucaagaggucggccauggguggcugcuuuccaaacagcgagcacccaccacgccucuuuuccuagagccaaaaaaaaaaaaaaaaaaaaaaaaaaaaaaaaaggccugcucuaaaccuaccggggcaagacgugcucugucaagagccuuuaaacccguuaaaaaugcaaaaaggagcugcccgggcgcaccccaauuugcagaaugaugggcgaaggugggcguggaagcggaggccagacuucagacauaauggguuuuccccagcccugcugguugccgagccucggagaggccgaccggggcagccaccugagcuuuguuugcggacucccgggcugcgcgauccccagcucgggggcgccucggccugcgggcagggcccggcuaggcagggugggguggccccgccccugggcgcccucccgcccgcgccccgcugcgcuccgcgcgguggaggagcagcgcccccugccggcgccacccgggaacgcgcagccccgggagcucccguugcucgaggcggagggaagggaaccugaugcaggccucagaaugugggcgacuuguguccacuccccggccgccgggcacggaagcuugccccgcgcgggucggucgcuccgagugacgcccccgucuuuuucuuucugccccgcaggagaauggccacguaaaagugaacggggacgcgucucccgccgccgccgagccgggcgccaaggaggagcugcaagccaacggcagcgccccggccgccgacaaggaggagcccgcgagcggcagugccgcgacccccgccgcggccgaaaaggaugaggcugccgcggccaccgagccgggcgccggcgcggccgacaaggaggcugcggaggccgagcccgccgagcccagcuccccggccgccgaggccgagggcgcguccgccuccuccacgucgucgcccaaggcggaggacggggccgcgccgucgcccagcagcgagaccccgaaaaaaaaaaagaagcgcuuuuccuucaagaaguccuucaagcugagcggcuucuccuucaagaagagcaagaaggagucgggcgagggcgcugaagcagagggagcgaccgcggaaggcgccaaggacgaggcugcagccgcagcgggcggcgagggggccgcggcccccggggagcaggcaggcggggcgggcgccgagggcgcggcgggcggagagccccgggaggccgaggcggcggagcccgagcagccggagcagccggagcagcccgcggcggaggagccgcaggcggaggagcagucggaggcggcgggggagaaggcggaggagcccgcgcccggcgccaccgcgggcgaugcguccuccgccgcagggccugagcaggaggcgcccgcugccaccgacgaggccgcggcguccgcagcccccgccgcgucgccggagccgcagcccgagugcaguccggaggcgccccccgcgccaacggccgaguaagcuccagagcccucacgcaauucaagaacuuuuccccccaguuuguuuguuggaguggugccagguacugguuuuggagaacuugucuacaaccagggauugauuuuaaagauuuuuuuuuaaauuucacauuuuuuuuaagcagcaaauuuuuuguuuuuuguuuuuuuuaagcccccuuccccacagaucccaucucagauaguuguuuccaccauuccgacaggccgaggacguguuagacagcuuccucugccuucuuucuuuacuuuuacuuuuuuuuuuuuuuuuuggcaucaguauuaauguuuuuugcauacuuugcaucuuuauuaaaaaaguguaaacuuucuuugucagaucuauagacauacccauauaugaaggagaugggugggucaaaaggaauaacaaaugaagugauaggggccacuaugggaaauugaagcagugcauaacauugccaagauaauaugccacuaaaauggugguggguguaaaggcuuaggguucuuguccuuucuuucuuucuuucuuucuuucuuucuuucuuucuuucuuuuuuuuuuuaaagaaaaauuauuacgauguauuuugugaggcagguuuacaacacuacacguuuugaauaagaaggaaagagaaaaaaauaaaaacaccaauacccagauuuaaaaaaaaaaaaaaagaucauagucuuaggaguucauguaaaccauaggaacuuccugcuuaucucauguuagcuguaccagucagugauuaaguagaacuacaaguuguauaggcuuuauuguuuauugcugguuuaugaccuuaauaaaguguaauuauguauuaccagcaggguguuuuuaacugugacuauuguauaaaaacaaaucuugauauccuucagaagcacaugaaguuugcaagucuccacccugcccauuuuuguaaaacugcagucaucuuggaccuuuuaaacacaaaauuuuaaacucaaccaagcugugauacguggaaugguuacuguuuauacugugguauguuuuuugauuacagcagacaaugcuuuccuuuccaguugucuuugagaauaaaggagaaacagaucuucagaugcaaugguuuuguguagcaucucgucucucguguuuuguaaauacuggaggagcuuugaccaauuugacauagagcuggaauguaacguugcuuacaagcauugcuauucaacuccugcuuaagguguucuaauuuucugugagcacacuaaaagcaaaaaaauaaaugugaauaaaauguacaaauuuguuguguuuuuuuauguucugaggcugacuucuaggucuuagauuaauuuuuuaggaaggccuugcaugccaucaaaaguacauuuggcugugguuuuugauaagaaguuuucaagcucagaaauucauaaucagugucaaauuaaguauguaggaagaucuuauacugugucaguuguuaccauuuaccugcuuuuaguuauagcaugcgagaauaaguccuuuaagacaaaaguggcuugacccuaagacuuucaaaugucuuaugagacuauuucauaaacuguuuccuugucauugcagguccagaaaguuacauuuuauaaucaggaagaauguggaguucagacugcacauaagucaugaaaagauggccaaaccuguuuaaauguugaugguuuauguaguauaagccuuagcguuuggcucguuuccaaaguguucuugaacugauaugcuauacuucauggacagguuucuauaaggaaguaaugguguugaauggacuuauugucaguuugggccauuagcauagcugcaagcuugguuuuguuuuuguuuuuuagucaaaguguuagcaucuuuuauucaaaugaaaagauaauccuuuauauauuaacucuuacuaguuuacuuucugcuuauuuuccaucucauaacuggauauuuuuacuuuacuggacccuaaacugaauucuuuuuauuuuuuaccauugcuuuauuaaaugcaaaauagucuaccuguugugcucuuuucuugaguagagugcaggguggaguucaggguaaaguugaaccacucugguggcaccucaauauuacaucguauuaaaaaaagagauaacagcauuagccuuucaauaauguuccucuaauugaaauaauagaucaaaauuaauggauacuuuucuuucuaaauauccucccugauaauaaaaccaaguaacacuugaaagaauaaacuugacccugaguuucuugagguuuuggaagauuaaagucaaaccugguaaccaaaggacugaguggugggucguucccgcuuuaaccaacuuguuugagaaccccuaguuggccagauauggugccugguauguaguaggacuuaacugaaauggguuuuaaaaaaauaacuccugaacugaguaguuaaaaauacuguguagaaaaguauucuauauugcuagguuuguucuuuuaacagcugagauuuauuaagaugcauuauuuugauuuuaaucacugccuaaaacacuuugggugguauugauggagcgguggauuuuccuccaaguggcuaaaugcaauuugacauacuuuucauccaaaguuuuguacauccuguuguuuucuaauggaaaaaaaaauguuaauauggcuuuuuuguacuacuaaaaauagcuuugagauuaaggaaaauaaauaacucuuguacaguugagaaucguguuauuaagucuguauuggcagugugugcaguggccuuugcugugguuaugaacacucuggauuauaagaaucauuugguccaauuccuauugcuuguaaauaaaguuuuaccaguugauauaaucaagccuacuaa

SEQ ID NO: 5467 - RNA, 2126 nt, Mus musculus
uauuguuuguuuugccaaaagagcuuuauugacaacagauuaauuaaggacaugagcggcucaagucuguugcacauauuggcagguguagaaaggaguuaaguggucuaacaggggacguggaagggguguugggauaauccacacccagcacacagguccagugucuuggcaucauuacuauaauaccagacuacuccaccauugccaaaugcaugugacaaugaccacuuagcuaucggcaugaaauuaaauaaaauaacucaugcaaacuguuggugcauagaaagcacuccaaaagugaaagagaccaccuaccccccacccccacccccacuaucucuaugucccagcucaggcuuuaucuuaucaguuuugguguuacaaacuugaaucagagcuucaggccaagaaggcucauauuuaagcuucaauucagcuuucuaucagcuggguggcccuggggaaucgcucauucuucuuccacagcaaggaaauaaaagcccuacuaugcgagaaugcugugguguuuacaaauguguggaaaguggcuggcacaugguagagaauaaacaguugcuuauguguauagcuuuagagccaacagcccauucggugaaauggggcucaugauaauguucacagaguugccuuacuguguaauuauaauucccaauaccuuaaaacuggccugagugucauuauauggcuaucuugcucaucugaucauuuuuaagcacuuuggggccuucccuccagagauaccuaaagcucugaccugaagcccauggaaauaaaggcaccuaucacuggcaguggauacuagucagcucaagggcagcccagcguaacugcagccugaguucuauggaagccuuggaaagguugcaugauucagacaaauguuguaggcaugagauugcaggccaagaggaagaggucgggcuacuaugagcugugggucgcauauucgacaggcucauacacugcaugccuuguucuggguccuucacaaagcaccucuuuagggaaaacaagauguucuuuguaaauaaaaguucaugcauuucaauaaugaagucauuuucuaguacuguagugaaagauauucucuccagcccucugggugaggacuccacagaggaagaggaguggccagugaagagccacaggcuaucccuagaaaaggagaggagaacgcauccagaaauggacaccaugccucuggcuccugaggucaucuaccucagguucccucccgccccuggaauccuuuuuccacccacuuuccuguacacuagugggggccacauacaaaucuauauaaauauagaucagacauccggcgccuuggcugcguaaauaagggauguggggaagcaaucaggaacgcugaauauucauuucgaguccuuggagagacuccaaacugcgagggggagggggagggggaggcggcgucuaggaaaggccugaccucggggucugaaagccaacuugaagugggagggccuggaaggggaagguggaaagggaguggugagaaugagugugggaaggaagccagagccgcgccgaccucagucccagccgccagggagaggagguggccaggagcgcucgccucgcucaugccagucugcuccccugccuuuugauguucacagggcgcuagcuccauccaucuguaagucccagaacccaagucucaggagcggcgggagaccggagacaaagugagagagguggauggaagcgaaagacaagcaggagagagagaagagaccacgcugacucucacucccucuucuuuaauacaacaaaguugcaacuugggcuccuggaucuaaauaccgcagguccagagaagacaaaacaccaggcaucacugcaucucuuaggggguacccaccaagaccuccagguccuucacuccaggaagggcccuguugaauaucugcagagagauggguuggagcacagcuuggugcucaguccuggcccuguggcuccucuggugugcugucugcuccaacgcagcgucaggggacggcaaugcguuuccuuuugacaucgaggggagcgcaguggucggcaggcaagacccaucggagacuagcgacuca

SEQ ID NO: 5468 - RNA, 1133 nt, Mus musculus
cuauuucuccaaagagauagccucgccuuugagagugggaggauaaaauggaaagguguuaagaauggcgauggcaaauuagggaagugaggagcaaaguagagaaguaccauugcagaaacugggaaagcuaggaccagcaaacgcacaacaaauaguaagaaauuaaugacuuguuagucucauuuucuuggguacccaaauaugcuccccgcccccccccccacaccuaccccaggaaaagugaaagagaaguaugacugaaauucaaggggccugcaacaaagagucccaaaaccacccaguagagauugcuugugcuuuucccuagcuguuuaccaguggccauugcucgucuggcuccuuggggcauucaaacuucucuugguuuucuuguuuucgcugguggcugagcugagcuuuuugcucagauuuuccuugacgaaauaauagccggguuggucugcagucuuuauuuccgauucagcuuuucuauggcaggauguaacuucauaaaaagaaacauuuugccuuccugauuuucuuuauaggcaauuccuguuuacugagaacucuguuuuaagacauguucagaaucauuuucuuuaaugauuuugguaagaaacucaucccucccccucagcaaaucuaaucuucuaagaaguaaguuuaagcgaagcagccuuggcuuccuuaggcgcucaaggucuguguuaucuuuccugcucaguacauuuccccuguaguuuaaaaauaccagucucuuuugcugacuuuuuuuucuuugucuuuuccgcagugcucuuuugagaaauuugcugcuauucaguaaaugauccucaugugauggacgaggaaacugaggacaagagaaggugacacugaggaauuccauguccgaucucuuccugaaaccuggagcagaugguacuaagucacuccauuguuaauaauuucuuugagaggagucucauuuuuggcaucugcagcauaauagcuucuucacguaauuaguggaccaauaagaggcaaaaugauuaaaugacaaauuaaccaacucccagcaagacucuguucuguuuuuuucucuuuacuuacuuuugaaaaaaauaaauaaaaacaaaaaaacagga

SEQ ID NO: 5469 - RNA, 143095 nt, Mus musculus
ugacaucaucaucauggcaacaagagcugcagccugggaccgaggagcccgugugauucccggcggcggcggccguggcggcagcagcagcgguaccacccgacccgacgaacgcgcgagggcuucucucccgcugccucucgcccggagcgucugaggaggcggcggcagcacacagccuccgcagccuccgcgcgccgccgccgcugccgcucgucccggcguccgugcgaggggcgggggggaaaagccgaaccgaggaggaaggggaggaggcgccucugcggagcccgccgccgccgcugcugccaggucgcugaguggaggggaggcgguggcgguggcggcggcggcgaacauguuuucugugcggauagugacugccgacuacuacauggccagcccgcugccggggcuggauaccugccaauccccgcucacccagcucccugucaagaaggugccggugguacgagucuucggggcgaccccggcagguaagcgggagcgggcgggagcgggagcgcgggcgccgggucgucggggcugcccucccuccgcgcacucgcgcgcacgccgccgccggcggcccucuacagggucgcugcggagucugcccuguucucggcuuugcucgccuucucucucgcgcgcgugacaggaggcgcaaaagaaaaaaaaaugugggcucgcgugagcgcugcgccccccuccgcggcagagaggcggcgggcgcccggucucuccuuugcgagcggcgagcaggcuggagccccugccucggugggucggguggcugcgccucguccccaaggacgaguucgcggguccuuagaggucgguccccggcggagaccccggccacucgcuacgugucccuagugccccguucgagaaaaggcuuugagggcagaggcgaagugucaggcguguuguccgucgcucccgguugccucuguucacccucgcucuccucugccccugccggagaugcuguggcuguagaaaguggcgcccggggccagauaauuuuucucauugaagugaccauguggcucuucugugagugcaggucgugacugcuuagaguuuaaugccucgacagggacagagcggcauccucaggugcaaugcuuucaggaaaugugcauccauggaaauaggaacuacguguuugugucgcccaacauaaaauacuacaccuaauggggguggauucguuaggaaacacagccaagcucagcagcauaggcauuuuaaaauuccucuaggcuggguugcaggguugcauuuuaaaaauagauuaaaaaaaaaaaagccauuuugaagaaauggugggggggggaaaugacaagcuauguucuggaacacucuuuggguuuauaauauaaauagguuaggggccagauauacaagguuuugcguuuuuaucuuucaguuuugcgucuuuuuacaugcuuuaaacuguuaagaugaaaugguaaagccguauucuggaagacgauucuuaccaagguauagcccuaugggguuucagacggcauuucccacuugaugcucuuugccuucgucgccauucaucuuuauuacuacagucagcuucuguggacuaccaagacaauaccauuucccaaaauacagacacucguucuaagcuacuaccuuuuaaugugaauucucuuuguuaacaaugccaaugacauaaauaaggcuggguaaaagacuccuuuuucaaguagaguuugaugcugugaaccuuggaagaucgagaaccggaaugcugguaacaguugguagaaaguauagcauuugagacguggaagacuggaaaaucagaggcauuauaauguucuggaggauagguuuucuaccuuuuuaaaugcugugcugcugucuuuguuuugauuuggaaucucaggguaauacacugccuguucuccuuucagcugcagaggaugauagugaaguugauuuucaaguuguagagcaacaugcuaauaggauauuguuguggugguccaguuuguaugguggucgaguuauagguuuuccugcuacacucacucaauagguauacgugagugauuuuaaaacuauuauguaggaaagcuuuuguuugugcgauugcaugaauuucacuugcuauuagccgauucugugaaagaguaucuuuuacaaauagacugguguagacacuuguguuucugaauguuggaaugugaacuauuucauaagaaauauuuaucucuucuucuugaauaucuuacaauaggucgccagccuccaauuaaaaagagaaacccucuguguuuuuugugguguacuuggaaauguauacuauaaaugaagaaaaaauaaguacuugugauacaggcaaaagcaaucaucacguugcuaaggaguaucauguugcuaaggaguaucagguugcuaaggaguauaagguugaagguauaauucacagguuaaagcaaaaguuucuguuucaagcaugacacauagauggauguaaaugucaguuuagaccucaguaauugguucauuaauauaugguaauagugcuugugagauaccuuggugcugaggucagaggaaaacaauaaaauaauuccuuacauaguauaaaacaaaucuuguuuccucaaugugagaaaaaaaaauugaaguccuuggcacacacuuaaagucuccaguuuuuauaaaucaagcauuuuuaaugucauagaccgccccccaguagaguuaauauuaauccagacucaaugaaaacuacccugcagaauuuucugcuuuaaauucucuucccaaagaaaacuaguccaggccauguagauuuaaaacuuggaaauaauguaauagagcggccagaauauuuuauuaaaaaucaguguuugguggguguggcgcugaaugccuaucaucugucccugguggccaaggcagguggaucucugaguucaaggcuaguccggccuacuuagcuaguucuggagacccaggacuacacagagaaacccugucuugaaaaaccaaaccaacuaaccaaacacaauuugaaugcuagaauuuuuuaaugaaaacaaauuuacuauuacaaaauucagacauauuacuaauguguaaacuauguuaauggacauuuguaacaccuguaaguccucaccuuguagguguuaacuuuggaaguccguaauucuuugauuuggagaaaagauuuuuuuuucuuaaacagaauuugcuauucaaaguagauccaauaucagcagaagaaaguuucucucaaaauggcuauuugaauuauaaauuccgagucaauuggauuacugcuguugcaggaaaaguaauuuucugcuuuaggaaacaguccaguuaacuuuuguuguccugucuuaaggacauauuuggaguaauguaaauaaaugucuuggauuuaaacaccuguguuuugaguuugugaaauuugaaaauauuuuuuuaaauagcauauucagacuugaaugugaauuuuugacugauugguuugaucauuugcuaauugaacauagugauuccuuauaaaagucacuucauuucuuucaugugagugagggaguuacguuuuagaaacccuuaguucuuuaaacucauuaauuuuuuuuuuuuuuuacaucucuuugguguguguguguguguguguauguguacacauguuuucaaacaccauggugugugugaguacauguguguuuucaagcaccaugguguguguguguguguguguguguguguaugugaguacccaagcaccucggugacauuuggaggucagagggacucguuccaccuuguggguuccuaggacccaggucaucaggccaggcagcaaguaccuuuaccagcuaagccuucucauuggcacuaaacucauuguuuuugaguugugagcauagcuagccuuuaacagcugagcaaucucuccagaucccuaaauucauuuuuuaaaaagucuuaaacauuacuuugauacauuauuugaugugucccaagcauuaucauuguagaaaaaaauuauaauaacgcucugguaauuugugggggggggggggaagcaaugugacuaaaguaugggaugaugucuuuuucauuucuaucugcauggguguggcacuacacauacaaggcugcugaggaccugacuccggugaggaacuggaugcguccagaauccacaucuccacuuuugcuucagugcuccugugcuccgugcaugcugagccuaguugagccuuucuuguucucagccccagguuaagcauaguuacccuuugaaagagauucccugcugagaugcagaggaggaguaaguaagguguucuccgucuaagucauugaaugaaguaggucaaacagacuguugagggagcugcuugcuuucaagauuacuguaaggaacuuuuacuacuacuacuacuauuauuauuuauuuauuuauuuauuuauuuauuuuuggcuuuucgagacaggauuucucuguguagcccuggcuguccuggaacucacucuguagaccaggcugacccgaacucagaaaucugccugccucugccucccaagugcugggauuaaaggcgugcaccaccacacccagcuuucugcuacuuucuuguacauuuuccuccuauuuggugaauaguuguauagauuguuguagauaguaacgugaaaucuggugaguucuuuuuuuuuuuuuuuuuuauuauucuggaauucuacaugaguuauaggugcuuacuugauugauuuauucuuauauuuuauaaaccuaacuguaaugaacuacuauaauugguagauuauuaaauauauuugaaaugaguaugaauuuguaaaccauuacgcuuaacucagauuauaaaaaauuugaaccuuguucauucuuuuagcuaaacauucaaaaauauuuuaagaucauguaagaccuauucaguuauaauuguuagagauuucuuuuggagcgcacagaucuagucaugcuaaucacaaacgaaguuguccacuuuaauuuauauuuuaaguccugaauagaaagcuuuaccaguuuuacauacuauauuuggcuaaagucagaucagcacauuaggaacaggcagggacccucuuacgucuagaacaggauggagaagcuacuauguguguaucaaccuauucucugugccuuuguuaaaucaggauuacccaccagcaacucagaaaacaggaagcaacaaauaugaaaauauaaauugaacauaaaauucuuaggcuaauacagaaauguaggauauaguuagugauggcuccaaaaggaggauuugaugagcacccugacagggaaauccagggaaggcuucaugaaggaaguauggaucaaguaaucuaaaaauuuuaagaauuaaauauuuugaauagaggaacaguuacaaaguaauuuacagaugaggaaaacuugucucugcagggaagcuuagcaguguauucugauacaccaggaacuggugcauuaaaauguucccuuuugacccauuaguucuaguuucagggauuuuaaucgaugaauagaaaccuuuuuggcaaaucugauucucuuuugaauccaucuacuuuucauuauuccaucaccauccuagugcaagcuccuagcauuuuugauagcauuuacuacaauggccuccuaaucuugauuuaaucccaaucuacucugccccugcuaaucugauuacuacacuguaaucagauuuuuuuccaaaauuuaauccugauuacaucaccuuauaugcuuuaguagcuuucaguuauauuuagaauacagacaaaauuccuugucuuaauguggugucaaccaccuguccacaaggucuugcauacuguggcccuacuuuucuguucagucauggcuugagccauguucuugccuggcucuuuguauuccggccauauuggcauuauguuagccccuucuugcuaugcuccucccacaaugaggggguuguacuugcuguucccucugaguagaagauuuucuccucuucuucuaaaacuccaguuuaucuuuccucagggaagccuucccaauccagaaguuuaaagcuccuuuguagcauugcuguaguuauuauucuguauauguuggagauuaauauuuaguuuuuccucauuguaaccuccagaaaugcuaguaaugguuuuuguuguuguuuacaauuauagaccuauacuuacuaguaugcuugaaacaugagcauucauugcaaaaacuaaucaauggaugauagucaucacagaaaauaacccauauaucuaacaaaugggaaguaauuucauaaauggagcauauuccagcaaaacauucauuccuaagucauguuuuagauuauauaacuguugugaaaguauuagcuuacaaaauaaucauuuaaaugcagaaaauuuuauugaaauaaagguugguucuauguagaaagucuucuguauuuuucagauuuuucugcagauaacauauguugacuuaauaguuuguaaaagacugcucacauguuuguuaagagaaagccaguuuucuagauguguuucagaagcauaguaagaaaaagguaugagacucauucagcucuccaaaauaaauauccacuaaagugcauaauuaauuacauuaugguguuuugaucuugauuauuaauucagaaaaugucaaaaacuuuuuuuuguaaagcaaacuagcaauuuuuagauugacauaucuauuuguuugugaaguuguuuuaauuuuaaagugugggaguaggugucugaaaaugugcuuucuuguaaugagugucagucagacgcuggggcuugugcauaccaggugaguguuccagcugaguucucacuccaggacuuaagaugguuuugacacacaauagcaaugcaacagaguaaaacucagaaaugaauucauauguguuagcaccuuaaaacaaagauacuauuuuugauuuauaguugagaaaugauuauuaaauaaugaucuuuguagauagauugcuacuauucugaacaaaaaguaaguuggcuuccagaguugucaaaaacaugugaaauaaggaacaggaucauauuuuugaugugguuuaggaaugaugaauggcuuucagaguaugaaaaaacugaagcuagauucucaauuuucuuuuuuuuuuuuuugagacaggguuucucuguguagcccuggcuguucuggaacucacucuguagaccaggcuggccucgaacucagaaauccgccugccucugccucccaagugcugggauuaaaggcgugugccaccacuguccagcuagauucugaauuuuauaacacaaauaaaacuccauuuguggaaaaaacacaagguaaaagguaaauaaaacuuguaagcucauuuguacuuuugaaaagggcccacuuucuucccaauaaauagcuccuacuaguagagaagugaacaaagacaauucaugugaaaaguguuauauguauauaauaugccuuauacaguuauaauuauagcugcagcauauuucaucaucugucauauuugcaaagcuacuuuggauaaguugagaauggugaggaaagaacggcagucucagacauuggugguaagaucauaaagccuuugggccccauguaaagcaguuuggaaagguucaaaauuggaagugcgcuuuuauuauaaaucagcaaucccaccgaaggcuuuuauacuucccauuuugcauaugugucaaaugaaauauaagauuaucuguggcagcacugugauaaaauaauaccugugcagcaguagugccaugucuuaagaggaaaagggcaaagugaaggacuggaguauguuuuauauagagauaacaguggaaugcauauguacuauugacuucagaacuagagggaaauuuggugauaguaguugccaccagagauuaaaacugcuuaaguuguagcuacaggaaugaguaaagcaaaagagaaggaacagaagccaggcgugguggcguaugccuuuaaucccagcacucgcgaggcagaggcaggcggauuucugaguucgaggccagccuggccuacaaagugagcuccaggacagccagagcuauaaagagaaacccugucucgaaaaacaaaacaaaacaaaaaaagagaaagaacaggucuuaauaauugcugugaacaguugcaaaaugauuguuacagugcuguuuaacauuuuauuuuguuagugaucuuuuaaucggagccuuuaauugauggguguagcuccuuggaggguggccauagugaauuagagaauccaaaaaggaggcuuuugggggguacuaauaaauaccaggaugaguaauguuuuuauuagauaccugaagugcguuaaagugcuucacuaauugggaugacaucagccguaagccacagcuguuucuugaggaauagagauuuuuggaguugcucugagcuuguauucagaguaccugaggagcaugccauccagugcaaggugcaucucacuggugaugacagggaagcagaaggugcuuuuggggagcuagagacagguuggggaaagaccaucucuagggccaaugcuugccgugugcauugguggaccaucuuagauggcugcaagguagcuaucuaauagaagaugugugucccuuuuuaaaaaaauuauucuugaugugaaguuugaauuuacaauuuacacauaauaugaacuuuugcauuuuauauauauguauauauauauaucacuauauauauauauauauauauauauauauaucaaagaauaucuauuguaauacucuaaaucuuaacuuaauguauauuuuccacuaaccaccaugcagauauucuguguauucuucugcuguccaaaguguuaacuaccaguaucauagugaggguggaaaaacaccauucuugacauccuuauauguguguguguguguguguguguguguguguguguguaugaaacuguguaugguaaugcaugcauauacuauauaugauacauauaaauauucacacaugaguuuuagacagacaucuucaggcuguguacacuaguugguuaguaugggucaagauaugaaaacugugaaucgugacagauuucacuacuucacauuggcccuuucucucucaaauuugaagggcuauaaugagaugcuauugaugacaauugaaagaugaaauacagaacauugggagaauuacuaauuucuuuuacauaguuugaaacugugucuagaagaggagagaauauaauuguagaauagaucugaguaggcuuugugugagugugaugauuguucuuuaagaauaaguaaaacauauaacaaagaauuuaggacaccuauaaaugaaaaucaauauucaaauuagacauaaucaaaaauguaucagacuucucagauuccuuugcuggaaugcguuuucuucuggcuuuucauucaguuaauauaaagaagaagaaaaaaagaaaaaaaagauugcaguuuaaguggguugcauuuaaauaguguugguugccaucagcuuuaguuguuucaaaggaauauuuauaaauuuaaggaguaugauaugugauaugcugugcaguguguguuacuuuguuaccuagcugcuguuuuaacacuagagugguauuaaauaagaggaaauagugugacuuaagcuacagugaacuuuggauacaauuaugaauaauuauauuaacuugcaauugccaugcaaauauaaagaauacagaaauggguauuuuagaagaucagaaagauacucacuguccaaacaugaugcagaugcauuaggagaccaaaacaaauuagaaauaaaaucagacucuuaguuacaauccuuuaaccuuugggagauuuuaaaaaacuuauuuuuuuuugaagauuuccagaugaucccauguuucuucugguucuaacagaauuuuuuuuuuuaaguauuucaaauuauuuaaaugaaaacucugguugcuuaguuaguauugugaaacuggacuguuuucugcagcagaaauuguguauguucagcagaguggcuucugaagcacaugguagucauuauccgcgggcgaugauucacacguauccucuggccaguucuauuguagcuuuaggugagagguugggaaauacuaagaauuugaagucaguuuccuuggggguaauuauugaauuuucuuuggguucagagaacauuaacuauauuaacaaauaaauguuacuucagaaaugccuugucugauauuugacaguuuguaaaaguuuucuauuuuucuuauacuucuuaccauugccaagaaaguauaacaagaauuaaaagaaauauuuuaguuugcauauacauauauuuacacuuaaaaaguaacuuauauauuaaauuagguuuguuuaagaugugaaauagauggcuuuguaaguaagaauacauguugcuaugugaaagaauguaaaguuaaaacauguuggcauacuccuaguuucucagaacaagaaaaugacuaaucuaaauuucauuucagaauaaaaaccaagacaagccacauaaaagcauccuaaaaauuaaacugucaucauauuauuuguuuuaaaacuauggaauaauauaucugaggaagauuacucucaaaauuguuuuucucaauuucaaguaaguaauuuauuuugguuaauauauugggggcaaggggggugggugauccuuggcauugaaguugguacucauccuuaaaauaacaacucagauaucacauucuuuaagccucuggcuccuucuaccacucccaaaguuuaucuccuugguuuucuuaagccugccccuuucccacacagcuauuaaaggacuuauugccuugaauauuguuuguagaaauagccauauaguacuauccucagguaacccccucacccccaaauaacuccucuguccuacuaccuuuugugcugagauacccugggcaaguuacuuuacuuuuauguaccuuaaucuccuuuucugcaaaacaaauuuuaaugauuucuaccucacaggauuaacaggggggaaaaaacccaaaaacccagcaaaugucugccauauauaguagcauaauguuacccuuuuaaauacuugucucuagaaucuucuuguuaccucauaugugcucuuuaaaauguucaaauugaagugaacuggaaaauguacuuguguagcguuucuguauuccucacauuacuguaagaucccuugcacacuguggguauggucuuuguauugaucagugacucaugucuauagaugagauuauuaccuauuuaaaacaccucuuaaaaguuggccaauuuuuauaaucaccuauccaggcauaacuuaaaaagaccaaaaacuuguuuuauguagggcagggaaauaaauguccaugucugaucuuuccuugaaagggggcagugguaaaccauuagggaguaacuguaguuucucagugcuacagguuaggcuaacuguauuucuuugaaggagccuuauuuuccaaagccauuaguaaugcuuuaaaaaauacauaaauuaugguagaacauauuaaaaucaugugccaaugucaaaauaaaggugacuuaucaaagggauuuauugcuuugauuguuuuugccuuuuaugaauuuauaguacacauauaaaaaaaugaagccucugguuuuaaaaccuauuuaagauugaggaauauaggccaagugauucauuauucgcuaauauuucaauugucuucagcguauauuugugaauauauuucuaaguguuccccccgccacaaaaucagaaaaaucauauuuugguugauuacacuuaagguuuuuaaaauagaaaacauguuaguuaauuguuuuaauauuauuuuuaguaacaaauuuugcgcuucuuauugaucuuuacuauaugccauuuuccaaguaauuuagucuuuauauuuguaaaaacaaguacugcuuucccacuuuacacuggaggaaaugagacgugaggaggcuaauugacuuccaucugagaguggagcauguuugccucauagcaagugagggcacgugagagaauggugcuaaccuguuacucacuagacaaagcaaguacaaaagcaagauaaagaguuuucagaauacaguaauaguuacuauugguaucugacagugacugugcgcauguucuuagucacauuaacaguacacuuggucucccuauugaucuguuuucuucuaaacaauauucaguccaugaucauuuagacugaaguacuuuauguaaauguuucuauaaggaaauuggacuuuacaguuaaucaaauagaaaauacuuuuguaaguuuaguauaauuaagcaaguaguaugugaaucuauagucagaccuucauauguggauucauccagccugagaaaguauuuguggggaaaaacaauugcacccaugcuguaugugugcaugcgugugugcagaccuuuuuuuuuuuuauuguuauuucuuaaauaauugaagguagcagauguuuacuuagaauuuauauuguauuugguacuuuaaguaauccagagguuauuuacaaugcaggggaugcuguagauaggccauuuacaagugccacuccucuuuacauaaguacuugaauaucugagguagaagaguaggaacucuggaaccaguccuccacagacagugggauuuggggagcuaaaaaaccagaaaaaguaaaguggaauuuuauuugaucagaaaucuuauuuucauaccuacuuuuacuaacuuuugcuguacaacaauccccccugaaacuugucaagaaauagcugcauuaaucuaugauucugggcaucuauuaguuaaaacaucucuguuacugcuucucuaugggcuugcuuauaugucugccaucaguggauaggucaagugguuagucaaaaauauuuauuugcuguggaauuuaguacuggauguuggcugggugcuagagaaccauguguuucuaggaagauagccgugacucuucaccugaaguuagcaccagaguuuacaggagcaacaaguaaaagcaagucccauacuguuuuuuguuuguuuguuugauaguccaaaacaaaucacaggguuugucuuuagggguuuccuaaggauguauggcuaauuaggugucauuauuauaaucacuuauacuguugcuggcugacucauuuucccaaaguaugcuaacaguaugauauuaccaccuuuuuaaacuaaguaguacuuuuacaauuuuuuaauaauaacauuaggguuuaaacccuaugugauagacaacauguuuuaucacugagcuauacucucagcuggagguguuuaaguaauauauuugauaguucaugucauucuuuguguuaaucacuuuuguucuauucuucugcgucucauucacaaauacaucauguacuaacuguacagaaaguauuauuagauaggcaauagguggaguaagaaagacuacucuagucauuuaaguuucuuaaaguuaccugucugcuuucagagaccugagaaagcagacacuuacuaauucuaaaaaaugacccuagaccauauauuaucuugugugccacauuuuaaaaaaauguuuuaucaggcauucuuaaauuauaaaaauuauaauauagagguuauuuaaucuguacugcuacuagaaaugagaccauauacugaggauuauguucucaaguguuuuaucauaaaucugauggguggaaguauggaucuuaauacaauguacaucucuccuccuccuccucuuccuccucuuuuuucuucuucaguauguguuugacuuagucuuuuacugcuguuuacagacaccaugaccacggcaacucuuauaagacaacauuuaauuggggcuggcuuacagguucagagguucaguccauuaucaagguaggagcauggcaguauccagacaggcauggcccaggaggggcugagaguucuaugccuucaucugaaggcugcuaggagacuggcuucuaggcagcuagaaugagggucuuaagcccaugccuacagugacauaccuucuccaacaaggccacaucuccuaauagugccacucccugggccaaguauauucaaauuauaauaguguuuaugcccaugcauguuucacaguaugcaugauauagguuggaggacagacaacuuuguggagucaggucuucucuuucauuuuuuauguggguucccaggauccaacuugagcaccaggcuuguauagcaaguaccuuuaccugcugaucuaucugucucuggauuccuguauuuuuuuuuuuuuauuauaguaauauugucuucccauuuguuugagagucauacaagcauguuuagacaaaguguuucauguagcacaggcuguccuggcauucacuauuuagugacucugaacuugacuggccugccccugccuccuaagugcuggaauuauggccauucaccauuagaccugguuuaugugguacugggggucagaccuggagcuuguuaagcgcuuugccaacugagcuauguccuugguccauauaguuuuuguuguuguuguuuuuuaaauauacuauuucucuuuugcucauuuucuuguuuuccaacaagaagucuugguucugagauguucuuuacauauuaagaaaauuggcuuguaucuauuaguuguucuuacagcaaaugcucuuuauuuaaauaguaauuuuaaaaauuuuauaaauuuguguguguguguguguguguguguguguguguuaaaugaaccuuuucaaacacauuuugaugaugcuauaccugaauacuuggaacagaaaugaaaaauaaauaaauaaauaaauaaauaaagauccagcaugggcauuucuuauuuggagaguucaucuuuaaaaguaugugauuuaaaaauuucaaaaauaaccuguccuuuuuuuucccucuucuagauuuguuuuuauuuugagacuguucuuuugauauuacagucaagaaauagggacaucuucuaaaggacuauuuuuagauaaucagauuauauagcauagauagaaaauacuuaaugucaauuugaauaauuguucagaguauuauuuugagucuugccuauuuuacauuguauauauagaugugauuuuuaacacaaaaauacacaaaaucaguacaaaauauuucuucggucacuuggcccuuccccaacacuagacaacacuagagugacuugauuguuagucucccacugaucacauaauaaaaaagauaaauaaaaaaguggccauuuugggaaaaauaauaauggucccacuaucaaauaauaauguacaaauuauguaagauuucagggagccauggaaugcagacaugucugucuccuauguagcaucuggaaugaagcauuugacucuccuggacucgauauaagagggaauucaaagcuguaaaaguagacagauuaucauguuuucuguaaauuaauguaguuuuaaauauacuuaaggcgggcuagugguggcgcacaccuuuaaucccagcacuugggaggcagaggcagguggauuucugaguucgaggccagccuggucuacagagugaguuccaggacagccagggcuacauagagaaacacugucucgaaaaagcaagcaaacaaacaaacaaacaaacaagccaacaaccaaccauacuuaagguugccagaucuuuuuuccauaguuaauuuuacucagcaguauaauaaagaaucaaaaccaaauaguaauucuuaagugacaugggagaacaugguugaaaaccaguauuuuauauuuuacaugguuuuuaacuuuucaaauuacugguuucuuuuagaauuuauuaugucaccaauuuauaugcacugcauuauaaguaauuucucacuuauuugauacagauuauugacagauaguucuuugauuauuccuuuaaacauuaaaaaaaaaaaaaacauuucaagccgggcaugguggcgcacgccuuuaaucccagcacucgggaggcagaggcaggcggauuucuugaguucgaggccagucugaucuacaaagugaguuccaggacagccagagcuauacagagaaacccugucucgaaaaacaaacaaacaaacaaacaaacaaacaaacaacaacaaaaauucagagguugcaggguagcucacaguguguucuuuugcuacaaugauuuuccuuuccaaaaaagcugauauuaaaccgaugccauaucuuagaauguacaacuacauagggaaauaugacauuuaaaaaauuuuuuuuuguuuuuuuuuuuaaagauuuauuuauuauuuauuauauguaaguacauuguagcugucuucagacacuccagaagagggugucagaucuuguuauggaugguugugagccaccaugugguugcugggauuugaacucuggaccuucggaagagcagucgggugcuauuaacugcugagccaucucaccagcccaaauuuuguuuuuaaauguuguauauucuauuuauuuuugucucgucuguugugaacaguuuauuuuccauuucuguuuuuguuuuacuuuguacuacuaauuuuucuguguaugcuauuuggcacgcgugcgcacuugcacacacacacacacacacacacacacagcuucuugacugauaggacuuuuauagcaguucuuuaaacuguuuauaaugaagaaacuuuuuuuccugguacucgaaacuacaauaagaugaauuacuagaaaaaaaucaagcugcauuauaaaaaucauuauauaacagugauagaauugcugucauauuguuauaaaguucuaagugcuaauuuuaggguuuuauaucugcuuucuuguagaucuguagcaaguuuacuuggaugacauuauagauaucucuguaguaauccgaagggauucuuuacuugauucccucuugaaucauauuucuuguccugugucauuauuucuguuucuuuuuaaacaugauugcuucuaugauaccuaauguaaauuauggccuguucuguauuuuaauucucuuaugucacuuuguguuuaaaaaacccgugugaacccaucgcuuuguuguuuuauccuuuucauuuuauacauuuaguguuauaugaugagagagguuagcacuccucuugacagggauaaaagacgcucuugggccuaacaacacgcauauaguuaaggcauugcuaccuaugucauaauuuuauacauuuaacauaaccuuguuuuccucucuuaguuuuggcuuuacaguguaaaaugucucauauauuuuuuaucuuagcauaaauacaauccagguggugauggcacccaccucuaaucucagcacuugggaggcagaggcaggcagaucuuugaaaaacaaaaacaacaacaacaaaaagaaagcauaaguacagaggaaaaagcauauauacugaaauacaguugaaauuauaaaauuuaagaacaaaguaaaauauuuucucuuauguaauacagauuuguaucccucauucagaauacaugugaucacaaauguuucagauuuuguguguuugcuuguagauaaugaaauaucuuaaggacaggcccuaugaaauucauucauguuucauacacacauaaaucacagcugacagugcgacuccaucacuguaggaugaguguaggauccugugccaaugcucaagacugccuggguuuguagagccuugcagguuucagauuucacaguggagagacugaacguguacaaacaauggcagguuuugguacucccagcuuuguaagacuucuguaaguauucaguguucuaaacuauacaugaucucuuaaaaauuaguuuuuguuuguuuguuuguuuuuguuuuuuuguuuuuuuugguuguuuucgagacaggguuucucuguguaggccuggcuguccuggaacuuacuuuguagaccaggcuggccucgaacucagaaauucgccugccucugccucccgagugcugggauuaaaggugugggccaccaccaccuggccaaaaaaauuagcuuuuuuaguggacacaaauuccuuaaaucugccuuagauccaagaauuuuugagcaacacaaauugacuuugacaggggaaaaggaggacauaaaguuggagggggugugggucugggaauaaucaguggaggaaugcagaugaucaaauaagugcagaacucucagauacguuuuuaaaaaaaagauuauuuuuauuauuaaauaacaacaaagauagcuuauauauugaauuaaaguagcuuggguuccacugaacauagugcuuugcccuagagcaccacagauugaguugcugucucgguuuguuugugguagcaaguuguccaggcugcgggacuggccuugagccugaggaauugccggcguuucaguuagcucuuccugccuggugauacacaguuacaacugugcuuuaauacucccagcaugggcuccaauuuuauuaccuuaguuucuccaaauaauguuuucagauacuguuuuggggugauugugcauguagaaugguuuuucugaacccuagauuaucugacaaugacuuguugcguguacacguuacugacuggcaugguugaggauggucagcuaaaguauaccuuagugugccuguguccuagagguuuuuuuuuuuuuucacaauucucuugaauauuuuucugauaucuuuacuuuuuuuaaaaaaguuuugugugugugugugugugugugugugugugagagagagagagagagagagagaggggagagagaaugaauaugagugaaugaauaagugugcaggucagaggaugacuuggggaguccuggggauugaacugagauugucaguauuggcagcuaucucucacugggcugaagaaacuccuuuugauacaaagaugcaggucguuuuuaguuuuggauucuuuuauuauauuuuugugauauuuauuccuuuuauuccuuuuuaugauaauuuuaauauaaaaauaaauaguaaggaguuuuaaaaguacuuuguuacuuguggauugaauaauauuucuuucccuuuuaaaacauauuguacccauuuucacugucuccuuuuuuauuuuuaauuaauuaguuauuuuuugagacaagauuuccgcguagcccuaguuguccuggccucaaugucuuauuuuuaagcauucaucuuuuuagguuuaaaauuuuuuuauuauauuuaucuauuuagugugcaugagugcaaaugugcugggacacacauagaagucagaccucagcuugcuggaguugguuuucuuccauagugugggccaucucuugaguuccauuuuaacucuguuaguuuuugauuucugcauaguugauaagcacuuuuauuguuuacuacauuacugauuuaguuuucaacaaaaucaaaucuguucuuuuucauucccagcauaguuuuucuuuuuuuuuuucucuuucauaguauuuuguuuuuauaucuuaguucuacauaugucuauugucuuguuucuucuuggccuuuucaguuuauuugcuuuccucaugacagauauuucacagaagucuuacuuugugugugugugucuauguguaucaugcuuguguguauaugugcauauauacaugcauauauuugugugugcaugugaaggccagagaagaacauuggguggcuucauugcuucucuuucuguuugagacaggccucugagggucugccugucccugccuccucucucuugcagcacaggguuauacaugcauacagccauggcuggcuucuuaaguggcuuuggggaucugagauaaguucuuugugcucaugcagcaggcacuuacacacugagccaccuccagcccagugggauugugaauauaggcaggcucauucuucagucuguucguucguucguuuguucauucguuccuccccuccgcuccccucccccccuccgcuccccuccccuccccuuccuuccuuccuguccuaaaucauuuauuggauaugaauuuuacaaacaccauauguauuagcgguaaugguggagcuggagaauauugcaccuucuccagguugcgggaaccaccaauagugugguggaacuuguggcccuuuccaaggccacggaucuuucagccagcagaugccagcccacgcaucugucugugcuuguggacugguuuggugauccacugggugccaagauuucuucugauagcuuuacggaacggaucaaugaagauaaccuccaaaaauuuauauguggaauuuucaccaauccaguaggaauucaggacucucaaagucccacaauggcccccagcucucuccucagcaacagacugaaggcuucgggcaaauuucagcugguaaacaccaugguggacaggcuugccguaaguugcacccuuaggaacucggcguuugcgaccaccacgauggacacgaagccuguaaaugacauagccuuacuuagccuuguaccccagucuuugagcuuuaucagaccggguggggcggggagcccugugcagcgcagagagcuggcgguauugacagcaguggacccucagaagaaaucgcaucaccucggacugcuucucccuccauagcuccuggauguauuuguaugcacccaucuugguucaccugauggcugccgccagaggaaaggaagaaggcuuucucccacaaucccuuuugucucuuuucuuuuaaugguaaaucaccacaauucuaugugugggguccggggcgguacagaugugcgcacagugagcaugcacgggcaugcauauguuuauuuguauagcuaaaggccagaagucaaugucaaguguuccuuaggaaaacuguccaccuugguauuggggcuggaggcauggucucucauucagaccuguggcuugcugguuaggcuaucaucauaaaaggucaucauaauggcuggucauugagucaaaaggauccucuuuucuccaccugccaaaaagugggcagguaccaccaugcuuggcuuuguauauagguucugaaaauuguacucagguccuuuguguggcacacagcuuaugaacuaagcuaucucauuaguccaucugagauucuuuggcaauuuuauaaagauaauuuuauuggacugggaagaaacuugccaucaaaccugaauaccucuuaaguuugaucccugagaccuacaugguggaaagaacuaacucccacagguuaucuucuuaccgucacaugugucuuuacuuguaugugugagcacacgcaguaacaguuuuaaaaaucgaucuaugcugcugauuauuuguacaaguuccauuccauauggauccaucuaugacuuaguuuuuaacuuuucauuacgugugcacacaagugcaugugugaguuccggugcauuaggucccuugaagcuggaguugcaggucuuuugagcuuuugaugugcugagaauuuggaucuucucugugaaaguaauaugcacuuuuaauuacugagccuucuuucuagccccucauaaauauuuuaaugaaaauuugguagaagaguuauuuuauauucccuucauuauaaaaagcauauuuucucccuguguuuuuauacaccagcuguuggaaugugaaugccucauuuaguugucaguguucugccugauugucuugggaaggucuugcuauguauuucagacuggccuuaaacuuuugaucuugucuagucuucaggguccugagguuauaggugcugucugagucuaggguuacuauugccuuaauggaacaccauggcagaaagcaaguuggagaggaaaggguuuauuuggcuuauacuuccacacuguagaccaucauucaaagaagacaggucaggaacucauagagggcaggaaccuagaggcaggagcugaugcagaggcuauggagguguguuguuuacuggcuugcucaucauggcuugcugagccugcuuucuuauagaaccacaguuggcugggcccuccccaucagucacuaauuaggaaaaugcccacagccucaucuuaugguggcauuuuccuaauugaggauccuucuucccagaugacuucagauugugucauguuuacauaaaacuagccagcacaaguauacaccacugugccuggcuuuuacuuucuuuuaguacagaaauaaguuuaugauguguuaaaagcaauagcaguuuugaugaaugaaauauaucaauagauguuuggcuugguuuuauucuacauugauuucuauuuguuucuuguaaagauaggaccaauauuagccuuucuucucuuaagaucccuguggcuuuagguuaacuugguagcuuuauucaacugggauggugguaagguaaaaugucaguuauauauccaagcgccauugguuuugguaaaaaugauucauauuuaguaaauuauauaaaaauggggaagguuguagaugaacucuaauucuggggaauggaguucuagcuuugggccuuccuggguguggcagcuccuauaauugaaggagccucuugcugaagcuuuggcagcuauuucuguuugcucuuuggcucuccaaaccugaauugcuaaugcaucaauccuuggacucucaucuuuguacacuuggauugucuccugaggaggcaaaggaaaauaguuccugaguagcuuugaggacuacuaaaaaacauaaugcuggcaugcuguuucauguucuacaucuuaucaagaaguauaaguaauaucuguuggguucugucugaauguucaauuggagcuaaaggggcugguuacaucuguuuaucauguuguuauuuguuuuaauguuugauuguagaaugaauauggauuuguuauuuauuuuccauaagaauuuaaauuuauaaauugugcacaugcauccaaacauuucuccaaaauggauguaccuacugacaauguauaugauucaugcuccagcauuuaugauugucagacguuagguuuuaaguuaguuuuucuuuaaacguuuuaauuacuaaugaguguaugugacugugugagcauaugucauguguauacagaugucugcagaggcauuggucaugagauuccuguaugucuacugaauaaagaggaauugauugaggcuaaauauuaaucugcagugcucuaaaaucucuugagcaugauuuagguacucaaaaaguuuaagauuuucuauuuccuguuaaggaaugaguguucaacuuguauauaauguuauagcaaaaaaaaaaaaucuaaugugcuaaauguucagauguauuaaaugauuuuuauaguaccauuugugcagucaucaaaagauuuaagaaucaaaggaaggggggcuggaaagauggcucagcgguuaagagcaccgacuacucuuccagaggucuugaguucaauucccagcagccacauaauggcucacaaccaucugaagagagugacauuguacucucuucauacauacauaaaauaaauaaaauaaauaaauuaauuuaaagaaaccaaaggaggaaauuuuuuccaugacuaugugaagaagcagcuucaauaauuuguguaguaugauccuuuuguuuaaaaauguauauauugaaaacauacagacaaacauaauaaaagcacgaaaaggugggugaugugucuacuuuugugcuguugauuauuuguaaaauaaaagcaacaucuuaugauuaaagaaaauauuaauugggcuggagagggcucaguugaguaaauggugauuucugucaagccugacaaccugaguuugauccauagaaucugccugguggaaauagggaaucugcucucaccaguagucuucugaccucuagguaugaggcagucacacacacacacacacacacacacacacacacacacacacacacacacacacacagaguacaugugacaaacaauguauaaaaacacuaauccuaaaacauaaucugacagucuucuccagccugagaccaucaccaacuuccuguauucuaaagauauuucccaaacuguaguuccugaacaaaauugucuugacauuacaauguucucauuaauacaaauuaauucugaggcuggagaggcggcucagugguuaagaacacuuguugcucuugagaggaccuggguucaagucucagcacccacaugauagcucauaaccauauaguucuaggaaaucugauguccuuuucuggcuuccgugggcaccaagcacacaugugcacagacguacaugcagguaaaacauuuauacaccugugaaauuuuauauauauaaugauacauauauguguauauauaauauauguguauauauauuauauauaauacauauauauaacaucucgcuucuaucuaccaguuauaggaaauaaaaaucucuaggaauguccuaggagugaguacuaaccaguaccacugguauucuuacauauuuuaagguucucaaacuauuuuguauucauaagaguguggguaacgccgggcgugguggcauaugccuuuaaucccagcacuugggaggcagaggcaaucgaauuucugaguucgaggccagccuggucuacagagcgaguuccacaacagccagggcuacacagagaaacccugucucgaaaaaacaaacaaacaaagagacaaacagacuguggguaacagguuuucaugcuguggcacugagcuguugauucagcuaccacugguucuugcugacuuuuuuuaguucuaaauugcuuguucuuccuucaggugaauaucuccaggcuuuguauaugcccaggguuuaaggaacacagaccuuggcuguuuuaagugugcagacuaucuaccaaugucacuccucaaauagauuugaaugaguaaaugcuguuuuuauauuugguauaacugcucauguggaucuucauacagaacagucuugagacauuacauuuguugugaagccuugcuucagucacuuuggcuuuugugccaucauuguguuuuauacuuguuagagcaaacaagugauuugagaguuaugauaacauauuaucuugacuugagaguuuuuguuugucuucucuauuacaguaugagcucuugagaauagaacaguaugcucugcaucucuguguccucaguguacagugccuagacaugccacaauuaggaaagaagucuuguggaggaaaaacacugcaugauucacuuaugaaauaauuagaauaaucaguuccauaaaauaggacgguaguuaacagaggcugggaggaggaaauggaaccuucuuguucaauaaguacagucuuaguguggggugacagaaaaguuuggaaggugguuagugaucaugguugaacaacaggguuguugaauuguguaccccaagaagguuaaaaugauaaauguuguguuguauguuuuacuuuuuguguauauauaugaauauugugcaugacauauguguauuugugugugauacaugugcguauguguaugugugaggguagagguuacaggaagacaugcuggcagacagcaagcccuaguaauuggccccucacugugcuggacuucuaggaguuugugaucucacuuagcuguaagcauucuuaccugcugagccaucucuccagcccuggcagguuucuuucuuuacuuacuuauuuauuuuuccagauauuuguggguguacaugucccauagcaagaacauagagguccgaagacaauguuuggagauuggucuaugcuucagccgugugggucuuagagauuagauuuggguccauugggcagcucucuggccccugacaauuguuuuaaaaacuaaaauuuauaaagauaaggauuuuggucuauuucauucacuuuuauucuccacaguuuguaaugcuuguuccuuuagauuuauuguugaaauuauguuuaaauauuuuuaaaauguuuagucuuugaaaacuuaauacguguguacacuguaucuugaucauauccaccuuccacucccucucaaauuauguuuuccuuugauauaauacuugaucauagagaaauauuuguaauuaaacuggauucagagagcaagcucaucacaaauaacauuuaaaaaacaaaauuuauaaaauagaaaacgucacauauaaaauauucuugugauuuuuuuuuuuaguaguaaauaaaauuaaugauugaagugguugucauuugcugaugagacuaccaguugauagcuaauauugugguaguucuaaaccauauauggauaauaguuuuuaguuuuauacauacauauuauaaagcuuaauuuuuaaaucuuacaauaaauuaauaaaagaaaaauuaguagcauuauaauaaaagguacaugaauguagucuuguguuucaauauuuaauuguacuuuaucccuuucacuuaaaggaagagagcuuuuugcagauucucuuuggcaugucugaaauacuaggaucacuauuagcuuguguuugggggucauaaggaaagcugcaguuacuugaacacaaacaagcauuacgauacugugacagaaucuaagacagcuacuaagugacuaaugcauggguagaacauaccauguuuuugucuaggaguggcgccuagacaaaagaaggacuccuaggcauagugggucaaagcauguauaagguuucaucaugcuauaaagaauggaugcagcuuauguguugugggucuguagagguggcugagcaauuaagaguacuuuagaggauccaguauaguucccaucacucuaauggcagcucacaaccaucuauaacucccaauucuaggagacacagcauccuuuuuagacaucuauggguaccagguacauguaaauauauuaaggcuguauauucacacacuaaaauuguguguguguguguguguguauuauauaauacauuuauuauacauaugcauguauauguauauguguguguguauguuugaauuuccacuuaacuguauuccaaucauauaguguauagcuacagauaaaaagagauuaucauuauguaucaguauggaggacaacccucaaauuuguaaguggucuggacgucgauuaugugggucucagggacugaauucaguucauuagguuugguaccaagugcuuuuauucaccgaauccucucucugcuuccugacaacuuggaucuugguccauuguuaaaacaaauugaugugcauguauaccugugcauauuugaauuucuaaugcaaauaaguucuaaugaguucuucaagacuuauuuauaaaagaauuucuaugggauaguuuuuaauuuuucauauauucucaauuauuuaaaacuuugaaacuuuaaguauguuuugaucauauucuuuccuuccuucaagucuuccagauccuuguccccuucuuccccacccaacuuuaaguuauuucucaaaaaacagacuuaguugggguuuuacggcugugaacagacaccgugacugagguaacucuuacaagaucaacauuuaauuggggcuagcuuacaggaucagagauucaguccaguaucaaggcaggaacacccaggcaggcauagugcaggaggagcugagaguucuacaucuucaucugaaggcuguuagcagaauacuggcuuccaggcagcuaggaugacagucuuaagcccaugccuucagugauacaccuacuccaacugggccacaccuucuaauaguaccacuuccugggcugaguguauacauucaucacaacagauaaaaccccaauacaauaauccgcccccaaaccaagacaacaaaauaaagccacucccaaaaugaguaacaaacaaaucccccaaacaaaauaacaaaacaccccacaccagacugcaagcaaauaaaaguguacauacacacaaccccaaaaaaccuggaguccauuauacauuggccuguucaggagugguuuauauacccagugucacucuauuggaguaaacuaauguuuccccacccaucagguggaagggacaguuuaguuguuaaccuuuacguuaguaguuagguuuucauucauucauucauucaaaauauauaacauuaucaaagauaaaaugauaaaagccaucacauugaaguugaacaagacaaaccagcaggaaaagagcccaagagacagcacaagaaagagaccugcuuguucacauacucaggaacccauagacacuaaacuggaagcccuguacuugcggcuuaaggcucuccaggaaacuuaaacaguagauuuagacccuuuucgccuagaauucuaaugcaguagaauggaauggugcucggaaauacguuggugcuucugagaaccuaccauaaaaaaguuauuugagcugggcaguaguggcacacgccuuuuauccuagccuucaggagacagagacaggccuaacugaguuggaggccagccagggcuacacagagaaauccugacuugaaaaucaaaaaaagaaaaagaauguuacuuuguagacacuauugauacuuuggucuuaaacgcguucucacgaccggccaggaagaacacaacaaaccagaaucuucugcggcaaaacuuuauugcuuacaucuucaggagcaggagcgcaagccccaagccccaaaaacgaaagagccccccgcuuacaucuuuaggagccagagcgccagcgcgccagagcgccagagugcagagcaagagcucuauuguuuacaucuuuaggagcaagcgagcaagagccagagccagagagcaaaagcgcaagagcgcaagcaagagagagaauggcggaaaccccguccccuuuaaggagaauuauccuucgccuaggacauaucacucccugauuggcugcagcccauggccgaguugacgucacgggaaaggcagaguacauguaguggaaaaauacccuuggcacaugcgcagauuauuuguuuaccacuuagaacacaggaugucagcgccaucuugugacggcgaaugugggggcggcucccaacaucucccccuuuccuuuuaauaagagcaauaggccacccauauuaaugagaguggagauagaggucaaauccccagugugcagguaaaggagccauguacaggauuagcucuuaggcucacaggcuuuuacccagagcaacccugaccugcucccgugucguuuugucuggagagaaggacacuuggacacucaaccuucuugaaagaugacaugucucccuagaauaggcucauauaugccgcagagcccuucuacugcaguguuuagccgugcaacucucucgggcugcugaagcacacucacucuaucccgugcaaugagacuagccucgugggaugcaagagcugaguggccagugaccuauugccuaagcauagauauaucaggggaagcaccauguucuagagcugcaagugccugggcaauaaccaccuugucucuccuaguuugggccuuaagcuuacagaccaaccaaagaagcaacacuaauccacagcaaaguguaucuccaaauaauaucaaucccacccauucuuuaaagaagggaaaugcugaggagauccaauuggguaauccuuuggucagggacagguccaagcgcguggaguugaccugaagucucaauucccgaaggaucuguucaaauucagccguccaauucuguaacauauacugaaaaagacuuuuugacaaauuagcugcccuaguaaauuuaucauacugaauggaaguaacacacaaucccggaaacuuuuguucacaucccagcugagcuauuugccauaauacaucuaguuguuucuggacaagaucuaugaguugauuaaccagcaugagaccacccuguaucuugacauuagcugaggccuguuuaucuaugacuguagucacugaggcugacaaaguguuaauggugucagucgucuggaccuguccagacagagccaaggcugucugaauuaaggccaaacccaguuccuaguuagugguaaaaaagcaggggaauacuugagcauuauacaucaccgucauugggaguggaaaugucgacauuaucccccaacgcugcucucucuuuauuauugacgcccuggacaucaccaagacgagggacaucaguauucccuuggucagucuggauuuuucgggugagucuuucugguauccaaaauggguugucuucauucugugggaaaacacagauagcuccccuggaucuuaucaaaauaggaucugggccauaccauuuauuaucaaggacauuuuuccauuuaaccaucucauugggccuaucuggcucugaacaaugacguucagccgcaguauggccaugaacaucaauauuuaaaaaauugaguguaaagagugccauagacacagacacucuugguacucgggguagagucuccucaauuccccucuucuguuuuauaagauaggcuuugagggugcgaugcgcacgcucaacaauacccuguccuugaggguuguauggaaguccagucaggugggucacguccaucugacggcagaacugcuggaauuuuugagauguauaagcugguccauuaucagucuuaaggaguuuggguuucccccaagcacuccaugccucaagacaauguugaaucacaugugaggcuuuuucuccuguuaaagguguggcaaacauuacaccagagcaggugucaauagaaacauguaaauauugauuucucccaaaggaggaaauaugcgugacauccauuugucagaccuguaauggccugaugccacgaggguuuaccccuacaugaggaguagauaaaauuugacaacaaucuaaaggcauuauuaaguaaucagaaucacuuucaguagaaccaaucccucuggcagcucuaggaauaccagaggaaggaaaaacagccauguaggcuuggcaaaauuauuaguugagcuauucugucccuuugugauauagaaaagacaacuugaggacaagaacagagaaccugaaguuccccuuuacaauccugaucuacaacuccaggguggacaauaagaccuuguaggcugcaagagccugccucugucauacuggccacaaaaucugagaaggacucuugaggucccuggacgaucuuuguuaauugucuaguggcuucaccugcucgggagagcgccuuccaggcccuaauagccuuuucaucugauucagaacuacuaagaacuggcuccuugagcucaucuagugaugaguagaggcuccuucuccuagaagccuccgcugauugaucuuuuuucuuuucuuuuuucuucuccuuccuuuuaaucucuccccagguauucuuaccugaccuaaacuuuuccucggguucaagacccuuggaaaggccuguauacuuauuuuguguaccauauuuucucuuugcuccuacucucucuccccgcuuuacuucugauagauugucucgaauuuuguccagaauccgcccugccuuaaccacuugauaacaugugaaaaggaacaaaagggcuucuaacacuagagaaaguuuaaggccaaacauaccuuguaaagcuauuucccacuuuacuucugauagacugucuugacuuuccuuagaaaguuuaagaccagacuuaccuuguaaagcuguacucacugguacuccuguuccccagcugaagaguucugaauucaugcaguugaauccuucucaacagucugugaugcgggaacacuuuauuaccaucauuccccagcugaagaguucugaauucacgcaguugaauccuucucaacagucuguuuuacgggaaccuucguuaccaugacccgcaguucugguuccggaaugagggaucuuccuugugccggugaugguuaacucccgucccgaguuuucuuguauuuucucgucccggguuuuuucuucccggauuuuuucgucccagauuuucucgucccggauuuuuucgucccggguuucggcaccaacucuuaaacgcguucucacgaccggccaggaagaacacaacaaaccagaaucuucugcggcaaaacuuuauugcuuacaucuucaggagcaggagcgcaagccccaagccccaaaaacgaaaaagccccccgcuuacaucuuuaggagccagagcgccagcgcgccagagcgccagagcgcagagcaagagcucuauuguuuacaucuuuaggagcaagcgagcaagagccagagccagagagcaaaagcgcaagagcgcaagcaagagagagaauggcggaaaccccguccccuuuaaggagaauuauccuuugccuaggacauaucacucccugauuggcugcagcccauggccgaguugacgucaugggaaaggcagaguacauguaguggaaaaauacccuuggcacaugcgcagauuauuuguuuaccacuuagaacacagcugucagcgccaucuugugacggcgaaugugggggcggcucccaacacuuuggcaucaucuaaguguuucuauaagaaguuuaaucuaaauauucuaauaguuaaaaugcaacauaaguguagcagcaucuuucucuuuguggcugagucauuccuuccagcugcuuuuuucuucuuuuuucuucuugucagucacugccacaucuuauuuuccuaucuguugcuguuuaucugucaaguguuaauacaucuuugugagugaaguaagaucaagggcagguguauucauuucucugccuaaauuaaaucaguucuuauugagguguaauuugcauauaguaaaguuggucaguaagaugagucaucucagcaugucuguuacauuaaaacguuuauuguacaguugucuccucauccuugacccuagcaacuguugaucugcaguauuccuaggguuccuaugguucugccuucucuagaaucucauauagauggaaucauacagaauauguuucuuucauucucuugcauuugucagcaaugugguauuuuuaauuuuucaauuaguuuuccauuacauggcugugccagucacuaaacuauugguucuuagauuguuuguaguuagaguuguuauaaauaaaucuacggugggcacugauguauuuuuuacaugauuauauacuuucauuucucuuacaaggguaggauugccaagcuucuccuaacccccaaauaacuauaauauagcauuagcucuagcagugugucgguggccaaguuucuccauauucuuacuaacauuuguuuauaugcaguauuuagauuguaucccuuuuuguaaaaauaugacauuucauuguagucuuuaguuuuauuucccuaacgacuaaggacaucuuuuaaaauuuuuguuauauuuuuuaaagcucaugugggugcauucauguguucaugcaugaauguguugccaugauaccuguagaggcuaggagagggagagaaagcauuagauccccuuagaacuggaguugugagccacuuaacauggguccugggagcuaaacuugggguccucugcaagaccauuugugcuuguaauugcugagccaucucuucagcuuuaguacugaauguauuuucaccacuuccuucuaugauggagauauguaugccagggguguggggcuuuugaguuauuaauuuccuuuaucauuuauuugaaacuguauuuuguccagaucuguuaucagguaccuguuguauaauuauuuucucucagucuggaaaguccaaguauuucuuuuaugauuaaugcuuuuuaugaccuaccaaaauacuuacuggcuaauguaagauaccagauaugcuucuucuauggucuauaggauuucauaauguguuuuuaacaggcuauagcucaaaacauucacauuuccaaguuuuuagaagauuuuuaaaaaaguuuuauuuuguuuauuuuuuauuuguuuauuuuguuuauuuguuugacagggucuugcuauguaacuuuuuuaaaaagauuuauuuauuuguuuauuuaauaugaguacacuguugucuucagacacagcagaagaaggcaucagaucccauuacagaugguugugaaccaccaugugguugcugggaauugaacucaugacuucuagaagagcagucagugcucuuaaccacugagccaucucuccagccccgacuuuuuuuuaaaagauaguuuagauuuguuuaucugauuuuuuuuuuaaccacugagccaucucuuuaaccaccccccccuuuuuguuuuuaauucacauuuucuaucuuuuccccugacuguuucuuauaggcaugugccacuauguccagcuagucagagaaaauuuuuagucaggcucauuuuuacuuugauguaucuuauaaaaccaccuuuucuauauuuggccaaacguuugcuuuaauuuuggucaaggugugaggccugggacuuacauucugacuuccugggaaguguuaguaucaaccugagaauaguacacuuaauguuucauucacagcuaaggcgauaugugucuaaaaaugccaucucaguuugugugugugugugugcgcacuugcacacagauuuguguuuauucugaccuaaggagauuaugaaugaaaucaaaugccuuucuaaguagcuuuacuguugagaaguugaaaagcagccaguuuguaugaguggcaaagcuagauaccguguccuuuggauaccggugaggugcccuuaacuaaacacagcucuaaacugccuuuucccuguugggauuuguuuuugagucucuuuuuuucuauaacugcuagagaccuggcuccuaacacuucacacuuccagcucagguccaggcaucuacuaucuucauguaagauuaauauauauaguuuaguauggguccuauugaugcuucggucuuaucugccaaauugccaugcagaauaaguuuaauaaaguaggaucuucaguucaucuugugagcuaacuaguaugguuuauuggcaauauuuuucuacaauaaauaagcugauguguuuuucagucaaaauaacaaacaaaagcagauauggaaaaccugcuuucacuuauuacaauagacauaauaagaguuuuuuuaaaauguguauuuuuugucucaucacuuguucuuaaaugacucauauauacaguuuuucauaauucucuccucaucuccauaguaguaguuuucucacaugugcuacuuuaagaccuuaucauacacccccuuccccucccugcuuuugaguaguuuucuguagcacuucucuggagacuuaaauuauacauaccauauguggguuuguuuaaaguugucaucguuuacacaugcuuuggugaaacauuuucaggguuuuggguuuuuuuuuuuccuuaugcuuaagauaguuucaauuuguugugucuucaaguuuauugaucuuuaaaucuggcauuucugauauauaacuuuuuaaucuuaaauauguauuuacaucacuaaguugaaauuuugauuuguauucuuuuuacaucuuuacuuaaguauuuuucuaauuuauuguuuuguuuugcuuuuuaaagacagggucucacuguguaucacuuguccuggaacuuauguagaccagguuggccuugaacuuacuuagcuucugccuucccagggcuaggauuaaaggcaugaaccaccagaccuggcaauuucuugaguguauaaauaaugcuuaacuguucugaaggcuuugcuugcuaaaucuguauaauuucuugacucaucuguuacugcucuugcuaguuuucuucaauuaauacuuuuaagcuuuaguuguauucuuagguagguaggaucagaacuaccgcuuagagguaguuuuacugaaaugauaaccuuauaaugauuugaccugagagucuguaaggcugcccucucuguggaugcuucguauauacuuuccuaggguuaucugucugauuaccacaugacagaacaguguacucagaguugaggagucaaaacaagaaaggucacuuaauucacagagcucccuaagcaaaaagauggaguuuugcuuggagcugaaugaggaguuguuccacacgugacugaugagcauugucagccuggugaauggcuucuuagaucuuugugaucaaagccugggaggcuguguucucacagcagguacuucagagaauucugaucagccacuucucaguuuugcauaucucaagaacuaagaucauuauuccccugggcuguucuuguuauugacugauuuguccauaaauaguuuuggacauaggcuaaagaagggagccagcagcugcccaggguugucgucgucuuauugaucaucaaacuuagugauaaugaaagaaaacauuucauauggucaaaccuaaauuaacacuuacuugacuauuggaagguagagucaggcaaguuuagcuagggagugcugggcaagcagccuggucucaauguugccuucggauguuucuuuucuguuuggaggagauuacagaggcauaugcugauauucucagcaaagacuuuaggggacucugcagaccuacuacacucagucggcacuauuacucuguuacucugccuaccaacuucuuuuuuuuuuuuuuaaauuaaguuagaauaucuccuuuuuuuuuuuuuuaagauuuauugauuuauuuauuauauguaaguacacuguagcugucuucagacacuccagaagagggcgucagaucuuguuacagaugguugugagccaccaugugguugcugggauuugaacuccggaccuucggaagagcagucgggugcucuuacccacugagccaucucaccagccccugccuaccaacuucuaacaagccuuagggcuuuguuucuuccaaccagggagacucccaguuuucauguggguuucucuucccuguacucgcuagagacuguaagugggaaguguuggaugcggagcuuucuugguuuuucucugagguacuccuuucccacauagccgauguguaguguuuaaaacccacuggggucuggagacaugguucagcagcacuggcugcuauucccaacacccacaauugccuguaauuccgguccuaggaaacccaacaccuucuucuggccucugcaggcaccagacaugcguguggugcacaggcagaacauucauauguauaaacaaauauauuuaaaaauaaaacaguuuauuuacaaaacauucauauguguguguauauguguauauguauauguguauauauauauacauauauauauauaugcauauauauauauauauauauuccuuuuucccuuaaauuauuuuagacagaaaaauccauuccauauuucaucuauacccaaagccuuuucuacucaguuuuuaaagauucagcucaaauccucuccagaguauuucauacuauauuuucuagucagaauuacuugauuguaaagaagaaaagcuauuucaaagaaaauucuaggggcuggagaaauggcucaguggcuaagggcacuuauugcuuuuacagaggacucaaguuggauucucgguaccccuugcuggguggauaccuauaacuccagcucuagggggaucuggucucucuguccucuguggacauaugcacucaugugcacauauccacagacacacacacagacagacacacacacacagaaacacacacuuaaaauaauacauucgaauauuuaaagaggaagcucuaauuuuauaaggucauuuauauuauauuaugagaaaucuuacagguguucauugcauuguauaaacaggguacaacuuccauuaucuuuugcauaucuguauauugcuucacaaaauucauuauuucuuccuuccuuccuuuuuuuuuuuuuuuuuuuuuuuccuuuuucuuucuuuuuugagacagguuuucuugguauaguccuggcuauccugguacucacuuuguagaccagagugucuucaaagucagagauccgcuggcccuagcuucuugccucaccagugcugggauuaaaggugucagucagcaccaccuuugacucacaggauucuuuugacuuuggcucucacuugccaggauauuaauaauaacuaauggaauaugacuuuucagcuuuaguucuuuuucauauuaaaaacaguuuuuauuagugugaauucaaggccagccuaguuuauauaaugaguuccaggcuagccagcaguagguggcuauauguacccuaucacaaaaacaaaaacaaacaaaacaaaacaaaaauaaaauuaaauuccuuaguguguauguguauuaauuagauuacguauacacauucuguguaugcauguggaggucagaagacaacuuaggagaaucuggucucucuuugcaccuuguugcagcaggcucuuucuuuuuuuuuuuuuuuuuuuuuuuuuuuuuuuuuuuuaaagauuuauuuauuuauuuauuuauuguaaguacacuguagcuguccucagacacuccagaagagggagucagaucucguuacggaugguugugagccaccaugugguugcugggauuugaacuccugaccuucggaagagcagucgggugcucuuacccacugagccaucucaccagcccaugcaggcucuuucuuguuucugcuguugcuugcauacuccaggcuaaguggccugugagcuucuaggcaauucuccugaucuugccucccaucuuacugcaggagugcugggguuacagauguguaccacugcaucuacccauuuuucuuuuugacauggguccugggggucaaguguguaugacaagcacuuugagcaaucuugccaauccuuagcuuuauucuuauaaaaaauagucaaauugcccaagggagucagaaaauuaauauuacuuuuaaauggauuucagaauuggcacaaugauucuuuaaaauugauagaagugauuuuuuaauguaaaaaaaucaauauuugagcuuaauaugaggaauaguuuggacauuuuaucaaaaguuuuuaauucuuaauaaugcuugauaaauauuguuuauacucagguaagagguauuuuguuuaaauucuuugauuuuuuuaaagauaaaaacaucuauaaacaauuuagaacauguguuuuguaccaggcauuaagauacuauugaaacaaaggggcuuauauguuagaaccugaagcauccuguguacauaugucaccucugccccaucuuuauuuucuguuacuaaaauuuuaauauaucaugcugcguccuccuuauuacauuauuaucugugaugguuuccaugcuccaaaagaagguaggaauuaguuguaaaagauugcuuccuacguccuaaauuuuuuuuuguccuguuauagaaaaaguuugccagccucugacauugcauaaaauuaaauuaguuaauuaauuugcaguguccagacuuucuuuaauugggucuuaaacuugaauaacaauuaauaaugugaaaugaucaaaauuacuuuccacagucuugaguuuauauuagaaguucucuguuucacuuucucuuuaugucaaaggguuauugacucuuaguuaacuucaaccuaguguuacuaagauugcuuuuuuucuauaggaggguuuucuagcacuugaaagcugacuuugaagugucuaauacaaggguaucuggguuuauuugugauuccgaacauauguguaugcuuguuggcaagaggcuaaaggccgacucuugcaaccacccaugcaacuacaaacuguaaaggaucuuuguaaauacaauuuuccucuucaguaugcuaacacaaugaguauuauacuugaagauuaaauaugguugaaaauuaacuuuucccccuugcaaaauguaaaaauuaaacacagaagcucagaaauuaccauccugggucuaaaugugcuugagaccaguucuuuugucuucauggucgccauugaucaaagcaaagaaguuucaugggauuuucauaaaguuccuuguguuucaggucucugcuaugugaagaguagaguuccagucaucuuuaacacuuugucacucuuagaugcucuagcuggccaguguucguacuccagaagacaagagcucuucugacugagggcccccaguagccacugccccucccccaugcuauccagcucaugucccuguuacaugcugcucugaucuuggagccccugaccaugccaugugugcugcacauguggcacugugcccuuccugaugaacacccugaggaagucagucugagggcuggugcuuguuuuuggauuugugcugacuauugauacuuuauuauauaagcauaauauaucauuuauguaaauaauacuguaggcaaugaccuucauagugggagauucccgauuaggaagugagagagugucaggaaaaauucaaguccuugugauuugggagcuugccacacauagauucccccaccccuacccagccacaugcaacauacauauacccgccuccauccacaaaggugauuauaggacaaugaaauaagugagucacagauuuugagauguuuccaaaacauauagcuaacaacuuuucuaugucuaagcaacucuaugcuaaauuauaaaggcagcucauuuaaaaacaaagucagcaaaggacuauagacauuucauuaaggaauauucuugaauauccaguaugcaaguguggaaaaauacuuuauacaguccugucaucauauaagugcaaauuaaagccacuaugauauaucacaauacaaccauuaaaaugacuagagcaaauuaccuagcuccaaacacuggcaugaauauugugaugugauuuggugugcugcuggccaaacacauaagaauggacuuucucuugacuuuaagcauuugauccacugugugacaagauaaaugaagacaaacacacaaaaaagacaacacagaugauggaaauguuguauaacaugacaguugcacuugugaaaauucaggguucacuaaauuccccauuuauagauuucacucuauaggaacuuucuauacucagaaaacacugaaucuuaguuuuuaaauaaaauuuucucaguggugaaguaguaacucugcgauuguguguguguauguauguauguuuguguguguucuaagcuuguaugaagccauauaauuauaaauauauaauaaauaaaccauauauuucaaauagcagaaccagguuucuuguuauugcucaggagaguaacauauagaggaccaggaugucucuacguuauuggguugagaucugagguaucauuuugagcucauaguuuuucauagaauagaaacagaaauauaugucggugaaauuauuagaaauugugccacguuugaugccacauaccagcacuugaguugcugaggcaggauugggaguucaagacaaucugagcuacauaaaagaccugauuaggaagagagggaauuuucagacaaaucucauaguccaggcugaccucaaacuugcuauguagccaaggaggaauucuugaacaucuuaauguugugauuacacuguuuccagauucugauuucuaaacauuacccauuuuuaaaaaggggggugucucuacagaaaucacuuauucuagaucuggggcagacaaaguacaagaugaaccuaaggcaucuuauucucagaaagagaaauucaauuagauauugcaauuuaugauucaauuuagcuauguaaagaaaugagagauugugccaaguuugguggcacacagcagcccuugagaggccgaggcacgaucugcagcucacggccaucugagcuccauagaagaccugacuaggaugagagggaagagggaggaagugagauugucaugcuugucuucacaguaaaaaaagaaccugaacaaccugaaaaccuauuuuuuaaaaaggaaccaaaccaaagcuggcaccuuugaucccagcacuugggaggcagaaguaggcagaucuuuaugagucugaaagcaaccuggucuacauagugaauuccaggacagcuagaguuguauagugaaaucuucucucaauaaaaauaaacaauacacaaaacaaaaaaacaaagucacaagguaaauguccaagcuagaagacaagugaguagugagagccacgucuugcuaaagaagccaguagagccaggaaguggugaggaaaugaagucuaaguaguuggaaucugagcgugaacaucuguauuaacaguugcuguugcccaacguuagcagcccccagccuuccauuagacuuuccacugaagguguuggugaugguggggugccuuugcacugcuagccgggaagcuggaaaugggaagcuacccagaggcuagucauuuccagaacgagaaaugcaguugcagacaccacucgcauucuuguuugauggaaaaggggaggaaagcugagaagugcuuaugaaacccuagccuaggcuacaggcuuacugaccagcuaaaaucuagucauggagcuauagaacacacacauccucucucucaacuucuuucaacaguucuaguguaacuauaagaacuauaaggcagcugugcauguguuaaauagcuuccaaacacgacauacaaaacaaggauauuaccuauauacccaaaauaagucuuaaaauguuuaaaaaacacccccacuugguuccucagcaggagguauggcucacugguagagcacucacucugaguuuaauuccuagaaguagaauaagcaaaaaaaccaaacuacucaucuuaccuguuguugugguuuuauuuuuauuuuuauuuuuuuuuacacuucagcaucucccccccccccccaggaaaccuccuaucccauccugcuuauaugaggguauuccccaacugacccacccacuccugccuccccacccuggcauuccucuacacggggcauugacccuucacaggaccaagggccucucccauuaaugcccgacaaggcuauccucuucuacauaagugacugaagccaugggucccuccauguguacucuuugguuggugguuuagucccugggagcacucuggggucugguugguugcuauuguuuuucaaccaaccagagcugcaaaccccuucaacuccuucaguccuuucucuaacuccucuauuggggacccccgugcucaguccaauggauggcugugagcauccaccucuguauuugucagacacuggcaagggccucucaggaggcagcuauaucaugcuccugucagcaagcacuucuuggcauccacaauagugucuggguuuggugacuauauaugggauggaucccuaguggggcagacugaaggaaagauggcuuucccuucagucucugcuucacacuuugucucccuacuuccucccuugaguauuuuguuuccccuucuaggaaagacugaagcauccacacuuugguccaggcuuuacaaaaaagaaaaugauaagucacaguguagggcuuuuggcaguaugcaaauugaguuucauaguuacuaaaagucaaaguaguuacugauuucuuuuguaugacaauuaaguuaaaugagcuuuuauguauuauuucaacaacuuuguaguauaauuaucaaaaaaauaguuguagcgggcgugguggcgcacaccuuuaaucccagcacuugggagggagaggcaggcagauuucugaguucgagaccagccuggucuacaaagugagcuccaggauagccagggcuauacagagaaacccugucuugaaggaaaaaaaaaaguuguaguauacuuuucuguuauaguuguucaaccuagaaagagaccuuucuuuacaaaaaaaggaagauacaaggacauuauaaguauuuuaauuauuagcauuugaaaggaauuauaagaaugaaacaauuuucuaacauguucaguugcagguccucuuucuuacaaggccuuccaagguuuauucuggcucucaggaaggugugauggcaggagugugagaguacucaucuguguucacaguggggaagcagagagaggggugguucugugucuuuuuguuguuuucuggggguccccagccuguaggccuucucagcucaguuaaaauccaccuccaaagacuuacucugucaaguaacugaguggaguggaguggagugagauaugauaaguuucacacuccgucaugauucugcauaguuuuacauuucauauuugguaguuuguuucuuguuuuuauaccgccauuacuuuuaucuuaguuguuuuuuguuuuuguuuuuuuacuguucucguuuaugucccuuauuguuuucuacgcaguuuuuaagauuauucucuuugugguaauuauccuuccccaucuuaccgugguauuauuuggauuagcuccuauguaguuuuauuguauaauuuucaucaacugugugucauucucuucuuacuuugugcuguugccaucauacaaagcccaucuuuuuaccuuaaaccccucaacauaauuuuauaauuaugacuuuaugcucuuaucucuuaaaugacauagaaugguuagagucuaaaguguaauuuuuuuguggcuuuaguucuuugaaauauucguaguaacuggccuugaagccuuugcucaguaaguucuguggcuagcauacaucaggguacaguuucucugaagugcuuuuuuacgcccuacaguaagaccauauuguuuucuuugaaaacuagacauuuucaaguugguagaaguuuuuucgguuuuuuuuuuucuuuuaagauucacuuuuuuuuuuguauaugaguucacugucacugucuucagacucaccagaagagggcaucaucagaucccauuacagaugcuugcgggcuaccaugugguugcugggaacugaauucaggaucuuuggaggaguaaccagugcucuuaacugcugagccaucuauccagccucucccaccaccucuuuuaaaaagauuuauuuauuucauuuauaugaaugcacuguagcugucuucagauagaccagaagaggacaucagaucccauuacagaugguuauaagcuacuaugugguuguuggaauuaaacucaggaccccuggaagaacagucuuaaccacugagcccugguggcaauauuuuuaagucagguuuuccacaccuucgauguuuauauuuguuuguuguuuuuauuucuuuaguaauuuugcuggcugguaguuguagucuccauucuuagaacucucugcauagcuagccuagaacaguuaaugauugaccagcuuuuuuuuuuuuuuccaaaggcuuugagcuaaauuuucuccaagcuuuuaaaagauguuuuuacuuguuugagaauuuugugcaacguauuuccaucauauuauuuccucuuuuccagcuccucucagaucacccccucucccccaaauacaaacccaaccaugugcucuuucuuucucucaaaauaacuauaacaaaccccacaaaauacauguacuuggaucuguauugaccacuuacuccagaguacgaggcccgccuuggacugugguugauauauccagugucauugcauugaagaaaacugauuaucccucccuagccagcaacuaucaauuauaaaugaccuuuugacuaggaguggauacuaaaauuuuaaucacaaaauaaauaugcaagggaauggguauauuaauuauccuauuuagucaucuuacaauauauacauaucaaaauauacccuauaaaauuuucuguuuuuauuauaaacuauacccuaauaaaauuucuggagacaaggaaauaaauguuuccuuagauccacaugucaccuagaaagagcuaauacccuaagucuguaagaauucaaaaccauuuacuagauuaaaauacuuuaauuuuuauuaauuuugcaaaaauauucuuaaaagauugcucucuuugucacaucuuuuaguguaguguagcagacagguuucuggacugaaggcaagguuuuugacaugacugcaacucucuguaguacugcuuauuauuauuauuauuauuauuauuauuauuauuaugcaguuuuuuguaguacgucuuagaaugcucucucuuacugagccgaaucccgacuaaugaaguugaaauagaauaguuugucucuaauaagauguugcagcugugucauccgugcacugauaugagguagcacuuucauaaggcaauagauaugguccuacuuuuaaagauaaaaacagugccacuguggaguuacagaguuuacaguaaaagcugcugcuauaaagcaguuggugugcauauucauuuuguacaugucucucacuuuugaguuucuaguuuuauuuuuccucauuuucauucugugaugcccauuccauauuagggcuguuaguauuauggcaggaauucaugugcaguuguuucugcuggggaaauggucccuagggagcagagaaugguaggucagucuguguuguuguugucaguauagucgugaguggagggaaauauugggagcaggaaauuaaaucaacaggcauucucaacagacucacaugcccggcuccuccugugccacaguuucugcuuucaugcauuacuuugucuucagauacauucaggcuuuuacuucauguuuuccccuggaucaauuauucuauuuuguugagcauucuuucauuuugcaaguauuuaguaaacacauugcauguauguuguucauuaguucugaauuuacuguucuucaaacauaaaguccuuuagauuccaaagaauuugucaucaaaugaguuaaggaaacacaauuuuaauacaaaucaagaacugagauuaaggaagccaacauucacuuuuuagaaauugagcauuuaauuaauguugaauaaaaagauuguugguuucagauuuguccgucugccaucaagucuagcuucaguuacuaaaaagccaugugccuuagaucagcagguugcaagcccucugagugcugcauaucagauauuuacauuacaauuccuaacagcaaaaucacacuuacgaagucucaaugcuuuuauacucccuucuauaagaccauaucgucugucguguuuauaguauuuucuuugaaaacuagacauuuucaaguugguagcaguuuuuuguuuuguuuugcugguuggggucaccacagcaugagggaacuguauuaaaggcucucagcguuaggaagguugagaacugcugcauaguuggcaaaguuguuucuaaguuuuuggcuuuuuuuuuuuuuuuagauuuuuuuuaauuggauauuuucuuuauuuacauuucaaauguuauccccuuuccugguucccccuccgaagaacauccuccccuuaucuccuccccccucucccugaucaccaacccacccacucccgcuuucuggcccuggcauuccccaacacuggagcauacagccuucauagaaccaagggccucuucuauugauguccggcuaggccauccucugcuguauaugcagcuggagccaugaguuccaccaugugugcucuuugguuagugauuuagucccagggagcucugggguuacuggcuacuucauguuguuccuccuauggggcagcaaaccccuucagcuccuuggguccuuucucuggcuccuucauuggggauucuuugcucaguccaauggauggcugugagcauccaccucuguauuugugaggcacuggcagagccaggcagcuauaucagguuccugucagcaagcacuuguuggcaucuacgacagugucuggguuuggugauuguaaaugggauggauccccaggugagucaaucucuagaucaucauuucaucaggcucuacuccacacuuugucucuguaacuccuuccauggguguuuuguucucucuccccuucuaagauggauagaaguauucacacuauggucuuccuucuucuugaguuucauguuguuugugaauuguaucuuggguaucccaaguuucugggcuucugggcuaauauccacuuaucagugaguguauaucaugugugguccccugugauagggguugccucacucaggaugauauccuccagauccauccauuugccaaagaauuucauaaauucauuguuuuuaauagcugaguaguacuccauuguguaaauguaccacauuuucuguauccauuccucuguugaagggcaucuggguucuuuccagcuucuggcuauuauaaauaaggcugcuaugaacauaguggagcauguauccuucuuaccaguuggggcaucuucuggguaaugggcaggagugguauugcuggguccucagguaguacuauguccaauuuucugaggaaccaccaaacugauuuccagagugguuuuaccagcuugcaaucccuccagcaauggaaauagauauuaacauucagccugguaccuucuacguaguuucuaccuuuucccuaagucauauauucacagauuuuuguaauuccaaagcuuaugaauaggaaaguagauuuccugacucuuacuaaggagaaaauguaaaaaguguaguauagaguuguuuuuagaauuguuuuuaaagucacuuuuaaagauaccuuauuaaugggaaucaaauuuguaauuguuucucuuaagcauuuuaaccaauauuugauuaagauauauugauaauaaaaaauauuuucuuaaauccuuacaguugccugugggauguuaguagugauucucuaaauuacuggucuugaauuuauuugccaacuucaaggaaacauguuugucuuucugaaauuuucagucucuaguuuagcauauuugccauuaauugaguuguggcuuaaaucuacuauuguaguguuuaaacuuuugauuaaugaguuauuuaggaagcauuuaagcaggucaucuguagaugauacauucucuuaacucacgcaucaucaguacuggaauuuucuuuauuugaagaauuuucaauuauaauuuugggaaauaauuuuauuuagaacucaguuuauuacacaauuugcuuuuaacuuaaaaugauuuuucuuuccucugaaauuaaguuucauagcugcuggucuaaauagaaacuaaauuuccagugcagugauacgcauuuccuaaguuuucaaaacuagaacaguuggugguucagauagaguauugcugcccauggcugguauagaucagugauacaggacucgcuucacacacaugcacucuuagguagugaguuuggguccagcauuaaaaaaaccagaauauuguggccuuggagcuguagauuuuauuuauuauaaagcugaccuuucuaguuuuguuagcuggaauaaucacuuuuagauaugcuauuucugcuuguaacaauaccuuacaaauaagaugguggauguggugguaugcaccuuugaucccagcacacaggaggcagagacagguuggaucuuugugccucuaggacauucagagcuacauaaagagacccugucuucagggugggaucuaugucugggagaccaauguuuuuaugauaaaauguccacacuauuuucuguacuuuuuuuaauauuuaagccagaaaugggaaauagugaucaauaaaaauagccacuucuaccaaaagaaaggucagcuggucagagugagggauacauagguagaaagaaauuuggacagcuuucugacagaaauagugcaagguacugacgagcaacaugagaaauauggguauguuuuuccauugcugcuguucucucuguuggaaucaaacacauggcauguacccagggggaacuaaggguagugcucuucgcguaggagcccugccaggcucaggaaaguagugugccucuucuuuucaucucuuguggauuuuguuuuuguggcucccccccccccccaccuuuucuuguuuugauucuuucuaguauuucuuuccuuucaaaaaagacuuaucuuuuauguguaugcaugaaagccuguaugaauuuaugugcaccauaugugugcaggagccuaggaggccagaagaggguggcuccugggaacgaaacccagaucuugcaagaucaguaagugcugagccaucucuccagccccucauuccuuucugaaucuuggcugugcccagguagugguagugugcugguuagucaguccccccuuuugcauuugaaaaaugugcauucuuggguuuuuuuaguuuauacuuuugggucccccacccuaucacauuguuucuccuuauaauaccauuucaucaaguaggaauuuuaaauaagcagaaguccauuuuuguuacauucaacugauauauaccuugguuuuuuuuuucccuuuguaauagcaacauuuuaucuuuacuucccuuccuguccccacuagcaaaauuucauacacaagaacuccuuuuugcuauguuuucuucuagagauaucucuauuuuagggaaacuucucacuuuaaaacauuaaugcaaagaagauucauuaacuuuaguaaguguugagugaguuuuguaagcuuuguuaacacuaugauucaaugagguaccugaaacuugucagauuguaauaguaaagcagcuacauguccuuauguauguaaaaccaugaagacaaguaaucuaguacagugcuuaugauuacaacaugcuuacaaaugacuuauauuaaaauaugguuaacacaguggcuaugaacuaauuuucuucuauccuacauaagcuauaucgccauuagaacauuuaaaugacuuguacucugaauguuauauugcugcaugugucucaagacuaaacuuuacaauguguuacguuuuaggucagaagacaugucuucaucuacauggcaucuuuccuuaccucuaugugccauacgaugguuauggacagcagccagaaagcuaucuuucucagauggcauucaguaucgacagagcacuuaauguggcuuuaggcaauccaucuuccacugcucagcauguguucaaagugucauuaguaucaggaauguaaguaugauaauaucuuuuaaauuucacuuuugccuuucuuuuguuauuuuaauuagagaaaacaugaaauauauuuuguucauuuuuuuuuuacugucauaauaauggagcuauggugaguuucuuuuugaagcuuuacaaaguaaauuuuuacuggaauuuuuauuuuaaccccuuuccauuuuucugcuuccuagaacuguggaaauucauguaauucuuacuuuaugggaccuuuuggucuuguguauacuguuguagguccuugguauguugcucugcuuauugucacuguaccaaaacaccugagacaaucauuuuauaaagagaaaauacuugguuugggucacauuuuauuagauucuauuuguauuaugauccacugguccaguagcuuugggccuguguuaagagaguacaugauuacaggagcauguagcugaacaaauuacuugcuauaaaccagcaaacauaagaaaggaaaaggaagagaccuguuccauaaauccuuuugagaacaugcuccuaaugacuuaaagacaugccccccauuauaccuuuuaaagguaccuccucaguaguaguaggaccuuuggaggauauucaagaucuaaccuguuuauuuguauauugcuaaacaaaacaaaauuccauagagguuauguucuaguaacaagaaaaggguaauaaucgguacauaugacaugagauagguuuauuuauuacaugguaauugauauagaaggaaagaaaacagaaagcacuauaagaagaauauaaggaucuguacaguuuuagacugggugcucaggaagggucucauugacaaaaucagugacauuaacuacuaaaugauguaagauguaaaagaauacaguggaagugagggagcaagcaagaguccagguggcuggaauaggagauggagagaaugacagagagugggcagauacgaaugagaacaaaaccauguagaccacuuauuuucaaguuucuagauauuccagcauuagcucuguuugauuugacaguugugguucucagaucucuuaaggaccaggauuguaccugaacaauggcgugaugaaauccagggcuucccauaggcuccgugagccagucucugaguacaagagcacuaaggcagucucuuacuugaagauugacaauucuauaauaguuuugcucuauucuuucuuuugauuugaacugcaguggaagaugacucccagcuuccgccuccauuucuucuccuuugucuuagcucagaccagaucuaaaccugaugggcauccuagccuuuuguaucucugcuugguuccuuucacauggcuucuccuuaauacauuucuuacauggcauugcuuucucagacagcugaaagccuuucuaucaauuccgaugcauacucaaauuugagaaucacuauaggcaacuacucuaugaacuuuacauuuucuucugagcuguugcaugauauugagcugccagggucugacuuacuaggguugcuucagcaacuauguaggugaacaaagauaugggaagacaaggacagagaagcaagaagcucaguaguaaaguaugguagcuugaaguacaguaauaucaaggaaguuguguaaaaucagcuucuguauguauucugaguguuaagucaaaauuugcuguucaguuaguugagaguugugauaugugucaagaaugacagcaggauuuauuuuguguugcucagaacuuugagucuguguugguggagcacaguggaggaaagaucuggauguuucaagcaugacuccuaucuaaguaggauauugccaugaucaucaugacuguacagucuauauauuagcucauuuuuguuuacuuuagcauuuaacagaacuuuaauuauuuuagguuuuguucuucacuagcuaauaguugagcugaagaaauaaccacacuugcuuguuuacuagaagacaccagcaccuuuucacaguguugagcacuauauuaggcaaaagagagacaagaauaggauacagauguagcugugguaagagcacagauacagauacagauauugagauagcguuuguuagggauugugucaugugguuagagaggcugaguagcuacaguagucagucuguaugcugaaaccccuuagacgcugguagccaguccaagucugaaaagccucagaaccagaagggcugauggcauaauuaugguauaauucucagcuccaggcugaaggccugagaccgugcacacuuuugauacaaguccuagaagcagaaucaacauguacaggaacuggagggcuugaagcuguggucagcaggagcaggaggauaauugcaucacaguucuaggaagaggagagaaagucccauuuuuucugacuuuuuguucauguugagauuuggaugguacucaucugcauguaaacagaucuuuuuuauuccccagcuuagcaagauaaaauuauuuagagacuuuuuuuuggcuaaaaaaucuuagaagauaauguauagaauuucuaagcuauauuuuagggcuauauauaugaaaccagaauuacagauuuccaaauaauuuuaauuuaauaguuaaauauuuauuugguaucugaaauuaagagacugaaaaaaaaaggcacuagagauuguuaacaaaaccaagacaaagcaaagauaauaugguccacauaaguguugguugucuuccuguuuauuugaguaaagaugacuaucuccuaagagcugcauuuauguauaugaaaaauaccauaauaguaggaaaagguugaaauuuaccauuaaaaaaaugagaucccauguauauuagccaagacuuucuagguuaacaauggauagaaugaaucuuuauccauguauaaaagggggguuauuaagaguggcuuacagacugugguccuccuaguccaacaauaguuauuuccaaucaaaaaguccaagaauccaguaauuguucagcccaugaggcagaaugucugagcugaucuucaguauacauuggaauucugaagaagugggguacaggaauaccucagcagcaggauaaaugaacugccagugagaccgaaggcaagcaggcacaaagcuucuuccuuccaaguccuuucuauagauugagaguggucuuccuaccugaaaugguccaaucaaaaacgucccuuacaggcauguccagcugcuuggguuuguaguuaauuccauggguagucaaguggacaccccaagaagagcuaucucagcaccauacaucuuuuauccuuuucuucauagaaacaguagcaaauuauagaaacaauauuguuacaacucauauugagcucuggccucuauaggaaugugugugcacacauacaauacauguguauccuguacaugugugugcauaugugagcauacaugccacacacauacauaggaugaaguaguaaguauuauuuauaaaaugauagaaguggcaugaugggaugccuugguaguuaagagcauuuguuguucaaacaggguuuguuuccuaggacccagaauauggcuaacagacacacauauaacuucaguuucaggacauccaaucuuacacuuucuucuggcccuuugggcaccaggcacauauguagcacacucauauacacacaaaauaaauacaucuuaacauaaagagugaaagauggagagagacaaucagagaauacaguauugaaagagguuaguuaagcugaaaucugcaucucugaggaugaaaggaagcuaugcaaaagccaggaacagggcuuuccaggcugagguagcaagcaagggaauucaugaggagggaugaaauuagccuaaugugguuuagagugguggugggcggugguggacaggggggauggggacagugagugauagguaagacaggauuaaaguaagaaacaaggauggaugugugcacauuucagauguugggaacuagcaaaaugaaaauuuaacagaaauuacuuggugacaauaauagagauagcucugacccagaguaugaguaacagguuuucuaaagcauuauuacuaugugaguauguacguggugucugugugggugugggcacuuaugugcuguggcacauuacauggaauuagaggacaaccucaggugucaacuucaccuuucgccuuguuuugagauagggggguuuuuuuguuuguuuguuuucugcuguauguguuagacugcauuugcuggcccaugauuucuaggcauucucuugucucugccuuccuccuccuuguaggaacaagaagcuuacacauauguugugcaucuggcuuuuacaugcauuauugggauuugaacuuagguccuugugcuucugaauggcaagcacuuuuacccuuugagccaucucccuagcuccucacugaugcauuguuuacauuacaucaucuuugagaagaaucgcagucagcguaucguagguauaaguagaguuucaugcccuccuaaaauuauauggaaacaccggcuucuugagccuucauugaacacuucuuccucaguauaaucaccugcaucucccuuuuccuguucagucucauggccugagauagcauaauaggguucuuaagcccccagccauacauagauacguucauucauuuauuuauucaucuauuuucauuucauuuuauuuugggggauggucagaggacaacuugggggacuuaauacuccuaccauguggguuccaggaaauaagcuucagucaucauugguggcagacaucuuuaaccacuaacccaucuuacuauccccauuucaagcucuuaaucucugaucuauuuaauuuucacuggauucauuuaauauguguagauguugaagacaucagcuacuaaaaugugucauguguugacacacuuuuuauaaauaaaacacaugagugcauaugauacauaguuugccucuugauaguaaacuugugaaauugauagcugauuauaggugcuguuaaaaaacacuguccaagagaaauggcaauagucuauauuguuuuagagcuucuuggacuuuccacuuaaccugaagggagguguuguuugucagguacuggaguuuuuguuacucugugacuucugauguggaaggcguuguccccucuggugccccucaguuuuugcuuuuguuaaaaaaacauuucuugagcugggaaaauaguucaaugaaugagaaugguuguuguccaagcaugaggacuugaguuugggucucugacacccuaaaaauauuugugugcaucccuguauuauacuuauaacuccacucuuugaugggcaaaggcgggggauugggggggguauaggguaggaaggguaguuguugggacuggcugccagccuagcuccaaagucagcaaguaucuuagucaguguccuauugcuguaaaaauacacuaguuccccugagacuucuaccauuaucccauugaugucauucuuuucuuauuuuaacuuuuuacuuugucuuugaguuuucagaauuuugacuauaauauucuucagaaagaugcauuuuaaaugaaauguuuuagacgugcuuugaacuuucuggcugugaaugucaguguaauguagccagggcuacugugaacuccugacccucauaccguuaaccucaacaguugccuggccagucauagcauuuucacucauggguuuuguuggcuagauuuuuuuaaaaaaaugccuuuuccagucuguucugaaaucucaugaagugaacguugacuuguuuaauggaauuaaguagauuauugcaaaagacuaucuucaggccaagaaauucuucuauauguuccgaucaacuguugaaguucucaaucagcuacauauguaacuucauucauuauguuuuuuaucuucaagauuuuuaaugaguuuuuuuuuuuuuuuuuuuuuaugaucuuuccuuagugaauuucaguuaggucuugaauucucuuccuaaguucauuuaguugucuguuuuuccuuaauauuguacuaaguuuuucagaaaauucguucucucgaauuuuugccaacuaauuuauauccuuuucuuugugcucuuacuagcaaucacugugcuuccuuccuuagaagcccauauuacagaauuaguucucacgcuucuuuaugcuggcauuugugcaucuggugguuaaucaguucccuguaccaguuuaugggaugacuuugguagugagagacuaacuauuguguugagugaauauaccaugcugaucuguguuccucaugagacguguguguuuauauauauauguauguauguauguauguauguauguauguauguauauauauauguauccauucagcuuuuucaauuguaaucaacacuagcaguaucugcaaguuuuuauagccaguggugguuuugggauuauauugccagccagaaaguaguuuccuuagcuuggacccagcuagguuguaauaugaguaagcuuuucuaggucaagauaggguuggacuacucgcuuguuccaucuagguguaacaugccuggucaaagaugcuuguuugaccaggcuacagagagaugagugguacaguugaugccugagagcuacaucagugacuucauugggccccugaaagaugaccuuccuagaaaaguuuauccagcuauuuuccugaguuaagaauggcuauguaggaucaagcuucuaagaauaggcuguuccauuacuucuuggccagaggagaaccacuagguuugucuaguugauuccccaggguccucaagcaggccaagccaaacuaaucgggaaauguuguaggggccucaguaggcugagccaacacaauuguaaagcuccucuucugugucuagagguuuugcuugauagguucauugguuaccuuucuauugccgugauaaaaacaccaugacuaagguaacuugcaaaagaaagaguuugggggcuggacuugguauaugggcuuuugagacuucaaaaaaggccaccccacaugauauaacuccucuaaacaguuccaccaagugaggaccaaguauucaaauauaugagucuauccaggccauucuggaucaaaccaccaagaacaacuucuuuauagagcugcagugauuaaauguaagguagaaauggguucacugucccuuuugguccugaguuuugucaaaggggaacuuuuaaaaucuuaaaacugcuuugguguuucuucauauauaaaucucugauagguuuaguugcaagcuugugggguauuuuuaaauguguuuuggguaauauuaaauguaagaagacugaauuaggccagcagagccuaauuaggacaauaaguuguauuauuucaucuuugaauuacagaaauguuuuaaaauauguuuuucuuauauuucaggccuuuuuaugguuaucaugagaaggaaagacacuuuaugaagaucuaucuuuacaauccugcaauggugaaaagguacaaagauaaaugaaaccaaaguaugaauaaacaugacuuaaauauuauauuaauaaaaagaagacgauagaagaaaggcuuuguaauuuauaacaccauuacaguaaagaauguaaacuguauauuaugaguagaaagagagccacugcuuagauuguguggaggauauuucaaagguaggucauuuguuuauggccccugccuacuucucuguuuuggauguugugaguuuguugaauuuuuuguaagagaugauaacugucugauacaauauuaguggccuguugaccaguccauauguucaagacuaaaaacaagauaauauuguaguuucaaaauaaggagaauuuuguugaaguaaagacugcagugagggcacuuuuuguugacuccuuauuagcuguuuuguauccugauuuuuuuccccauaucuuuuucucuuuuuuucuuuuuucuuuuucuuuuucucuuucucuuucuuucuuuuucuuuuccuuucauuccuuccuuucucucucucucucucccuuucuuccuuccuuccuuccuuucuuucuuucuuucuuucuuucuuucuuucuuucuuucuuucuuucuuucuuucuuucuuucuuucuuuccccuuaauguguccucugcaucaaguaguugaauuucagacucuaaaaauaaauuugacaggggugaggcuuggagucugggggcagccagaugauucaguagaaagccacuugcugcuaagucugacaccugagcuguauccccaggauacacauccuguaagcagugcuccuucaaauugcccucuggcccuauggacacauauaacaauaaauaaaugcaacacaaaacuuccuuuuaagagcaaauugucuaaguucaacguggcuuauuaguuaggugaccuuaggcaagagccuuccuccuccuuucugccaugcuuuccuauguuugauucugaugucuggaccaccgccacacugauuugcugcuccuugucagugauggcuuuacaucuuucaguuggcuccacuugccuucuucaugccauuuuaaugucaauacucauaauuuuacuuggaauacucauauacagacauuuauacauauaaacacacccaucucucacauaucaauucuucaugaaagauuucucucuccauaucaaaugucuuaccucccauccauucuuuacuucauaugguuucuacccaaacuaauccacugaauuuucuguucacuaacugucgcuaaauucauuuuaugucuuuccuuuuugagcuugugguacuacuuaggaaaccuucaaaugacugcauaugcugguuucugagacuuugacaccuccuuugauuauccucauacuugcaugaucauucaucuuggugccgcugcguauuguugcuguuuuuucuuucauauuggugauuguuucuuagggacugccuuuaugucuucaucuucucccuuuuauauuuauauuauuuauucauuuuuaugaaugugaccuuuaaguuaguaugaaugucucaguuuuccucuugaguucccagucaauacaugaaaccacuaacaggguaaauagacucucagugugcuuaagacugaggacucacagagaagaugugaugucagcuuuauagccuuuucauuuuuguuugugugaguuuaaaaaauacauugugggcugugaaugugaguauaggcgccugcagaggccagugucauuugguccugugaagcuggagccacccagcgugugugcuaggaaccaaccuggguccuuugcaagacuaauaugcccucuuaaguacugagccauuccaucucuccagcccuuuuugugugaucuuuaauaccauuuaaauucucuugaagauucaucacuucauuuauaaaauguuagcauggacuuguaguaaguucugcuugagguuaagcguuuguaauauauaaccuauucaguauauagaccucaaaaguauguuagcuaugccuucaguguuaaaacauuaugauuguuccuguucauuuucagugggaccuccgcuagaaugucccacuauacuaaaacuaaggacguuuagagcuguuuuuaauuuuucugaaaccaaaaugacaaccaaaccaaaacuacuuuucuuucauucauuacauuuucaauaaacacaugaccaccauuuggcuuaaucucaauucuucccuagcuuaccauccaucuccagucaguuccucagaugugaccaugucacccuuacaguucuccugacucuuuggcagauguuugucuuauaacuaucaaucuagguuuuccacuguagccuccugauaugauuguuuuguuugccugcuauuuacuucuccagcaaauuauauacugcuucauauuuaaguaggaugacuguaaccugacuucacauuuuaaguagguugucuauaaucugacuucaggcauuucuuucaguuuugacacuagacuacauacaguaucuauggcuucccuuccugaauauacugcuuucuuauaaccuuuacuguacccuacuauguuaaugugaaacacucuucccucucuucagagaguugaaccugugguuuguuuaacuuccugcuuagacuacucacagaggccuuccggagacaccucugccucucaguucuuggcauaggacuuuuuuugaugugcauuguugauguugcuuauguucccuauuaugaaggaacuagcauuuccaugguaacacugucucuagugguggacuuaugguugauauuucuuuggggaauuuuuagugguguauaugaaguuauuucuguauuuuuuuuuaauauuggaaagcagaaaaagauuuauccaauguugccacaauugagaugagggaccaagacaucuagcuaggaaacccucuccucuuacauaccaguuuauuuucaacauccugaaguaagaguaaacuuuagaaagugaauauauacacauuuaaacaguuuuacucaaggugugacacagcccaccauugaccucauugacuaggccugaguuucauccuuuaaauuagucagacacguuguuagaacugugugaauucuuuucuagagacaaguuuccuauacaguuggugccuuuuucuucccccagcaugaaauuucuaggggacucccuccucacuuugguaauucuuuguuuuaguagucugagacucaguagugugagacucacaagugucuuuuuaaaaugucuucauuugucaagaccaguuacaguuuuucguuuucuguuuaauaccuacaucuaaaaagaaugcaaguaggaacuaagguuagaacauguuuaauuagugccaaguagccacguauaagaaccauuuuggggggcuagaaagaugucucggcaguuaaaagcaugugucgcucuugcagcagacccagguuugauuccaagccacccacaugaugguucauacccaucaguagcuccagcaccaugggauguccucugaccuccaugcaaguacacuuaguagacaaaaauaucugaaaggaaacacuugugcacaaaaaauaaguuaaaaauuguuuuaaauaaaaaaauuuggaaaaaaaaaaccuguuggcuuuuaguuaccuuuggaagggcuggcuccaucuugguaaucuaagaugggaucuuguuggaagccuaggcagaccacaggccuccuuccugcuuugccuugccgagugcucagaguauaggcaagcacugccaggccuaggaugaauuucucuaaugcuuuucuuaggugguuuuaauuuuuucccauuuaauccaugaauuguuuuuuuucauugagaaaaauucauuuuacuuuaagacugugguuuaaacuuuuaacuugaaauaaaauacauauuucuagaaaaaaugaaaugaaaauuuuaaguauuagugggaauuucuuuugucuucuauauuucuguaaucauugcuucauuugauaaugaacauaauucucuaacuuucuuuuucuaauuuaggauaugugaacuuuugcaaagcggagccauaaugaauaaauguuaccagccucaugaagcgcauauucccuaccuccuacagcucuucauugacuacaaucuuuauggaaugaauuuaauaaaccuggcugcugucaaguuccgaaaagcaagaaggaaagguacgguuacuuuucaagucagacuaagggugcuguguaaucaguggcuuacaaaguaguaugcguaguggauaaagaauagagaaaugcugagagcaggguuugagacuaucaggaagagcuuugcaggagacauuuucuggagcuguagagguuaagagcucagcaguuaagagcauuggcugcucuuccagaggcaacagguuugauucccagcaccuacauagugccugccucacaacgauuuuuaauuccaguuccaaggaaucgaugucaucuuaagacaccaagcacacaacuggcaaguagauacucuuacaggcaaaauacccauauauauaaauuuacuacuuuguggagauacguacaugcucuauaaaucacccacuccuaaggagacacgcugaagauguuucauguguuuggaacuauauaggcauugucauaguuuuaaaauauuuuagucacuuugaaggaaacuuuuuuauacuuugguauugaaaucugcaaacuucccaacucugcaacuccuaaauaaucaguaauaaacuuuucuguuugugcauagguaccugagcggugaauuaguuaaacacccgcccaaaagcucucuggauguaugcacgcacccgcgcgcgcacacacacacauacacacacacacacacacacacacacacacgcacacguguguuugcacgugugacagcuuauuuugguaugccuugacuggcucagugguugggcauuucucauccucccuaaggcuagcuacagucuagcuacagucuccccuccaacuuugcugagugaucuugcuaaaucaacauuucaucucugcuagcccugacccaaucagggaguuucuuucucgaauucuuacaugccugcuugcuuucuuuccugcagcuccuaagucugaucccucugcuuuccaguuguggaaagugauccuccucuucuuccccucucucuuggucuccugccugcacaaucuaaaagucccaccucuucucccugcccagccaauggcuguaccgcaauucuuuauuaucaaccgaagccaguugggggcagggauccucgggucuggaagcucagcuuuuugugagccgaaauaaaacaaaagcaucagaaccaaucuccaauaaauacccauccuguauaucuaauauuaguagagaugugguucauaauuuuucuacuuaauauccuauuaugguuaaucuaugugucguggauuaguacuucauuccuuagagugacacaguaauagucugcuguguguauaacguacauuuuuuucccaguuggugggcauuuggagauuuuuuuuccauauuuuuuacucuuguguacaaaaaauuuuuuugaacauauauugggaauaacauuucuggguucauuggucuuccuuuccuuuacauaagagacuguguguguguguguguguguguguguguguguguguguguguguguguguacacauucacacauguacuuguguaggcaaacacuuuaccuacucuuuuuucuguuucuuuuagaacaaaauaaaguggacauuuuuuucuggccagcacguaccuucugauugccacauuuccuucccucguugccauacgucuucagccagggacgagcauuuuuguuugaauuuacuaaacauucuccuuugguuuauucuucccauucuuuucuacccaaacuucuuuuugugcccaugaauaaugggcuauauuuucagaucaaucucuuuaaaaaaaucauuuaaaaacuauguaauaguugaauaauaguaaacacaccaaaaaugcaauaauaauaaaagcuuuaaacaaaaagagauaguaguuuaguaaggaugauuuuugcucugaggacauauguuuauuaugggaaauuuagaaucuucuuugaggcaaccauccugguuauaaaagaaacccaaacccaggucugccugguagguggaaaguccagaguauaguaggauugccaguagaugcacucuuuaguugaacacagauggacaacuugaacauucuugauacauucaaugcaguguuuaucuccuaggacuaaaccauucucaaacccagaaugugagcugagauguuacuaaucugguaauauauuuggaucugguugaagaagugaauguagaucuucccuggaguguccucucuuacuaguacuaucguauauuagaucuagucuucauaaauaaaaccuagaaaacacaccuuaaaucagcagagaauccagauguugucauuauuaguggcuauugaaaaauuaacauuguaaucuucaucaaguaagaauguuaugugcagaguucuacuauacaauguuauauucaccaguaguuuuuaaaauaaaauuggcucaccaacuauuaauaguaucuugauguggaacaauuuagucucagugaaagaaacuucuuuuagaaagaaaauuuuuguagugacaacauauacuauauacuauguuuuuaaguccacauuaacccagacuauuacuauuacuccccuucaaagaccaaaauuauuuauuuauuuauguauaaacuauaauacuagcuaauaaccucguuuuaacaacauucuuuucucaaaccucuuggugauuggaguaauauaaaaucucucauaggaaccagauggucugaacgaguaguuuucuuuaaauccuaaaaaccauuaagaaaaaagucauauaaggagggaugagauaggcuugaccuccuauugauuucuuuguggaagguuggcacuuuggagcccagaaauagguucacacuugaaacagcucacauauagucaccuuaacuuugacggugguacugugauaauucaguugggaaagaauagucauuucagaaauuuuugaauguagaauuguuggauguccacauacuaugacugggacauauaguuuauugguuuauacuguguaugugugugcaugcauaugcacacaugcaucugucugcaaauugaauccagagaucuguguauccuagaccaauguucuacaucaauccacaucucucuuguuacuuuucauuuugacauggggucuuacuaaguuguucagguugaccuugaacucaaucuguagcccauguaggcauuggacuuauaauaguccugccucaguugcuuuaauugggauuucaggccugcaccaccauuccagaugaauuacacauuuuuaagucauuaaaaugcauuacauauauguaaaauauauaguauagauauaugaaauaaguauauguaugucaaacguaaaauaucaaguauuuuagaugagaaaucuacccauccuugaauuugaaagggaaguuuuagauauaucuaugaggggaaaaguugguaaguuggauuuuucuuaaaauuuaaaacuucugcucagagaugaaaacacauuuuaaagaguaaaaagaaaaggcugaauagacaucucagcaguuaacaacacuugcuucuuuuauagagcacccaaaguuucaagcacucacaugaaauuugcaacaaucuauaacuccaguucuagggaucuaauuccuucuuuuguccucuguggggaccaggcacacacauggggcacaucuauucaggcaagcauauacucauacagguaaaauaaaaacguauuucccaguggaucaguucuuugaaaauuuuauauauuguauuuagaucauauuuacugccucccucuaugccucccagauccauaccaucucuuccucacccagcuuuguguccuauuuuucaucuccucaaauacaguuugugcuggccauauccuuguagauguagagccuucacuggagugaccgaccugugagggccacacgcuuaccgaaaacugacuuuccucucuccaagaguuccgcagcuucaaguggcuguccaacuccccucuccaugcuggaauuuugccuggcuuaagcuuuccuagguuuugugcaugaugucuuuacugcuguaaauuuguauaugcaauugcccugcuguguccuuguuaguacuccacugcuucugacucuuagaaucuucccaucaucuuuucugcaguggucccugagccuuaggaggaggauggauguagauggccuauuuaggucugugcauuccacagagagagagagagagagagagagagagagagagagagagagagagagagagagagagagaguguguguguguguguguacauauguguauauauauuuauauaguucuuuuucuccauuuacuuauuuauucauucacucacuuuacauccugaucacagcucucccaccuguuuccucccauccccuccccacagcuccucccuccuuuaucucugagaaagggaaggucucccuaguuaccaacccacccuggcaccuuaguucuuuauuuuuuaaugaaguguuaaccauuuagauauaguuauuaugcuaucaaauuuuauaagugcuccuuacucaauucauugcaaauacuuuuuucuacuccuaguuaagaauuauugcucucaacuguacauauguaauccuuuaaaauauuuuuugguguucuuacaugauuuguaaauuauuuuacaaaggauaaucuuguacaaauuauaaauacaauuugccagauguaguggcucaugcauguaaucuuaguacucaggauguaaagucuaugagccugagacugcccuagucuacauagugaguucuaggucagcuaaggcuguguaaugagacccugucaccaguaaauaaaugguagauggauugauuagacaaaauaaguuuaaaagcauaauuuaucuaaauuuuccuuucuuucucuagguaaugcaucacaugcaacuggauuauucaagcaucaauugucaggaaauucuccugcuggcacuuuauuuaggugggaagaggaugaaauaccaagguuagccucuguggucaaagaaaugaacauuuuauauaucuauguuugugauuagucagcaguggucaucauaauuaaaacuuaacuuuuacuacauugggucuuuuaaacauuuauauuuaaaauauaucaauaacauaacauggaaucauggguguaaagaacagaccguggcggagaggacgaugaaauggcagaauguaaaggcgcuugccuccaaauuuggugaguuugauuccugggauccacauggugagaaccaguuccuauagacagugucugaccucuccgugcaagugauggcacacacaccugcacacagagacacagagaaaccauauaaaguuaaguggcauuuuaaaauauacaaaaggcagaugacagaaagacauaguuauuaccuaacuaauaaaagaaccugccaggcgugguggcacacgccuuuaaucccagcacuugggaggcagaggcaggcggauuucugaguuugaggccauccuggucuacaaagugaguuccaggacagccagagcuauacagagaaagagaaacccugucucgaaaaaucaaaaaaaaaaaaaaaaaaaaaaaaaaaaaaggaccugaaguagguuguuacauuucuuuuuuuuuuuuuuuuuaaagauuuauuuauuuauuauauguaaguacacuguagcugucuucagacacgccagaagagggcgucagaucucauuacagaugguugugagccaccaugugguugcugggauuugaacucuggaccuucggaagagcagucgggugcuuuuacccacugagccaucucaccagccccgguuguuacauuucuugccguuauuaaucuucaucaugcacucugaauugaugucuugcaaguuaccaaguuacaaacucaguuauuauaaaauagcaauuuuaaauuaaauuagcacauauuuuuaauaaaauaauucuuuagguuucuaaacauuaaggaguuauggaaauaaauacaggacaaaauacaacuuguuuuguugauuaugcuuuuaguauauucagaugcuuagauuuuccuaucacaaagcagacacauaaccaucgccuuucucaauuaucagucaucuuuccuuuguagauugcccuacaaagcauugcccaaagcuuucuuaagccucuuauuuugguuacugugguauuggcaacaaaguuaaaguuuuuuuuucuuuucuuuuuuuuucuuuuguuuuuuugagacaggguuucucuguguagcccuggcuguccuggagcucacuuuguagaucaggcuggccucagagauccaccugcaucugccuccugagugcugggauuaaaagagugcgccaccacgccuggcuuuuuuuuuucuuuuuaacuucauguauucauccaauuuuuaaaagguuuuaauuacauuaauuuauguauuuguuguauaugugcacacaugcacagaaauuaguguauaauuugugggcgucauuuuuuucuuuuuacccuguagauccuagaaauagguuugauaccaaauguuuucacccugugagccaucuuacugacccuauuuuuuaaauuuauauuuauuuuaauucauauuaugugguuacuuauuuggugagugugugugcauauauguucugaugcauuguuugagucauaagacaaaugucagguuguaucuuuccuucuauuuugugagaucuggggaucaaauuuagguuauuaguagaucuuccugcaagaagcacccuguugagccaucucacuagcucacuaaucuuuguggaguuuguuuguucguucguucguucguguguguguguguguguguguguguguguguguguguguguguguguuugugaagaggccagaggucauagucaggaauccuuagucacucacuuuccaucuuacuucuuagaagucauucacugaaccuggaacuugccaguuaggcugaagagcuccagagagcauccuccuuuaguccucagaccuagaauuacagacucagggugcuaccccagcuuuuguacauggauacuggagaugugaauauggagucgcauguuuguguggcaagcauuuuucuggguuugcucucagcccaccaacucaaugauuguuuucucuuuaagcagauuugugcauuuauaugugugaagaaauggggugggcacauaguauuccuugacuuuauuucuaauacauauuaagaaaaugaauugccagacagugguggugcacacuaaucucagcauguaggaggcagagacaagcagaucuccauguucaaggccagccugaucuaccaaaugaguucaaggacagcuggggcuaccaaaacuauacaaaaugaaacagaacuuacugguugaacuuaaaaugaucaugaaaauauuuguuuugagugguggauacaucuuuauaauccuaacacuucaaguaaguugaagcacaagcauuggaaguuugaggcuaaacuagaacccugccagauaaaccaaucaauccaaaggaucaguuuuacuuagagcuuaucuaauugcccuaaguuacuuccaguugcugugauggaaagcagcuuuggaaggaaaggauuuauuucagcucagugcaucaugaaggaaagucagggcaggaacucaaggcaggaauucgacuguaggaacugaagcagaacuacaggggaugcugccugcugcuuugcucugucugguuuccuuagcuuguuuuuuauacaacccagauguucuacuugauuuuguguuuuaaguggaaauuaucaggugccgugguucucagaguuaauugcuacagagaugaagcuauagcagucugaguacaggaaguccacugucuacccaauagauugugugugucuguguguguaugggggggggcgaggagaaagagaaagagagagagagaggagagagagagauguauuuguagauucacgagccagaaugaguauuguggugaucagaggacaucuuaaggagugaguuucuccuacuguugcauggguuuggcuucaaggauugaacuuaggcuaccacacuuguaaggcaaguugaaccaaccuguagguauuuuuaagaguauaaguguuuaaauucugucugccaugauucuaauuagucaaucucuuguauuuaguugucagagaauauuuaggaacaauccuguaaguuccauuguaauuuuaucuaacuuuaaucaccagcaugaauuuuuugcauuuacuuaauaacccaaaacuuuuaccauuuuuuucuacugaaaauaauuuauuuugaaaagauuuuccccucuagaaguacugcaucaaauuuuugaaauaguuuuguaauaaagacaaaaaauaguugcaaauuuauguugauacauaacauaccuauaaucccaugucccaggccagcuugggcuauauguuuagcuagacgcugucuuaaaaacaaacaaacaaacaaacaaacaaacaaaaaccaacaaccacaagacauggugguguacauguagucccaguacuugaaaggcagagacaggcagaucccugugaaucugacugaggcccaccuggucugcaccaugaauuccaggacagcuagggcuauguagagagauccugucucgaaaagaaacaaauuuuuuucuacugugagauuauauuuuuucaguauugcuaaguauuuuccccuaaaguaccacucuuaauaauguucauuuuuauuauaacuccuauguuugucaauguaguucuuucaagucucaaaacauguuaguguaagaagaaaguuguuaacucugaacucuucucucuagcacuuaauucaugaaacauggauuuggguuaguuaauggacauggaggccagccuacuuugggaauuauuuuuucugaaagguaaagggauauguuugugauagguuagcuuacucugcccuucuuuagaaaugauacgaagaucuuugugugugugucugugauuuaacaaauuaacuucuuuguucuguuuuaugguggugagggaacuguaaaagaugagagccagaccuuaggcauuccagcagccuuucuuccauugagcuguauguauaccaccaaccagauaacuuaguguugaauguucaccaaauucucuuuaggaaaggugguagaaaaugaaaguuucuuaguguucuucuuaaaacuuuuuuaaaaacuuucauccucuauuacaaacaaaguuucugaucuuucauuuucauucguaucucaggcaugagauacaaaguuugcaacagaaaaauugggaucugcaccaggugucuaugaguucugggaggaauggacgguuacauggugucuuccucuuuuuguuuuuaguggcucugcaggaacuaagcaguguuuucaggucaaaaagugucagugagaacagucuguaguuuucaucagaaggaaagguugucaucugugccggcuggaacucacugcucacgugggaagaauguuagugccuccagcucagcaguggcugaggacaagaagagggaaugucacuugcccaccugucaguaugcuuaccucauguaugauuguaggggaaaaugcccguaggcagcuuauuuuaaauauuuaugaauuuuagugaauucuuguguugucuuaaccauauuuuagccagauccacaugcuaauuauuaaauauuucucacauauaaaauaugauucugaauauauggacaguaaauggcauccgauuuauaugguauccauagguuaucauuguaauuuuucaucccauuauuucauacacauuguaucaugaauaaucaugaauucauuuaauauucucagguuuucucauuacugccaaagugugaauuccugcauaagaaaaaucucagaucccagcaacaacaacuugggaaguuuguacuaauuacuauauuuguugacauucuuucuuuacaguucuuuauuguuggaagguguugaaccccugaguacaugugaacuagaaguggaugccguagcugcugacaucuuaaauaggcuggacauugaggguaugcgcaugauuauuccugauaugcauuguuacucacaaaauguaaugagaaagcagagcagagguguuaccagagaagugagauacggaaggagaaggcaagguuuaccugcggguuauauaccauggacagaaguuuagacucauuucucaucaguguuugaauuuuacuuaguuuguguguguguguguguguguguguguguguguguguguguugguggugggggguagggauggguuccauccaaaaaauuaaaauggacgcaccaugauaaacuuggaauagagauaauuugcucauuauagcacacaccacauuuuucuaaaauaauaucauaaggcaugauaguacaugccuuuaaucccagcacugagacgacagaggcaggcagaucucuguugggucccaggccagccuggguuacaugaugaguuccaggccagucagggaugcacugcaaacuagcccccacuuuacuuauuaaaguuuaagaguuuauagagaagaguguuucacuuugacccuuguaguauuguugugauuguagcucagauugguggaaacccugggcugcaggccauaugggaagaugaaaaacagcggagaagaaacaggaacgaaagcucucaaaucagccagcccgagucacaagguaaaggcccaacaaugcucugaugcuucuaaugggaaaauagugcucucagcacuaaauguugugucuuaauuaccccuaauuuuucuauguaaaucuccuguggucauugcuguacaaccaguaaaucuuuauaauuaucuacaaaauaucacuuuauuauagucaucccucugucucuguguucuuguuuuaugugccguaucuucuugacacaguuaguuguuuccuuuccauccucaaauauauucuugucuucuuuuuccgaauaagguacugaaaccaugaaucccugcucagaaacaccuuuuuauuuguucuacuuugaaaauguuggccaugaaacauugucuucacuguucucugaaacugucauauaaacgcaccuugaucaucaugugaaacugagggaaauaguccuucguaauuaaauguuauaaucugaaagaauuugaaggcucacacacuguagaugcagcaaaauuuuaaacauaaaaauguaaaggacagcucagaaaacacaugugaugagucucuuugaaacccaguccaaaauuuacaugucacuguaauaucuagcaugccagaaaugcauugguaaaauuuaaguaucucuuucuaugcucuuuaaaauagaaauguauuuuacaaaggaggaaauuucuaauuucaggguacaugauguauuuauaaauagagagcaauaguuuuguuguuguuauucuguuuuguuuuagguuauaauuauagaacuuaaacuugaagugguaauaaguucuuaauuucauuguuuaauaaccuccauuucccuuuuguaugauccuauaacaggacugcauuuagauggugggauaugggccaggagaaagauaaauugcugugauuuucaaagcuccuuuaaggagaaaggaaaaguauuucaucacuugcuaucuaauguacauuuuaaauuuaaagauugcagauuuguaccagcaacagaaagugaaaaacaauuucagaagagacuucaagaaguucucaaacagaaugauuucucaguguaagugguuauuuauuggagaucucagagcuaaauuuacuacuuuguuaaauguuuuguuauaaaaaguuauguuuuaaugaagcagaacauuaucaggaucuguggacuacagcaauggaucccaagaguucucugcugaguuaacauuacacucggagauucuuucuccugaaaugcuaccguguucaccagcuaauaugauagaaguccacaaagacacagauuugagcaaaggugagauuaucggauuaucuucucaauuaaacaaaaacuacuaaaacaaacauuucauuggacacucauguuaguauuuggcuguuuccuuguuuguuuuaccccucagaauaaauauggauauagcaaaaauuauuuccuuuucuuugacccuuucuaaaucucuaaagauaaacacuguagucaaguuucuguaaacuguuaugauguaaaauuuuaugaugauuuuuuauauguguauguccacaguaaguacuguuacuuaauguuucaaauuuuauacaaagccacuauuggcauaaauuaagcgacuagcauuuucauucaaaauguauuuuuuaacagccaauugaggaauaauuuggauagcacaaauucauucauuuuaaguacauaauuacucuguaaucuaauuuuagaaaauauccaucagcccuacaaggcuuccuuacuggcagucaugaccauucucagcuccaguucccaagcaaccauuuucuuagauuguugucugucuacauucuuagauaugucauaugaaaucauacaauauggcuuuuuuuucuucuaccacuuagcaaauauuuucaggguuuaugcuguaguaauuaucaauauuucauuucauuuuauuaccaaucauuauauuuguuaauucacuuaucaauugguagauguuugaguuacuuuuacuuuugacugaauaaaaauaauguucaaaugaacaauaaaauaugaaauuuaaaauauuggaaguaguagcaaauaaaccgauugcaaaguaagcuuugcuauaaaguaaugcuuagccaaguauguuuucauuucuuuucaguagucacuagaguguggaauuuguagagcaugugguaaauuuguguuugguuuuuuaaugaaaugccaaguuguuuccauagugggcacucuguuuuauguuacuaccagcauuguguaaggcuucuuaugauuuaauguuuuuauuuaacacuugcuauuaugucuuuaauuguucuagaguauaugaaaugcuaucuuacugaggcuuaauuuuuauuucccuuuaauuuauuauuuauuaauaguagugauuaucaucuuuuuaugucaacauguucacuuugagauuuaucauugauuauucaccuuaacugcugacugcuuuacuuuaacacuuauuggucucucuacaaauauuagaucguuuucacuuuugcccagggcuacgacugccaucucaauggcuuugugcaacguuuucucuacagaacacaagugaauaguuggcugauaagaugcaugcagaaacuauguuuguacacaguugguaggcaagaguguagugaagguucuguagauuagucuuuguuucagaugugaugugcuuaggcaggaggacccuugaucacauuuaaggugccaaacaauagacugaaaugaaauacaaagaauguaugcuacugugauucuuugauguggaauuuucuuauuuuaaucuucacuuucggacuaucaggaaguugaagcaauuaaaggccauuucccauuaggaaaucuuuuuuaaagauuguguguguguguguuugugaguaugugcagguguccccucacgcugaagugacuaggagguugugaacugccugauguuguugcuggggagugaacucugcaagagcauugaggacauaacuguagugccaucucucaaguccuggacucuuguauaagacuuccugauauuuuguagagaaaaacuucuuuuauuucucccuaucaaaacuuauuccggagacaaaucccuuuuuaaagcuuauuuuauccaucuuauuucuuccucaugcuuuuuuaauucuuuaguauuuugcaugucauguuuaaugucauguuuaccuccuucugauggcuuagguuuuguaccuggggcgugaauccuucucuauccugauguaaggaaaguuuccucaagucauucuaaggcuuagguguguguucuacucuguuuuaugcuguuguugaaaauacuaugaccaaacgcaacuuggaggaggacagacggguuuauuucaucucauguuuccagguaguaguccaucacugaggaaaguaaggacaaguacucaagcaggaguagaggcaaggaccauggaggagagcugcuuccucuggcuuccucagcugccauuccuacacagcagaagaccaccugcccacagguggcacugcccacaaugggauggaccuuccuacagcaauaagugauggagaaagcgucccucagacaugccccaggccaguuugauccaggcaguucccaguugauaugcccucagaucacugugaauuguguuggcaguugaagcucacuaggagacuaguaauccuuugaacuagacacauaaaccuaucacuuuugccauagcauuuucuuucugguuuauguacaagaucuuauacuaccaugauuuaaaauagucuaacuuuuaaaagccccacagucuuuuaaauaaauuccaacaguuuaaaagucuagauuuucuuuaacaauccugaauugucuguauuccuuuucuccauugccguuauaaaacuccaugaccaaagcaacuuggagaagaaaguguucgggcguacaguucgagguauaggaguccaucaccaucauggcaagacaguguagcagcagggcaucuguggagaaucaccucuuaaaccauaccucaaaguucacucugaagcgacacacuuccuccaacaaggcucugccuucuaagccuucugucuuacuuuuuuuucucuugcuguguuaaggugccauacccaagacaacuugucggugaaacaauuuauuuggggcuuacaguuucagagagugagccuauaaccaccauagcagggagcauggcagcaggcaggcaugguacccacuagcaaaugagaaucuacauccugauccacaggaaagaggcacugagagagagggggaugggagagaggggaaggagagagggagggaacuagggagggagggagggaagacuaacagaguggagaagauguuggagcaucaaagcccaccuccagugacacacuucuuccaacaacuuguaauccuucccaagcuaacugaggaccaaauauccaaaccucggagcugacuggagccauucucauucaacauauuauauuuccccaaagagacccagcaacuacagacaaaauauucagaugcccaagaugauagggaccaucucauucuagccaccacagugucuuagcuaggggcaccuauaagaccaacaaaacucuauaaaccuuuguauacaaagagggaagaaccauggcacaguuaacgucaaaucaaaacuaacauccaauaauguaaagaacucggugcccaacaccugcgaccucuucgugaucuucugcauuccgaagaguuggauaguucugcuucuuuuucucugccaucccggcacaugggacaugucucagagacucguguuggcugcacuucagaccuugguccuggcauuucuggcgugcuggaccuccaccgcaccaucaucaucaauggcuacucuugggcucuccaaggauuccaaaucugccacacagugcuagaucucagcugcucucuguguccucuucaaucuugcaucugacaugcauauuaccauguggaggaugcuuaagacuucaaaaccaguaccaggcagagauaacuuuuaggugccagcuugauacgcagucuuucucccaccaccacuacaacuuguaugugcugacauaagaaaacacuucccagaagacacuuccccgugaugcugaugacauauuaaucauagauggauuuccagccacagcuaagcagcauccacugcuccaguaaagcacaaauuuuccuugcaccaauuccuuuguguguuugugacauuauaacauugucccuucuccuuccucccuccaaaccuuccgcuuaagccucugcccauacgucuucaaauucauggccucuuuuuuuucacuaauuguuauugcguguauauuucuaaauauaaccuuuucagucuguaugauguguguauguuuucaggguugaccguuugguacugaacacccaauuggugugcucuucgcuagggaaggcuaccucucuugccuccagcuuuucucaguugcccauaguucuuuguauaggguuuaggucuuacacuucuacagauucuuaauaaaaauauaucacacaaauggccucaauagauuuuuggggggauuccuagcucuccucugaaacuucagaagccaugucucccaaugucuccauuucucugcacaguuuuuaccuucuaagcucaccauagcucauuaggucuaagcacuuaguggcuuuaccauccuaaaguucugaaugguuccaccauccuccacaagcccagcauggucccuucacagcaacucuccacucucaggaccaaugucuauccuaguuuuaguuugauuuucucuuucugugauaaacaacuuguggagaaaagaguuggcuucauucuggugucaguucaucacugcucaaugaagaagucugggcaggaacucaaggcaggauccuggaagcaggaacugaagcagaguccacagaggaacacugcuuccuggcuuauacccagguccuuguuuagcuuccagggguauagcaccacccacagugaguagcacaugucugcagugcccgugaaggccagaagagggcaucagaccacuuggaacugggcguauagaugguuuucagcugccauguggaugcuagguauaaaagcugaauuuucugauagaguagccgguucuuuuaacugcugaaccaucucucauagccucuuuuucucauaucuuaauggccugccacaacaucaacaaugaugcaggauaaaaacuuuggugaucagggucuucaaacccagcacuucuuuuuuuccuucccuuuuucuuuucuucuccuaguccucuuccucaauuuccaccuuuucuuccaccucuuccuccuuucuuguuuuuuguucuuugagguuguuuguauuuuuuuuuuuaauuuuuguuuucagccugggugagccuagcacuuucuguauaagccaagcuggucuugggguggucuuuaugucccugucuucucaauguuggcauugcagguauggagauauuuuuaaaaaucacuaagacugaaauuuacauaggaucaugguaaauguacuuuaauuggguuaguagccuuuguuauucuuauuuugcuagaaguuguagccacuuaauauaugaugaauauuagauugagauuuacuaaucuucugaauauauugaaauuagucuuucuuuuauacucuuaauauggugaguuacguuuuuuugaauugauuuauuuauuuuuauuuauuuuucuaauaguuuucuuagaauuguauguaucagugaaaaagccauacuuuccucauuaaauaaguuguaagguuucagcuucccuuuugagaagucuuauuaaguugggaucaucugucucuuucggguuucauagauuaaacuccccagccccuccagaugcuagcauuguguugacgggcuuuccuuguaaaguagcuacuuaacucugcucugguguucuucuguucugcuuugagucuguuuuuauaccauuuccccuaagacauuacccauuuucugaguuuuccaggguuuagcacaaagcugcugauaguauuacuuaacauuuuuaccuguagcauucuuuuguacuguguauuuaugcuuuccccauaacuacuuugaucauuguuuguaauuaucuguaucaucauugguuucagacaaccaggauuuguuuuuaaccaaaugcuuauuuuagaaaguuguuuucuggguuuugauuauuuguuuguuuguuuugauuaaauacucugucuuagaucuacuauuuuguaguauauuuuauauaaaaauauuuuuccuauuuaacuuccaauaaaucaaaagcauuuaagugucaagucaguuuaaaugucuaagcaaaaacuauuuuuccaguuaguuguaauacuugcaguuagcugcugauuuuguguguguagucagucucucccucccucccucccucucccccucccuuuaauauaugcuuuuucuccuccuccucucccuuacuagauuuuaauaugggguucucaaaauuauugauucuuuuugggcuuuagacccucuuuuacauguugaaagaaacuauuuuuagguaacaaaugggaagcuuuugaaaaauauacaauuaaugcaaaagggaauuuacuuguuuuugaaccacagagaacaaaacaccauaccugccuauauucccagcauuuaggaguggaaguagauuaucaaaaguuaagaucuuagcaaguuacgggccagaugagacuacaggagaucuuaucagaaaacgcagcaagaacaaagacacacacacacacacacacacacauuguaugucucaauacugauuuuaucagaguacuauaacuguauggauauaauaaaaugcagaagcguuuaugaguacuuggugauguauaaauucauggugcuuugcccuuuguuuguuucuguuguugagaggucucacuguauaggucgagcuagacuggagcucacuggguagagcaggcugguccugaacucagggaggucugccugcauauguauuccucccucugcuggggucagagaugugugucacaguguucagcuugcuuguuuauuuuuacuuuuuaaaauacaugugauugauaaugauauucuuuggacuuuuuuauuacauucauauugcauuuuuaguauauuucaaaauguuaaaguaaauuuauacuguaauauucuauaauuuguacaaauucuauauuguguaagcugauagguuuuagaaccaaggcauugccuuaauauucuugucuucuuuguugucuuaagguaauacuaaacauaaaguagaagaagcacuuauuaaugaagaagcaauuuugaaccucauagaaaauagucagacuuuucagccuuugacucaaagacugagugagacaccaguuuucaguaaguagcaacacuaccuuaaugugucauguuuuaaucaaaguaaguuucugguugguuuuuuuuuuuuccuuugauuugaagaagugaacauuucacauuaaguaaaugcugaguauaaaaauuaguuaucucauuagaucaaguaguucuauguuuucucauuuuuccuuaaaaaaaauaaauaaacaacugugaaagaucuauaguucuugaacuauauuguauaaaagcauauugcuuuagggguaaaacaaauuuauuuuguuuuauuuuccuauuuucuauguguauaguaugcauauaaauguacauguucuagcauguguaaggauaagcagggauguguuguguccaugcaucuugaggcuccagaacaaugucagaacauccuuaauuguucuucaaccuucuucacagagacagaaucugucaaacccacagcuuacuguuacggcuugucuugguagccagccugcucugaaaugcccuucuucaccuccagggcaagagcuacaggugggcugcucugcccuccaauauuauaaggguuccuggaggucuaaacucugguccuuacacuugcagaguaaguguacacuaacuacugagccagcuccccaccaaccaaacacacucauuuuaaaacaguauccaaacgaagcauaguaauaaaauuguggaugcuucucugugguaggagggaguuuacauguaagccaggaguccugaagaagcacaguguuuucugaguguuguuuuaccuccucgaugcauuucagccagaagcaguuaucuaugugucucaguuugcuugguaucaccaauauuacgcugcuuccuuguuugucccuuuaaguuuuuauauugcauauuugaauuuuuuauguauucuugcugucuaucccauaauauaaaaacuuccuugagaagguauuuucacaaaagcuaauguggaaaagaaaugaagggagauucccaacauccaccuuagaccucuacuugcgcaugcacagacgucugcacacacauuugcacccauaccacacacagaaacauaaaagaggaaaaaaaauauguaugucacgacagcaggugugccaguugauuuggggaggcacugagaggaaggugaaagaggagaaaaagguaauggaaacguagugaggugauaugaaccaucaguucauaugcugacucagaguggacaucagaggugugaaaccaccagaaugcuuucagcuuucuugcauauacaugugguaguagaauuaauggguuauguaguguggauauaggggaaaauaagcucgguuucuccuauauuccucaccacaacagucaacacagaacaagucugugacuggaugucuaggcauuuucccacauaccaagcaagcugucaguuuuggaauggauaucuccuugauguucucuagcucaauucaguucuaaccugcaucaaccuggagauuaaaucagaauccacaggugagggcucccauuccccuucccaaggcucaauagauuugauugagcagaucaccaaacuagggcaagcagacuuacuacugaauuaguuaaaggcucuuacaaagguuaccaauaacagccagaaucaaugaguaagucaagggauaggagaaaaugcacagagcucccauguucugugccagcuucuaggaacauaccugugugugugugugugugucugugucugugucuguguguguguguguguguguguguguguuguuguuguauguuguuuuuguuuguuuacuugagcuuucugaaauguauauauuguacacugaauauauccuccucauucuugguaauuccuuuuucucaccucaccuucccuccuguaaguccauuuagaccagcaguucucaaccugugagucaugaccccuucgagguugaaaugacccucuuacagggguuaccuaaaaccauuagaaaacacauuacaauucauaacaguagcaaaauuacagcuuugaagcaacagaaagguuggggccacaacuguagaaaaggguugcagcauuaggaagguugagagccacugguuuaaucaguuuuacuucuacuuucaaagugugugucugucugucugucugcgugagagagagagauccagauugagauuuuagauuuuaugugucuguauaaaaucuggggaccacaaauggaagaaaaugugcagucuuuggggucugugaauauuucauuaugugggcaugacugauugcccagugugauuaagucaaccaucaguuacucugacuacacugcagguuggaggauggaacugagagucaacucuaaucuugccuuucucuuucugguugucaauauccauccugucauauuuagcauauuaaaagacacuuugaagauuacaaagauuuuagauguaugccagaaauuaaggaaauuuuacaaccugaccaguaguaaauuaagauuccaguuucaucacagccuuuucaauacuugauauuaugugacuuuguaacuuuaaggaucuuagcauauauaguauggcuucauaaaaauugagcuauuaacucuuuuaacgauucucaacuagauuuuauuuuacuauccugugaguauaguugaaguaaaagauaagaugcuuacaugauuauuucuuauacuuaguuaucacugcuuuggguguauuuaauuuugaacacuuauggccguauuuucuuuagugcucuucauaccuagguaagccugggaaauucuuuaaaggcaccgaucucugagcgcugcuccagaaauucucauauagaugagagauggaaccugaaaaccuucacuuaaauaaagucacuaaguucuugucauucggaugguggaaggcacucauuuugauaagggagcuacagcauuaacaccugagccuuugcaccaauuacacucuuacagugugugucagcguccauugcacuguuuugagauuggucucaacuguuagagcauuuggaaaccuuaugcuauuuuuuuggugauugauuugcuuguuuuauagugggcaguaguccugaugagucgcugguccaucuucuugcugguuuggaaagugauggauaucaaggagaaaagaauaggaugccauuaccaugucacuccuuuggagaaucucaaaacccccaaaauagugacgaugaagagaacgaaccccagauugagaaggaggagauggagcuuaguguggugaugucccagagaugggacagugacauugaagaacauugugccaaaaagaggugauuucucuuaaaaguuauuucaguuacucuaacacguaccuuuugucacugcugcacuucaguaaaaauuuauuguuauuauucauacuguaaaaugcccugagaacuaaauuaacuuuccaaaucuccuuuaaauaaugacuuuuuucauguagcauauauuuaauauuccaagaaaugucauguucugcuacauucaaacaaacaaacaaaccuagaaacaauguguuuuauauacagugccgacaccuauaaggacaaauggguaaaacuaaagcuccuccuuaccauagaacucggaaaguaauucccgagaguaacuguuaacagagcuaaguagcccugugcagaguccacuuaaaaauaagugacucucauauccaauuagccugaguuaauuacauaguaauagaagcaaauagcuggcugggugacauaugccuauaauaccagccaaggcuacaaagugagaaccuaucucaaaauaaagucuccgaaguaggcacuguuacuuugguuuaagaucagucaguaagacccaggugugauggugcacgaguuuaaucccugcacucguguaguaaagguaaaugggucucugugaguaagaggcuguccugguuuacacaguaagugccaggccagauagagcuacggaauaagacccugugucucaaaagaaagaaacaagcagaacugauauguuauucaggguucucuaaaggaguagaaaugauagcagggauguauguuuaugcuuauaaugaguauauauaauguauaauauauauuaagaggaacccauuggauuggcuuacagucaagaaaccaagaaucugguagucacucagucuaugaggcagaugucucagccgccccauucuguucuugaaugccagcaggcuuccuggguauucuacauuggauggacaugcuggaaacagugagggcaagcaggcaagaagcaaguucuuuuccauaucuagggcgccaccagagggugcugcccacauuuagggugggacuuccuguuucaaauaaucugauuagaaaaauccuucacaggauggcccagagauagacauuucaguggauuccuggucagguuggcaaccaagaguagccaucacaaauggcauugugauuagcugagcagccucugggagcuugaguaguuugagucugccucuaaaacucaaacauuuuaugaccauauuagagagaaauugaauaauagaaacagaaagaaauuaguuaaauguauauuaaauguuauguuuagccauguuuaucacaguuuaagaagaaagaaaauaaagggaaagaaaaggaaggcuagaaagauuggugaacacuuuuauuuuuuauuuuuuauuuuuugugguguuuuuuuuuuuuuuuuuuuuuuuuuauugugacagggcuucucugugcaguccuggcuguccuggaacucacucuguagaccaggcuggccucgaacucagaaauccgccugccucugccucccaagugcugggauugcaggcaugcaccaucauuaccuggccaaacacuaucauuuuaaaagaacauuugaauagagacuuuuuggucuaauuagguagcuaagggagaagugaucaacauuuguagauugaagauuaacauguagaaaauggcacauacccauuccuuauguggcagaggauaacucaugaauacuucauggaaauugaaaauauucaugugauuguuauaucaaaaagcaguuaucugcuaagagagucgguaguaagagaguuauuguaugagacagcaagcuccugaugcagagaauaugaaaacaaaaauuaucauuuauuaaauuaagauuuuuacaucagauaaccaauuugauuaaagucauuauaugaugucugauguaauaaguuucuuuuagcacauaacugauuuuaugacaaauugugauuguaaaaggcuuaaaggggaaacuguucuguguauaacaaagagauguuuucaagcaacugaggccagagggaacaaguuggguauggaaagaaagacuuagauguaucuagaugggagugaaaguaucagacuaacauaaauaugggauagaacuuagaggcucuaaaccucaauucaucuaaaacuuucaggaaccuugcaacucaguuaccacauugucuucuagcucuuuuuaggucacugcuacuuucucuugagaaaaucucuugauauuugaaugccccaucucaccuuucuugauuuucauuucauaguuuagugaucacuguaugaauaccuuaaaauauauuaggaugcuacauuuuuagaagucaccuaauucucauuuguuauauuuguauauauccuauccacagauaguuugaggggagaacgugagcaagggcaugacuauauaggauaauaauccaagauguuguggcuauaauguaagaauuauaugcugggcagugguagcucaggccuuuaauccuagcacucaggaggcagaggcagagacagaaggaucucuaugaguuugaggccagccuggucugcauaguuccugaagagccagggaaaccuaucuugaccagaagaaaaaaagaaaaagaaaaaauaauuaugaugccuucuaugucacaugaaugagauuauaaauccuguuuaugguaacuuuuugccgguccuguagcagugcauguuaauaaagcaaaauaaaccucuuucuuuuuaaaaugcuacuuccauaucuuuauauuuuuuagugucauaaucaagucagaaaaauugcaucuaagaugcaccuuuuucuuuuaagaucuuacuuuuauuuuaugggucugaguguuugccugcauguguaucuguacaucacgugcauguauugccuacagaaacagaagagaguaucagaugcccugaaacuggagauccagacaguugugagccaucaugugggugcuaggacugaaccuagaguccaguguguuuaaccgcuaagccaccucuccagccccaaaugccuuguuuucuaaugacuguauucaccaaugaguuguaaugcccucuaggucacugugcagaaaugcccacagaaguucuaccgaagaagaugacucguccucagaagaggaaauggaguggaccgauaauaguuugcuuuuugccaaucucucuauaccucaguuagauggaacugcagaugaaaauagugguaagaaaacaaaccuauuguauuugguuauuuagugacucaaaauguauuuuauuugugacauauuuguguuguguuuaagugauuauaauuuaucuuuaagugacuacaauuuaaaugacuauauauugugguuuuuuuuuauauaagugacuauagcugugugauugcuuauucuaaagaggguaggauauuugugaguugcuugguugaaucuauuguaucauugaaguagcauaagaaacuaagaaauaugcuaacaugaggaagcauauuauuuuaugaaaaagcuuaaauaugguaguauuuuugcauauuccuuuaaaauuacuauaacauuuuucugaucaaaagaauauauguuuaaaauaaugacuaguauggucucuugauuguuuagauuguauaauuucuuuuuuucaggucacuguuucagacauacaaacuuaauauaaauucuuccuuaagaaauuaacacugugagugaauauauucuuuuuuuuuucugauuuuagacaauccauuaaacaaugaaaauucuagagcccacucuucugugauugcaacgagcaagcuaucaguaagacccuccaucuuucacaaagaugcugcuacauuagaaccuccgucuucugcuaagauuaccuuucaguguaaacacacaagugcccuuucuucccauguuuuaaacaaagaugguuuaacugaagaccuuucacaaccaaacaguacagaaaaaggucgagauaauucagucacuuuuacaaaggaaaguacuuacuccaugaaguacucuggcucuuuaaguaguacuguucauucagauaauucccacaaagagauuuguaagaaagacaagucuuugccgguaucuuccugugaaaguaguguuuuugauuaugaagaagauauuccaucuguuacaagacaaguaccaaguagaaaguacucgaacaugagaaagauugaaaaggaugccucuugcauacaugugaaccgucacauuagugagacuauauuggggaaaaacucuuucaacuuugcugacuuaaaucauucaaaacguaaauuauccucugaaggaaacgaaaagggaaacagcacaucucucagugguguauuucccucuucgcuaacggaaaacugugacuugcugccgucuucgggggagaacagaaguauggcccauucucuugagagcaucacugaugagaguggacuaaacaaacuuaaaaucagauacgaagaauuccaagagcauaagauggaaaagccaagucucagccagcaagcagcacauuauauguuuuuccccaguguuguucuuucuaauugucucacuaggccacagaaacuuucuccugucacauacaaauuacaaucuggcaauaaaccuuccagguuaaaauugaauaaaaagaaauuaauaggucuucaggaaacuucuaccaaaaguacugaaacuggagccacaaaagacagcuguacacauaacgaucuguacacuggugcuuccgaaaaggagaauggauugaguagugacucagcuaaagcuacucaugggaccuuugaaaauaaaccaccuacagaacauuuuauagacugucacuuuggagaugggucguuagaagcugagcagucuuuuggacuauauggaaauaaauauacucugagagccaaacgcaaggugaauuaugaaacagaagauagugagucaaguuuuguaacacagaacucaaaaauuagccuaccucaucccauggaaaucggugaaaauuuagauggaacucucaaaucccgaaaacgaagaaaaaugucuaaaaaguugcccccugucauuauaaaguauauuauuauuaauagauuuagagggagaaaaaauaugcuugugaaacuagguaaaauagauucuaaagaaaaacaaguaauauuaacugaggaaaaaauggaacuuuauaaaaagcuugcaccuuugaaggauuucuggccaaaaguuccugacuccccugcaaccaaauaucccauuuauccacuaacaccaaagaagagucacagaaggaagucaaaacauaaaucugcuaagaaaaaaccugguaagcaacacagaacaaacagugaaaauauuaaaagaacuuuaucuuuccgaaagaagcggacacaugcuguccuuucuccucccuccccaucauacauugcugaaaccgaagacugugacuugaguuauagugacguuaugucaaagcuaggcuuucuuucugagagaagcacaagcccuaucaauuccucuccaccacgcugcuggucucccacagacccgagagcugaagaaauuauggcugcugcagaaaaggaaucgaugcuuuuuaaggguccuaauguauauaacacuaagacuguuaguccucggguaggaaaagcuagucgagcaagagcacagguuaagaagucaaaagcaagacuugcuaacuccucuguaguuacuaacaaaagaaacaaacggaaucagacaacuaaacuaguggaugauggaaagaagaaaccaagagcaaagcagaaacagagagccaaugagaaaagucugucaaggaaacaugcaauaccugcggacgaaaagaugaaaccgcacucugaggcugagcucacaccgaaccaccagagugugucugagcucacaaguaguucuggcgcucaagcacuuucuaaacagaaagagaugucacagacaggcccugccguggaucacccucuuccuccugcccaacccacuggaauuagugcacaacagcggcugucuaacugcuuuuccucauucuuagaaagcaagaagucuguagauuugcgaacauuccccaguucgagagaugauucacauucuucuguuguuuauaguucuauagggcccggaaucucaaaaauuaauauucagagaucucauaaucaaagugcuauguuuacucgaaaggaaacaaccuugauucaaaaaagcauauuugaccuuucuaaccauuugucucagguagcacagaguacacagguauguucagguauaauaucuccaaagacagaggagagcucaaguacacaaaaaaacugugggucaucuaugggaaaguuaaaugaguaucgcaguucccuagaaucaaagccagaacaagucugugccccuaauuuuuugcacugcaaagacagucagcagcagacugugagugugucagaacaaucaaaaaccagugaaacuuguucuccagggaaugcagcuucugaggagagccagacaccuaauuguuuugucacuucuuugaaaagucccaucaaacaaauagcaugggagcaaaaacagaggggcuuuauuuuagauaugucuaauuuuaagccugaaaagguaaaacaaaggucauugucagaagcaauuucacaaaccaaagcgcugucucaauguaagaaucaaaauguaucaacaccuucaguauuuggugaaggacaaucugggcuagcuguucuaaaagaauuguuacaaaaaagacaacagaaagcacaaaguacaaaugucguacaagacucaacgucuacucaucagccagauaagaauauuucuguuucuaaugagcauaagaaagcaaauaaacgaacacgaccagugacuucuccaagaaaaccucgaacucccagaagaacaaaaccuaaggaacaaacccccagacgucuaaaaguagacccucuaaaccugcagaccucuggccacuuggauaauucccuaucagaugacagucccauccuuuucucagauccagguuuugaaaguuguuauucacuugaagauagccugucuccugaacauaauuauaauuuugauauuaacacaauuggccagacuggauuuuguagcuuuuacucugguagucaguuuguuccagcugaucagaauuugccgcagaaguuucugagcgaugcuguucaggaucuuuuuccaggacaagcuauagacaagagugagcugcuaagucacgacagacagaguuguagugaggaaaagcaccaugucuccgacuccagcccauggaucagagccaguacuuuaaaccccgaacuuuuugagaaaguagcuauggauaacaaugagaaucaucggcacagccaguggaaaaauagcuuucauccucugacaucucauucuaacucaauaauggaaucuuucuguguccagcaagcagagaacugucuaacagaaaaaucaagacugaauaggaguucagugaguaaggaaguguuucucagucucccacaggcaaacaguucagacuggauucaaggucauaaccgcaaagaagcagaucagucucuccacucugcuaauaccucuuuuacuaccauacuuuccuccccugauggggaacuuguggacgcagcuucggaagauuuagaauuguaugucucaaggaacaaugauguguugacaccaacuccugauaguucaccaaggucuaccaguucucccuuacagucuaaaaauggcaguuuuacuccucgaacugcucauauucugaaaccacuuauguccccaccaaguagggaagaaauuguggcaacuuugcuagaucaugaucuuucagaagcuauauaucaggaaccauuuugcaguaauccuucggaugugccagaaaagcccagguaaucagaauuaauccucccccaccuugggucacuuugaauaauuuuuauuucuauaauauuucauaacugauugcuagucuucuagcuguguuacugcauuuuuaagaacagugaagaaaauuauuuguaauuauagacugauuaagcaaauucacaaacuagaaaacuguaccuagagaaauuaaguugaugacucuuagacuuaaauuuacuaguacugaauuccaugucaccauuggggauuagaggagcaaggaaucacuuugacauguugcagaauuugaaagaaugucaaaauaccucaauguauugcaggagaaggugggaaggagggacaaaaugaagagacuauguauguacaugaaaauuugagguugagaacugaacccaggggcuggagagauggcucagugguuaagagcacuaacugcucuuccagagguccugaguucaauucccaguaaccacaugguggcucaugaccaucuguaaugagauccgauucccucuucuggugugucugaagagagcaacgguguacucauguaaauaaaauaaauaaauauuuaaaagaagagaaagaaagagaacuggauccaggaccucacaucauaggcaagcacucuaccucgggacaccccacaaugguccuuuuugaaguggaacuuuuacucaauaagcuuuaauauauuuguauauacugugugugucuguguguguaagcauaugcauuucagaaguauggaggucagaggacaacuugugggaaucaaguuguaccuuucaccacaugggucuugaggaaucaaauucaggucaucagcuuggcagcagggccuuuuucuguagaaccaucucaccagacuaaaguuaagcuuuuggauuuuuuaaaaaguuguuucuuuaaaguuuuuguuugucugcuuucugucacugugagacauauuggauaccgcccagucuguaaagagaagaggucugucugaacgcauaguugaugagcuuauuacgucuauggcaagagcacaucagcauaggcauggguggcagaggaccgaagagaggagacuagugccugucacaggauuuucccuguccaguuacguuagugcagcaggaggucugugauuagacagggaauauccugugacuuuuuaaaaaauagcuaaucagauuuauauuucaauaaaucucaauuuacaagauaccaauccaauaauuucagaaccaauugauaaugauaaaagcucuaucccaauuauucuaaucuuauaauaucauaacuaccuguggcuguuaaagccacgcugauucacaucugccuccaucuuggccuucccucccugucucugcaacucuucauuccaccucccuuuucccagucuaaucacaggcauuggacagggaaaauccugugacaagugcccauacucuaaagacuucucaccaaaucccaucuuaaaguuucuggcaacuccccaacucccaagcuagggaccaaaccucugguguucugccaguuucaaaguucauauguuuauaucaaacucagguaccuaacagaauggaauuauggcaguucaccucagcucuguagaugggaauuuuguuugauacaugacauugaacccuaggccucgugguauaccaccagcaaguauaugcuuuuuuuaauauugagagaauuuaaauacaaagucuuguuugaaucaauuggcuuugcuaaacuacgauaggcacagaaagaguuacagaaagaggcuauagagaaacgcaugauaacgucauuguuuuaaaucuauguauguugacaguggaacaguacucuaaaguaauaaugaauagcugaggagaugggugcucugguaaagucccugcugcagacgaaugaggaccugaguuuggacuccgagugcucacaggaaaucuggacccuugcccauaacccuagcacgggaagaguugcacccaugcagaucucugcagcuaauuggccauccagcuaaucaaauuaaugaacguaugguuuaguuugaguugcuaucucaaaauauaagguggggaacaacuaagaaaggaugucacccucuggccuccacauacgcuaacucggccauauaaaaacauacuccaaacacacacagagacuaauaauagugauaaggauucugaugaguuagugucaugggaugcuaaaauaaaaauaaaaguaaaaccuuuuuucuuuugaauuggugcugccuucuaaaagaaauuaauuuuguaguuaaauagaaaagcauauuacuagcugcagauagaguauuuugucugcaauuggggugaauggggaaaaagaaauuguuauauuugagacaccaaagaggacccuaagucuguuagauaggaacuuauuuuggguaauuauuuauugaaacagaaacauuuauucuaaaaauguauuuauagggaaauugguggccggcuccuaaugguggaaacucgacuuccaaacgaccugauugaauuugaaggagacuuuuccuuggaaggacuucgccuguggaaaacagcauucucagcaaugacucagaaucccagaccaggguccccacuucguaauggccaagcaguugucaauaaagagucaaguaauagccauaagaugguagaagauaaaaaaauuguaauuaugccuugcaaguaugcuccaagucggcaacugguucaagcauggcuucaagccaaagaagaauaugaacguucaaagaaacucccuaaaaccgaguuaacuccagugacaaaaucugcugaaaaugucagcccuucacuuaauccaggugacacaugugcagucucuccacaaguggauaaaugcccacauacacuuucuucuucugcacauaccaaggaagaagucaguaagucucaaauugcuuugcaaacaucaacuacaggaugcagucagacacugcuagcagcugccucugcagcugucccugaggaagaugaagaugauaaugauaacuguuauguuaguuacagcuccccugauucuccagguauuccaccuuggcagcaggcagcauccccagacuucagaucauuaaacggggaugacagacauucaucaccaggaaaggagcuuugcucccuagcuguugagaacuucuuaaagccaauaaaagaugguauccaaaaaagcuccugcucugaaucgugggagccucaagugaucucuccaauccaugcuagggcaagaacugggaagugggauccacuuugccuucauagcacaccaguuaugcagaggaaauuccuggaaaagcuuccugaagcaacuggccuuagcccuuuaucuguagguaaguguagaaaugguagaaaggcaacauccuucuucaaagaugaagcauuggacuaugugguaaacguccuuggcuuguaagcgagauggcagcucaggagaugaaggauuaugauuaaugcaucaugcuuuagagaaucauaacauggaaaugcuuccaucuuucuucugcaaacaccauuguaccugucuaccuccugggcaaaguacaggagccucucagaaaccuucugaacuugauuuuccccauuggcuuuuucacauacacccaaaucuccaccaccuuuuuguuacuguuuuucccaguucugagucucaaaaacccagggccuauacauacacuugacuauugagguauauccccagccucuuuccugcugauuaauauagaaacaaccaaaaauuucccucaaccuuauaucucaagccaaauuuccuucuucaaagccaacuuucuuuuaaaaacauucucuuaaaaacagcucugcuuauuuacuuuguauuuauuuaucagccuacucuaaucugaauucugccuguaauuacacuuuuuaaaaaguuccucaaauuuuucuuauaacuaaaucuaguggaugaauuuauucuucuaaucauggcuucuaagcagucauugacauguugaccacagcuuaguuucuggaauuucucuugucuuuauuuuuauuuuuuucuacuuaauuuucuguuaaauauaucuuacuauucuuaguugucaucuaaguguugcaguuuauuaagucuuaagcuuuccuuggguuuucuccuaaaugaucaaauuccuguccauaggguuaauucugguaauuugcaaauuuguauuuccagucaggaauuuaggcaguagaacacugaccauauggcauuucugcuugacagugcaaaguacuacaaggguuaacccuuaaaucaugaucucaaugccugcauucaccaccaucucaccucaugugccccgugaguaguuacagguacaucugaucuuucaguccaccccaccccguccaucucucucucugucucucucugucucucugucucucucucucucucugucucugucucucucucucagugaauaguacuaugaccccgucagucaccagagucagacacaauauauauguagcaccaccugauugucuugguaagcaccuugauuuucaauccauuaccaaguucuuucauuuuaucucugccaccacaaccuuauguggcuuauuaucaucucuggccuaagugucuacaggccuucuuagacacucucggugcauggcaaucagaagaaauaauuuauguguaccuacuacacauauuucaguucaaagacaccaagcuuuaauuagauagauauaaauucucaauuaguuccucccucacucagaauuugguuuguaggaaauucaguugcauacagacaacugcaguccaaaaauacucuuauaauacucuguaaguacaugauccauaaguuuuaagucaugugcuauuuugaauaucaugaaauaugaaccaucucuuugucugauguaugcauucuauccaugauacccuuuuucaucauuuaguaguugucucaguacuccauccaacuguugugggauuggagcacucauguucaaauagccuuuauuuuacuucauggcucuggagcauagaaguaauggugcugaccauuuauagauucauagaugccaaggggaacaggaaaacacagucuuuuugaaacaguggggaaaauaagaauguuugagaaagagcuaacaugcauguaacuuauuagaguauauuauaauucuguuuuauuacuggguuuguuaaucuuacugggccuaguuuaugaauuaaaagcuauuauuauggggguagguagguagagcaaaacaguguaaacagaagccagagguuccagaacaaucagcacagauaagggaaacuguugucauuucacuuccauauacaauucuuucuagaauacaaaagaaacuaugucacucccuccucaucagaaacacaugauaaaugagugaauuagccccaagaguaaugacuaaguuuucuagcucaguaguaaaacauaaaugugcuuauuuuaaaauguagaaguaugaaguauuuuguagaaauuggagguuuuaauuucauuuuaaaauuaugaaaucugaaaaaaugcauauagcaguauucacaaaugauauuugauugaaacaacaaaauuugcuuuaagaaagagaagcagauguacaaguuaaaaaugaaauuucuuucuacagaaccaaaaacccagaaguuguauaauaagaaaggaagugaugcugauggucucaggagaguucuccugacaacgcaaguggagguaacugugccagacaccuacagcucagugcaaggccaagucugcgcuucagagcucucuguguacuaacuuaauguguauuauuuuugccaucauuauuuacacaucuuugagaaaaaucuaguuuuuuauuguugggauagaaaagauucuuauguguaaaugcaaauauuccagagacagugacuaugacagccagaauguagguuaugccgauacauauacauuagcugguaacagcaucagagcaucuuaucacagcagagcuuaaggaaugguucaguugcuugaguugguguucuguuguuugguuuuguuuuguuuuguuuuugaaacaggauuucucuguguaauagagccccagcuguccuggaacucauucuguagaccaggcuagccucaaacgagcagagauucaccugccuccgucucccaaguacugggauuaaaggcguguacgcccaccaccugacuaaauaagugauuuuuuuuuuuaaaucucaacaaaaauauauuuuuuucuuuggguuuuuucccaaauauuacuuaauuuuuaauuuucuucaccaaguuacaaaagaaagcagcauuauguauuauugaaguugaggaauuauaacuguccuuauucaaauacuaaagauaugauaguucuuaauugagaaguaugaaagcaguagucagguagaacuucuauacauauuagacauuaucuuuggaaauaaaugacagaaaccacuuccauauuaucuacuacucagaaaggucauuacauauaagauguauuuuuauacugaggcuauacuacaaacuuugauuuauaaagguuuugaauuauaaccuauugauauuaaaaacaaguagcagugcauuguaaacauaagucaacauguuacauaaaaugguuaaucuacuuaaauagcauaagagguauuuuaagaacagagagagcuggauaugguuggucacacauguaaucccagcauuggggagucugagacagggaucaccaugaguacuaggccaaucugggcaguagcaugagacauggcuaacaaaagagggggggggcagcaagaaaagaagaaaauuguaaaagaaauaggaagugucuauucuaaaugcuugaaagcuuuucuccaauauguguagagugggguaaggugcaccauuugcaaauguuagccaagcaguuguaaauguuaaauacuugauguucuuucaagaaaggucaagguccauauccauguagugauguaguguaaaugauauaaguauaugugagcucugccugaccacugcuuucaggauuggggcuugucaaucaggguuuguuuauagauugcauccuauucuacaguuacuaaaauaaaaugaauguuaauaaacuuuuucuuaaacuuaaagagaaucuuuauguuuaucauguucauuauuuauuacuaaguacauaaaauguuuaagcaagaauaauccaaagaaagaaugguugcuuaugcccuuucugaaugugccuuuuuuuuuuuuuuuaaauagaaucaguuugcggcaguaaauacuccaaagaaagaaacuucucagauugauggaccguccuuaaacaauaccuacgguuucaaagucagcauacagaacuuacaggaggcaaaggcuuuacacgagguaaaacugcagcuuuaaggcugcacacacuaugcuuaguuagcaggauuuguccauaggacaaggauggaaauguuuaaccagaaagggauauauuaaauucucuuuguugaucuccaucuugcuauucuacuguacuuguguaaaacagaaaaaaguaaauauugaccaguuacugagauugauuuauauucucacauuuuugcaaaauuaauaacuaaaauuuaguuuauagaaauuaaauuagaaaauauuuugaaauuuuagaauuauguauacaagucuucucuuuacccuuaauacauguucauucuuccuaauuaaauugguuguuuuguuuuacuuggcuauaggacagagguuuuucccuuaaaguuuuuguguuuacuaaguuaaaugugugcuaauuauuaacaauaaaaccuauaggauauaaguuucuaagaaaacauucuggggcauggggaugcuuagaagauggcucagucacugagaugcuugcugcuucagauccuagcgcccaccugugagucuuggguauggcaauguguguguagugccccuggacugggaaguaaggagaaucccugggcuucugggccagccagccuaguaagugagugagcucuaaguuaacaggaaaccuggcuucaaaagaagauggagugcaaccaagaaagacacccaccaucuauuuccagcauacacaaaugcacacugcucuguguacacacacaccagcaggguuucuaggcugaauauacauacagcugaguuguugaguuuuuaccuaacggcuaugaaaucccugauuaaaugaaaauaagucaaaucuuucccuuagcucacagcucuacucuuuguaguguuuuucuuacaaaaacugaaagauacaguucuuaggaaugugauggauuuuggguugcuuuauuauuucuguaccuuccuuauacacgcauaauuaauauuuuucauaguuuaaaaggaauguaguauauauaucaacaaacucuacauguauguguuaaagauagacaugguaaaguaagcaucuguccuacagcaggcuggcaguuuuauuccccgaaagcucugaggaguuuuacauuuuccggccucuguaggacuuuucugugcauguacuuacauuuuaacauauguaagaccccauccaguuguuccauuuaucaguauauuauagugaugucuucguaguaagaaauacagaucuggcuuguuauucugaaaaugcuaaaauuuaccaacuguucugucgucacgugaccuuuggcgcuaacuuaguugcuaaucucccaucaggacauucagguccuuccuagucauuugcucuuagaguugcaagugaacuccuucuacuuauauuuugauuaaaugagugaguuuauagcauaccuucucaggaggagaauuucuuaguuaaagauaugugcauuuuaaauuuugauagauauuccuaaauuguacuuugaauggauuugccagauucuauuccuaugacgaauggaagucaugcacuuacauuccucauuagcccucauggaucauaacugcaaauccuuucuaauguaugugaucugaauaauuaugagaagacaccaaauagucuuacuuuccaaugccagcuguauguauaugguagcauauaccaugcaaucaugaauccaggccaaauccagauguugacuuuuaauuuauuuuuacuuuuccucgucuuugagacagacuguugcuguugcccugcuggauuugagcuuguaagcugaagcucccauguguuaggauggcaggcaugcuccacugugccugucugucuugauuuuaaaaagaaauuaagaauugcaauugagagguuuuuauuaacaaagcgugaguguagaaacaguuuacugugugcugcaugcuagugagcacauauacguugucagaugaaauggcuuauuauguagucaguuucauaacaguucucuuaauuuucuuucuuaagguaaaauuaaaauuuaaaaauuggcucaugugcaaaaggucuaaauuuagguaauccuuauguaguagcauauuaauacauaggaacauauagauuaauacauaggaacagacaguuucuguuuugaguuguaauuaaaggcacagcucuaauguaguuaacuaugaaaugugauagacugauuugaauguggauaagcauuugaacuaauuucuuuuccucaagaacaaauuaagucacacugcauauauuuuaaacaaauacuuuuuaagugcugccguugagaagugacagcucaagcaguuuuugaaaugagagcaugaguaaaucuaauuuuggaagcaaacaucuuaaguuuaugaaaaucauggguuaauugcuuguuugucuuuuauguccauauuuucuauauuuuugcuuguuuguuuccucagagucuuagugaaaagcacuucuuugaccauucaugcugcaaaccacuuuaagcauaauuuuuaauuuccuuugguagauacaaaaucugaccuuaaucaguguggaguuacaugcucgaacuagaagagacuuacaaccagauccugaguuugacccaaucugugcuuuguucuacugcauuucaucugacacuccacucccagacacagaaaaaacagaacucacggguguaaucguaauugauaaggacaagacagucacccaucaagguauuguucauuuuuaucaaugacgugcuuguccacgaauuggggguugugggggaagagggacaaacaggcuuucacauagucagcccaguuugaucuuguacuaguuguguagcugaggccugcuuugagcauagauccuuccugccucuacuucccaagugcuagauaacaggcaucugccagguaccaugcuuggcuuggaauggcucuuaacaaaauugccuucuugaagagccauaaggaagcaggaauacucuuuucuaacguuggcugagguuggauaggaagcuauauguaacauuuuccuagauuugugauucuuauuuuaauuauuacaaccauagguagccuggagguggguuggagcccuuaccuaguuaugggagugcucuggguucugucuucagcaccaccagggagggaaaaccagaaacccuguggacagacacaaagaucuuaauaaaacuuuuaauuaacacauaacucauacacgacugauuauucacaaauccaaauaaucauuagcuuggguaaacaaucuucauuaucugcagauauuuugcugcuaacacagaauguuugcuuuagaacauugcuaacuacuacaaauuaauaguuugugaguuaccauguuuuuuauuuauauaucuuccuaaguaacugcacuuugguucaaagguucuucauacaccauagaagcauuuuaggaaaugcaaguauuucucugagcuuuuaaagggaacccuuacaaauuauuuaggucuccugaggaagauuuaguauagaagaaagacauuaagaaucugauguuuaaucauggcuaacaccagcuaacaagccaaucauugaauuuucauaacccauggugagauggcuuuacauaauggaaauaggcaagcaaaaacccauuaaaguauuuuuuuucucuugaaauguguauuaaccauuuucuagcauacuagugaauaaaauauuaucugcuagacaaagcauuaggaaaaacaagcacagaaacaauaauuuucuuucaagugguauguuauagcuugggaauuuuauaaaugaagacuaaaaagguaacuaaaaauguagaacuugauuuuagcucuauguuacauuagaaaaaccauucaaggacauuuucaaguaguuggacuauuggggggggaucuguuuuuauauuccuuaaugcaaaaguaaagacuaauauuaauuuuauauagugguauauaauacaauguuauauguaacaaauauuuuauuuccuuagauauuagaagucagaccccguuacuuaucagaucuggaauuacaggauuagaaguaaccuacgcugcugaugagaaggcucucuuucaggagauuacaaauauaauaaagagguauugucuuguauuuuccgaguuuuccaucugccuuauucaguuauuuccugcuguugcagagggcauaagauauaaaagagggugagagucaccugcaggacccugggaagugugugaucauccuuaggaaguuuaccgcacucagccuccuguccucagucccaguccaucaaauacgggacaggaaaggcaagucuaugguguuacaacaaagaaaaguaugugcuucuagcuucucaguuggauuuuaagaugacuuuucuaugguuccgaaguaauggggauuguacaaaaguucagcuguguuauucacuuaaagaaguuucuaccuugggagcuggccacuauuuuaguaguauuuuugaaucaguuuguuuuauugcuuuucacuuuaauaauuaaucuuuguugaaaguacaucuaguaauguauuuuugucauaagcacuuaccuccauaauuuuaauuaccuacaucugaaaaauuaauaacuuacauaaaauaugucagugcaccagaaaacuaagagcuuauugucuggcauucagucaguacuucauugacugacuguauaagaauauaugcuaaauauaaaaaucaaugaaaaauaaaccaggcauugaugacuuacuucuauaaucccagcaaaaaaacaggauuggaaguuugaagcuagccugggcuacauaguaagacucuugucucaaaaauaauaggggguuaaaaauguagaucauggguagaguaguuaucuagcauguuacagauaacaacagcuaguaaugauaauaauaaguuacauauacaaguaaauuauacaaaugaaacccauagaucaaaaaauaaauaaauaaacccaccaacauaguuuugaggguuuuuuuaugccagcuguagguuuuagucucaaaacaaaauaaucaauuccucucuuccuacaguuuucccuuugaaguuaaauaaguuuauuuucucuuguacuguaacaaaaauauuuucaugauagucacugcauagaggaccuaagaggagccacagaguaaguccugaauuugauacagauugucagguggccuuuaccaggacaaucaugcaguggcagggagggcccccucccuuaggcucucaagcuugcuuuuccugcauuacauuaguuauacucucaguaguuucaucuauuaccaacugaauugcuccuucucagaagacagaccuaucauuucuuagacauuacuuugugugagaacccagucaacacuaaaaucacaaggaaaguguuugaauccuauuuuuuucccucagcauuaacacuauugaaaggcuguauagguuaagaaguaaaaauggcagucugugaccuggaagaucuuuauccuaauaccaugcccacucaggucucacccuucaccuucccugcccacaucauauuugcagucaugccuucaguacaguagugacugcuugucucucucuccagauguugucaaacucugccaacacagucuuagugaaauuaggcuuauucuaagucauucuauagcagucauucuacagcuuuacagcugcuacugacgcaucccuuuccaagacaauggccauugggaaauauagauuuuaauuuuuccuccaccaugagaacagugguucuuuugggcacaauuccaaauguaauguugugugcgcugauguuuuucuugucuagguaugacccugacauucugcuaggcuaugagauucagaugcacuccuggggcuaccucuuacagagggcggcugcucugagcguggacuuaugucagaugaucucucgagugccggguacguagaacugcagauguucuguuacaacuacggagaaguuauagaguaaauagugacaacauuagagaaaggaaagaccauaauuccagcucaguacauuuuaacuaagcuaugguaagcucuagauguaaccuauagaaagguuaaagcagcagcagaauaaggccugcauucucacagcugcguucgugugcugcuuuauauagugggucuuucccacgcuuagucacauuuccauauauaaaucuuuauagcagaucguaccaucuacuccauccuucguguacuuccuucauccaguauccuagaacuaguuucucauauucucacaguccucaugaaggguuaucugaagcugcauaacccuuggcuuuauaaacugugauuuuacuguuuugccauguuuuauaucuuugcuccuuaaauugguaggaaacgacaaggacaagucaaaaaacauacuaugaauuuuaagagcaguucccaaaaguuugguacugaguuuacagaaaaggaguaauaauguuuauaucagaauugcuugugauuugugaauaauuuuuuguuuccucuacaacuauaacauuuuuauuauccauauuucauuuugcuuuuuauuuaguuuuaguuuuuuucuuuuuaaaguucauuuuauuuuuaauuuucaauuuuuaauucaaaucuaauuacaucuuacuucuccuuccucacucuagaccauccuuuguccccacucuccacaccuccacucacucacucucacacugauggugauuacuguauaugucauauaccuuuauauaacauaaauauaauuugcugaguuaguuugcugucccuuauguguauaugauuucaagacugacccuuggugcuggauaacuaacuggggcuuuugucccugggagacacuaguucucccucucugggcagucauuaguugucuguauaacuacaaaaauuuuuacauuuguuuuggcucccacagcuuuugggagaguuuuccaaguguuuaagagaggcagccaucagguauacuuguuaauuacuuugguuguaagagauaaagaugaaaagacugauugaaaauguccuagauuaggcuguagcucagcucuagggugucugucugaaggacuugagguuuagagauugaucccagcaccacagaaaagaaaguagcuguggaaagaggaaaggaaaggaaaggagaagagggagggaaggaagggagggagggagggagggagggagggagggagggagggagggagggagggaaggaaggaaggaaggaaggaaggaaggagggagggagggagggagggagggagggaaggaaggaaggagggagggaaggagagcacgugcccuuucagagucauugcuaagacuugucaagcagcagaguacagcagaagggauaugcgguuagugagguagcacaguaguaguguagugcacagauucugaagaaacgucuuccuagguucaaaugcuagcuaggccucuaacuaccuguauaaugucaagcaacugacuucauagaucuguugcacaauuuuuucauccauaaaguggaggugcugguagaauuuccagggugauugcaauugugccugaaaacagugaacacugugugaauguuguugcuaauaucauuuuugaacauuaucuccuuagcauaaagaaaugagaggugugugggugaguguacguggccgucagggugaagacauccuuuuuugcaauacuacuuguuccuaccauaugaaccaggacaagauguaauguuucuaaguagaauuuuauaauacagagggaaacuuagagugguuguacuaaaguaaagaagcaauguugguacaguuccuagaacaugauggauguauaagguacaauauguauauucaauauuguagucaacaacauucaccaaaucuauuguuacuuuuauucucagaaaaccaucacccacaggacuagacucacuucucuuugaucuaaggaacucucagaauucuccauaaacuauuaagagaauuuuuugaguaucucagauucugagagaauauguauguauguauguauguauguauguauguauguauauaaugcaaauauauauauugauuuuuuuuuaguuaaaauaauggguauucccuuauucuaauaugaaauauggauagaacugaaucaaauuuuaccuuuagucuuaauucuuaguucuuuagauuguucucauuuucuuuggcaucauuuaccaaaugcuuguuuucugugagucuugaugucuugaugcagucuacauucuuuuucuauagaugacaaaauugaaaacagauuugcagcagaaagagaugacuauggaucagauacaaugagugaaaucaauauuguuggaagaauuacccugaaccuuuggagaauaaugagaaaugagguaagguauuugcucagaaaugcuuggaaguaagauuaggccauuauaacaguguacucauuacaaaguauuaggguaaauucucuguuuugugauuuacuauuauauguaaauaaaguuacaaaauauaagauggcuaaauaagaaagaauuauaccuuuauuguuuuucuacuuauucuaacuuaacuagaagaaaaaugaauaucauacauacauaccuguacuucucagaacuugggagaguaagacacgaagaucauuaaucucuggcuagccugggcuguacaauaauacccuuaaaaugauaaaaucuacagcuauaauggaguauuaugagguuuguguucaguguuguggaauuucaucauuaagaaaaucuagucuagccuuaggaaggaaacucucaaaauacauaaauuuaaauacuaggcaaaauuggagagaagguauuuagaaauaguuaauacuagcauccaguuggaugggcuuuuggguuaaaugauuucaacaaauucucccauuacuuugcaauucuuuauagaaauaguuauuuuacacacaauaaaaauacacuuguggggcuuacuagauguuacgucuuugaaguugucuguuuucucuaaaugaaauauaaguuuccuacuauaauuugauuguuuuuugauucuggacuuuuggguaauaauagcuaaaaugucuagaugauaauucauucuccaauugcgucuccuauuugaaacuacguuuucauuauaaaauuucuauauuuuccuuucucuucacugauuguuguggcuguccugaauuuauguucaacacugacuuugcaagcaugcugggacacuauggcaugcuacccaugccagauaaggcaguggguucuuuauauaagauuuacguaaccucgguuucuucccguuuccucuuugugccaugagucgggaguugugcuuacauguaaucuaauuugaaacagugcaugagugaaucugcuugagggcggugcuauuucgugugcgguugugugcugcacacagaggauuuguguaugcaccugucuguggaagccagaggucaacauggguaucguuucucaggagccauccaccuuguaccuugaaacagggucucucauuggucuggaucuucccuccuucccaguacucagauuacacgcuaugcuaccuugagugacauuuuuugcgugacuuuuuaacccauguaaaaauuccucucgccucuuaaaaguuuaauuacuggcaauuugacaguuuccuuaaaguccugaaugcuaguuguacccuguaucuccagccauucuagacaaucaagccuucagaccagagcuagccuugaguauuuauuuacuucauacuagagacauucaaauuagguuuucuggauuugaguuguucuaaagguuccuuuuuaaucuuuuuaccuuuuauuuguguuuuucauaaugcuuggcaacuuauaaugugugauccuuauaaacauuagauaucuucugccuuauaaugugugauccuuauaaacauuagauaucuucugcucccacuggaccuugagcccuuagugauaaacugacugacucuuagguaauaauucucauuggaugcauauuagcugcuuaaaggaauauaugccuguuaccaugaaaacugaauauauuuacagaccuucuaaaucauccacuuucagauuuuggcaauacagagaacaguguuagauuugacuguugagauuuuucagcuuccucuaagaacuugauuugccuguaugguaacacucuuauuuucuagucauguguuccccauauggucccuucuguuauuuucaucucuuugcuccuugucugaguucugagaaaaccauguagauuaauucucugcaccacuuagucgaucugugauacauguguucuacuugcugcuuuaacagugggcuuuauucugcuguuagcagugucuuggcaguccuuccuuaauuaaacuuuuugggucuuuaccucaacaacauugccuucucuaccuuuuccagacagugugagagagacggggaaagggagagcaugaguguguacuuaaugcugaagugugauguuguucugcagaugacagaaaucuuaaauaaaaauaugugacuuuggaucacuguacugagaugggaucgaaauuaaaaaucccuguuuuauacuuuaugaguuguaaacuuggaaaaauuuuaugucuuguaagcugagcauauuaagguucacuaauaacagauaaucuuugcuguggaaaguucuaagugguauuaggucuuuuuaaaaccaagugagcuggguugacugauaaaaggcaacaaauguucugcauaaagaaaauaauaauuauaauucugcuuugcccuuuuuuuagguugcccugacuaacuacacuuuugaaaaugugagcuuucauguucuccaucagcguuucccccuuuuuaccuuccgagucuugucggacugguuugauaauaagacagaucucuacagguaauguuucaccacucucaagaggauaugguaugguuuuuugguuuuuuguuuuucaaaucagcauuauuaggggcuggaaagauagcuccacaguuacaagcacugacuacucuuccagaagacccagguucgaguucccagcaaacuauguggcaucucacaacugucuguaacuccaguuccaggugauccaguguccucuucuggcucugcaggcaccagacacacacauggugcauagccacacaugccagcaaaguaccuguacacauaaaaugauaaguuaauuuuuaaaauaaaauuaaaagucaguaucauugagcuuucuguuacauuccaauaaaagacacacauuuaaagucuguugucucugacuuugaauaugugccuucacucuguaccagagccucaucauaaggaagagaacuaacuacaggagagagcucuuaaacaaaucaguccacucaaagccuaacuauccaguaaauaccaaggagauuucuauuagcugauuauuuuugccacuucauauaaauagaaauauuaguaaucuguugauuuuuguuggacuucugugaugaaauucaauauaauuuuuuaacuuguaacuguugugagauucaauauauugcauguuguucuuauuauucaguuauaugaaauacacaguuuauucauucacuucuuaauagagacaccagugugcauuguagcuacuaugaauaaaacuguuauaaauauguacgcaagucuauaugaacauauauuuucauuucuauaguugacacauuucugggccauauucuugguuagugucuguuaacuuucucugcuuccucuagaaguucaucuacugcaaaucugcuggaaauaaauuauccuaacccucacugaucaaaagaaacaaagaaaacacuuuugacugauauuuuacugucucauucuaggcuugagcuuugcuuuguuucuuucuuucuuucuuucuuaacuacuaugaagauuuugauugccuucccuaucuguccuucauuguuuuugauaaaucaacaguaauuuacauuuuucuaauuuguccaacucauuugauuucuuccuuccuuucauucuuucauucucucucuuuuuuuuuuuuuuuaagacaagaucucuguacauagccuaggguagccuugaacuauaauguagcccaggaugaccacaaacuuggaauucucccucaaucucccgagugcaaggauuauaguuguauaaaacagaagucaucuccuuguugccuuguguaagucguagaguggauuggagggagugcguuacucgcuucuccuggcccaaccuuagucuuuggaaugucuuguuuucuggggccuagacaugagcuuucucagcacuccuauucuuagcacaguggggagaaccucugcuuuguguaacuacagucugggugcagacaaguccucugccugucugcagaggcaggcagugcuauccugugucuccuuagcagcugagcuccuuggcgcggguucugggaugagaaguacccugccccuuagcagaccuguuguucaucuguuuaaugccaggucugugauugcuuccucuagaaacacuucuaccuugacaggacuuagacuccagaagaagaaaaaagcaaggcagguguucaguuuuuaaaaauuagugcauucuggcuuauuaaaauacaagaguaaaugaugggaaagaugcaaaagauacugcauuuaaaaaacaacucauguguguggaaaaaaaaaacaauuuuauuggaaauacuuuuaaaauauauucugauccugguuuccuucucucccagcuccucucagauccucgccauucucccacuuacccagauucacacucauucucucucucaugguuucuagucaucuuccauucccuuuugaggaaccucagggaagugauguagaacuacaguaagggcugagugcugaugguucacacccuugacuccagcacuugggaagcagaggcagguggagaucuaaguucgaggccagccuggccuacauuauuauuuccaggacagccaggacuacacagagaaauucugucuuggaaaacagaacaaaacaaagcaaaaaaguaaauaaaaaacaacaacaacaacaacaaaacaaagccuacauuaaggacuagauuuugguauuaaaucuuuacagagaaguugguuaucgcucagugacagcucaaggaaaaaguaauacauaaaccuauaaauaacauuuauauucaacuuaacaccauaaccuacauuugaugauuuguuuagggaugguagaacuguucuaaauucauauauugccaccucuaguuagguauuauccaggauaaauaaacccuuuuuuugcuaagugaaauagagaacugggccuggguuaucaaaaacucaagggaaguuuugaaacaaguuaucuuauaauuccuuaucauaaguacuaguuuaaauguugucuuguuacuaguuucuccuuguacuguucugacauacugauguaaagguucauguugugacggccccuaaguaaccccacuuuaccuguauucacgcaugcauucucuuucgacagauggaaaaugguugaucauuaugucagccguguccguggaaaucuccagauguuagaacagcuggaccuaauugggaaaaccagugaaauggccagacuuuuuggcauucaguuuuuacauguauuaacaagagguucacagguagaaauuuuucuuguacacuuuaaagcucuacacaagugagauacuugguuuugaccucuuugaaaugauuagauuuuuuuuaacuuuguaucuguuaucaguacuugaguaauugaaucuuguaguaucguuaaaagcgccccuuaccagcagggaaaccaagaaagacgauuucucccauguuuuacgcuuuacguuuuuauaaguuuggcauuuucuaaauccuaaucgauauucuuaacauaaaaauaaagguucugucaaucuaagugacaccuggaaauuugacuaaacaauacuuaacagauguagaaaaccauacauacauucauauaugugaacaguauauuuuuauuuaaacaguauccuuuucucuuugcaguaccguguggagucaaugauguugcguauugccaaaccaaugaacuauauuccugugacaccuaguauucaacagagaucccaaaugagagccccacaguguguuccccucauuauggagccugagucucguuucuauagcaacucuguucuuguucuggauuuccagucacuauauccuucaauugugauagcauauaacuacugcuuuuccacuugccuuggccauguagagaauuugggaaaguaagauuucuuucuuauguuuacagccauguuauaguacuuuauuugcauuaauauuauagacuuucuucacuguuuuuaagaauaagaugaauuggaauguagcccagcuaacccauuuacugcaguugucuuacuaauggacaugaacuguggugugauuaguuuagcuuuguagacagauggcucaugugaggagagccgugagcagagagagagagacgcaucuucuguuuuauucuucauggauaucaguagucuucuuuagaaugagauuuuguuuguuaaaucagcuuccguugcagcacuuugaaauuaaugauuccagucaucaguuccuucugucuuagaaacaugcugugauuuuucaaaugauugacaguuuauuaauucagguuaaacaagaguaauguuuuaaauugucaaaggaguggauguuuuucuuaauuucaagaaauauagaaucuucuuuuuaauuauuuuguguacuugagaccacaucuagugauccaacucucauaggaaacacuuguggaagcuguaucauuauuugucuuuuauuaagaagaaaauuugaaauuaccuuauacuugaauuuuuccuuagggaguuuaauauaacaugauuauauguugaguugaaauuuuguauuugaguguguauuuagucauaaguaguaaaguacugccacuuagaaaugcuuguuuggugggaugguggugacacaugccuuuaauccuagcacuugagagguagaagcaguugggucucugaguuugaggccagccuggucuacagagugaguucuaggacagccaggacuacacagagaaacacugucuggaaaaaguaaaaaaggaaagaaaagaaaggaaagaaagaagaaaugcuucuuucuauaaaucguacauauaugaagaauuuuuguuaauaaaccaaauaaucauauugccaguuacauaaauucauguuuucauuucugaaagagaaguugugauuaaauuuuauaaaugucuaaaagcucugagaacgucucugcuuaacaucuucuuucuuaacagguaugaugaguucaaauuuggcuguaccucucuaagaguaccuccagauuuacuuuaucaaauuaggcaugacgucacagugucccccaauggaguagcuuucgucaagguaauacucgcuuguaaaugaaaggagucaacuguggcuuaccuuuaagaaagcaagucgugguuuggguauuguuggcacauaaggcuauacuacuugaagacuuuucucucauaaaaucaaaaccaaaaucuucugggaaacaauuuugaagaaaaauaaccaucuugcuuugguuagacuuggauuuaacuaaugagcuauugaggggagugcgugucuauggcaucuaccucuguagaaucuggcagacaugcuuagagucugauggucaaagauguuaacugguaaagaguucaguugcuuuaguguauacagccuucagcuguuccacauuauuuuaaauaaagucgaugcuaucuuagauagaaugaaacuaacauuuaauaacugcauucuuuaaaaagacauucaaacuaacaagagcccuuuauuuucuauauacuuucuccucaagaaaaacugaagaaaucuuucuaguugaauaaagaaaauagauuucagaaguuguauuaccucuuauaugccaacuucauuucuuuucaauuucccuagcagugaauuuauguauacuacugguaugcaugguauuugauggaacaggcagaccucaccaacccuccaauucauucugguguacucaucaaaaauaucauucucuaccaauuaagagaugauauugaacuuuaauuacaagucagaugugaagaaauuuuuuagcaguaaguucgugguauauuucuuucuuagagauuuuuggaauagacuauccccagcuuuugguguagguaaaguuggagaaauugcaauugauuuguuuugauggguuuuuuuuucucccauguuuaaaaaaauccauuuuaaaauagcauuucuacauauuuggucaugguucuuuuuguauuauaucuuaaaauauuaugccuccaugagaaagaaaucaggaaagcaauccuauucuuaauuggggaauggaacccugggaauaaaccucaccaaaaaagugaaaggccucaacaauaaaaauugcaaagcaguaagcaggacaugguggugcaugccuuuaaucccagcacuaaggaggcagaguuacgcagguaucuaugaguucaagcuagcuuagucuauagagcucguaccaggccagcuagggcuacacugugagaccuuaucuaagaaauaaaaauuaugaaacacuggagaaagagacugaagaacaacaagaugggaaaacaccacuguaugaaagaguuaauauuguuaaaaugaaauaaugucaaaauugaacuacauaaugcagacccugugaaaguaccuaugaccuucacaaaacuggaagagaaaaaaaaaacccuaaaagucuuauggaaacacaaaugauaucaaauagcaaaagccaauccuaagcaaaaaagagugaugguggaggggaggccucagaauaccuaaugucaaauacacugacaaagccaaaguaauaaaagcuugauaguauaggauuagcauaaaaagaacacagaccaauagaauaaaauuggcaaccuagaaauaaaccuguuugucuaugccaucuuauucuugacaaaacugccaaaaaauauauauaagaaaaaaagucaugucaacaaacaauguuaggaaaccugauuauccauauguagaagacuaaaacaacaacccucuuaccauucauucaauauagaaggcaucgaaagggcuaugcagcucagugguuaaaagcacugccuguuacuugguuuuaauuccuagcacccaucugguuuacaacugcuugcuagcccaguuccaggggaucugggcucucugagcaccagacauguacauugugcucagacagauauacagguaacaguuuccugaguaagacucaaaacuugaauuaaccaaugggauuccaaggcuucuuacagcaaaguaaacaaucaggauuaaucacaaguaaagauauagccuggaucaggaugugucugaaauauguaaaggacucaagaaaccgaauaccagaugagcacacaauccagucaguaaauaaucuucuuugugaucacaaagagauagcaguggccaaagaagaauaggaaggucccaggugucuguggccaucaggaaguguaaguuagacugcacugagacuuccucaccacagucaucgaggcuguugcucaggaaauaaaaaaggccaacacgugugagagcagaaaggggccuuguucuccacagcuggguaggaggguaaaugacauggcugccauggaaaugcugugaaggccuuucagacuaaaacaccacuagcauggaauccaacaucacugcuugggauaaaccagaaaguccgaauacaaaagagcuuacuugcuuauugcugcacugcucacaacagcuaagcaauaggaucagccuggacacccaucuuacuuaucagucgacaaguggauuaaaaagugugauauauauauauauacauacauacauacauacauacauacauacauacauguauguauguauguaguauuuggccauaaugaauaguaaggcauaucaucugcagggaaaugaauggaaccugaaacccaaacacagacaccgcuuugucuguuacauguggaagguagagcuuguaguagagcaccugaaguaagcaggaucugcuaggaaaggcaaaggcaaggagaucauagagaggacggugggaaagggcuggacaaugaugacaauauaguaguauauaaguauaaagguuuucacaguugauacgaacuaauaauuagagguuuuuaaaugauaaaacaaagggagaguugggcuggcuucuaaagguacaccaaaugaauuagagacugaccuacguuuucugucacauguguggguguuugcuuaagcucccuucaauagcaucuuaaaaaccccauuuacauuuugaccuaguauguaaaguuuaaaaauaauuuuuuuaauauucaaaagugugauuauccuauaacugaaguuuuaauuguucagguugacaugcguuauuuugcacgugucugugaaucaucaguuaauacuguuuugugguuuuucauuccuaccagaguucucauaaauccucccuagucuugauuaauacaaaugauuuuuuuuuggcaacaacaaauguuaucacuucauuauucauccccucuuccagauugcuaauaaauguaggccggaggggauggcuuagugcucuaagcaucagauuugaaauaccuagagucccuggaacugcagguuugaaugucagcagagucaacccagcucaucacucuuccaagguagauaaauggaguucccugcagagcacuguguggggucgcuagggugagcgcuuuaccaacugaggugguuuaugacugauacaaggcccaugugucucucuagaaggaugggggucucgaucagaguuugaacagcauuucccucugaguuuguuguauggcuaucuauguacuaguugacauccugcuuccuggaguucucagagcucguauagaagugcugcauucaauuuuuaaacaauaccagaaccuuuuaaaagaaaaacucuucaacagaaauaaacugugaugauugugaauggcagcuacuaguccugugguuauucuguuaguagcauguuucuguuuaugacaguuggccguuguaugcuuguuuccuucuuaguuaccgaagucuauaugcaugugggugugauugaggcauuuuauacacucuucuucuuuuucuccuuuaugguagccuucuguacgaaaggguguucuaccaagaaugcuugaagaaauuuugaagacuagauugauggugaagcagucaaugaagucuuacaagcaggacagagcccugucacggaugcucaaugcccgucaacuaggacuaaagcugauagcaaaugucacguuuggcuauacggcugcuaauuuuucugggagaaugccgugcauugagguaacacauuuaauaagagaguaguuacugaaguauuuugcuuuguuacuaaacuuuaaaaugucauuuccaugacauacuaguuuuucuuaaauuggaucuauaaacaugcaucuuuucuuauuucaauaauaauuuuuaaauuauaugcauauuuccacauuuacuaacauaagguuucagugccaguuuauaauaguauuuacaguaauuuugauacuaaauaauuccuuuuaauuuuguuguuguuuuguuuugauuuuucaagacagaauuucucuggguagcccuggcuaccgucgaucuguagaccaggcuggccuagaacucagaaaccugccuuccucucccucccgagugcugggauuaaaggugugcagcaccaugacugacuccuuuuaauuugguaguuagguccaaauauuacauuaaagaaaaaacaccccauggacuggagagauaguuaguucacucaguaaagugccuacuguauaaacaugagggacccacacgaaaugucagaaacagcaacuuguuacguguauccaaguguugagugggugguggcaggaggaucccuggcgcucacuggcucuuacugacuagucuguuuaacugcauaaacucuggguuccauggaagaccuugucucaaaaaggugggaaauaagugacuaagacaucuaaugucaaccccugaccacugcacacacaugucuugugcacagcucacaagaggcaaagugaaucucacaccugcucaagagcugacauuagaguucaucaggucagcugcuuaaugaagcaagccugcugacuucaguucagucccuaggacccacaaaaauguggaaggagaaaaguggguuccauggaguuaucuucugccuuccuguguaugcuacagucacacacgcacacacauuuguguguguguguguacgugugugcgcacgcgcgcagucacguaccaacauaaggcuagagagaugguucacugggagaaggggagagaagcgggaugggaacauggcucagucagggcuugggggcacugugcacacuagagagcuugagcuucccaguaccacuuaagguggacauagcuaugucuguaacuccaguguuacaaggaagaugggaaggugggcagaagguggcuucuggguugagcagagauucaacguuuuguuaaaacuuugugauuucaguuagauaacaugauuuagugcuuuguugguugguuuucugguuaugcuuuuuguuuugaaacaggaucucacugugaaacccuagcuggaacccguagagaucugccuuccucugccuccuaacuacugggauuaaagauaugcaccagcaugcaugcugauucucaguguguuuuaauguacuaaguugucguuuucuaauauacucaaaguuucaauaugauauauuaucuuaacuuaaaauacaaaucaaauuuuugcuuccauuuuaugaucuguuccuuuccucauauacuauaguuuccuuugcagugcagcuuuagacagcuuucugaauacuguuagaucuguauuuaguuugggaauuucaacuuuuggaacaaaaagggaaguaucauuauuacuguuguuugguuauuaacaaaaagacaagaaugcacaaguuuacuguaaaauucaagggaaaugcuccauuugguuuggauggcagucuucucugucuuuugaccucaguugauuuaguaauuaaaaucucuuuaauuuaccaaacuacauaaucuaaugaagauguguuucacguugcuuaaggccuagaauuuucuaucagcuugugcccuuauccuuacuaaaacucaguagucacagugaaagaucccuaugggcauauuuuuguacuuacuuguuuguaauuaaacacugcaaauauaauuuguuauauaauuguguacuuuuuucuuuuacuuaguuuuaacaaaaauuauguauuaucaaucucagagauuuaauuucagcacuuaaauaaauuaucauaaacagaauuuuuuugaaauuuagguagaaaauaagguagacacaccuaccuuauacuuggacccaacacacaguacuuuguacccugguugauuuuaugaauauaaaggagaggcuuugaaaacccacauguggcgaugcaugccuuuaaucccagcacucaagagucaguggcaggcggauuucugugaguucaagaccaaccuggucuacaguagaaaguuccaggacagccagggcuguuacacaaagaaaucuugucucaaaaaaauaaauaaauaaauaaauaaauaaacaaacaaacaaacaaacaaacaguuauuugggcugugcguauacaaggcuuauucuuucaagaaucaaacguaccuauguaccuuguaaaaaugugaaguccuucuuauguccugacauagucaaaggcaagucuauagucauagauucuuuuaaauucauuuuuuuacuuugugaugcacugguaguuauuuuuuuguauuauuucauuuuuuaaaauaucuaauaauuaagauuuuaguauuauuaaaauguguugacucuuaccgagcuauguuaaaucauuuccaauguguuuguaucaucaacagguuggugauagcauuguucacaaagccagagagaccuuggaacgagcaauuaaacuagugaaugauaccaagaaauggggugcuaggguuguuuauggugauacugacagguaaugaauuuagaggauuguauuuggguuuggggcauugguuuacaggugggguuuuuuucuuguugauuuuuuguuuuguuuacauuuauuuauaucuucuuuuugguguuugaaauagcuuaggggagauccuuuuaaauaacacuccuccaucauuguugucguccauaugaucuuuugguuggauaauucuucugagucucuguauuuaagucccuuaaagaaauagugguagugguggugguaguaguaguaucagcagcagcagcaaacaaguacagucuagggagaagguucaacguggcaguugcuauacuaccaugaaggccugaauuuggauuuauaucacccauauuaaaagcuagacauggacacaugaguauccccagcaguaaggagggcaaagacaagaauaucuccaguuucccggcugccagcauugcaggaaaaucaggaaaguuuggugagagaccuugucuuaagaauaagguagaaaacaauaaaaaggggcacucauugucauagucuuuccuagauaaacgccugcauacauguccacacaagcacgcacgcacccacccacgcacuuaaaaggcaguugccaaagccuuacgcuguuaaauuauuauaaaaucuguugacguccuaagagaagaaacagucaaauccacuuacccauuagaucccagggcaugugcugacuucugcaagcccacucaugccuggcaaagaaugggguggcuuuggauccuggaucacuagcuccagccugcuugcuugguuacuuacacuacuauuuuucagggucccauuguuuauauaacaucuuacuuguauggcaccuggaaauccuuuaagugguuuucauaguacguuuggagucacauuguguucgugcuuggagcacuucccucagcaacucugaucacuaucuaguacaacagagcaguuggagauagugucccuaauuaauaaagauaaccuguaagugauccuuaaacaguguuaaucuugcaguccguuaaaguguauauaaagugaacacuauauuaaugcuaagugagagcuuguugcccguaaccacuuucccauuaccaucagacagagguagcuugcuauuucccaagcucugucaguguuaccuaaugucccuccucguuugucuuugggcaguucacugcucaacuaaaauucugcuugguaguauaucaaaaugaguuacuaaaacaaacuuuguuauguuguaauucuuuguaaaauuaguagaaaagcaaaaaacuuuaaauacuuaaacuauuacuuuuaacccagagucuauauguguugguuguuagcacauagaaucauaaguuaacaugauuuuuauugcacguuaucuaccauuuaagaucuuuaagaauugaaacaagccacagggaguggugcacaccuuuuaauaccaguacuuuagaggcagaggcagaugaaucucugugaguuuaaguccagccuagucuaccuagaguuccagaccagccagaacuacacagugagacccuuccuuuaaaacaaauauauaaacaucuuaaaaauugaaaaauaauuucaaauaaaguccaguacucacaggcucucagaacaaaagaaaagauagaguuggauauuauuuaggcuggcaguucacaacccuagguaagaaauuaucaccagcuagucaauaauugagacauaaaugugagcuccgugcucugauucuuagcaagugcuuuuucuguauaucagauuucacgggaauguugagauuccagucagugaaauacaaggacaguaucacuuugcccaucauucauuacuugaucugugcaaggacaauucauuuagaauaugcacucuaacaagaacaguagcaccccagcagaguacaaguaaguuauuagaaguacaaaaaguucccaaaauauaugucuuucuuaauaauuacuuucauuaaaaaauaaguaacucuuucuuugggaugauaauuaugauaaaagguugaaaaacugccuuagaaauaauagcuaaugcuuggcagagugaaagagaucuuagccacaaggaucuaaaaagcugucagcuauacuuuauuaacauggccaaucacaguucacugagcuucugugccucaacuacuucaucagcggaauggaggaguuugguaacugcugaucagugaccacugcuucccucaguuucaaggaucaugauucauagaguccugguucccaucugugggggaucuaaaggacugaggaggcuguuuuaccacuagagcaguuuuuauugcuacccacuuaaguguaauuaauaggaacacuaaauauuaccaugguucaaaccauuacuucauaugguaaugcuucucauucauauuuauuccaucuggugggauauuaccugcuucagccaaugacaagcuguuuauaaggguaauucauagucaguguagggauugacuuccaauaagaauauauauacuuacaggguagggaaaugaaaucagaaucucuugggaaauucaucggacuauaauuaagaaaguccucuuaggcagcauuuauauccccaauuacucccuauuauguauacuaauuaauauucuaaauguguacuugaaccucuuaacccaaagauaaauguuauuuaacauuacagugacaauagacucugauguaagaccuuuuccucagguguggcagaggcagaaggguuacuccaaguucuaggcucaguggguuacauagugagcuccaggccaggcaugccugacaucucacaagcaauagugacaacaaagacaucuuuuccuuuuuagacuagucaucucugaacucucaccaaaacuugucguucgucuaagccaguucucuugaagcauagcuccaaaucaaauuagccauaacaguguaucuacuaacaagcccauugauacucuuagguaaaaccucauauauaauaacuuucaaaauauagugaguaugcuuguaugugucuguacauacacagacuacacauaucuagguuuuguacuccugacccaagggguaagugacucacuuucuguuacuguagauuaguuuuauuuuuucaaguauuuuauauaaauggaauuacacaguaugugcuuucuuacaucugguccugaagagugugugcucuaggagacagauggggaggaauuagagaacguagaggggagugcuauuccacaugugugugucaugcugcagucacuuggcccgucugguaaaguaaugaauacuucauguauugaucucuccccccacccuccuuacacacacacacacaugauuuuuauugaaacauggucauaguagaaauauguagcauguaucuacuuuauaugaaaguauaagagccugccugaugagccagccgccacucuagccaagccacagcacguuucuauuucccgaccagcaccccauguagcuccaccucugaugucugucaccacagcugaauuuuacuuguucucaaacauauguauauaugcauccugauuuuuaaaugcuuauauucaucacugcaacugaaaaacuuaaaaauaauaaccuuucauaauaaaaauaguuuggucauuuauuaagcacacccuuagcauacauaaaaaccagcaaucccacuucuauguuugccuaagaaaaggaaaaaggauguccaugcagaaauguguauauaaaucuucuuuggaacuuuccucauuagagucaagugaauagauagaaaguuuguuuauucauacagugaaauacccagucguaaaaaggagcuagcuauccccaacaucauaggcgacucucagguauccagagagaaagaagccagacccagcagaguaugcaugacauagucccauuuauacaaaauucuugaaaaaaaaaauugaucuguaauaacagaaagccaaucauguguuaauccuggggcaggaguacaguuuuaaaagacuuuuuuugauugacuuaacuuauacacaaccuuagcuguccagggaugauccugggaccuuggcagcuucagugucugaauuuuagucggagcugagccuuucagagcuguaacaagguauacuguaaguaucaaggggagggaguuaguuagacaggaaagccuugaaagaaagcaacuugagaaagaacagugagggcgaaguaggucauccuugcuuuagacuguuuauuagccaggaaguaauucuugaagaaauuguucuuaugacuuccacauuaccugcuauauuuuuaaucucuuaguauguuuguacuacugaaaggagccaccaaggagcagucuuuuaagauuggucaagaaauugcugaagcuguuacugcuacuaauccuaggccagugaaacugaaguuugaaaagguaaggggaggaaaauguuaauagucacacagagcuuacgugcuucuuagauguuucugacuuacucaaucggcagucucuggcucuauaaauauguugaauauuaaaguuuuuaguuuuauaugaucucucaguuugggagcguuuuguauguguacacuugugguguuugguucauuugguuugguuuggggauuguguguguggcguguggguaugauauuagggcuuauacuaacauuaggguuacuaauacuaauauuacuuauacuaauauuaggguuuauacuaacaagacggccacugagcuguagcccucaggccucccgauuucuuuuuuucaauacugucuuaaaaugugaaaagaguuucauuuauuuugcuguaaagcagucaacuccaagcuuaaugcuguaaaacagccagcauaucaguagguuuuucaguuucagggguuuagaaaaacuacaccaaaguaauucgucucagcuucauauuuuccaggcccucaacugaauagcugcaaaggcugacuauaaucccagcagucaacaaguaggggcuaacaucccccgacgacacgcccaagcccuuggacugcuguaaucccaguucuuggaacugcagcaauccgguagcuacaaguuugaggccagccuggucuucauaauucaaggccacccuggcuacauaucaauauuuguuuuuguuauuuucuuuuucccccaaaacaauuuuuuauuagauauuuucuucauuuauauuucaaaugcuaucccgaaaguccccuauacccucccccuacccugcuccccaaccuacccacucccacuuccuggcuccuggcauuccccuauacuggagcauauaaucuuugcaagaccaagggccucuccucucauugauggcccacuaggccauccucugcuacauaugcagcuagagacauaagcuuuggggguuauuggguaguucauauuguuguuucuccuauagggcugcaaaccccuucagcuccuuggguacuuuuuuguuguuuuaauuaguaaaacuaaaaugggguugguaaaguauuugccauguaaacauuaagaccugauucaugaguggugaggggcacugacaggaggaucucagcacgcauguuggccgccuuaccuuagccacaggcccagugagagacucgucucaaaaacaaacagggaaaugaggccugauaacacccaaggcuguccucuggccuugacgcccaaaggcacacaaauucccaaacacagcuauacacaccugcacauaaaaacacacacuaacuuaaauuuuugaaguauuuucuaaaagacauaaauaguguauaaaauuaauacaauuacuucuuccuuaaaugguuguuagaauuacuuagccauuuggaagcagaauuuuaucuacaggaagauuaauuuaaacuaaaaauaucauuaaagcuauugcauuuucccaguuuucuucccuugccuguuuuagugacuuuugguugccauggcauuccuuucuuuuuuacauuguccuauuuguuggcaggaauccuucauguuucuuuauugcuuuaggaucuucauggucuuugguggcaucccaucauugugauaauugguaauuuauggguuguuuuucuucauucuagcuaugcauuuguugcuuuauugcacuuuaaaaaacaaaacaaaacuacuuuaaaaacuuugcacugucggucugcuugcuauagguuuaguuugcuuuguuuuccagucucuuaauuuguaaauaugauucauugauucucuaaucuguuauaaacuuugaaagauauaauaauuucugccuaaaccugcuaagguucaaguuuaacauuuuuguuuucuugauuuauucauuucagugauacugacccauagguuguuuagaaaugugcucauuucuagucuuuaggaauuguguaagaaauuccuuguuagugguuuaauuugguugcauuaugucgaagaauauacuuuguauuauuuuagugguccauaaaguuguugaaauuuguuucuuugguauaguaugccuuuguaaauuuuaaugugaccuugaaauccuaugguuuuuugucaauggcuagaaugcucuaggaaguguugcucaggguuuguuuuuucaugguaguauugugaaagucugccuguucucccugaucugucacucgcugagaugaagaugcuaaagucuccacuguaaucaugaauuugccuucguucacuauugugcuguuagguuuuauccuuauuuuuuuauaauauuccuuguauugaaugaaaaccacuuuuccuaccuuucuuuuuauuaauuuuaaugugaguaacugucuaguuuuuaggguuuuuuuuuuucaacuuuucugagcccuuauguuuaaauagauuucuaauagaucuuagaauaguuucauuuuuuuuuuuuuuuacucauuuuggucauuccugccuuuuaauugaaauauuaaggccuuuuaauguguuuaucaauaaagccugggcauuccauauaaacaugguuuauuaccauguuaaccaugacaaacauaaaguuuguacuuucaaauugagaaaaaguaaauggaccagacauaaugccacaugccuguagcugcucuggaggaugucaaaagagaauuacuuaagccuaggaaauucaaugcuacucugcgaaaaauauacuguauuuuuaaaaagaaaaauaagaaauguuaaaugaggagguuuuuggaagggagcuuaaggggaagaaaaaggauaaauuuuauaauuuaaaguaaaaggauuuaucguaaagauuaaaucaugugaggugugaggugguuuacuauagcuaaaugccuaaagauugaaggcaaccuccauguccuggggguacucaguuaccugagccauacuaccccucuaccauggacuucucuuguggauccaggacagauggcgagccauccacauuuuaauggcauacucuagaaagcuauugacuuaaauauacaacgugcaaagcaguguaugcgguaagcuugcagaggagggggaagacuagaauguuaagugcauguguuugccgagacucucuggacagauccagaggaggccaguaagggugcgccuuuaggaacucuucauuguuuauucuuagaacuuuagcuuugugcugucucuaaguauaaaguaauuuaaaguuaauauaugaucaguggcuuuugaaaagcaauuuuacuugaaguagaagcaaguuagugcagaaagaguggauuuuaagaaggaauggcaauuuguucugugugcuuuuugcauucuagguuuuagauaggaauucauugggaauauugaaauauuuuauagugacaucugaauauagagaacaguaacagagaaugucccaguugggggaaacagguacuguaagucauguguccuguuuacugcagguguauuugcccuguguuuugcaaacaaaaaagagauaugugggcuacauguaugaaacgcuggaucagaaggagccaguauuugaugcgaaaggaauagaaacagucagaagagacucuugcccugcugucucuaaggugaguccugugucuguuguucucagcaguaagaaacguaacuguccuuaaacacacaucuaguucaagaacuaugccucauaauuacaugaaaauaccggagaagcgugaauugugggaauucuauuuuuaauuggagacuauucuacccuaguguuuaguuucagaccucuuaccauaccuuucuaucaauguuucuaucaaaauuaugaguuucuugggcauugccuuugaagauaggacagcuucucguguaacagcucccaagaaguagggagcaggacucagacaagaaaucaucagauaccuccaaagaaacucaauucauuccagauugacugagaaauccacuaaaucaguccacagcccgcugcgucacgcuauaucugaaaccgugcauacagaaacuccaucccuuaccugcacuauuaaaauaggcaaaaggcagauuuuuuauuuuauuuuaugugacucaucgguaauauuuauauuucucauuuuuucuuuagcuaacuuggauucuuucaguacauaauauuuucucauauuucuauauuucuuguucuccaggugcuuugacuguugaagaaaaacaaaguuuuauguuuuccucacauagcaaauguuucuucugaauaucauuccaacauaauuuuucucacacuaugugauauucuaagaaauaacaagcuauauaaagucucaaauacuuccaguuucuaaucauuuuuaguaucuaaucacaggauugagcaugggcgcgcgugugugugugugugugucuguguguguguguguguguguguguuugauuccaguaccagauagcuuuuuaaagaaaacuuaacaauaauacugaaacauacugggagcuauuuuaucuuuucugcaucuuuuuguuuuaagauacuugagcguucucuaaagcugcuguucgaaacaagagauauuagucuaauuaaacaguauguacagcgacaauguaugaaacuuguggaagggaaggccagcauccaagauuuuaucuuugcuaaagaguacagaggaaguuuuucuuacaggccuggagccuguguuccagcccuugaacuuacaagguaaugaugugcacuccagcccguuccuccaugcauagccaauauaguccuccgugcauagccauauaguacuccgugcauagccaguauaauccuccgugcauagccaguauaauccuccgugcauagccaguauagcccagaggucgccugcagcacaguaggagaaagacaucgaguuagaacugcaguguuuucuuuacguccccacccuaaccucaugaaaaucaaaauguuccccugugcuuuguaagauuucuccuucugagcuuuucuuaggaaacuaaaugcaaucaagcugaugugucugauuacauuuguuucuuccauagcagaaucacucacaguccuuaaauuugaaaugacaaagcauuuagaugucauucugcagucagauuguuuagauaauuucucucuucuuucacuguuuuauauauaauaacacuaaggacucaucccuaaaccagguaacagugcuauagagcauaagucucaaacuguuacagcacugucuacuugauaucagcugagcaaaguguacauaauucucaaagaaucaacaaucuaauuugaaggauugcucuugguuucaggcuuaauucugaauaguuuguuggcaagaugccuucucugacagucuauguacuuaauuuggauuugaacaggaaaaugcuugcuuaugaucggcgcucugagccucgaguuggagaacgagugccauaugucaucauuuaugggaccccuggacuaccccuuauccaguugauaaggcgcccagcagaagucuuacaggaucccacucugaggcugaaugccacuuacuauaucaccaaacaaauucuuccaccccuggccagaaucuucucucuuauugguauugaugucuucagcugguaucaagaauuaccaaggguaaguuuacuaaauaacauauguccuguaaauaguucacuucagaauucaguguaacuggauuuuaugugugcagugagaacuuagccuccauuauugaaacuugcacggacgucgugcucgccaggcuuccuggaggagagauuauaaauaucuguguguacugucucagcuucuagcaaguuccaaaccacagaaacauucaaugaauccccaagaguuucagugcugauuggccauuuauugauaacucaauaaaucagcuacugaaaaaaaagugaauuacaaaauuacuucaaaaugggaagguuuuuuuuuuuaagauuuuaugaguguuuuuguuuauguggguguauacacacaugacugugucugauaacaguggaaaucagaagagggcaucagaucaucagauauccugaaacuggaguuacagauguuuguggguugccuuuuuugugcugggaacugaacugggguccucugaaaggacagcaaguguucuuaaccacugagacaucgccccagcccuuuaaaguagauauuuaagaaaugcauaggaggacuggagagauggcucagcgguuaagagcacugacugcucuuccagagcucuugaguucaguccucagcaaccacaugguggcucacaaccaucuguaaugggaucugaugcccucuucugaugugacuaaagacagcuacagugcucucauauacauuaauaaauguuuuuuauaaaagaaagaaauacauuggaggggaccgaggauaugugguugcugccacuaacaagaugacuugaguucagaccccuagcacccacauaaaaugguagauaguguaugcccuaaccccuacacugggaggcagagauaagauaagagaguuccaguggcuggauagccagccagucuagccagucuagcuccaaauuuaguaagagacccugucucaaagggucgggggagugaagacagugaaaguaaguaccugaaaucaagcugugagcuccacaugcuauacacagcacacauaaaaugcaugggauauaagccagguggugguguacaccuauacuuccagaacucuggaaacuggagcaggaaaauggugaacuugagguuaaccuagccagguuaacauagcaagaucgucucucaaggaaaagaauacaugggauuuaguaucuagacauaauccugcaaaaaaacagaugaaagaacugaucuccagauaccauuucacuugagucaaaugcccgguguggaagcuuagaacagagcuuugcuuggacuccucuugcuuaguuuaggggccuggaaagguaaaagucgaagcaucuggggcacauuuuucuaaaagaggauucauuuuuuaucuguuugugagaauuuacuucaaaugugcucagucauuugucaauaauucauaguauucagccaaacuaauaaagaaaaaucguuucuuuuuuuaauuauauuacauuuuuagaaagaaggggaaacauaagcaaggaaacuaagguuagaacuacuucagagaagcuuugcugguuauuauaaaaugcuauauccuggcuagaagccaggaaauacaguuuuuuguuuuuugguuuuuuuauauauaauugcaugaccagcaagaauucuaagucagugacauuucuaaaaugcuuuacucccuauuuaugcaaagugauuuuauaaacuccaagaacagaauauuauuuccaugucaaaagaguaccugaucucugaaacagauacuaugccagcuaaagaauuccuggggguauguauccaauuaacuugaaaugcuuuguauuuacuuucauuggaacuuccacacucugcugacuaacaaaacaagacaucugauaguggugugucagcucaggggcuggacacauagucuagugguugacuacuuuuuacucauauagaggaccccgguucaauuucuagcaucauauggugacucacaaccaccuauagccccaguuccaggagauccaaaaggaauauauguauuacacauauaugcaagcagguaaaacauucauacauguaaaauaaauaaaaucuuuuacaauguaagguccauauaagucuuaaaaagacuucgguccaaagccaggcggugguggcgcaugccuuuaaucccagcacuugggaagcagagacaggcggauuucugaguucgaggccagccuggucuacaaagugaguuccaggacagccaaggcuacacagagaaacccugucuugaaaaaccaaaaaaaaaaaaaagacuuugguccauaaagacuuugaucacuucuauauacucccuuaucuaaaacaauuuuucaacauuuguuaaagaagagaaagaaaaaacuauaauuaggugaguagcugcuuugcugugaagaucacucugacuuauuucugaauugauguauuuauagauccagaaagcuaccagcuccuccagaagugaacuugaagggcggaaaggcacuaucucucaguauuucacuacuuugcacuguccugugugugaugaccugacucagcaugguaucuguaguaaaugucggagccaaccucagcauguagcaaucauccucaaccaagaaauucgagaauuggagcguaaacaggagcagcuuauaaagguacagccuugauccguagaucccaacacccagacggucugauucuucagggagacagcaucagcucuucaggguagaaugagaugugaauccagugugaacagugaagugagcauucuaaccauauagacucuuaguacaguuggcgguagagaaauggcucagggacuauaccagugucuacugcucgggcaguuccuagcacccauaauacagacaguuagcaacuauuggaacuccuguucucaggaucuggugccuucuggccucuauggggaccuucaaaaauauuauacacauaagcucagucaggaacacacaaauaaauauuaauauuuuuaauuaacacuaacaauuuuaaaguaaaaaugguuuguuauuuuauaauuuacuuuuuuguuuuauaggauugaauauuguuuauuaaaccuagauuacaauggccaucuacccaauauuuuuuauuuaaaaauaauguguuacagcucugcagggaaagguuucuucagugcaaauguaacaguucugcuccaggaagggagguuuccccacuacacguguuacagcucugcacccacaggggaaggguuuccccagcaaaagcauuacagcucuguucccagagguauccuggcaaggaacaccgcagcuaguaucugcauuagaucuuucacccuaauagccagguuuucucucacuuuauuaaaacuuacuuacauccugccacuuaggaucugagcguucuaaaaaauaucacugcuucuugguaucagggacuggaguauugcuguguuugcuuguaggaauauggauuuucggauguuggaaagcagaagaaugcuguaaaugaugcuuagugggccauucuugcaguagcauagaaggcgguggugcugaaggugauaugaucuguggggucuggcucgagagguuucagaggagaagaauuuuaguugccuagagaugguucuuuucauuuuagugaagaauauggcugcuccuuguccuuguccaaagagcuuuccugaggcuaagguaaaaauacuuagauuaauugaauugacaaaggaagucucagaaaagccuaguuagacuuuguccuuugguucacucuuaugaggaacauuuuuaucaaguguagcaagcuuagaaaggaaaaauacaaagugcaugguucaaggauuaaagaggcaccaggaaguggaauagagcuaaaucuccauucagggauauuacauguaauuaaaggaguggugacuuuggggcaagaucccacccaacuuaaagcuuauuguuuauguguuuaaaguugaacuagggauaguuauaucauguuaggugcuauuauaaccugguaauuguuuucauuuggacauaaagauauaugauuaugucagauugacaagagauagguugugauggcuauucuugguugucaacuugacuauaucuggaauaaauuacaauccagaacuuacaaagaucuuaugaaaaagaaaaggauggugguacaugccuuuaaucccagcauucaggugacagagccaucagaucucugaguucaaggucaggcuacagagcaaguuccaggaaagccaaauuuaggcagugaaggauguaauagaaaaacggggccauauuucagcccuaccaagcagcagaacguggcagcuucagccaucuggcucugacuuuaaagugaaaaguauaagggguuccuuggacaauuaaugauacuuagcuggagccuggaggagggccuguucaaguugcugggauggcuuaguaauggguucaagaaaggguucaugugaggggucaagggccaccuuauauaagguggucaagaagagagagaaggaaucuaggagcauaagaaaccagacaucccugagaagaauagaauuucaugcuugcuagugggacuguacaugacuggauuaaguguuuucuaucuaugguaguggccuuggcuaaucccagauaaguagcuugaggaguaaacagcuggaccuuaaagaugagacucuauaucccuugccugacaauuuaauaagguagagguaucugccuggcugauuugcagggauggacuacaaagaaaaagaucaucuacauauuguauaagcuuggauuuagggagagauaaagagagucagaggccagaaccuggccaaauagauuugggcuguccuggacccccugggguaggaugguucaaauaaguuggguagauguuuggcuauaaaggggcugggguaucccauacccagggaucuaccugagagaggcuaguaagggaaaagguaugucaaagugugugguuuggagaacaggaggggaacaacuggugaguuugaggucaagcagauguagggagcaaaagaaauagaggcucccauuuuggcuaggaggcccuucccagcaagggcugggacagguuggcaccacuaaaaaggaaagguuaagaaggauauccugaaauauauagcugaguggugaggcuuggugcgccugauaaggcugucccccuauuccaacaauagaggaaugaggagaggugaguccccagaaccuugucagaacugaaaauguggccccaguguccagaaggcaggagauugaguguccuaauacuguggugacuaccaaaagcucccugucagagauggcaguggucaggccaggggagccugggcccccucaguuguccauggccagaucaaggagaucagcuaaagggugaccuggguuugauuuccccaauugauggagucuuccaaagagaaagacuguauuucuccugcucucaguauuccuagaguugcuauaguucuuuguuggaguuagucaacuuuaauaugucuguuuguucauguuugggcagucauguugauuagacuuuagaaguguagcuacugacauugcuaggcaaggcaaacucccugauucucuaguucuuacaaccuuucugcucucucuuccaaaauguucucugugcuccaaggcugcauuuugauuacauguggcuuucuauauugauucucuugcacagaguaguuuccuugaugaggggugaacacuacacuuaucugcagguauaaggacagauguuuagaauguagagauuauacuaguuuaguaaagugguggcuguaggucugccuccagggucugugaccucacaaugauauuuuuuaaaugucugccuucuuaagguaaaacauagguauccuuuuguguuaaaauuuuaaauuuaagugugaaucaagcuguaacacucuggguuuaaucaccaguaaaagccuuacaaguaaacauuucagcuagacuuagcaaguuaagugucccaggcuagauuacuuaccaggcaggcauggaaaggucuuaacuagucaucaguuuguccuggcaccuuaguguggcuguagugcguacagcugcagcacagagaugcucuaaugggaguagauggaggcucuugguaaagaucuaauuagcaagaugcuuccuagaauaguacacugccuuugcagaguaucugcuucuaaacaguuugcuugugguaauaaugugacauuagauacagugaccagugugcuuaggaaaaugugcauucaguugacaggcauuuuacagaucagaauuucagugccuugugagcuauguuuaaaccagaaccccuugcacaaaugaacuaaagcuuguucaucuccuuaaucacagucuaaugcugucucacuugauucugaaauggcaguguaagcuggcuggccuaagaacugcuuaauucagaucaucuuccuaccugagacuccaaaguagcuuaagacugaaugcuugcaccuuuggcccccuuucuaaccacauaguuguucuguauuuccuugacucugaagaguucucacuaguauugguuuaaacuaguuuucauauuuaguaaucauauuaacuacauuuaugacuugaagcuaagcauuauuuauaccugauuguguaaggcaucauaauguuuccccuuugcuagaaauguguucugugauuaauuauucuuaagcacugucuuaguaaggauucuacugcugugaagagacaccaugauaaggcaacucuuuaaaaagaaagcaugcgacugaggucuagcuuacaguccacacuuuuccaaaaagaccgaaccuccuaagccuuucacauagugucacucaaaucuaugguccuaugaggacccuucucauucagacuaccacauuccaugcauucagucugaccucuaaaguccccauaagucuaucagagucucaacacuguuuaaaaguagaaaguucaaagucucuucugagacucauggcaaucucuuaacuguaaugcucuguaugcagauggcauacuuucaacagaucauggcauagaauauauauuaucaguccaaacguaggaaaggaaacugagaaaauacuggaccaaagcaaaacuaaaauccagcagggcaaacuccaaauucuguaucuccaugucuggugugcacucuucagauuucuagcuaaugucagcuuuguuggcugcaacaugcuucuuucucuugggcuggucgcacauccuguuagcagcccaccuugccagguaucccauggcucuggaucuccaacauccugggguccccaaggcaaccaggcuucacuuucacagcaucauacaguggucucucugaaccuccauacagagaccccuugauguuccccuagccuuaguggcuuuccuuaaccacuugagggagauucagcaaugucuuucuugcauccuugacucuaaagccagaaccguguggucagagcuaccaagucugcugcuuaguggcccuggaacccagccccuucuuccauuacauauuuccuuauguaccuuguacaguacauguuuauguauuagaaugugaugacuuagugugcggccaguaugcaaugacuggaucagguuaauugacauuucuuuguauuaguaauauccucuccuccccuuuuuggccgacgggccuuauauccagagcuggucucaaacuugcugucuagcugaggaugacuuuaaauuugugcugaccucccugccucuagcuccugccugcugggguuauggguaugcaccacugcacucgguuuauguauaucagcacuggggauuaagcaaaggccucucuucuaccuccuuugggauaauuacuauugauuguuaucaccaugcuguguucaugacuagaacuuauucuuccaauguaaguguauuuugauaccuguuacgcagccuuuguuuguuucuucucucccaacccucuagugaucauuauuacauucuuuauuucuaugagaugugaccaauuuuaauuucuauauaugaaaauauggcguuuuuuucuuauauaucuggcuuauuucaguugguugcauccuuauugcuacaaaugaugggcuuuccuuuaugacugaacaauacucuauuuuguagguaugccuuauuuuuccuauucaucuguugcuacauaccucaggugaugccauaucuugaaugguugaaaauagaaccuacaauuaacauaggaguugaaugugucuuugauauagugauuucauucauuuagauauaggcucaguaguagaaauacuugcaucacgacuaguucuauuccuaaauguuaauguccccauacugucuucugauucauuaauaucuuuuuuuaaaaauaacuauucuaauugagauaacugauaucuccuuguagauuuguuuguugguuuuugguuuuuugagagagaauguuacagcccuggcuagccuggaacucaggacgcuccagaguauaagaauuauacuuauauaauucuuauauauaagaucuaauucuuauauauggcagauuauaagaaugugccaguacccccauaucuccacuguggucuuaucauccugcuuguuagugauguuagcugcuuuuucauauuuuaggggcuugccguuaaguuuguucauuguagguauuucucaucacaugaauaguuuccuaacauuuucucccaauccaccguccuuugcuaugcauaagcaccucguuuaauagaaucacaguguugguuccugcuuugguugcucauguuuucaaaucaugauccucaguugugacuuugucagcagugugugcaagucucaguggcuuaggucagucuuguaggacuagaucugagacagggcuuuuccaggugcugggcucugguucaguagucugggcaagcacagguagccugccugugccuuucaguguaacgagguagcauuguaaaugaaagugaaccaagaaauaaaaugaaucuugagaccguuuuguacuuuccaugaaauauggcuaggcuucugagauaggaaacagacagaauucucuguacugaguuaaguuugccaguuaacugagguagcagaaaagaaggaaucuaaaaaccuguuauuuacauagguguguguguguguguguguguguguguguguguguauguauauacacacagaagcauuccuauucuguuuucuuucaucuucagauaugcaggaacuguacagguuccuuugaccgacauaucccguguguuucccucaacugcccgguacuuuucaaacucucacgaguaaacagagaauuauccaaggccccguaccugcgacaguuacuggaccaguuuuaaguuagcagugucacagaauuccaggugcucucugcucaguguuuaccacucaguuccucugcauggugcuuucucaaccuccaucaagucaaagauguucacugucugucugccauccaagacuaugaagauuucugcuaacgggauuaaaaaggauacaugcugcucucuggauagcuuacuucuuacaauguacaaauuccgcaucauuucaccuuugaacauuguuuuauaauaauacagguguuggauuugcuccaguuuauguaccaucuuguaaauccauuugaacagaucauguuuacuucccuguggaaggaacacugaaaaccucuuaaagucauucguguguauuccuuaaacugucuguaucaggauguguugcuuagagauauccacucacuuuauaauuuugacugcaaaauauuuuguaaauacacuuuuuuacuuuucaaauaacugaguaaaauaaugugcaaugaauuuuauacaaugauuuucacguuguugguauaucuccucuagguuuugcuugacucaaagguagauuuguuacuuugaucaaacugugcaaauaguaccauguguagcauuuuugaaacauucuuuucuaaagaccgcugucuugcuauagcuacuaacggggcauugugaggaacugugcaaagacauuuuuguuacaaaccugugggccuguugcaauacuuuaaaaauaaaauaaaaaaauuuauuccauuuugcuuguuuuguauagacauuucuauugcuucuaaauaugcuuaaaauauuuucuuuccuuauguacuguacaguuaaucuuauuugccaucccuugaacacaaauguguauuuaggauauuuguauaacuguauaaaaugaaaaaggaauuauguggucagugcauuguuuuuuaaacuggaaauccuuuuguuuugagaguuaauaauggaaaccaaauuaaaaauugaauaaaauaugaaauacag

SEQ ID NO: 5470 - RNA, 1874 nt, Mus musculus
aacucccuuguucccauagcugaucuuccccccuccacucagaccaagaaccuuauccucaccuuagugaacaaaccuccucacacucaaugccaccuccccuaaccauguugaugacugcuggcuguguuaccauucccaaccaccuuuuugugaaggcauugcuguuccuggcuguuuuaccccuacaaaugauccccaccauugccgcuggcaaccuggggaguggaaugguuuaucccucucuuagucucaggauugggccucugugugacuucuaauacagccccuucacaacaugcucaccuuuguaauauuacccuugcaccugauauuuauuaguagccgguauuuaguucccccaaaugauaccugguggguuugccuugaugaccucacccacugccucucagccagugccuuuucugcaaaaaauucugauuuuugcauucuuguacaauuggucccucgauugauuucuuaucauucagaagauuuuuuuucauuugugagaucaguccacugauuucuccccuucacugguccaccagugaagagagucccuaacugccaucaccauuucaguccuccuaggucuuggugccgugggcgcggggacuggcaucucuucauauguucucuccaagucuagggaucaagaacucagugucaccauugauaaagacguccacaucuccaacaaggcauugacgaccucucugauucccucuccuccuuagcugaaguccuccuccaaaacugcagaggacuugauuuacucuuucuacugcagggagggcugugugcagcucuuagggaagaauccugcuuuuauguagacaagacagggguggucaaagaaagcaugagaaaaaucagaaaaggacuagggaagagaggaagagagagagagagagagagagagagagaagagagcugguauaaaaauuguuuuucaaccucuucaugguugucaacccuacuuccuuccacuuugggaccauuaguuggguuuguuuuuguuuuuuguuuuuuguuuuuuguuuuuugucuuuuccuuauuucuuuuggucucugaccuuuaacagacuuaccaacuuugugaaacaacagauagauaauuuggcagcaaaaccuauccagauaccuaucuauccagggugcuccccaaacccaucuucacccaaccuaaaaaaaggggacgccugccccuggaacaaguagagaggggccacccagaacccccucugacugguaaacuaaguucuugcuugggcugcgaggcaaagcacugcaagggaauauaaaacaaaaacuaaaaguaucuuucuguguucccugagggauaagccugacugcauaggaguugauguccaaacuauccccucaccaggaaaaaaacaucaggacagguauggcccccaugccucaguggacaauaucagguggaccggagccauuacaaggcccccuuuagucacuggaggucaggccucuauuccagccuggcaaagauuaaaaucgcaacaguccuucuauacaaagaaaaagggggagauguuggagauguugaccuugcuugaauguuaccuccuugucagccauaagugcuuacuggcacaaagucuuggccucugugggaaaguacuagcccaguugagaacaaagagcuauagaucuuguggucaggugccuagcagcccauucuguucugcucuuucugcugaacuuuuuacccagccaguauccuguuccugaaaacaggugcaguccucagagacaaagcgacucuacuccauucccugcaccucauauccugcuucuaugaguauauaaacuguguaggaaaaaauaaaaauuugucagcuugauca

SEQ ID NO: 5471 - RNA, 1136 nt, Mus musculus
cugagggccucucucuugcucucaguguccuugcugggguggguggucuaggguuucuuacucuuuggaggccauguaggccaugagguccaccacccuguugcuguagccguauucauugucauaccaggaaaugagcuugacaaaguugucauugagagcaaugccagccccggcauugaagguggaagagugggaguugcuguugaagucgcaggagacaaccuggucuucaguguagcccaagaugcccuucagugggcccucagaugccugcuucaccaccuucuugaugucaucauacuuggcagguuucuccaggcagcaugucagguccacgacggacacauuggggguaggaacagggaaggccaugccagugagcuucccguucagcucugggaugaucuugcccacagccuuggcagcaccaguggaugcagggaugauguucugggcagccccacggccaucaugccacagcuuuccagaggggccauccacagucuucuggguggcagugauggcauggaccauggucaugagccuuuccacaaugccaaacuugucauggaugaccuuggccaggggggcuaagcaguugguggugcaggaugcauugcugacaaucuugagugaguugucauauuucucaugguucacauccaucacaaacaugggggcauaggcagaaggggcggagaugaugacccuuuuggcuccacccuucaagugggccccggccuucuccaugguggugaagacaccaguagacugcacaacauacucaguaccugccucaccccauuugauguuagcggggucucucuccuggaagauggugaugggcuuccuguugauggcaagcuucccauucucagccuugacugugcuguugaacuugccguggguggagucauacuggaacauguagacaauguaguugaggucaaugaaggggucauugauggcaacagucuccacuuugccauguggaaagcagaaggcagcccuggugaccaggcgcccaauacggccaaauccguucacaccgaccuucaccauuuugucuaugggacgaggcuggcacugcacaagaagaugcgguuguuucuggaacagggaggagcagagag

SEQ ID NO: 5472 - RNA, 23801 nt, Mus musculus
uuccggcgcucgcggcggcuucccggaaguaaucgguacacgugcauucgcuaagggaucuugcagcuauggaugcuuuggacaaaguucuguaaguguguggggcgcgauggcgugggggcgagucucccgugaccuccgacgcggucuucccgcugucgcucuuuccggucgugcuuugcuaguggucccugggaaggagucggcucggccgauucuccgucccgaaucgccgcuggggaagccgugguggcagaccgcgggcgguggacuggagcgagggcggacgcugugaucggcuuaugaccucgccgcugauagauucugagcugugagaauggugguggccucggaaucugacaagaaccaggcgacaaacuggacucaaaguuuugucacucugggcauuugaacagcccuaaaucaguuuacccuguaaaaaauagcugucacaacagccgugugucauagaacuguagagagcaguguuugccacaacagguacaaaaugggaauuuuucuuuuccuuccaaccuuguacacuucugcauuucccugagugaugguuacguuuguucaaaaaauacuuauugaguucccaaaugcuauugcauugguucuuacaguuuucugcuacuuaaguaaauauguaguguagacgacaguuucuuuuuagucauuaaugaauuuugugcaccuacuaugacuaacuaguaaggugcuauuuauauugauaacugguuagucaaauugcauaaagacacgggcuguaaaguguauaaaaacagugugugccuugauuuaacucaauaaaauguguacaucuuugacugacuauuaaaugacuaacuuggguuuuuuuuuuuuuuguuuguuuguuuuuucgagacgggguuucucuguauagcccuggcuauccuggaacucacucuguagaccaggcuggccuugaacucagaaaucugccugccuuugccucccaagugcugggauuaaaggcaugugucacuacugcucagccuaacuugguuuuauacaugacauuucauuggaggagaauuuuuaaauucuaugugggaaauuaagguguaugcauauuuuggguuuucuuuuauuuuuuucuuucuuuccucucccuuucuccuuccuuuccuuccuccccucccuaccuccccuuuucuuucucucucucuuucucucgcucucuuuuugucccuccucccuucuuuuuuuucucucuuucuucuuucccuaccugucccaagacugggaaauggaggguuauuuuuauuugagagaggagaaauuuuguucauagaaaacugugaaaaguaucauguuuacugcagcaaaucagaagcaaaguugaauucuuuuuuuuuacauucuuuuuuuuuaaauuagguauuuucuuuacauuuccagugcuaucccaaaagucccccauacccugcccccugaauuauuugcacauuggaguuguaacuuacaucuaguacaauuuuaacguuggcuuccaugccagcagugaagaucuugggcauauuauuuuuuuagucuugaguugccugauuuguuaaagagcuguaauuacaggccaccaugcagaaacauacuaaguuaaaaacaacgcuuaacuugacgucaucucauuuuuuaaauuuauuuuuauuuauguaugugugaaugcuagcuuguauuuaugugcacuuguguaugcaaugcccgcagaagccggaagagaacagcaggucccuggaacuggaauuacagccaguugggagcuguccugugggugcuaagaaccaaaucuacauucagaucuacaaaggcagcacuugcucuuaaccuaaccucgaagccccacaauccuuuaguguuuaauaagagguguagaaaaaauuaguauuagaacaagugagaauagcaaaaaggaaguuuauguaagaaaccaaaagcuaauaaaacacauaucuaacaguaaugauaaaauacuguugcuaauaccaucuugaaaaaguagggauuuuuguuuguuuguugagacaagguuucucuguguagcccuggcuguccuggaacucacucuguagaccaggcuggccucgaacucagaaaucggccugccucugccucacaagugcugggauuaaacucgugugccaccaucacacacuggcuaagugagguuuuuguuuuguuuuguuuguuguuauuguuggaauccugcuugauaaaugugaguaccauuccugcugaguuccugucauaugaggaaaauguguaacuuguucugaauugugcuuuuuuuuuuuuuuuuuuacagaaagccuaaaacuaaaagggcuaagagauuccuugagaagagagaaccgaaacucacugagaacauuaagaaugccaugcugauuaaaggcggaaaugcaaaugcaaccgugacacaaguacucagagacaugguaggcauauggaauuguugcuuccaauucuguauuuuguaguauguguaugcgugugugugugaguauguacauaugugacuauaccugugagccuguugauguggugguagcagaacuuggaugcucuucgaggaaugccuugccaucuugucagcccuugcuggccagcagcauucucacugagccacauugcucaccuuucgucucacugagcccgggauuacagaugggagccacagugucuggccuggcucaucuuuuucugaaauauuugacugccuguugugguauuggggggaacagccagccauuccuucccagugaccuuacacauuuaagcaaguucuaagagcaguacaauauuagaauauuacaguagucagcguucaugaugaucauucucaguuguuagaaaaagguggcacuguucauugcacugagacagggaaacacuuggcugagugagacccaacacauguuuuauuaaacacgguagcauauguaauccuagcacuuaggaggcagaggcaggaagauuggcagucagggcagcccgggcugcauaguaagauccugccccagcccugaauuuagaacaacugcuagugcaggcauauaaaucaggaagguagccaugacucugcuucuugaauguucuguugagaaaguuuaaaauuauguuuuacaguaugcacugaagaaaccauauggaguucucuauaaaaaguaagucauuauuauuauuaucaucaucacuuauuuugcuuaguuguaacaauuguuuuaugaaagguuuggaagaaaaagguguuaguauuuacacugaaugaauauucuuuauauauauauauauauuuuuuuuuuuuuuugagacaggguuucucuauguagcccuagcuggccucaaacucagauccaccugcuuuugcgucccgagugcugggauaaaaggcgugcaccaccaugccuggcucagaauauucuugcaucauuguaacuuagcuaauuuugaaggaguuacauauguauaggaaaacucuaagaaugacuagaguuccugcgugucccucacccagcucguccaguggugucuuacauuaucacagcaguuaguguaaccagggauuggcaguaauaccgaggaaguuauugguuuacuagguaacuguuuucucucucacauuguguuucccuagucuuguuuguuuguuuccuucuugaaaauaauggggauugaacccagggcuuuguacaugcugagcaagugcuccugccaguuagggguacccucaagaccccaguuguuaucuuggcauaggugcagagaucagaggacaucucuguggugugggugaguucucuuuccaccucucuguguguucuagacuggagucaagcuguuuguuaggcuaggaggcaagugcuuaccuaccuguugagccaucuugcuggccccauucuuugucuucucuaguuugugaaagucuuugguagcuuuaucucugguugucuccauuauuacuaauuuccccuuuauaguuaguaaauauuuaggggagauacuuugagacuaugcaaguuuagucauuccucaguucuuggggguggggguggguuugggacuuuccugcaauauacaaaucuuuggauacuccaguccugaguguagaauggcaugaucuaucucauaaccuauguacaucuuccuguguaccuucaguugucucuacuauguaaauuguaaaugccugguacauaguugugcuuuguuguuauuggaauaaugcuaagaaaccaacaucuucccauguccagugcagacaguccccgggcccccaguauuucauauuucauaugcacaauugcauggaucuguggauuuuaaacucacaggcucugagggucagucuccuuucuuucugggaacauagcugcugccuguacugucuguaguggucugugauauagucaggaugcugugguacucugguggucucuuucugcucagaauucugaagauaaaguuaucugaaaucaguguggguucagcauacucaugagaguuauuauacagugcuguuauuugaucauacuacaaucuauucucaaaacacacaaugauguuuuaaugagaaaaaauuuaaaaauauauguuuauuuaugaguauguuguagcugucuucagacacaccaaaagagggcaucagaucccauuacagauagcugugagccaccaugugguugcugggaauugaacucaggaccucuggaagaacagucaguguucuuaaccgcugagccaucucuucagccccaguaagaaccuuuaaaaaagaaaaguuaagguacaggagagauggcucagcgauuaagaguucacaccggucuuauaggccacugaaguucaauuaucagcacacaugucaggcagcuuacaacugccuaugacuccagcuccagggcgucuugacauuucugaccagcacaggcaccagcacuugcauguaaacacaccauggaaacauacauauaauuggaaacaaagucuuguuuucaaaaucuuagcaugucacuccuuuccauuauucuuucugcauauagucugcagccuuuaaccaguaaaguuauuuguuuugguuuuuagaguugcuuugguuuuggcuuuugagacaagguugcauauagccuaggauggccucugacuccauccugcuuuacuuccaagugcuaaggcaugcucagccauggcauucacaucauuguucucuuugguggcucaguuccagcaguacuugccugauuuuuuuuuuucuugaauacucuaagcuucugccugucucaguaucuuugccuuuuugugauggagugcuagagaugagauccaggguccuauccaugcuagagaugagauccaggguccuacucaugcuagagaugagauccaggguccuacucaugcuagagaugagauccaggguccuguccaugcuagagaugagauccaggguccuguccaugcuagagaugagauccaggguccuaaccaggcuagagaugagauccaggguccuaucuaugcuagagaugagauccaggguccuguucauguuagagaugagauccaggguccuaucuaugcuagcgaagagauccagaguccuguccaugcuagagaugaaauccaggguccuacucgugcuagagaugagauccaggguccuguccauucuagagaugagauccaggguccuauucaugcuagagaugagauccaggguccuguccaugcuagagaugagaucuaggguccuauucaugcuagagaugagauccaggguccuguccaugcuagagaugagauccaggguccuauccaugcuagagaugagauccaggauucuacucaugcuagagaugagauccaggguccuguccaugcuagagaugagauccaggauucuacucaugcuagagaugagauccaggguccuguccaugcuagagaugagauccaggguccuauccaugcuagagaugagauccaggauucuacucaugcuagagaugagauccaggguccuguccaugcuagagaugagauccaggguccuacucaugcuagagaugagauccaggguccuauccaugcaagacaggcccucuacuacugagguaguaccuuuuacauucugcucccacuuagaaugauccguuuuaaauuuuacuuuauuugugugugucuaaguguguuugcccgugugcauaugaaggccuguggaggccagaagaagucauuagaccccacagagcugaugugagcugccuggaguggguucuaggaacugagcugauucucuguaagaacauguacccucagcugaugagcaauugcuccaccccaacacuuagaauaaucuuugguuuuugugacaggguuucucuguagcccugguuguccuggaacucauacuguagaccagacuagccucaaacucugagaucuaccugccucuguauccugagugcugggauuaaaggcgucugucaccauugccggaaagaauaauguuaaucucagacccuuucuguggcaaauugauuaaucaggacuuagcuugaauaauccuuucacucuuuaugcugauguggcgccugcucuuguuuugucacaaaagucauugcacugugguuguugucguuguuguuaucauuguuguugguuauuauuguuguuucuguuuguuuguuuuagauaggauuucucuguauagcccuggcuccccuggaacuuucucuguagaccagacuagccucaaacucacaucugccugcuucugccucccugaugcugggauuagaagugauuggcuguuuuugguuguuaauuuuguuucuggguguuuugucugcaugcacuccugcaccgagugugugccagaugcucugugaggcccuggacuugaguugaugguugagagcugucagguggauggugagaguugaacccagguucucuaaaagagcagccagugcucuuacccacugagcaucucuccagcccuccucccccauccccugugggaagcauauauugagacagggucucaccgcagccuggcuugucuggaacuuaaugauaucuaccuaccucuauuuuccucggugggauuaaagguguaccacagugcacuacuguuugaaucaucugauauaaaauuaccuuuuauucauuauuucauuuaacuguacuuuuuaacauuaaaacuggagucacucuuuuuuuaauauucuuaggaaaaauauuacaagaccauuugaggaucagacgucacugguaaguacaagacucuuuuuuaagagaguacauaugggcaggacugggugugugguuggguagcuugccuacucugccugaggcccuggguucuguccccaccacucagaaauaacagaaccgacuguguaaaaaugacugcagacuaaaacacacuguguucauaaacuguuauuuuuaaguuagaaguccuguacagggggccuggcgagauggcucagcgaguaagagcaccaacugccccuuugaagguccugaguucaaaucccagcacccacaugguggcucacaaccaucuguaaugagaucugaugcccucuucugaaucugaagacaguuacagugugcuuacauauaguaaauaaaucuuaaaaaaaaaaaaagaaaaagaaauccuguacagugugaggauuugauauucagauugagaaguaagaguacugccuuuuuacagugugugugugugugcauguguguguguguuuguagguuugaauuaaauucagguaccagguuuuauaccucuauccacugagccaccucuccuacuaagaauguaaaagauacagcuauuauuaaaagauagcuauugucauuauuaugauacucuuuuuauuuuuuauuuuuuuuuauauuuuuuguuuuuccagacaggguuucucuguguaguccuggcuguccuggaacucacucuguaguccaggcuggccucaaacucuaccugcaucuuucuccugagugcugggaggcauugucucgugcccagccgguuuugguuuuugacacagggucccauguauuccagggugguuugaacucuguauauggccaaaggugacuuugaauuucucauaccccccacauccgccuccagugcugugacuacaggcauggaccaccaccacuguuuaggcagugcugggauaggaccaaaggcuuuguacauguccuacauccccagcccuugugguaguuuuaaugaaaaaaaaaauuuacuaucuagaaagagaagaaucugauggaaacugucagcuuuggguguagaacacacaagggccauuccucucugcuggguaugaagggauuggagaucaaaagccaggaagguaaugagaaagggcuucguguauaaaugguggagaugacaguaggguugauuucuagccuugaaguccugucucccguguucuaagugcuggaaugacgguuguuugucaccaugcuuagcuugaauacauuuuaaaaugucacuaaacuucauauucuuugaaauaccauagucaauucagauaucuggauaauauaugcucgucuuuuuuuucucuuuuuugaaacggguucaggaaacccaggcuguauucagacuuguagaugauggcuugagcauaugguccuccucugcuuucgaggucuggccuuaaagacgugucgcaccacaccuguaggaggauguucuagagaacacguuuugagaacuuauucccaaugguuuagaccaugaauauauucuaaagaguuuuuauuuuuuuuaaugugugugcauaugugugugggucugagcacaugagagccagugugcagaugccagaaguguggguccccuggagauguagucacaggugguucuagaccgccugaugagugcugggguugaauuugggucucuggacgagccggaugaugagcggcccugcuuuuuggagcacuuuguagaaugccaucacgugacacaucauaugaccuuggugggguuucugcaagacuauuucuggcaaauucuuagaaaaguucauuugucaaagacauaguuccacagccugccugccugugugccuuccauuuguuugucuguauagagaugagagucuauguagcccuggcuaugcuggaacuagaucuguagacuaggcuggucuugaacuuacacagagaugugccugccucugccucacagugcugggguaaaaggugugcacugccacacccugucagccuaaauucuugacuguucugccucguuugaaagugaugggcagguguggcucuuggcccauuugcuucugcaaagaaacaaacuggaagagaagcagaucaggagcucaccccucagaguagugaccaaugaguguggcaugggaugggccgggucgugcagcacauggaggacuuagaaauucuguagguuuuuuuuuuguuuguuuguuuuguuuguuguuuguuuuuuuuuuuuuuagcugauuuuggacuagaacacauugaaucuagguugcauauguguauuguaugcccgugugcgugcgugugugugugcgugugugcgcgcgcgcgcgcgcgcgcgcgugcgugugcagguaagagguugacgcagagguuuguuacccuccaccuuuucuuugaggcaggucucagugaaccuggcaauuuuggcuuagaguagcgaguugugagccccagaauugcauguuucuagugugccagugccggguuccauaugugugcugcuguaccugcccuuugaaucuuaguuuuauauuaggaauagugaccucacucucgugagccaaguguguggaauauaggacuacacaggacucucuaggauugaaacuucauauuucuguuguuucaacucuguaauggaagccaauaaauacuucugugaucccagccgugccuacacuggaauaucauagucugucaguggccccagccagacgcauggcccggagcuaaguaacggugagcaugaggcucccagagcacugcuuugugugguugcaguugcucugaaaaguagcaacaugcauaaaaaacucaagaacccagguccagacauccaaagucaguguagucauagguucauggggcuccccugugagugcugaggugucagaggacucaggcagcaaugggacacuggugugcuacgcagaaggacuaacugcauaauugaaaugaguggucuuucagauacugacuucguaauguucauuauuucuccucuugaaaagugaaucuuuuaacuaaguaaccccaagucagaaaauugaauuugaaaguuaaaauuuuuaugucugaguuuuuugccugauugcauguguguuauaugugccugauugugugugugugugugugugugugugugugugugugugugugugugugugugccuaguacccuuagagguuagaggaaggugacggaugauucuuaguugccaugguucugggaacugaaccccgguccucucucuacaagagcaacaaauacucuaaccucugagccaucucuccaguuccuucuguauguaucuaguuuauuaccuuuuucuuagcuauuucugggcgaggggcaggggcagccccuaaucccuuccaugagcuuacagguaagaugguugcuguuuggagacagucucuugcuguguagcuuuggcuggccaccucacugcagugcuuccuucugccucagccuugcaagggcgugagcuaccacagcuggccaggcugaaauucuucaagggcuuuucuucuuauuuuguaggaguucuuuucaaagaagucagacugcucuuuauucauguuuggcucccauaacaagaagaggccaaauaaccuaguaauaggugaguaccauccucucucgguuuuagguugagacaaggucuuauaauguagcucuggcaugccuacaacucaguagaugccccugccucagagugcuggaguucauggcauuugccagcacucuucaguguuuggguugguagagucagcucugugauucagauagauguuuucagaacuuacaagccauuggcaggccccauguuuucuguugcugcuuuagccuugugacguuggacuggggucugccucagugguagacaucaguauuacccugccaucccugggaagugagaaagaauaugaacuaguucuugguuaguaaucuuagggcaucauugcuaacaucuuuggagaccaguuccaguuuuuaaacaggaagugcaguuuuauuuauucuauguguguuuguauaugcacaaaucacaugaaauuacagucaguuaugacacuguaauugugcugggaaccaaacucagguccucagaagagcaggaaauacuauuacccacugagccaucuccgucacugauacacagcguuucuaucuaacauguucugucguaggcgacuccuucacucucuguugucuuccuguaucuuguucuuugaggguagauguuuuuguuaagguuucaucccaagccuaaugcaugcugaacacuccugguauacugagcugcacuucuuuuuuuuuuuuuuuuuucucgagacaggguuucucuguguagcccuggcuguccuggaacucacucuguagaccaggcuggccucgaacucagaaauccgccugccucugccucccaagugcugggauuaaaggcgugugccaccacgcccggccgcuacacuucuuuuuaguucauuuaauuauuuuugaguagaaucuuuaucuccaggcuggcccaggauuaguuuuauagcccagguugaguuugaacuccauucuccugccucuccagugcugggauuguaggugcucagccgccacacucaguuccccauuuagucuguuuaaaaaaaaaaaaacaaggaguugugcucuucgugagaguguugucagcuuuuccugacuaacaucccaauagcacaccuaaguagauaucaaaguuuaagggagugugugaguucagagagacagaagacacagguaauuugaagccuuauagauaacaaaagguaaaugugaaaaccuaugugcuuaaaaauguauuugcuuuuaggucguauguaugacuaccaugugcuggauaugauugaauuagguauugagaaauuugugucucuaaaagauauuaagguaagauacugaucauaaaacuuaauaguauuuuuuaaauguucuuggccaaaauuagcaucuuguggugaagaaguacugauagaauagugaaagaaacuucaugcagaauuacaguuuuaccuuuauuuuaaaaagaggacauguaggcugggcaguguggcccacaccuguagucaaaacgcuugggagacagaggcggguagaucucgaguucaaggccagccuggucuacagagagaaacccuguuucaaaaaacaagcaacaacaacaacaaaaaaacaagcaacaacaaaaaccaaaacaaacaaaagaggaaugaauuuucuuuuauauguaauauauaguaaguacauggaucuuaugaaguuaaacucgggagcguagcgauccauuccuaguuaggcucaugguuuaaaugcugucuuucauaagugguaacauuuauucacaaucugaaguuuucaacuugggcacuguucuaugaccaaaaaccucuggcugccccuauauuguuuugguuauuaguugccaaauuacuagcauaaccucccuugggaaccuacaguguacuacuuguuugaauaggauugugaaguaggaaguagcaaggugugguaagacagccuagaaaggcugcaagagugucacuucagauuguccugucaaacguugccgucaccuuacaggugugagaucaaggcaguuucccuggcuggugggguuucuguuugucucuguuuuugagacagggcucacuaugagcuuuggcuguccuggagcucccuaccucugccauccaagugcugggauuaaaggcccgucaucugaccgccaucaggcccaguuuuccauuuacauugggugauugaagcccaaagggguuucauuguuuaacauaugguaacauacaugugguagguaaaacucaagauuagguuuaagagcauagagagaaaaaauaguguguguaauggaaaguuauauaacucaguggggguuuuguguguugccugcauuaagaaggguuuuaauuaacccaggcuggauucagacuugcuaugugaccagggcugaguuugaacuucugaucuuucugcuucuacuucccaaaagugcuggggugacaggcaugaugcacugugcccagcugagcuggugcauuuucaaggcuugugauauguguuaaauuauaguauacuauauuauauauuauaauauuguguuauaguauaugcauauuguucaucucuucagcucuccucuaaaaaggggacagaccuugaaggucuaguauaacuaaauguccuuuuccuguggguuggaaaaaggcuuuuaccaacucccuguguggucagcaacuccugcuuccaaagcucaaaggucucacacuggauggacguguggauucaaggcauaacgugacacugauuuaccggaucaguuacugucuugauccucaguuguggauguagcaacaagaaugagauagcauauguguaaaaauuuugagauuguuuuaauacauauugacuaucuuaaaaauagcauagauucucuagauuuugguacuuauauaauuacacuuguuuguuuugucuuuaaucucauagacuaguaagugccccgagggaacaaaaccgauguugauauuugcuggugaugauuuugauguaacagaagacuucagaagauuaaaaaaucuucuuauugguaagugcuaguagaacucaccuuguuaacaauugcuguuuuugagaucugccuuuucugugugguuaaucuuguucacauuguuuuucugagcagacuguaaacucucaucauaucuuuaugcuccuucucccuggacucuggaugagugguauuuuuugcuuuuguuucucgcuuuguuuguuuguuuuaagacuggauuucucugcauccuggcuguccuggaacucuauaguuuguugagaccaggcuggccucaaacucagggaacuaacugccucucuuccugaaugccggggcuaaggggccaugccacuccaccucauucucuugucuuaaagccucuccaccaagcaagauaguucuucauugcucccccucacucagguucugagggcagagcagccugccuggcugucagcugucaugcuaacggccuccugcccacuuccuguaccguggacaaucuguguuccugcugaaagcucucagcguugucgucuucuaaacuuguucuagaguggccuggcaagcucugcguguggugucuagggcuccucuaccugggcaggcccagccucuccacacuccuuccacagcuccguuucugaucucugccuucugaguccugggaucacaggacugcaccugugcccaacccuaucugucauuuucccagccagaaaguacuuaguuauuuccuaguuaaugggaugcuagacuuuguaggguauugguuuuuuguuuguuuguuuuuuuaauuacauuuuuguuuguaugugggggcuggggcacgcucauguugaguugguacuccaccauaugggucacagggauuaaauacagguuggcuugguggcaagcauuguagccugcugagccgucucacagcugugaugaguuuggugguauaggaaucucaagucuguuuguucuaaagccuuguguagagcgcagcccuaugcccucauaacuggcauuguggaguuacauuuagaaaucuguggucaguuaaaacuuaagauuguaaaauaucauuaauucccaacucugaaaucccaaaguuuuguauauaaugcccuucauaauauaaguaccguauaacaugcuuuuaaaauguuaucugcaaagcacaguagggagugaguuagcuuauaauaacuuagugagucaguuuauuguaacuuguuuucuuuaguaucuuuuaaaagauuguuuuauauaauuuguggguguuuugucugcauguauguuugugcauuauauacaugucucaugcugguggaggccaaagaguacaacaucagauacccugggaauggaauuacagacagaugggagcagccaugcaggugcugggaaucaaacccagguccucugguagaguuaugaucuuacuaugggagccauuucuucagacccccaauuucuucuuuaaagaacugguuuguugaaaauauguuacagcugggcagugguggaccauuccuguaggcaggcagaucucuggguuugaagccagucuggucuacagagugagcucuaggacauccaacaaacccuucccagagaaacccuguugaaaaacaaaaagcaagcaagcaggcaaggaaggaaagacagaaaguaaguuagcuguaacuguuccucuuacguuuucuggagucacgcuuuguguguguuuauugguugguuuaggcagcuucuugcuguagcucacacuggccuuauauucuucagcgugcuaagaggaaggcugccaucccagcuagcuucauccuuccuuaccacauuccuagcacucucucggguucuucucuaggaaaccugucugagcccauccaguccaugugaagugcugggcguuuuccuuugcucuguacuggggacucuggccacacacagaccaucucaggcuguuauuucccuuugggagcucagggccuuguucguggaagcacaccugcgcucuuuugccaauagaggacuuaacucuuagugagccaugcucguucuucuguuuuaguuugguuguuagacuggccuccuauaucccuggcuggccuggaacuugcuguguagcucagucuggccuugaaacucagagaucaaucugccugugccuccugauugcuggaguaaaggugugugcuaccauguccagcuacaagucaucuuuuaaguuuugaagagcugcccuuauucucucucagaagguuacuaaucauagcauuguguuugguuuaugacuaggaacaguugaacuugaccuaauucagaucugcaggaguaucagcaucugaggguuagaggcaggcugggcuguaagcgacugucugaggaaacagaaaugugcuggagagagagcucugccauuuagaguccugcugcuuuugugaaaggucaggguuuguuaguacucacaugguggcucaccaguaccucuaguccaggagaucugacacucucuucuggucuccacaugcaugugguacacaugacuacauguaagcaaacacuuauacacauaaaguaaaacaaaaauaaaucuaaacacacacacaccagccagguauggugguggugugucccccccuuuuuuaaaagauuuauuuauuuuauuuuuaguauaugaauacacugcagcucuacagaugguugugagccaucaugugguugcuggaaauuaaacucaggaccucugcucgcucuggccccccucacucuggcucaaagauuuauuuuuuauuauauguaaguacacaguggcuuucuucagacacaccagaagagggcaucagauuucauuaugguuaguugugagccacuauguggcugcugggauuugaacucaggaccucccgaagagcugucuuaacugcugagccaucucuccagccugguggugugccuuuaauccuagcacuucagaagcagaggcagguggagcucugaauuuuaggccaaccccaucuauauagcgaguuuuaggcuagccaaugguauaaauagagaccuugucucuuaaacaaacaaacaaaaacagcugucagaguauuugccauacauucacaaggccuuggguucaugacauaccacaaaauuuucaaagaaaagaaaauuaaacaugucccuuaugaaauguauuguuccuguuuucuguucuuuacuuccuuguuaaguaagaugcucacccugggcuuccauucacagcacaagaacuuccuuuuugauagauagccccaagauccauuucuguugcucaguacuuuuuaaacuucaauaauguguuuuguucaaggcuaagcuacccuuuaaaugguugugugucuaugugcaugcaaucgcaugcugguuucucauugucuuaguggcaugaagggagggaaaggagcaaaacuagaaaagaaaccuugggcagagcagggcugugagagaugcaguaagaggucaucgggggaacuuggguuuucaguauaaguauuauauaaggccacugccuuacuguggccacuagacuguggcacaugcuaaaugagauacagggauagcagcucauacuuuguacagugucaucacaugaucuccucaguucauauuuacacagcaaaauggcugggccaccaccagcugacagagccuucggguguguucuuaugcaucgugugacaggaaagagaaucaguagggaaagguuaauagaggacugcaggguucuuuucugguguacagugaaucucaaauacuuguuuauucuucuuacugugguucuggggaugaaugcaggaccuuauguaugucaggcaaggcuuuuacuauuggauuauaugccagucuauacaacugcuuuucucuaaaaucaaaacuuauuauuuugugugugugugugugugauguguaugcagguguacauauaugugguauucaaaggagagcuuugugaaguugacuccucuaccuucaugugagucccaggguuugaacuugggucuucaugcugugcacaacaggcacaucuacuuacugagccuucuuaccuaccugggacugcuuuucuucuuuggaaauccaguaaacaauaccaguguuuagauuguaauuuuuuuuuaaauguuacuguuccuguuacugucuguaaggaugauaguaaacaaagaauagguuuauuuugugcaugcauuuaauccuggcacucuggagucaggaguugagagaguucagaguauuauguaucauuuuuuuaaaaaaauauuuauuuauuuauuauauguaaguacacuguagcugucuucagacauuccagaagagggcgucagaucuuguuacggaugguugugagccaccauuugguugcugggauuugaacucaggaccuuuggaagagcaauugguguucuuacucucugagcaaucucaccagccccauguaucauuuuaaaaagcauacuaccgggcuggugagauggcucaguggguaagagcacccgacugcucuuccaaagguccaaaguucaaaucccagcaaccacaugguggcucacaaccauccgcaacaagaucugacucccucuucuggagugucugaagacagcuacaguguacuuacauauauuaauaaaauaaaucuuuaaaaaaaaaaaaaaaaagcauacuaccgccuuuccugggagcugcaacagagcuguuacuccucccuguccccuuuuguuccuccuggcuuagcccaugaucgaucacaaccaucccccaacccaucuucuuucuccuacccaccuuugcucugcagauaaaaaaauaaaaacaaaaacaaaacaaaaauacucagacagcuuuauuacuuuagaauuugccugcuggcacaguugcugaguucaaauaccuccugcuuuggaaaugcaauaacauuuuauuauucccgucucuccuccugcccuaaacucaguggccuguuccaaaucagccccugccagacaucucuggcagccugccugccuggagaucuuacaugauugcugcgugcugcuccuuccaaaucauggcugaaaaaccccucucuccuugugucuccauuuuccuccugggaccccaaagucuccccuauaccauccagcaauuggcuccaggccuucuugaaccaauuagggaaccagaccucccucuacaucagaguuauccuuauuguugggguuugaggccagacugacauuaauuguuacacaucacaaagcaagcuagaguaggacuggggaacuaacucaagggcuaguugugugcuucagcuuggucauaguccaggugcuggggaggcagagacaggccggcacacgcuagggcuccugaggaauuguauguguccccauacacacacacacccccauuaaaaagauggcacuuuguagcugaauuuugaaauaguucucuuuaacaaccaaauaugugcuuucagauuucuucagaggccccacaguaucgaacguccggcuggcuggauuagaguauguucugcacuucacugcacugaaugggaagguuuacuuccgaagcuauaaguaagugcaccucggaguguguuuuggaguucucagguuacgaguuugcagauaacaguggcagggccugugcccugaccucccuccagcucccuuccugcuaaccgugaccuggggaacucacucuuccuggguuccuggucaucuauugugagccuaggguuuguccgagauuuuugugcugucucaaccccagugaggccaguuagauuugaaagcuacgaccuaaaacagguagaaaguauggcugacuacagugaugcucucguacacuagguuucugcccuaaucccagcacaguguuacugugaauguaaaucccagcaagcagagugcuuucuuguuugaguuuuugaagcaccaucucugguguagcuucagguggucuugaacucgucaugcaccccagugggccucagacuugcagucugccugccucagcugaagugcugggacugcaggccugaccuacugcuuccagccagacuccguuuuuauugauggagauagugccaugcuaaaacuuugccuuugagguuagcauccccgacacuccuuuuauaaaacagacugcagaugaagcuaaguguuugccucuucucgucuaucuacccuucugugccccagcggauaaagguuuauuaaaggaugugcuaggugggcucaagccuccuuagcaacugcuuucuucauggccauggucacuaagcucuucccaugucuaccguggauaacaaaagucuugacacugucuugguggcuaucuguauacguagauucccacuguuaacucucuugggccuuccuuaacuguucuguuccuucucauugcccaugucgucuguugcuucuguaacagcuuuuuguccagugcuaaucuuuucugaacauuguucugucaguaaauagcucccugccaaccccucaccccccucagcuuuuuacuuaugggacuuaacugcucuauuaaaugugguugcuaaauauaauauucagauuugggguuaauauuuaucucucucccucccuaccucccucucucccauuauuguuguuuuauugagacaaggcuucacauaggccagacuggccuugaagucacuguguagcagagaauggccuuuaacugguccucaggccuccauuucccaagugcugggauucccagcacucagaaaacaacuggggugagaugaguugugugccugagacugaaagagaggugauuagugacuggaaguggggcuguaaaagaaaaccugguaaacaucguggauacacaggauguguccauguaaagcaucauggugaguccccuggauuuguguuaguaauauguucauaauacaaagagaaucuuaagacuuuguguucucugucuugacucugucugugcccagcuccccauucuuccucccucugcugccccagauuucuccagaucaggaguucuguuggacacaguguguugaagagguuguaguuuagcuauuaggguguuuagguuugcugcagucuacggacgucauuaaugugcuacggggaaaggcugauugggaguggguugacguaacucagacaguguuggagauggcaguguuacuuucuaaaggccaguuacaguucuuauucugguggcaucacacuuggagccuugugcaaacauucauguguucugccacuggauuguuuaagaacuuguuucuuuauuuaaaaaaacuuuuuuuuauauuuaguuauuauuaugacuaaguauacuguagcuguuuucagacacaccagaaaagggugucagaucucauuucagaugguugugagccaccaugugguugcugggauuugaacucaggaccucuggaagagcagucaguguucuuacccacugagccaucucuccagcccaagaacuuguuucuuaacaauaccacauaauuucauguuccaauuuuuaaaaacuuaaacaaaagaugcacuuggcaugaaugcccaacauguuuuaagaagagcuuuggcuuuugcaacuuauuauuugaagcuacaaaacucucaacaaaguuauuucagagaaggacuuuuaaaaagaauuaaagcagucccccuucuccccauucauaaaggcugcuguugaagaaaucugggugcagaacaccgcgaaucgagcuagaagagaugggaccaucacuggaccuggucaugaggaggacacaccuagcaucagaugaccuuuauaaacuguccaugaaagugcccaaggcucucaagguacacagcuucuucuuucuuuuuuuuuuuccaguuaacaguuaauuuuaauaauaccuguuauguuuaaagagucaacaacacaggagaaaaagucuucugugaauguuuacacagugugaaugcaugcuuuaacuaugcaguggaggaggagaggagcauucaguuaacaaagccuaaaagaaaaccccuuguuaugaauuacacaacgcauauaaaauauuucucuggaugcauagaugguacagaguuucuguguuuauuucuguauuccacacuggccagcaagguuuugugguguuauauuaaaaagaugcgugaaaagaugagugaaauggauacgggcuaggcucugagccaggagaggagaaagagcccauccagauguccaggccauacagaguugcaggagccagggucuaguuuggcugacaguuuucuuguggccaagacugccauuuucugcaaaccuagagucuugugggcaccaugaagacuggguugagagcugugcuucuagaugcauagucuaggcuggccgugaccucugauucuuccgucucagaccuucaacugcuggaagugcuggauuguaggcaugcaguaccaggcccagcuuuguuuugacuuuuaaauuguaucagaaacaaauagaagggguaagguuaaaaguacuuguuacuguuccagaggaccagaguuuugaguuucagcauccauugggcucucaaccaccuguaagcuccugguggccuccacggaucccugcauacacauaaauaacaaauaaaaaaauguuuuaaagcaacaguagagauuuuaacucuggauacuaguacacauugaacugagaaacugcugaagcugaacauggcaaacugucuugguacaguggucagugcauccugagucuugccagaugaccugacauuuacccagauggcagcguuguugggcucuggcugagaacuuguaucccaugaucucuagaugagaaagcugugaagagcuguguccuuugugcugcugagaggcgucacagugggaauugucacuaaggguuaugugcuacauuuuuuguuuuuuguuuuguuuguuuguuuguuuuuuugagacaggguuucucuguguagcccuggcuguccuggaacucacucuguagacagggauggccucgaacucagaaaucggccugccucugccucccgagugcugggauuaaaggcgugcgccaccacgcccagccuuaugugcuacauuuuuaucaguucauacagugaaagccauuuaaaaauuacauaauacauaaaucuguguguguguguauguauauauauauauauacauuauauauauauauucuucuuguuuuauagccaaagaagagaaagaauaucucucaggauacuuuuggcacaacauuuggaaggauucauaugcaaaagcaagacuuaagcaaacuacaaacgaggaaaaugaagggguugaagaagcgaccugcagagaauggaguagacgaccaggggaaaaaaucaaagagaauuaagaaaaauugaccugacugacuacgagcacuuucuuaugguuguuuacuaaagagaauugcucuacuugaggcuguucgguuuccugauaaaaauuuguugcuuauuugaaugaggguguaacaaaauuucacacuauagcccgggcuggucucagccuuccacgugcugugauuauaggcagguaccaccauauacagcauauuguaugugucuauaacauuauuuauuacguaaacuuuuuuuaaaaaaauugaaacuuguguuuggaucauacucaccccagcucucacuguuuuuaauuuuuaaaauugauuugugugugcacauguaugucacaguguggguguggccaaaagacauuauggagucgguuauacccuguggggauuaaaugauaccucagugugucagacuccuacuaugggaagugccuuuauccacugaaccauccuguuagccuaguuuauuaccuauuuuuaugaacaaauaacauacuacgaguuuaaa

SEQ ID NO: 5473 - RNA, 14734 nt, Mus musculus
cucaauguuacuagacaauuaagcaaacuuuuauugaagcuuacauugugguacagaaauacauuucagcugauuaaaaguccaacaccaacaaagagaaauuauggcaccaaaacuuccccaccuguaauuagacuagaucacuaguuuaccuacaguuguucuaggcuuuguuccacacaaaccuaugcaauucucaacauuaggauucuuaauuuaagacggggaaaucagaccucaagccaaaaucuacuggguuacaaaauccagcuuaaauaagcacuggcccuccaaauagcaauucaaaauaggugcugugcucauuacagaaucagacagauaaagcugaccgaaagcuuccccaaagaagccuucaaucaacaccguguagaaagaguccagacaguguuccaaccacuugaucucaaaccaaguagacucuguuuagaaacgcuaaaaaaguguuucguuauaaauacggaaggaacaaaacaucacugcaucaguccagaaacuaccaagaaaacagaagggcaauaaauagggaguuuaguccaguuugcucuuuucuguuuaagucccaccaacaugccgacucuucaacgcccauuauuucuagugccauuaaauagauucagaauauugcgccguuccauccauucauacauucacuaucuggcugaguaaccuggagaggccuccucccucuggucagucauucaucugaucaucugaaggccacggugaaaggaagaccagagaccagcugacgguaggacaaguagaaaccagauucuccuucgaaucaaaaucuccuuuaguaaauaaaaccugguggcaacggcagcacuuacugaggucagaaugcuaggacuacauuucugcuuugacauaguggacauuccuaucacuuaguaaauuagugagggcauaguaggcacuccauuaacgcuaauuaaggugcacugcacagccuaucauuuccauggaguuuucuuuaauggguucuccuugcucaucgcccuggagacugugaguucuuuucauuugauacauucaguuuugucauuuaucuuccacagaaguucaugccaauaaagagaccacauucuuaugucuuaggaaaaaaaauuaagcaagggaccaucuccaaacucucaccugggguguaaaauuauaauauaagcccacaguguaacaguguauugcuucaucaaaggugguggaaaaacuauaggacucuaaaugcaggagcaauuauuaaaacagcagaacauaaaacaagcaacuggagucauuuucuuacaaagacucaacuuguggaagaaaaacuuuaauugccauugcauaaaacaccuguaugaaguagaaauugguuuugaguaacauuaguagagaauaugcccuagaaaguggaggugccuggauguaaaaacucuggcagcaauuuaauagaacagucacagaugucagcugaggccgcaucuaauggggacgaaagccuugucuguggggaauuuuggaugaugccugcagaaauauuacacugugcauaaaccaaauuguaucauuuucacaagugucguaaagauucauacagucaaaggucuuuucuacaugcacuucaguuccacagcaagaguggcauagaacaccuaaacacagaagagagcauucaugcaagauaccuaacuccuugauauaauaaugcauacacuucaaaaugauugcacuaucauuacaccuagggcuuucugcaacuacgaggugguggucauggucagcauggcccucaggaucagcaucuagaaagcagccaccaccuccugugugucuucucuuuuugcguuuuuucuucuucauuuuuccuaaucaacucugcuguuguugcuguuucuuagcaaaacugguaaaaacaaaauuguaaucguugaacauagcacucuggcaaucaagacguuuaaagccgucaaucuucuggggcgaagaaagcacugugcgacauuuagaacucuggggaaaaguugaaacaagcauuaguacuucucaccacuagaauauuuucagacauaacaguaaugccaugaauagaugacuuucuuaaaacuaugcauuuaaaaagauugauauuucaaguguuuguguguccaugccccugugagccacucgcccaccgcgcugcugagagaaagccaagugcucugaacagaugagcucucuccacccaaaccacagcauuuuauagcauccucuuuuuuguuuuuguuuuuguuuuuuuuuuuuuuuugcauuuuguuuguuuuccgcauagguggggaagcaggguugucugucaacagggagggagugucagcagcacaggcgcucgcucacuagccuggugccccucccccgaugacuaaaaaccuaaagaagcauuuuagguuucucugcccagcccaggcugggaagugcuugccuagcauacacaagaccuugaagaccuuggauagccgagagagagagagagagagagagagagagagagagagagagagagacagagagagagagagagagagagagagagagagagagagagagagacagagagagacagagagagacagagagacagagagagacagagacagagagacaacaaaacacaagucaagguaccugauuaacaaacaagguggucacaaauuuuccuggcuugaagacuuccacaacuuuccugaucaggucgucauaggaggucugacuuagguuuguuucaaagcuaacauaagaaaauucugguucuggagugaugugaauaguccaauauguucccuuugagaaaaguuauuaacagaaaguuaauauuaaacaaaaguuguuauuaacagaaaggagaagauacagauauuaaaauauucaggcuaacagcuacucacauccgauuucauuccauucaucgaguagccacaaggauugaacaguguggcaucaaugacagaaccugguaucaggucacgaauuccacucucacgagugacauccuuugcaguaacaccaucuuucauguagaacugguccauaacugcugggucaagcucacucaucagaauuuccaguguuugaucuggcugacugauuacucggcucucugggaaauccaaaguauacaaguaccuauguagaaguaaaacaaguuuuaccucagaacgacagguuacagagaaacccagucuuaaaaccacuauuagccuauagugggaagggggugcuucaugagcccccaaucuuaacaggaaagacagggaaagccgggcauggcagugcacgccuuuaaucccagcauucgggaggcagaggcaggcggauuuccaggacagcuagggcuauacucgaaaaaccaagggggcuggagagauggcucagagguuaagagcgccaacugcucuucugacggucgugaguucaaaucccagcaaccacaugauggcucacaaccauccguaaugagaucugaugcccucuucugggguguaugaagacagcuacaguguacuuacauauaauaaauaaguaaauaaaucuuaaaaaaaaaaaaaaaaaaaaaagacaaggacaacuaauggcuucugaagagucaguuuucuuuaagaguuccaggcgggcuaaggagacucuaguguauggccaaauacccaggaguauagauaugggcaauggauugcagcaggcaugauguauguauuucuaggcaaggcgucacugcacagcgaugcccuugucucuggagaguagugcuagauuaaaggcuugcagcaucacugccuggcucaaacgguuucuaaaaggacagguuaagaagguggggauuagggaaaaguuauggguagaaaauaaauaugaucaaagacaaaauauguuguugcaaagacaaaacuugcaaaaacaacuuugcaacagacaugauaggauauauacuuuaaacaggaagcaggcaaagauaucgacaagccuggucuauaaagcagaguucaaggccagcaagcuagauaaugaaacucugccucccacaacaaaaauuccaaaauuccaacuuugcuuaaaaaacaacauuuacaguauuaagggaaaauccuagggccuguguacacuugccaaguacaugguaccauugaaacacaccucaaaucuucucucucuugauuuuauugcacuaaguugacuuuauuggucuuguuccucuuaccucagucuccagaauagguaggauuaacaagaguggguuacuaggucuagcuuaaaacauccuuuaccccuaaaaaaacuccacacauagguaacaaagccaaaccaaaaucaaaacuacauagcaagcugggcagugguggcgcacgccuuuaaucccugcacucgggaggcagaggcaggcggauuucgaggccagccuggucuacaaagugaguuccaggucagccagggcuacacagagaaacccugucucauaaaaccaaaccaaaccaaaaacacaaaacaaaacaaacaaauaccuacauaccagcagucagaauucaugcgucccauacaauaugcugcuccaucugcaaggaaagagaaucuuuuuaaaaaaaaaaucacauaacaggaugccuuauuagucauucaauaaacaguauuauauaugccaacuaucaaaaauguccccagugaagagacaucagagugagugaauucuaacagcaagagggcagauccaugaccaugcuggcaccaggaaagcaacccucuguccuuugcaggggcaccaagugcuccagucucucuagcaucucucuccccuuugcucuaggaggcacuguaucuggcugccacuggugcuugucaaguuguagauggacccuagguauugagauuacucccacggguauggaaucggucacuuuucuaagcugguuuccuuacauauccuucccaaacuguuuucaagauuuucccuggcccagcaaaccaacuuagaaucaacaccaacuaaauccucgccccucuggcaggacgucauguuugauggcauacauuacugcaagggucugaagucuucuuucuguagugcuaaaggucaaguccggggccccaugcuaugcauauguguguucacuacuauuugugaguucuacauaccuaagucugcagaacaggcagucucugccucccuagccccagcauuacaaccccuccaacccaauacgcgacugccauugcuuuuauaaacguagguaccagagaucaaauuuggguccuguguaguaguuaccuuacaucuacuuugaguuaucuccccagcaauuguuuuugaaacaaguucuuacuaucuggcccacacuggcccugacuccuuaaccucaagcgucccuucaguuuacuuagucaccaugacuaacuacggugcacgcccuacugccucacuuaccacaaguggucagugguccacuuuauuuuuacaagcacauaauacaauuuguacuguuuugcccacacaacuaaauccuuguaacauccagguaaacagaaaacagaaaaacaaaaagccacacuaucaaacaaucccuggauuuccaggccagaaccagaccaggaaggguuauacauggagcccaucucaaauuauaacaaauaugaacacccacccaucccuaaaugacaagaauuauuaaauucuagguuuacuuacuugggaaaauugcauuaagaaacucgauuucuuccuggaaauuccgguguggguacccuuggugagaaggcuucaugaaauucuuacgagaauaaaagaagcucuuaaaaaaagagagagaucuuaaagauuaaaguuugacuccuacauucacauggaggcucacaaacucacuuuaacuccaacccagggaucugaugcccuauucuguccucaaggguacuaggcacacauacauguauauguauauaccauucauacacauaaauuaaacaaacagggccucauuauguagaccagucuuguuccuccugcccuagccuccccaaaccaaagcacuggaauuccaagugugcagccaccagauccagccuggagcaguggcuucuuucuauacauuaagcaaaaacuaugggacagcacaaauaaguauuguguaugcaugugugccaugaguguauguggaggucaaagaggacaaauuuggagucacuucuccccaccuuugguagguuccgggaggucaaguuugcacggcaagcaagugcuuuucaauagucaacaauacaauuaaaacucucccaaggagacagugaauuaucaaauuacacuagugugggcucacagcucuagucucagcacaaaggacacuaaagcaagagugagaauuugagagcagcuggggcuucaaagccagacccccucuucuucccacccacaaagcaggcuggguaugguaacaugcaccuguaacuccagagcucuuaaagaaaaaaggcagaaggguugaguuugaggcaagccugguguauaugauaauaucacauauuacaaaacaaaaaaacccaaaagcccccaaacaguauuaccauggcaggcagcacuuuagguucaaccccaaccacagguguaaaagaaccaaauucugagauuuuagugacaauccauucuuugagguaaaacauuaaaauccaaccagagcagaaacuacucaaguuucacacaaugcguacuuacuugaauugagucaaacccacuguaaucccuagcaagcuucaacaggggaaccagugcuuucaguaagagggugguaccacaugucuucaaaaugaaacgucucuuggagacaaacaugcuacucucacugcaacagaaagucacaaaccaucaccacugcgucagguauuaugagaacacaagucaucuaucaguguaucaguauuguacaucacuggugaauguauguuauguacuuauccaccaaaaccagcuacaaccaaaguuagaaaaacaacuggcucuguauccuuguauagcucgugacuguaacaggucuuccuuccuuccaucaccuaauaguuagcuuuucccacucucuucuacacacacauccauacacagcuaucgacuaaauucugaaugugugcagcugcguguauuucacuucaagauuguauaacuuuugcuuaaauaguauauauucuaugccaauccauuuuccugcaaguguguaacuguuuuguauacccaacaucacacuucacagcgcuuaccugaguacauaagcuuccugcuugucagucuuugucacacuuaugauugagcacugcacauccuucaaaaggacaucccauucagaucugugacccaacaaaacaguuauuaaagacuauuucuaccacacuuuauccuuuaagaacacuuuugccccccagugcuagagaucaaacccugcuccaaaugacaggcaagcacucuaucccugagauaucuuucuagucucuuaagacagauguaaugugacaggacugcaauggguaugcacuauacacccaggcuggccuccaacucagacaugucucuuccucuaauugccgagcacugugauuuaagaaaaaagugccaccacacuggucauuuccuucuuuaauagaaaauuuauuuuauauguauggaauguucugccugcauaugucuaugcacaacauacauguagugcccacaguggccaaaacagggugucagaugcuuaggaacuaaagcuacagauggugugagcuggcacacggcggcugggacuccaaccugggucuucugggaacaguagccuuucucuuucccagggaauacuuucucuaaucucucuagcuaccaucuaagcaaacaacagacacacacaccucuuuuaucgccaucuuuagaacaccccccaaguauucuuuccuuuuucuguuuuuuguuuuguuuuguuuuguuuuuuuguuuguuuuucgagacaggguuucucuguauagcucuggcuguccuggacucacuucguagaccaggcuggccucgaacuuaggaauccgccugccucugccucccaagugcugggauuaaagacgugccccaucacgcccggcauuuuucugguuuuuugagacaggauuucucagaucuuggcuggcuuugaacucagagacccauuugccucuaucucccaagugcuaggauucaaggcaugcaccaucaugcuaugcccacaugcacaguacuguacugccuuuaauuuuaugccuuuucuugagcuucuggcuguaaguguauaugagccuucauaaccacuugauugauaaguccaaugguuuaaccugagacuuuaaaacaacugcuuccuuucauuccaugacaggaaaaaugcugagcaucacugucacuugaagaagcagcaugcugaguugcuaagauagaagaaacacaaugaaguugucucuuaggacugaacaguauaggcaaagccaggcacuguauucagccccugugaauaugcuuauacccuagcacuggagagagaggcuaagucagcuauaggccagcaccaaccacaagaugauacucaguacccaccuagcauaaucaaggccgaguuccaaccccagcuccccacucaaaguaaaaaugagcagcaauuauagaaaacaguauagaaagugcaaccccuccccuccccuccccacccccaaguaagguuuagaagaacauuguaucccagcacgacuuuuaauagcuuagaaaaagaaaaucuggccuggcagugguggcacaugccuuuaaucccagcagaggcaggcagagugagugaguuccaggacagccaaggcuauaccaagaaacccugucuugggggaggcgggauucucaccaaaugcuacaaauacaugaaccaagggcauguuagcauuaugcagucacaaacucuuaccauuccauuuaaaucaaguucacauagcuaaaaggguacaaaaggaccuggguuugauucccagcacccacacugagacccauuaacuggaauuccaguuucaguguuacacaaauauauguaugcaggcagaacacccguauuauacaugaaacaaacacuuuaaagguuguugauaagggcugagggaaagaguugcuuguguuuaacaaguacugguuacacuaccuaaggacugacugagagcauaucuggaaaaauuaaauauacaccaaacacauacagaucuuuauuucuugcuuuucuacaucguuagucuuuaucaucuuuauauagcauaaguaagcuacaggcauuuauucaaagcccacacaagaaaucagaacaguacuaguaggcaaacaaugaacucagagacaggaggagaguuacauuucagccacccgaaaaguugauaaaugcuggcacacacauugcuagauccagcugagcuauucagacuuugagcagguuguccccagauuuuaaucuauaaauuuaagugguuacauuacauaucacuccuaaaguggcugguuccaaaguucaguuuaccuaguuacugcuuaaaauucaacugaagcuaccaaauuaguaagcacaaaaccugaccaaggucuguuucugagagucauauuacacucagaucaccuaacccuaacccaagguaguaacugaacagacaguauuguggcugcuuacaggacacccaaugcucuucuggcccccaaaggcauccacaugcaugcacacaaacggcuaaaccaaacuuguccccaauuuaucugcacuauguucucuauugcugcuaguaugcucaguguaugcuucuuaaagagagagaauuuggggucaacaagaugacucagugguaaucauagcaccugauuuugacccucagaacaaagaggaaagggaaagagccaagccccgauggcugcccucugccccacaggaggacacacuugcacagcagcacaaccauagcugcugccagaagcucacacugaaaggucuucuggcaacgcacuguaaauucuuucuguaaaaccaauaagaacuccaauacugcaugguggcgcacgccuuuaaucccagcacucaggaggcagaggcaggcggauuucugaguucaaggccagccuggucuacagagugaguuccaggacagccagggcuacacagagaaacccugucucaaaaaacaaacaaacauccucugcccaaaaaaagaguucaggaaaaagucauggcucaugcaugaccuuuaacgacgacaauccuuuacucaaaucuuuauuuugcuuauaacauuccuaaagcagccugagaauugucccaccaauucuaaauguuauuucuaccaucaguuuuaaaagucuauauuuuucaaguacugcauuuaucuucuuuauuggcaccggaauuucccaccuaacuucaccuuauuacuaagauuugucuguguagcccuaaguuggucuguagaccagcuggcccaaccuggauauccacuugugucuggcuccccggugcugagauuaaaggugccugcccaagucuaccuagcuaguaagcuacccacuauuuccuaccaaauugaacccuaagaacucugcuucuuuaaucugucaacuucaaauguauuuauucugugagguuaaguggauucuaaagccuucauucuccccuucauccagcuacguuacccacgccauacucuucuccaaucaaguagcuuuaaaaaaacuaagcugcauuagccaagauggaucagcaguuaagagaaauuccagauucaggccugguggcacaugguccuagcacucagggugcagaagcaaagggauccccaugaccuuaaggguccuggagcuccauuuauauaaacaaaccaggcugaccuuacaaaucagcaacaacccugugugaaucuguugcugugcucuagugcuuacaggcccugaccagccuggacuugcuuacuauguagacaaggcuaacuucaaucuuccugccucugccucacgaauucggggauuaagagcuugugucauaacacagccagaaacgcauucuuaaaagguccuucaugcucccuuauaauccauuccucccuuuauaaggccucuaauccacaacugaccagucuugucagucugcauuuccuagguuuacagaaaugaaaucuuacagcaugcaugcuccucaggccucuuuucucagcauaucugcuuacauuagugcucguguggggcacagaacaaggcuucacuuacugcugggcagcauucuguuauaugguuauacaacuauccauuuguuuuuccauuucuggguucaagaucucacuauguagcaccugaguggcuugaaacucacuuguacacaagcauggccccugcccccucacccccaccccucccagugccaggauuaagugugccaucaauuccuaacgaccucccuccccauuaguagauuugcaguuuggggacuaacacaaaacugccauuaaaauucucaagucgauauaaucaauuagaucuuaaaacuaccaggccugguaaccuugugaagauguggaaagcaauggcuauuucuuuuuuuuuuuccuuuuuuuuuuauuagguauuuuccucauuuacauuucccauguuaucccaaaagucccccauaccccccccccauucccacuuuuuggcccuggugguguuccccuguacuggggcauauaaaguuugcaaguccaaugggccgcucuuuccagugauggccgacuaggccaucuuuugauacauauacagcuagagucaagagcuccgggguacugguuaguucauaauguuguuccacuuauaggguugcagaucccuuuagcuccuuggguauuuucucuagcucauccauugggggcccugugauccauccaauagcugacugugagcauccacuuauguguuugcuaggccccgggcaauggcuauuucuaaaguuacccuuugacucucuucuguaggcuuauguugaauaggcuucaaacauaguuucuuuaacugcccaucugucuuuagacaggguuucucuguauagcccuggcuguccuggaacucacuccuguagaccgggauggccucgaacuuaggaaucggccugccucugccucccgagugcugggauuaaaggugugcaccaccacugcccagcauuagaauugcuuccugacagcuuuaauaccuaguguuuuuauauuacuguuauuuuccccagccuugacugcuguuaauacuauaaauaucaguuuauuucaucuuauuagcccaugguuauucuuuccauuucaggaaagaugcagguccccuacaaaccucccuguuagcacugacucgugauuuauccaccugcugucucucagacacuuauuuaaaguucauaacaaccagugcacccucagcuggauggccacugaaaaagcacugaauuuuuuucaguucuuucgaacagauuucagcucuacuugauauauaacagucacacacacacacacaaaucaguuucugguuacacaaaguaaagguuuuuaaacauuuaauaaaagcacaggucgguggcaaagcagaggcaaguggaucaggucagccauggcuacacagaaaaguccuguguagaaaaaaaauagccuaccuuuuuaaaaaggcccaucuuuccucuacucaggagccacuuuaaucaauauauuuuagcauuaauauauauuauuauuuuagccuauggcuauuuugccuauacgugccccacagaugugcaggguccucaggagucagaagugggcgucagaucccccggaaucggaguuagaugguugugagcugcaaugugggugcugagaauuaaauccggguccccuggacaacuaacuaucuaguaucuaggacccuuaaccucugaucuauuuuuagaaucccacucugguacuuccaacuaaguugagaacgaaaaucuucucuuuaucaacaagaaauguuuuuuguaauuuccuugcguaccccucuuucaggucguaccaagauuuucuaggaaauaauccuggaagcaccagcuuuccgagacgccuaucacaaucagcuuuccauaucuguaaaagagguaagcuucucuaugcuuacuaugagaaaacgucaaggguuuguaacugaaaauggcacacacuucacaugaggaucgaaaacugagaccuuagcacuucggguacauuuuuuucccuacaauggaaacgucugcagcaacuaguaggaacugcguuucccagugugccuuaaagucucggcagcacguggccgcugggauucucuucucgcuuuuugucagaggacgguugcaccgcgcagccaacauuccuaaaacgcccauugguccacacccuggggccaggcuccggaggggcccaggagcucauugguccgccucucaaugaaccggaccacgccgguuccuccgccacucuagucccauuagugcgcuucggagcacggcggagcccggguaccggccaccaaagcgggaggcuggugucaccgccgccggguccaugcauccucagugucauccgcgcuucaaugcucgacucucccagcgaggucacuagcaacucuccgcaccaccucccgugucgggugugagcagggggcccgcaggucuccuuugcuccagcuuaaggcauuaaguaaaauagaucuucgggcugacaggcuuguaccccgggaagcaggcaaacccuccagcaccccgcugcgcucucccggacuucgccuccguaacagguuacacagcccaaggucaggagccucccgggcaaagcccgcggagggucccgaggcgccccgcucugcugcagggcacguccgggcgucggcggggcccggcacugcgacacggccgcucccgcccaaucccgccgcccgagcgagcgccacgcgcggccgccuaccccgcggcgggaggccugcuggucgccccgcggcccaggcccacccagcucgugcuccgcccgccccucacccagccacaccugccggagggccgcgugccccccgccggagcccgucagcccagccccgccguccgccggggacguuaccugagcacgcggccgcgccggccuccuccccucccccaggcggcgcaggcggccccgcaacggcggcgggagaagccaguucccgcccgccgaccuggccccaccugaggccgcgacucgugccucgcagucggcggcgagccgcccucaggcccaggcacccaccuugggaugguacgaagauccccagaucccuggcuugcgucggacugcugucuggaaaaccagaccuccagcaguuucuccgucccuucgaaaaaaugugcagcuuccaucaccgugagacuagcgaacaaccaacaaccacagaaaaucaacuaaauuaaaucucuucucccgccgcuccugccgccgcugcggauuguuccagcuguguuacuaaaguucagguuccuuuuuuuuuuuuuuuugcuauaauuuuauauuaacuuuuuuuuaaaaaaaggacuaauaaaauuuucccggcuauuuucgugagcgaaaguugaacgugagucuguuggaaauagaggcagauacaguucagucucuuguaguccgcugcuuucccguuaggagaguugagcgagcgcuagcuaaugucgccggccauacuguguaagcgagg

SEQ ID NO: 5474 - RNA, 14734 nt, Mus musculus
ccucgcuuacacaguauggccggcgacauuagcuagcgcucgcucaacucuccuaacgggaaagcagcggacuacaagagacugaacuguaucugccucuauuuccaacagacucacguucaacuuucgcucacgaaaauagccgggaaaauuuuauuaguccuuuuuuuaaaaaaaaguuaauauaaaauuauagcaaaaaaaaaaaaaaaaggaaccugaacuuuaguaacacagcuggaacaauccgcagcggcggcaggagcggcgggagaagagauuuaauuuaguugauuuucugugguuguugguuguucgcuagucucacggugauggaagcugcacauuuuuucgaagggacggagaaacugcuggaggucugguuuuccagacagcaguccgacgcaagccagggaucuggggaucuucguaccaucccaaggugggugccugggccugagggcggcucgccgccgacugcgaggcacgagucgcggccucagguggggccaggucggcgggcgggaacuggcuucucccgccgccguugcggggccgccugcgccgccugggggaggggaggaggccggcgcggccgcgugcucagguaacguccccggcggacggcggggcugggcugacgggcuccggcggggggcacgcggcccuccggcagguguggcugggugaggggcgggcggagcacgagcugggugggccugggccgcggggcgaccagcaggccucccgccgcgggguaggcggccgcgcguggcgcucgcucgggcggcgggauugggcgggagcggccgugucgcagugccgggccccgccgacgcccggacgugcccugcagcagagcggggcgccucgggacccuccgcgggcuuugcccgggaggcuccugaccuugggcuguguaaccuguuacggaggcgaaguccgggagagcgcagcggggugcuggaggguuugccugcuucccgggguacaagccugucagcccgaagaucuauuuuacuuaaugccuuaagcuggagcaaaggagaccugcgggcccccugcucacacccgacacgggagguggugcggagaguugcuagugaccucgcugggagagucgagcauugaagcgcggaugacacugaggaugcauggacccggcggcggugacaccagccucccgcuuugguggccgguacccgggcuccgccgugcuccgaagcgcacuaaugggacuagaguggcggaggaaccggcgugguccgguucauugagaggcggaccaaugagcuccugggccccuccggagccuggccccaggguguggaccaaugggcguuuuaggaauguuggcugcgcggugcaaccguccucugacaaaaagcgagaagagaaucccagcggccacgugcugccgagacuuuaaggcacacugggaaacgcaguuccuacuaguugcugcagacguuuccauuguagggaaaaaaauguacccgaagugcuaaggucucaguuuucgauccucaugugaagugugugccauuuucaguuacaaacccuugacguuuucucauaguaagcauagagaagcuuaccucuuuuacagauauggaaagcugauugugauaggcgucucggaaagcuggugcuuccaggauuauuuccuagaaaaucuugguacgaccugaaagagggguacgcaaggaaauuacaaaaaacauuucuuguugauaaagagaagauuuucguucucaacuuaguuggaaguaccagagugggauucuaaaaauagaucagagguuaaggguccuagauacuagauaguuaguuguccaggggacccggauuuaauucucagcacccacauugcagcucacaaccaucuaacuccgauuccgggggaucugacgcccacuucugacuccugaggacccugcacaucuguggggcacguauaggcaaaauagccauaggcuaaaauaauaauauauauuaaugcuaaaauauauugauuaaaguggcuccugaguagaggaaagaugggccuuuuuaaaaagguaggcuauuuuuuuucuacacaggacuuuucuguguagccauggcugaccugauccacuugccucugcuuugccaccgaccugugcuuuuauuaaauguuuaaaaaccuuuacuuuguguaaccagaaacugauuugugugugugugugugacuguuauauaucaaguagagcugaaaucuguucgaaagaacugaaaaaaauucagugcuuuuucaguggccauccagcugagggugcacugguuguuaugaacuuuaaauaagugucugagagacagcagguggauaaaucacgagucagugcuaacagggagguuuguaggggaccugcaucuuuccugaaauggaaagaauaaccaugggcuaauaagaugaaauaaacugauauuuauaguauuaacagcagucaaggcuggggaaaauaacaguaauauaaaaacacuagguauuaaagcugucaggaagcaauucuaaugcugggcagugguggugcacaccuuuaaucccagcacucgggaggcagaggcaggccgauuccuaaguucgaggccaucccggucuacaggagugaguuccaggacagccagggcuauacagagaaacccugucuaaagacagaugggcaguuaaagaaacuauguuugaagccuauucaacauaagccuacagaagagagucaaaggguaacuuuagaaauagccauugcccggggccuagcaaacacauaaguggaugcucacagucagcuauuggauggaucacagggcccccaauggaugagcuagagaaaauacccaaggagcuaaagggaucugcaacccuauaaguggaacaacauuaugaacuaaccaguaccccggagcucuugacucuagcuguauauguaucaaaagauggccuagucggccaucacuggaaagagcggcccauuggacuugcaaacuuuauaugccccaguacaggggaacaccaccagggccaaaaagugggaaugggggggggguaugggggacuuuugggauaacaugggaaauguaaaugaggaaaauaccuaauaaaaaaaaaaggaaaaaaaaaaagaaauagccauugcuuuccacaucuucacaagguuaccaggccugguaguuuuaagaucuaauugauuauaucgacuugagaauuuuaauggcaguuuuguguuaguccccaaacugcaaaucuacuaauggggagggaggucguuaggaauugauggcacacuuaauccuggcacugggaggggugggggugagggggcaggggccaugcuuguguacaagugaguuucaagccacucaggugcuacauagugagaucuugaacccagaaauggaaaaacaaauggauaguuguauaaccauauaacagaaugcugcccagcaguaagugaagccuuguucugugccccacacgagcacuaauguaagcagauaugcugagaaaagaggccugaggagcaugcaugcuguaagauuucauuucuguaaaccuaggaaaugcagacugacaagacuggucaguuguggauuagaggccuuauaaagggaggaauggauuauaagggagcaugaaggaccuuuuaagaaugcguuucuggcuguguuaugacacaagcucuuaauccccgaauucgugaggcagaggcaggaagauugaaguuagccuugucuacauaguaagcaaguccaggcuggucagggccuguaagcacuagagcacagcaacagauucacacaggguuguugcugauuuguaaggucagccugguuuguuuauauaaauggagcuccaggacccuuaaggucauggggaucccuuugcuucugcacccugagugcuaggaccaugugccaccaggccugaaucuggaauuucucuuaacugcugauccaucuuggcuaaugcagcuuaguuuuuuuaaagcuacuugauuggagaagaguauggcguggguaacguagcuggaugaaggggagaaugaaggcuuuagaauccacuuaaccucacagaauaaauacauuugaaguugacagauuaaagaagcagaguucuuaggguucaauuugguaggaaauaguggguagcuuacuagcuagguagacuugggcaggcaccuuuaaucucagcaccggggagccagacacaaguggauauccagguugggccagcuggucuacagaccaacuuagggcuacacagacaaaucuuaguaauaaggugaaguuaggugggaaauuccggugccaauaaagaagauaaaugcaguacuugaaaaauauagacuuuuaaaacugaugguagaaauaacauuuagaauuggugggacaauucucaggcugcuuuaggaauguuauaagcaaaauaaagauuugaguaaaggauugucgucguuaaaggucaugcaugagccaugacuuuuuccugaacucuuuuuuugggcagaggauguuuguuuguuuuuugagacaggguuucucuguguagcccuggcuguccuggaacucacucuguagaccaggcuggccuugaacucagaaauccgccugccucugccuccugagugcugggauuaaaggcgugcgccaccaugcaguauuggaguucuuauugguuuuacagaaagaauuuacagugcguugccagaagaccuuucagugugagcuucuggcagcagcuaugguugugcugcugugcaaguguguccuccuguggggcagagggcagccaucggggcuuggcucuuucccuuuccucuuuguucugagggucaaaaucaggugcuaugauuaccacugagucaucuuguugaccccaaauucucucucuuuaagaagcauacacugagcauacuagcagcaauagagaacauagugcagauaaauuggggacaaguuugguuuagccguuugugugcaugcauguggaugccuuugggggccagaagagcauuggguguccuguaagcagccacaauacugucuguucaguuacuaccuuggguuaggguuaggugaucugaguguaauaugacucucagaaacagaccuuggucagguuuugugcuuacuaauuugguagcuucaguugaauuuuaagcaguaacuagguaaacugaacuuuggaaccagccacuuuaggagugauauguaauguaaccacuuaaauuuauagauuaaaaucuggggacaaccugcucaaagucugaauagcucagcuggaucuagcaaugugugugccagcauuuaucaacuuuucggguggcugaaauguaacucuccuccugucucugaguucauuguuugccuacuaguacuguucugauuucuugugugggcuuugaauaaaugccuguagcuuacuuaugcuauauaaagaugauaaagacuaacgauguagaaaagcaagaaauaaagaucuguauguguuugguguauauuuaauuuuuccagauaugcucucagucaguccuuagguaguguaaccaguacuuguuaaacacaagcaacucuuucccucagcccuuaucaacaaccuuuaaaguguuuguuucauguauaauacggguguucugccugcauacauauauuuguguaacacugaaacuggaauuccaguuaaugggucucagugugggugcugggaaucaaacccagguccuuuuguacccuuuuagcuaugugaacuugauuuaaauggaaugguaagaguuugugacugcauaaugcuaacaugcccuugguucauguauuuguagcauuuggugagaaucccgccucccccaagacaggguuucuugguauagccuuggcuguccuggaacucacucacucugccugccucugcugggauuaaaggcaugugccaccacugccaggccagauuuucuuuuucuaagcuauuaaaagucgugcugggauacaauguucuucuaaaccuuacuuggggguggggaggggaggggagggguugcacuuucuauacuguuuucuauaauugcugcucauuuuuacuuugaguggggagcugggguuggaacucggccuugauuaugcuagguggguacugaguaucaucuugugguuggugcuggccuauagcugacuuagccucucucuccagugcuaggguauaagcauauucacaggggcugaauacagugccuggcuuugccuauacuguucaguccuaagagacaacuucauuguguuucuucuaucuuagcaacucagcaugcugcuucuucaagugacagugaugcucagcauuuuuccugucauggaaugaaaggaagcaguuguuuuaaagucucagguuaaaccauuggacuuaucaaucaagugguuaugaaggcucauauacacuuacagccagaagcucaagaaaaggcauaaaauuaaaggcaguacaguacugugcaugugggcauagcaugauggugcaugccuugaauccuagcacuugggagauagaggcaaaugggucucugaguucaaagccagccaagaucugagaaauccugucucaaaaaaccagaaaaaugccgggcgugauggggcacgucuuuaaucccagcacuugggaggcagaggcaggcggauuccuaaguucgaggccagccuggucuacgaagugaguccaggacagccagagcuauacagagaaacccugucucgaaaaacaaacaaaaaaacaaaacaaaacaaaacaaaaaacagaaaaaggaaagaauacuugggggguguucuaaagauggcgauaaaagaggugugugugucuguuguuugcuuagaugguagcuagagagauuagagaaaguauucccugggaaagagaaaggcuacuguucccagaagacccagguuggagucccagccgccgugugccagcucacaccaucuguagcuuuaguuccuaagcaucugacacccuguuuuggccacugugggcacuacauguauguugugcauagacauaugcaggcagaacauuccauacauauaaaauaaauuuucuauuaaagaaggaaaugaccagugugguggcacuuuuuucuuaaaucacagugcucggcaauuagaggaagagacaugucugaguuggaggccagccuggguguauagugcauacccauugcaguccugucacauuacaucugucuuaagagacuagaaagauaucucagggauagagugcuugccugucauuuggagcaggguuugaucucuagcacuggggggcaaaaguguucuuaaaggauaaagugugguagaaauagucuuuaauaacuguuuuguugggucacagaucugaaugggauguccuuuugaaggaugugcagugcucaaucauaagugugacaaagacugacaagcaggaagcuuauguacucagguaagcgcugugaagugugauguuggguauacaaaacaguuacacacuugcaggaaaauggauuggcauagaauauauacuauuuaagcaaaaguuauacaaucuugaagugaaauacacgcagcugcacacauucagaauuuagucgauagcuguguauggauguguguguagaagagagugggaaaagcuaacuauuaggugauggaaggaaggaagaccuguuacagucacgagcuauacaaggauacagagccaguuguuuuucuaacuuugguuguagcugguuuugguggauaaguacauaacauacauucaccagugauguacaauacugauacacugauagaugacuuguguucucauaauaccugacgcaguggugaugguuugugacuuucuguugcagugagaguagcauguuugucuccaagagacguuucauuuugaagacaugugguaccacccucuuacugaaagcacugguuccccuguugaagcuugcuagggauuacaguggguuugacucaauucaaguaaguacgcauugugugaaacuugaguaguuucugcucugguuggauuuuaauguuuuaccucaaagaauggauugucacuaaaaucucagaauuugguucuuuuacaccugugguugggguugaaccuaaagugcugccugccaugguaauacuguuugggggcuuuuggguuuuuuuguuuuguaauaugugauauuaucauauacaccaggcuugccucaaacucaacccuucugccuuuuuucuuuaagagcucuggaguuacaggugcauguuaccauacccagccugcuuugugggugggaagaagagggggucuggcuuugaagccccagcugcucucaaauucucacucuugcuuuaguguccuuugugcugagacuagagcugugagcccacacuaguguaauuugauaauucacugucuccuugggagaguuuuaauuguauuguugacuauugaaaagcacuugcuugccgugcaaacuugaccucccggaaccuaccaaagguggggagaagugacuccaaauuuguccucuuugaccuccacauacacucauggcacacaugcauacacaauacuuauuugugcugucccauaguuuuugcuuaauguauagaaagaagccacugcuccaggcuggaucugguggcugcacacuuggaauuccagugcuuugguuuggggaggcuagggcaggaggaacaagacuggucuacauaaugaggcccuguuuguuuaauuuauguguaugaaugguauauacauauacauguaugugugccuaguacccuugaggacagaauagggcaucagaucccuggguuggaguuaaagugaguuugugagccuccaugugaauguaggagucaaacuuuaaucuuuaagaucucucucuuuuuuuaagagcuucuuuuauucucguaagaauuucaugaagccuucucaccaaggguacccacaccggaauuuccaggaagaaaucgaguuucuuaaugcaauuuucccaaguaaguaaaccuagaauuuaauaauucuugucauuuagggauggguggguguucauauuuguuauaauuugagaugggcuccauguauaacccuuccuggucugguucuggccuggaaauccagggauuguuugauaguguggcuuuuuguuuuucuguuuucuguuuaccuggauguuacaaggauuuaguugugugggcaaaacaguacaaauuguauuaugugcuuguaaaaauaaaguggaccacugaccacuugugguaagugaggcaguagggcgugcaccguaguuagucauggugacuaaguaaacugaagggacgcuugagguuaaggagucagggccagugugggccagauaguaagaacuuguuucaaaaacaauugcuggggagauaacucaaaguagauguaagguaacuacuacacaggacccaaauuugaucucugguaccuacguuuauaaaagcaauggcagucgcguauuggguuggagggguuguaaugcuggggcuagggaggcagagacugccuguucugcagacuuagguauguagaacucacaaauaguagugaacacacauaugcauagcauggggccccggacuugaccuuuagcacuacagaaagaagacuucagacccuugcaguaauguaugccaucaaacaugacguccugccagaggggcgaggauuuaguugguguugauucuaaguugguuugcugggccagggaaaaucuugaaaacaguuugggaaggauauguaaggaaaccagcuuagaaaagugaccgauuccauacccgugggaguaaucucaauaccuaggguccaucuacaacuugacaagcaccaguggcagccagauacagugccuccuagagcaaaggggagagagaugcuagagagacuggagcacuuggugccccugcaaaggacagaggguugcuuuccuggugccagcauggucauggaucugcccucuugcuguuagaauucacucacucugaugucucuucacuggggacauuuuugauaguuggcauauauaauacuguuuauugaaugacuaauaaggcauccuguuaugugauuuuuuuuuuaaaaagauucucuuuccuugcagauggagcagcauauuguaugggacgcaugaauucugacugcugguauguagguauuuguuuguuuuguuuuguguuuuugguuugguuugguuuuaugagacaggguuucucuguguagcccuggcugaccuggaacucacuuuguagaccaggcuggccucgaaauccgccugccucugccucccgagugcagggauuaaaggcgugcgccaccacugcccagcuugcuauguaguuuugauuuugguuuggcuuuguuaccuauguguggaguuuuuuuagggguaaaggauguuuuaagcuagaccuaguaacccacucuuguuaauccuaccuauucuggagacugagguaagaggaacaagaccaauaaagucaacuuagugcaauaaaaucaagagagagaagauuugagguguguuucaaugguaccauguacuuggcaaguguacacaggcccuaggauuuucccuuaauacuguaaauguuguuuuuuaagcaaaguuggaauuuuggaauuuuuguugugggaggcagaguuucauuaucuagcuugcuggccuugaacucugcuuuauagaccaggcuugucgauaucuuugccugcuuccuguuuaaaguauauauccuaucaugucuguugcaaaguuguuuuugcaaguuuugucuuugcaacaacauauuuugucuuugaucauauuuauuuucuacccauaacuuuucccuaauccccaccuucuuaaccuguccuuuuagaaaccguuugagccaggcagugaugcugcaagccuuuaaucuagcacuacucuccagagacaagggcaucgcugugcagugacgccuugccuagaaauacauacaucaugccugcugcaauccauugcccauaucuauacuccuggguauuuggccauacacuagagucuccuuagcccgccuggaacucuuaaagaaaacugacucuucagaagccauuaguuguccuugucuuuuuuuuuuuuuuuuuuuuuuaagauuuauuuacuuauuuauuauauguaaguacacuguagcugucuucauacaccccagaagagggcaucagaucucauuacggaugguugugagccaucaugugguugcugggauuugaacucacgaccgucagaagagcaguuggcgcucuuaaccucugagccaucucuccagcccccuugguuuuucgaguauagcccuagcuguccuggaaauccgccugccucugccucccgaaugcugggauuaaaggcgugcacugccaugcccggcuuucccugucuuuccuguuaagauugggggcucaugaagcacccccuucccacuauaggcuaauagugguuuuaagacuggguuucucuguaaccugucguucugagguaaaacuuguuuuacuucuacauagguacuuguauacuuuggauuucccagagagccgaguaaucagucagccagaucaaacacuggaaauucugaugagugagcuugacccagcaguuauggaccaguucuacaugaaagaugguguuacugcaaaggaugucacucgugagaguggaauucgugaccugauaccagguucugucauugaugccacacuguucaauccuuguggcuacucgaugaauggaaugaaaucggaugugaguagcuguuagccugaauauuuuaauaucuguaucuucuccuuucuguuaauaacaacuuuuguuuaauauuaacuuucuguuaauaacuuuucucaaagggaacauauuggacuauucacaucacuccagaaccagaauuuucuuauguuagcuuugaaacaaaccuaagucagaccuccuaugacgaccugaucaggaaaguuguggaagucuucaagccaggaaaauuugugaccaccuuguuuguuaaucagguaccuugacuuguguuuuguugucucucugucucugucucucucugucucucugucucucucugucucucucugucucucucucucucucucucucucucucucucucucucucucucugucucucucucucucucucucucucucucucucucucucucucucucggcuauccaaggucuucaaggucuuguguaugcuaggcaagcacuucccagccugggcugggcagagaaaccuaaaaugcuucuuuagguuuuuagucaucgggggaggggcaccaggcuagugagcgagcgccugugcugcugacacucccucccuguugacagacaacccugcuuccccaccuaugcggaaaacaaacaaaaugcaaaaaaaaaaaaaaaacaaaaacaaaaacaaaaaagaggaugcuauaaaaugcugugguuuggguggagagagcucaucuguucagagcacuuggcuuucucucagcagcgcggugggcgaguggcucacaggggcauggacacacaaacacuugaaauaucaaucuuuuuaaaugcauaguuuuaagaaagucaucuauucauggcauuacuguuaugucugaaaauauucuaguggugagaaguacuaaugcuuguuucaacuuuuccccagaguucuaaaugucgcacagugcuuucuucgccccagaagauugacggcuuuaaacgucuugauugccagagugcuauguucaacgauuacaauuuuguuuuuaccaguuuugcuaagaaacagcaacaacagcagaguugauuaggaaaaaugaagaagaaaaaacgcaaaaagagaagacacacaggaggugguggcugcuuucuagaugcugauccugagggccaugcugaccaugaccaccaccucguaguugcagaaagcccuagguguaaugauagugcaaucauuuugaaguguaugcauuauuauaucaaggaguuagguaucuugcaugaaugcucucuucuguguuuagguguucuaugccacucuugcuguggaacugaagugcauguagaaaagaccuuugacuguaugaaucuuuacgacacuugugaaaaugauacaauuugguuuaugcacaguguaauauuucugcaggcaucauccaaaauuccccacagacaaggcuuucguccccauuagaugcggccucagcugacaucugugacuguucuauuaaauugcugccagaguuuuuacauccaggcaccuccacuuucuagggcauauucucuacuaauguuacucaaaaccaauuucuacuucauacagguguuuuaugcaauggcaauuaaaguuuuucuuccacaaguugagucuuuguaagaaaaugacuccaguugcuuguuuuauguucugcuguuuuaauaauugcuccugcauuuagaguccuauaguuuuuccaccaccuuugaugaagcaauacacuguuacacugugggcuuauauuauaauuuuacaccccaggugagaguuuggagauggucccuugcuuaauuuuuuuuccuaagacauaagaauguggucucuuuauuggcaugaacuucuguggaagauaaaugacaaaacugaauguaucaaaugaaaagaacucacagucuccagggcgaugagcaaggagaacccauuaaagaaaacuccauggaaaugauaggcugugcagugcaccuuaauuagcguuaauggagugccuacuaugcccucacuaauuuacuaagugauaggaauguccacuaugucaaagcagaaauguaguccuagcauucugaccucaguaagugcugccguugccaccagguuuuauuuacuaaaggagauuuugauucgaaggagaaucugguuucuacuuguccuaccgucagcuggucucuggucuuccuuucaccguggccuucagaugaucagaugaaugacugaccagagggaggaggccucuccagguuacucagccagauagugaauguaugaauggauggaacggcgcaauauucugaaucuauuuaauggcacuagaaauaaugggcguugaagagucggcauguuggugggacuuaaacagaaaagagcaaacuggacuaaacucccuauuuauugcccuucuguuuucuugguaguuucuggacugaugcagugauguuuuguuccuuccguauuuauaacgaaacacuuuuuuagcguuucuaaacagagucuacuugguuugagaucaagugguuggaacacugucuggacucuuucuacacgguguugauugaaggcuucuuuggggaagcuuucggucagcuuuaucugucugauucuguaaugagcacagcaccuauuuugaauugcuauuuggagggccagugcuuauuuaagcuggauuuuguaacccaguagauuuuggcuugaggucugauuuccccgucuuaaauuaagaauccuaauguugagaauugcauagguuuguguggaacaaagccuagaacaacuguagguaaacuagugaucuagucuaauuacagguggggaaguuuuggugccauaauuucucuuuguugguguuggacuuuuaaucagcugaaauguauuucuguaccacaauguaagcuucaauaaaaguuugcuuaauugucuaguaacauugag

SEQ ID NO: 5475 - RNA, 144326 nt, Mus musculus
cuacgcacgcaaugagccugaugggaagauuuacagcucauuucuccuccugacuggucucccgggggcugggcaggcacgccaucugacuugaauaaagcugucaagguaaguuuccguugugaguucucugccugggccaagagagcacaacacuuuaaauuuuagagcagaccguucauguucuuuaccaggggagugauauggauuguuaccuucggggguacuauuuagugggggcugugugugcuuguuuaaacuagagugggcugcaauucagugucagggagcagcgccugcugacuuggagcuaacaagcccagagcuggggguaagguuuggagugcugcgaugucuggcaacagcagacuugggagccuggucuguuuuccugggcagaucaccgagacaagcaaggugccuguguaggugugcugccuuuuugaggaguuuaauuucggagagaucuagcaaacaauaccuucagcucucugaaguaacugauaccuggauacaaggauugaucaacuuacuguguuacucuuugcagguccauuguaaaucuuuacuguauauuugagggggaaaaaguccucugaucugucuaccaaaaaaaaaaaaaaaagccuaauuaaauaagauuauuuuguuguuguuuuuaacuaugcauuucugacugucuguguauggguauguguagguuaacuauagaggucagaagacagugucagaccccugaaccugaaguuauaggucguucugagagaccugaugugggugcugagaaccaaacuuagguccuuugcaagagcauauguaguuuuuuguuuuuguuuuugagacaggguuucucuguguagcccugguuguccuggaacuugcucuguagagaaagccucccgggugcugggauuaaaggcacgugccaccacugcccggcuuuguuugucuuuuagauuuauuuuauguguauggguguuuugcuuggauauauguacaccaugugugccuggugccccagaagucauaagagggcauuggacccccugaaauuggaguuguguccagcuucgagccacauaugugcacugggaaccaaaccugguacuggaaacugaaccugggucuucuuugagaacaacuaguguucuuuaccauugagccaccagucuaucccgggucuacacuuuccuuuucucucuuauggcccuaucuggcaucggugcugcugacaucacagugugcccuccuucacucuauuuuauggaacauuucgggagcaucggcaccaauguccuccucgaagagcugguaggauucggcaaugacuccaucugaaaccguaaccuuauuugaaaagaagauuuuaauaacuguuaucaagcuaaagcaagguuguagugacuuauaaugggcccaaauccaagcuagcagauauccuuguaaguggaagagaagaccgucagacaagucaagcuucaaagacgacugaccgugagaggaaaccacugcccggaggaagcaggggcagcaggauugccuggcagaggcugggaccaacugaggcaccuggaaaggacacgcuccaagcuccugagcugccugacgcugcgcagugagcuuuugugagcugucaccugugcuggggugggauuuggcgugccagggugacugggcaccagcagcuuugggagcuuuuggucuuuuuuuuuuugguuuuuuugagacaggguuuuucuguauagcccuggcuguucuggaacucacucuguagaccaggcuggccucaaacucagaaauccaccugccuuugcuucaaaggcgugugccaccacgcccggcacagcuuuuggucuuugagucauuucugcuccuguauccuucaucaguauuccuguaacuagcccuaauaaagcucauggcuucaccaaauuggacuuuggaugguauucacacuuuaguccaucaugagcucccuaucuggggugaccagguguguguguuuaguauuuuuuugaaagauuuauuuauuauuauaucuaaguacacuguagcuaucuucagaugcaccagaagagggugucagaucucauuauggauggcugugagccaccaugugguugcugggauuugaacucaugaccuuuggaagaccagcuggugcucuuaaaugcugagccaucucuccagcccaguauuuauuuauuuauuuauuuauuuauuuauuuuauuuauaugaguagaauuauagcuguuuucagacacaccagaagagggcaucagauuccauuacagaugguugugagccaccaugugguugcugggaauuaagcucaggaccacuggaaaagcagucagugcucuuaacugcugagccaucucuucagccugcgugucuuguauucuaucuucccaggaaaaauauuauugcaagaccuguguguccaaggcugaagaucaggaaccucccuagagacuuccucaugugaguccaucuugaaaagcacaggaaacugaacucuuagauuuacggcaauggcagccucagaagauacagcuaccaggaaaagaggggcuuacagucacugguuggcuuccuccccugcuugccuucauucuuuugauaccuccugacuguaggguacuccuauccacauacccugugagucuccuucaguuguuaucucgugcuaaucaccucuggaaagggugcuuuaguguaauaucuugggcaccucccaaacuaaucacgguaaauaagauuagccucauaaauccucuccuugucaacuugaccuccaaguacacuuccccacagcacgcuuaauauucacacaaagauaaucaugaagucacggguuauaaggagagucuucaguguagccagcaacuaaccacaaacaauaacaaccaacuaccaaacaacaacccauucacacucuuggagccguagcauuuauaaacccucugaaaaguccacagaguuucaaacuauguacagaucacagaaucgcaccccugccaaagcaugagguaaaucauagcugcuguggacaauccgaagcagccccauaucccacaccuggguuuaaagcaaaaacauauuauuauaauauuuauguuuucuaaagaaaacaaauuccagaauucucacuauacuuuagcaaccaaucaaauuggaguacugcuggggggggggaggguuuuuuuuuugugcacuguguaaucaguugcuaagaagacagaaaccuuagaacaagcggagcuagugauggcacuccuaguacuaaccagugauacaguccuaguaugaggcugagggccuuggaaaagauggagucugaaguccauggcaaugucugaaguaggugcagucucaggaaaaguggaacucacacuuacuucuuuaucccaccuuuuugcuaccuccaggccccuagcuugucagugccaccugcauucaggauggguccucuccccucagcugguguuuagcauaucaacugugcuggagacacccacacagacauaguugggaaugggcuuugcugaucuagguaucucuugauugaaccaauugaugaccauucuuggcgucuuuaagaaaagugacucccucagucgaaccuuugcaccuacagaaacgggcuugcuuaguguccgagguaucugagauuuuacacauuuguucugagugugacuucugagagguguggcuucugucuagacacuucgcucagcacauggggccucuuaccgaaggaaaugggagaggcguauuuucacaugacaguggaaaggagcuugucaccccuaaugauagccugaaucccaucccuaggauccucaugggagaaggaaagaucaaagcuuauaaguuguuaucagacauuuacacuugugcgcauacaauaccccccacacacaaacaaauaaauaaguaaauauaauaagguuuuuaaaagacggcauaauacuacuuagaugaaaaugucgucacugcuagguauuguacauagauagagucaauggauauucguguuucuaugcguuuuuacacaugggacuaaaaaaacaaaaaaaaaaaaaaaacagaaacaaaaacaaaacaaaaaacuguauuacauuaucuugcaggacauaauaguacugccaguuggcuucuuuggaaucagucuugaaauggagaugaacauauuuaacauauagucaguuuguuaugaagaguuugaggaauuaacaucccuggaaggguaaagaggcaagaugggagaaguuaagaagucggucugggggcuggcgagauggcucagugguuaagaucgccaacugcuuuucugaagguccugaguucaaaucccagcaaccacaugguggcucacaaccauccguaaugaaaucugaugcccucuucuggagugucugaggacagcuacaguguacuuaaaauauaauaaaauaaauaaaucuuaaaaaaaaaaaaaaagaagucggucugccaaggcagugguggcgcaugccuuuaaucccagcacuugggaggcagaggcaggcagacuucugaguuugaggcuagccuggucuacagagugaguuccaggacagccagggcuacacagagaaacccuguucgccccccccccccccaaaagaaguuggucuguagugcuuucuuaacuacagcccuggcuaucccacagugagcucugaaaggaggaugagucauuaguuuuccugaagugagggagugguaugugugugugugugaagggguguaugugggguguguguaugugugguauauguauguaugguguauuuguguauauguggugugugugugugugaagggguguauguggugugugugugugguauauguauauaugggguauuuguguauauguggugugugugugugugugugugugugugugugguguauguauguauauggugugugugugugguguguguauguauggguuauguguguguacauauguggugugugugugugugugugguguguguaugugugugguguaugucucuguguguguauuauugugucuguguguguauguauguggugugugucugugugugaguguauaacugugucugugugugugugguggguguguauaugugguguguggugugugagcacaugcauauggcauaaaggucugauaaggacauacuccaugccauuguucauuacacagaggucaggagauaauuugugggauuugguauguuccuucugcuauguguguccuggggauuggacucaagucauuaggcuugccagcaagugccuuugcaguuugagccaucucaguagccuaggccucugcauuuaccagucauggaccaagguugcuguagugagaaggcaugagcacagacuuagggaauuccugaaggcugagagcuggaagcuguugcaggcaugagccucaguaacaacuucagggauguauccucuugcccagaagaguaucuggaaagcccaucagaucauacaccauauggaguaggaguuagaauaaauuccuggacugcauugcuaaaccaguaugugugugugugugugggggggguuagaaauaaacuuuuauuaaacuauuuaauauguguauuuuaagcuuacaagaggaugacuugugagaguugguugugguuuucgacuuuccacugucugaguccuggguagggacugaauucugguugucgggcuugguggcaagugccuuuuccaugaccagucauccugcugguccacuguugaaaauuauugucuuaaggauagaaucucuccauguagcucuggauggccucagcucacuaugaagacaagaguggccuuggacucacagagaucugugugccucugccucccaaaugcugugacuaaagggguauaccacaugcuuagacacuguggaaugcuguacaggauggaauccaugaccucaaguaugcuaagcaagcauucuauccccagcuuuuaaaauuuucuauuuacucucauauauauccucacgcaugccugugucuaccauucaauauuucaguuguucaugugaaaaacaggaguaauggauugcaucucucagggguguuuguacguagagauauaaggggugcacacaccacuguguacaaagaacaaguguauuagcuacuuuuuccauugcuguggcuagaguccugaaaaaagcuaaggucaggaagaaaggagucauucuggcugaugguuuagggcccuaguccaucgugugguggcugaauauacugccgugggagaggcaugguggcugccugugcugcggcugcucagugucagcagucaggaaggagagagagagagauguaugcugguguugcaguggguuuuccccuuuuagauucagucuggaaucccagcccauggauggugccugcugcccuuucagaguggguuuccucccucaguuaaucuucccucuaaauaucuucacccaaauaugugcuguaucaaugcccuaaguaucucacaauccaaucaaguugacagcugaaauuagucaugcaacacucaaucaaaaaucuuagagcugggcaugguagcacaugccuuuaaccccagaaguugggagacagaggcagguagaucucugugaguuuggggccagucuggucuacacagugaguuccaggacagccagagagaaacaaagaaauaaagaaacaaaaauauucuugggguuggacauggugcucaguaauaggaugcuagccuaaaauuaaaaugcacaaggcccuggacacaguacugcagauagaagaaggaaaaaaaaacaaaccaaaccuguuauuccagcaucacauagugaucacauagcccauccauggguugggauuccuaaaacuauauuuagaccauuuuuuuuucaagacaggguuuuucuguguagccuuggcuguccuggaacucagucuguagaccaggcuggccucgaacucagaaauccaccugccucugccucccaagugcugggauuaaaggcaugugccaccacugcccaguuagaccagucuuauuggaaagaaaaacugugucucuuucaauccuugccagcacuuuggucaguguguccaaaccaaauugauacuuguucucucaagucuugcucccaguccuggauucccugguuuguccaagguucuaucucauuggugaaguucuaaccauugaagccauguuggaacauccccuuuccauggacucuacacuuaauuuaaccaccaaguuuuguugaauuugaguucuaaacaauucccaacacuugccucucccucauaaugaacacugcuauuccauggguuguguuuuuuguuuuuuuuuaccgguguuaaagcaguagcuccuucauugguacuucccccuacugugaacugaacuauauugucagaggaguuuuuuuuuuuuuuuuuuuuuucuuucucgagacaggguuucuuuguguagcccuggcuguccuggaacucacucuguagaccaggcuggccuugaacucagaaauccaacugccucugccucccaggcagaaggauuuuuuuuuuuuuaaauacacagacugauuacauuucuucuuagcucaaauguguuugauaagcaguguaguggcaccuacuuguaacugcagagcuugugagucuuaggcaggaggagccugaguuugauggguuagugugauccugaaacagacuaacaaacuuaaaaaaaaaaaaaguuuuauuuauuuaauguauaugagcacauuguagcuguacugaugauuuacuuauuuaauguauaugagcacacuguagccaucauaugcuugccgggaauuugaauucaggaccucugcucccuccggcugacccugcuugcuccagcccuacuuaguuuggccuaaagauuuacuuauuguuguaucuaaguacacuguagcugucuucagacucaacagaagagggcgucagaucucauuacggaugguugugagccaccaugugguugcugggauuugaacucaggaccuucagcuggugcuuuuaaccacugagccaucucuccagcucgugaagaacuuacuacuuacagaacagugaaacauaaaaccaacgagcaugacucacaguuugacaccuccuuauuugcuugucuuauccauuccuucuuucuagcuuaaucuugcaggacucaaacugguugcuuucuccuaauguaucauuuugugaccggggcgcaggcuguccugccugcagcuuuauggucucuguucucucacuuccucaaggcccuguucguucuuuacauuuaagcucauggugcuuucuucaugacggcuacccaccuagccuaacagucauccugccgauuuuaucacugugccuugugccuuacaguucauauuauagauguacgcacgggaguccuacacaaugaaaucgaaaggccugaugauugaagcucaugacauacagagaggaacaagaauuggaaguuuuaguagguauuggagauaaaugaaggagagggaaggaaauaaagaggaaauaacaagucgauucuuuguuuagauggucuccccagcaauaauguugucuauggauagcuuagcugccuuuuugacacagacaccuuaucaaauuucccuuuuaaauuuaaucuuguuauaaaaugcugccuuuuauuuuagguaguggaagagagcugaaacgcgcgugucgaauggaucucaauuucuuuucgguuuaaaagccaucaauaugcagugggucacauuuuuaguaaggcacuuucuaaguucuuacaguacuacuuugaggugauggguucugagccucagacaccauaacgaaucaacgucaugagcaagauaaauaccuuaaaccccuaggugagccucgccauuacuguaaaacacgcuuuacuacccagcaaaaacgauuguuuuuaaaacgcugcauuuuugcaaucuuccaagcgcuuuaauuguucucagacagauggcuaaagcuaggcuaccgcacccgcauauguuaggauaaaaccgacuagagcgccaagaaaaagaugauuggcugugggccguagaaguuacacgguuccccuagcaagagcugggaaaccgcugaaucuucagguuuugaaauacgguuuuugcaucguaaagaaagaagauuaaccuaucaggaagaaccgagcacauccaauuaccaaucaagagcgggaaaacagccaaagccggagauaaccaggcaccaaagcggacgucacucuucagucucugccaauaagccgaggcaaggggcggggcaaccagaggaucaauugcccaagaaaacaaacaauguguaguacaacugucuaaaccccaguccuaagcuccggaugcgccggaaugagcucuagagcaaggcucucgugaggugcuucccgcuuuucuagccuaaugacagucagggccggguaucuacuuccuagcucagcaaagguguccuucccgccagcucccacgggcucgcaaaaaucccgcugcaacuuugcgcuacaguuuacaggaacagcagucgcgcgcugaggggguggggcggcggcagagcgcaggcguacaugccuuguggaggcguggcccaaaaggccccaggaacucugggaacuguauuccccgcucccgaggagguagcacaacucacgagcccucuugaacuacauuucccagaauggcucgcgaccuuggggcgggacgcuugguuccuuaaugaguucgagaaagccgcggcgcggcccaccagguuccaaaacaaggaaaugaagggaggaggcgggacuguagaugccugcgggagccgccgccgccgccgcggaggaggaggaggcggaggagguggcugccgcggccgccgaggagucccuugcugaaggcggaccgcggagcggcgggcggcgcgcgcgcgcccgagcgacggcuguuggagaaguggagcggcggcgguggaggagggacugaguggcggcggcccccgcgucccgguuucucuaugggggaagcagacaauggauuaugauuucaaggcgaagcuggcggcggagcgggagcggguggaggaucuguuugaguacgaagggugcaaagugggacgcggcaccuacgggcaugucuacaaggcgaggcggaaagauggguaagagcgcgagcggggagugggcucgucccguccccuccgcugcggagccccggagggcugggugggucggagcucccgggacgaggcggcgugggucgcagagcgacgucccggggcuaacucggaggcacuggugcugccgccccccgcuggccggucgcgccccucgaagucguacggcgcagccccgucgggggcgucggucccgccuggagucgcggcugcgugauuaacagcgggcggcggguggagaccgcgccuggagguggaguuuaggggucugguccccggggacccuccggagggcuuggcugaagaguuaccgguuuggcccugugcuggugacgguagugguggaacuuccaaucggcgcagcgccuucccggggcggcgguuugaaagcucgcgggggcgccuccugucugguggcgcagcgcuugggguccuggcuggccccuugggucugacuuccuugccaacccagacuucaucucugauguuuaccuggggacuucccgauccugcucccgauucccacauuuuaauauucugaauucagcacucugaagguggacccuggagagagauaaauuguauauuacaagauuuaaguguucucugguugcuuaucuuuccugccucuuggcuaucuuagguauaagauauaucuuggcuaucuaauuccccccaacccccuuuaagauaggguaucugugcgcccugcuuggccuggaacggagagauucgccugccucugcuaaucagguacuaucauuaaaggcguaugccaccaaaccugguccauuucucuuuucuucaggaagaaaucuugauuucuucaaguucuuagccucugucaaauggcugugagcuuugguaguguuuauugagaaccuagaccaccaagaacagaaaacggagugacaggcuugagccuggauugccguuuccuuaguugaggggaucuguaggaaucucuugggaagucuuuauggauuguuauaucaguaaaagacaaguugauaaagcaucgagaauguccccuucgggccgguggucagacuggcuuguaagagcuggcccgguggaaccaaacuucaggccugggaauggugaguuuaaagccaguugucaccuuggcuccuuucuggaaggaauuccuuucccuuagguucuguaacuuagacucaaacgauugucagacuauacaaaagggagacuuaaggauugugauggggcauuuuugauaagccggauuaucaccauaccucagauuuaaagugcuccuuggggccccuccuucccagugcugugauuugauaauguuggugaggcgcucccgcaucaaaguaagcagugcucgagcuacuuuucuaagaagaaagccagagcacagucguaccaagugucucauacucaguaccuggaaaguuacagguacuguccagaacucaaggaugaugguuaaucgcuauugcagguagaccugucuaggccaagcuacucaguugucugagcuguuucuuuuaauuaccacauguccucgagugcacaccaggggcuggaggguacuguaauugacuugcacucuguuuuuggcauagccacucuccugauuaaauugauauuccagugggacucuucacagggcuguuuggggaaagcaaauccagugcugucauuuggacacugugguuccauuguugggcuggauuuucccguauccccagggacugugcuaacguugugauacaugucaucuagaauacacaaaguuuucauuaaaaauaucuuaaaauauuuucauuugcccugagucuuugagaacuuuaacaauucuguuucugagucacauagacuagaugggauuacaacagaaacaguuuccgcuucuuaguuuucacuauauaauaaggauauugauuaaaauacacuuauucuaugagugaaauugguaaaguagaguacauaaaauaaggucaguuuuuguauuuucaaaguagaauuaaaacaaaacaaaacaaaacaaaaaaccaaaacacuuagagcuagaggcaggcauagauggaucucugaguuggaggcuagccuggucuacagauggaguuccaggccagccauggcuacacagagaagcccuguuucaaaaacaccaacaaaacaaaauaaaccaaccaacaaaaaaccacuuagaauaugaaaauauauuuucagaccauuauaucacauguucagaccacuauaucgcauguaagacaauccaugauagguuuuauuuauugauuuucuuggguuaagagucugguucagauuccuggguuuacacuaaacauucaagucucuugugauuugguagugggauuaguuuuauguucauuacuaaucagcaauuugaaagaacagaagguuuuagugguaguucucaaaugugauacggauuuggauaguuaaggauuuuauccucuggucauucuaaauuacaguuccccucuuuacauuuuauuuugguaagcucaggaaaaugaguggugcgaugcuauuuuagggagcaagaaagaugagggccugcuagagaaaaauaauucuaguguauauaacacuauugcauauacaugcauacauauguguacacacacauaaauguacucuaucauauaaauaaaaauugucagaacuuuagaauaacauuacagguuguuaguuacuucaaaaugagauuuucaaaugagauuuaaaauaggcaauacaaugcaguguguauuuauagcaggcuagaaauauaagacaugucuugaguuuuucaccuuuauauauuuaauuguugcauaaagauuuucauacacagugguacuagugauguuuugaucccuuguacauuguauacuguuuccaccagaguaaaaaugucuccucagacacuuagaaugucauuguguugaaacauuggaaauguuguuucuagcuuacuugacauguuguaucaguuucuuugcuguucaacauggcacgguggcuuauuucucccaaaguguuuuccuuuaauaaaaauguuuuucauuaauuuuucauuuggaaggaaaaugaaaauauugaccccuguaaaaagcagucaggcuugcacccucaagauggcacaccugcugccuagaaugugcuggcacgcaugaggccugagccgcagccugggggauugucaugguugaagauacccauuuccacagagcuguccucugacuuccacaccugugacauguggguguucucuccucuagguauucaaaggaaauaaaugccaaaaaaaaaaaaauucaggcugaaaauuaauuaccuacaauuuacuuauuagacauauuacaugugagcuguggcaugcacuuggaggucaggagacaaccuuguggcauggaucuugucuaccuucauauagguucugaggguugaauugaagcugccgugcuggcguuaucuaucagacaggugccuucaccugcuggaccauuuuguuggcccaaauuuacuuacugguucugagguccaauauagagccuugggaauacccagcaugcacgcugccacugagcuaugcuuccagcucuaggauaucuuagaauuuuuuaguaugaguaagaauucauaagauuuuuuuuccuuaguaguaaaaaguuucacacugugcuggggauguagcucaguugguagaaugcuugcauagcacacagaggcucuagguucuauacuguauaagccggacuugacacaauaccaauacuugggaaauggagccaggaggaucagaugcucaaggcuguaguuagcuauauaugaguuccauccagccuggggcaccugagacccuguuucaaaaaaaguugggcauaaaacuuuauagugacaagucugaaaacaguaucuuucuaguuaggagcacuuaauuaugacugauaaaggaauauuguuaaauucuuuucauuaaaagggucauaaaaaccugauucuauggcauaggauuauauaugaaaacuugacuaaugugaguuggauuuccaagacugauugaaaacaaaaaguugcuuuguaugacuguuuuugaaagguacuugguaaucgaaaguggaguggcugccagaguuccuaagaguuucaguuuugucuuagguuucagcugaggacuaggguacguaggcauguuuuaaugucucaugaaguccuucacguguaacuacauguagauagacacggaaaaucagugcagcagcaucugucugggugguuuuuguuuuuuuuuuuuuuuuuuuugcaucugccuguuuuuaauggaguuuccccaguugguuuguagauuuuuguguuugcuuuguguguguguguguuugcauuuugaucgguggcuccuggagguuuagguaguccgcucugugauaauaaguaguauuuucuaauucucaacagcuuuagaucaucuagcucaacugccuuuguuuuagacagcggagcucagggaaacucagggcuccaagguuauuaacucacugucacacagaacuaggaagccugaagcccagacaggaguccuguauuuuguuaugcauuuuccuuccuaaugagaagaaagcaaaaaaggccauuuuggccgggcgugguggcgcacgccuuuaaucccagcacucgggaggcagaggcaggccuguucuacaaagugaguuccaggacagcuagggcucuacagagaaacccugucucgaaaaacaaagcaaaaaaaaaaaaaaaaaaaaaaaaaaaagaccguuuugccuuuaccuuggguaauuuuaucuaaacacuuauuucauacaaacaaaacaaaacaaaacaccaaccaacaacaaaaacaaaaacaaaaaaacacccccaaaccacucauaucagaaauaugggaaaaaacuacaggaaaagaacauuuaaaaaaggagugcagaggaggagguauuugggguaaaguugguagcuugcccaaggcucuggagucaaugcccagagcagcagaacaacagaagaguguccgcauagcugcuuaucuuccugacuuacccugguccccugugucaccacugugguccuuccugugacucacacagcugcagaacugguguccaccuuuggucuuuucucacuguagacuaagauccaaguugcugucauugucauauuuccugaaaauaaagucagguauauuuuguuuagaaaaaucauacauuucuucuuauguauaacugggucagaucuacccuacaguaccuuaauuugacaucagaagacaugugcacucagauccugaccauucuuuuuccacuucauugaauugauuuauaguguugaacuacauuuucuaggacuuaggucuuccccugucugauacuuacguuuuaccuaggauggggucgucacugacaguccucuuacucauuucuuuguccuuacacaucaggccaccucuuguucauauuucaguacccagcuuuauuugcuuucugccggaagucuccccucagucauucaaugugcuuaccugugccucuguuccuccuuacagauacaguuucacucgcaaagauguugcagucuuuccaaguuguuagcuucagugucuaguauacaguuggguauauauacacaaucaaaaacuauguagauuuuguaguguagggugcaguggcacauacuccacccagcacucaggaggcagaggaaggagaaaccuucaacuccaacugggccacacgagacccuguuggaaacaaacccaaauuguugaauuuuaaaaauucuacaaagugguaaaugugcuuucaugaccuuaagaacaaauugagcuagguagugguggagcacgacuuuaauacaagaacuugggaggcagagaggcagguggauuucugaguucgaggccagccuggucuacaggacagccagggcuauacagagaaacccugucucgaaaaaccuaaaaaggaaaaaacaaaacaaaacaaaacccaaaaaacuaaauugaaauuacacacgugcacaugcagacacacacacacacauauacacauacgaacuuaugugcaguuuuagagacagaaaucuccaucuuuaucuucuguaugcugggauuaaagguaugugccaccacaccuggcaugaaauuuugaaauggcaauguucuaugggauaggugauuugauauauuucuauaggacuaacuauugauuuuaggcuaaccuaaacuugaacuaaugaucucuccacuuugccuuucccugcuagcauuauaggcacaagccccagccccugguuaauuacaggucaaacccaaggcuuugugcagguuaggcaggcacaggagcuacuucagucuauuuccaguucuagcacuagucaucuugccgcuccccccucucccagucuauguauguauuacuuuuuuuuccuaagaagguauacguuuaauugcuucccuuucauuuugaggcaaaggcuuaaucuguaguccaggcuggucucaaacuccccauccuuuuugcuacagacuucagagugcugggcacacaggagcauacuaccauaccuuaugguuucuuuuaauagacguugauaaagagcagaguucuuuuggaauaguaagcauuuuuccuuuuuagaccaaacugguuuuugcuagugugugaauucuuucuucugugcuuuuaauagcuauuucauagccaugcuuagaagauaucagacucauauauuuuaggaauucuuuuuugauauuacagauuuauaguuaaaaagauauuuuuagcauuuaguaauugaagugaauguugguuuauauuuauuagcuuauuuuugcaauauaagcuuucuaaaacauuauuuuugagaccuaagggaaauaaucucucaaugccuugcuaggagcagugguccugagacugaacagcagcugcuaauaagcauuuuaggcuuguguggccaucucagaugugcuuguuuacaacugagucugaagagaugggugaagaauaccaguguucacagaacaaugcaaaagaaaccacuccacucuuugaaaugaauugaagauaguuaauuuucaaaaaaaguauuuugugggcuguucggugguuucucaguuaagagcacuuugugacucuuucagaggguacagguuucauucccaacacccacuugcuggcucauuauuaucuguaacuccauccaguuucaugguaucccaugaacucuuucaggccucaugggcaucauacaagaauacauacauacauacauacauacauacauauauguagcaaaacacucauacagaaaaaaauaaaaauaaaucuuaaaguauccuguaaaaugaagaacguguuuaguuaguaauugcaagggccugggaaaggaggcggugagugugcugaccuugcugucgcacccuuuccucucuggaggcagcuccuggaugcguuuucucuugugaauauaucacgcaugccguuugauauaauacaugcugugguuugcauauuuuucuuuuuaaacuuuaacaacuugaagaccgaucauugcauaucuuuugcacagacaugucuuaguuuuguuuucuauuuuauugacacaugauuuaacuaguuaaucuugauggaacuuuagaauuguucuaguuuuuugcuaguacuaacacuaaugaauaucccaguaagugcaauauuaauauguaaguuaaauuccuagaaacucuuucccuuuggaaguagugacuugaaauugaaauuguuugcuaauaccaugaucuacaagacauacaccuaaacaguggagauuaagaaguggcuuuugagauacugaugcagguaaguaaugaauuacuuguuugccgcaugacaugcagauugcuuucacauacuguuguuuuaguaauacagaguuuuaacuagaaugaguuuuaaaauacagugccugccaguguugaugaaggaaguguuucuacuuucucucacuuuuugggacuugauauacuggauaagauguuaauauaugauauuaaaugguaagcuuguuuuuuaaaaaaugcccaggauagucuggguuagaaguugguauagacuauuuuaaguuaauauauuacaguuugaagauuucauggugcuaucaucagaguuacaguauuuagaucuuuuuugaauauuuggauacuaaaaacugaguuuugcuuacugugguaaaauccuuuaauuccagcaguggagcauagaggugggcagaucucugugaaccuacgcugguauacacagcaaguuccaggccagccaaagcuacauagugagaccuugccucaaaaacaaauaagcaaaacccuccccaaaccaagaauuaccacaagucaguguugguaaagaaugaacuuguuaucguguuauguagcuggacaauguuaggacuuccuuuugguucuaaaacaaagugacaagaaacauuauuuuuagaauguguuuuaaauuuaaguaacuaacucagccauuucuuaaaaauagcauuuuuggucuggaaccaggcagaguuagccaaugaugcuauuuuaaagauuuuguccauguauaaauagcugaccguccagcacuuccuguaauagcuguuggagcacaggcugugcaggguaagagcaucuugagagagcaggacgucauucaggaugcaaguguguagcagucaguguuuuaaacugagguuugaguucugcaggagugagugauggaucacagaaauaaaagccuuuggagucauuagaugauugguguccucauaaaaugucuuaagucuccugugguagggaucaaaacauacaguaagucucacuacaaggaaaagcacagccuucuugcugagacuuuaaacuguauuuucuacguaaaaauagaaaaggaaacaguaguugaugguaaauuacugagccucagcaacagcuuuuugucuguuuacuguaucccugugcauuguggauuuaacacagcccucauugcaaaggggccuuugucaccuuguuguuuagguaugacgcuguacagccucaagauaccuuugacagggcuggagagauggcucagcgguuaagagcacugacuguucuucugaagguccugaguucaaaucccagcaaccacaugguagcucacaaacaucuguaauaagaucuggcacccucuucuggagugucugaagacagcuacaguguacuuacauauaauaaauaaauaaaucuuuaaaaaaaaaaaagguaccuuugauagcccacaggugcauaaagcuuuucaaaagaaagucauuuauaaaaacauuggaauucaaggucauccucugcuacaaagagaggugccuccggagagagggaguuaaggaaggaaagaggaaagaaucuaaguucccuaagcauuauagaccuacauaagcaaguaugcaagccaaguaaaaaacaaacuagucaggaggugguggugcacgccuuuaaccccagcccucaggaggcagguagaucucuggguucaagacuagucuggucuauagaaugaguuuccccagugcuuuaagucacuuuuaaagacacaguuaauaguaacggcacugcaggaggucaggaaugcuguccaagucugugagcucuuggcacaugugcuugagggucugaguuuaguucccagcucuguaagaaagaaagauuucaugguacaaaaugaaauuuuacuuuugagaaaagcauugcugcugcauccugcuuuugacuuaguacuggugagcauauucaacuuacucuuuuuauaaagauuuaucuaauuuuuauggguaucuguucuguguauguaggcgacuagaggaaggccugggcaucguaggggugaaauuacagguaacucugagcuccucgacuugggugcuaggaacugaacucagguuuuuagggagagcauagcaagucucuuguagcugcugagcugucuuucuagcaaccccccccccccccccgccaccauaaagaauuaaacaaaauuauguguguaugcuuguguauguguaacugugagcacauguagggucagagggcaauguggggccuguuguugccucccaccauguggcuacugggguugaacucagaucgccgugcuuggaggagagcgccuugaaccuucugagcuaucacuggcccugacccuugagcucauugaaaauaaguauguuacugucuugauaaccgccuguuacucagcuugcaggauuuggaggagggccccaguucaaggguggucugggcacagagagacugggcccucugccuguuucucagagcuacccuucccacuuuccuccuccuccuccaccaccaccaccaccaccaccaccaccaccacaaguaauccacugggaaggcaaaaguuaaaauauaguuuuuagcaaccaagaauucaccuuuucguccagaccagugguucuuaaccuucccaauguugaggcccuuuaauacaguuccucauguugugggacucuuccuaucccaauuauuuuuguugcuacuucauacuugucauuuugcuacugcuaugaaucguaauauaaauaucuggugugcaggacaucugauaugugacuccuguaaaagguuuguucaacuuccagccaaugggucaugaccccauagguugagaauugcuggucuaaaugugaaauauuuacauccaucucagauagaguugaccuugagugcuaugcugcacugcacugugcugcuguggugucccuaggaaguaggacauugucagcucccuuguguugugggaccaccaauaugugugugauuuaucauugauggaaauucauuauuuagcagcacauaauaggaucuuuuuuuuuguuuguuuguuuuuuguuuuuuggagacaggguuucucuauauagcccuggcuguccuggaacucacucuguagaccaggcuggccucgaacucagaaauccgccugccucugccucccgaaugcugggauuaaaggugugugccaccacgcccggcuuucauaauaggaucuuauguaauguacagaaccaguguuuguugaucuuucaguaggaauacuuuuguuuuuauucuauuaaauuugguaaauaauagcuguacacaguaaaaaccaagccuucaacaucuuacguaguuguacacaagaugaaaauuggaugcuuucagucguacuguauuuuuucaauuucucuuuacuucucagaaguaaacacucgugcuagccucacuuuuaguauaugccucaggaucaagccuguggcuuuggggucccaguggaugucaugcugaaaaggugcuugcucccaagccuaaguaccugaguucaaucuuugagacccacaaggugggacgagaaacugauuccacugacuuccacauguacaaccacacccguacacacaagaaagagauacaugcauaaauauggaaauaaguaaauaugaugauuaaaaaaaaacucauaaagcauugugcauguuugacuuauauuacaucgagcugcguuuccaguccuuaacaguauaaaaguuuuuauuaaauuuauuuaugugugugcucaugccugugugccuuagguuucauucauauaggauagacauucugaguucuuauauguguaauaauguacuuuauuuucauacuugguuggcaaauuuggcuauguguagaauuuuuagaacuauuagcuauuaaaauuuuauucuuggugcaugccuuuaaucccaguacuuucggaggcagagggaggcagaggcaggcagauuucugaguucgaggccagccugguccacagagugaguuccaggacagccagggcuaaacagagaaacccugucucgaaaaaccaagggggaaaaauauauacauauuuauuuuaguauaugccucaggaucaagccuguggcuuugggguuccaguggaugucaugcugaaaaggugcuugcucccaagccuaaguaccugaguucaaucuuugagacauauauauuuuucccccuuguuucuuauauuuaaaaaauuuuuuuccuuugaauacaacagugcugcuucauguuuucuagacuacaggggaauaugugaaaagggaauuuucuuuaugugaacuuuguucuuguuuuuauccuuuuucgcuaugcgcauuuguacuuagucugucauacaccaucuccagaccaaagccucucccccuucacuccugcuggcuccuccuuucccauuuguguucuuuaagggcuucucaguuuauuuaucauucuguaacauuuacaagugucugggaaaucaggucucuuuuuuucaucuggcuuugucucuuguguuugcuuauauggguagauaacugcacuuaauuuaacuuggagguuaaaaucuucagugaguagcuuuagcccuacuguucucaucuucugcuccuucagcauuugagugguguuucagggucccguguagcccaagugggccugcagccugcuggaccucucaggcuggucuugaguuccucuuugcuugccucuaccucccaagagcuggguuacagcaaguucuuccaucccauuauggauuugauggccuuucuccaugugaccuucuucggggaugcucacuaaccagccucccuucuccacucuuccuucaguguggcuuaaauuuguugucaguguucagcccucagugcaucuggguucugagagauuuuuccuuuauuuuaauuuccuagguaccaguuuagucuucagugaagcuuaggaucuuauuuauuaugaauugaauucaagauucugauuuuuuuuuuuuguuuuaggaguuuccagaguaguucuuuuuuuguuuguuuuguaaauagcuuuuaaagugugugugugugugugugugugugugugagagagagagagagagagagagagagagacugacugauggugacagaguguguuagaguguaggaauugagccuguuaugacccagcugcuguggaguuaaagguuuucuggacuagguucucgucucccaccuuguugaggacaguguuuccuuucugcuucugugauuauagucugcccuaguuagugaauaaagaaaagaaaugaaaggcaugacuguucuuagguagaggagaaaguuuauuauagcuaugugggagagcauagugagcggcagggacaccuaggagaguccagaguggucaugaccuuaaaccuugaggaagaggggaaccaagugcagccgccagguaacuagaaugucggaugagccucugcggguggggagggguugcagaguucaagauagagggcugggucugccagccacacccuuuaaccccgguugggacagagggauaggggagaaccuggaggccaggucugcuuucauauguuaacuaggcuugccccagguuugaaacuuaauaguuugcaaauggucacuaucucaccuccaccccuacccccaacucucuuaucugggguggggguggagcaggaaggaauggugguggaggagggagguggugcaggaggagagggugguggggauggaggaggagcauggggaggagggggagguggcaguggaagaggaggagguguugguggggguggaggaggaagaagaguaggaggaggaagaggaggagguaguggagguggguucuggggauggaacugaaguccucagguguggauaagcaagugcuuuuacuggccaggaauuucuuuuuuuguuguuaggauuuauuuguucggcuuuuuugagacagugucucauguagucccgacugaucugcaguucacuagguagcccugaagauauccauauguagagauccacuugucugcuucuugagugcugggauuccagucaaguauauaguaauuuuuuuuauuacuauguacuauuuuucuuuuuuccuucuuagguuuucuuacaaucucauguuauacuaagauaauggaaauauuucucuaguuuaacuuucagagacacauuuauuuuacuuaacaauauauagggacuuugaagggcugcaggaaugugcugaauucugcaaguuuaaguaucaugcugccuuuguauuaaagauguaguugagaaaauguaaggucucuuucauaguuccccaaauaaguaaauuugcuguauuuauuuccagcuauauuguuuuuuaaagauuuuuuucccuaaaugacuaacaagagacaagagacaguuuaguaugaagaaguuuacguuuaaucuccugcagaaccaaaaaccggugagacaaaagaggugcggcaugcuaaacagauacagugauacacaggaguuagcccacuuagcaaagacagucaugucgguccugugauaguaauuucugaacaaucuccaccuguccguaugucauccaccagccugucugaccauucauccaucccuguccuguucauuagcacacacauugucugccuguuuucuguccaugggcacaugguuuccucucauuguucuuccauuugugccaauuaauuaauucuuuacuagcguuugauuucucccacgaggccaguguugugacacagguaauacuacaaagacaaaggagggguguaaucuguuuguaaaaccaggaugcaaugcucagaacagauuacuaacuauccacaguuucugugagauggaaaucuggggugaaagaaaaacaggguucaacccaaggacucacaugcaagaggaggacuuaaaaauuauauuggaaaaucuauuugcuguguauacauuucccacuuaaaaugauaaaaguauuguguaauuagaggagccagaagugguguguucuuuuaaggaaauguuucuggacacaagaaggcauuuguaauugcacaguugcggagagcaguugugacagcagguuuaaagccugggcuaauucaaaccacagaaucccagaauggagaggaugggauggcauggagucucagagcugaggagauuuugugagagggaggggcagcuuucuuuguggugugaaugcuagucuuuugaucucccucugggguagguaccacacccaaaaggaguuaguuggucagcacagauugcugcuugcuugcauggaggugaaugagagcagggaguuagugggucagccgggggauugggacguggaagcgacugggagggagauuagcaucaaaaugcauuguaugcaauucucagacuuuauaaacccuuuuuauuuuaaaaaguacaaguguaaauaucauguauuggaaauaagcaaaagcccuuugcuuuaaacccugcacuuguaguccuggcugcuuugggcugagaaggauagcuucagucuggaguucugugccagccugggcaacacaccaaaaucucaucucuuaaacaaguuuaaaauaucauaaauguuuuaauuuacauauucuaaaaaccaauauauaaaaaugacaguaaggaaaguuagggagggguuuuagaaaaguaaggaggaguugaguaugauaaugcauacguuaaucucagaauuuaaaauguugagacugggggacagauaguuagagguuagcuugggucacauauugagacauagugucaaggcaagaucaaaacaagagaaaaauaaauuauuuguggauaacuggagguaaguauuguuaguauuuuguuuuauuuucuuauaguguauauuaaaaaauacaugcacaauaugcuuuuuucuaauaagguagaaucuaaauaacaaaauucauaauucuguguagcuaggagggaaacugaggcaagaggaucucuugagcacaggguuuuaaggccuggggguagagaaaugguucaucauuaagagagcauacuguugguguagagaaccugaguuugguuccuaggguggggaggucacaauuaagugccuauaacucaaagcucaggggaucugaagucugguuuccaugcacaccuucacuuugugcacauguccaccucagacacaaucaaaaauagaaaacucaaaagaaggaggaggaguaacaggaagaggaagaggaaaaaggaaggaaaagaagacggggaaaggaagaggaggaggaggaaaaagaagcugggccugauagauugaaucucuaauccuagcuaacaccuaggaggcagaggcaggcaggaccucuaaauuugaggccugucugguuuacauggcagauuccaggcuauccaagguuucauauagagucucugucucaauaaaggaaaaaacaaaaaacaauuuagccuguuuaguacauucaguguuuuguaacuguuacuacugucuaauccuggaagauguucaucccccaaaggagccccaucccuuuggagucuuuauucauucuuuccucucucaauucuggcacgcacuaucugccuucugucaguggaugguaaacaaucuggccuuuuaugauugaccuauuuaacuccgcaugguacuuacaagguauaccauguuggaguaugugcuaauaacuccuuauuguggauggauaauaguauggccacauuuuguuuacucauuaaugacaauuuguguucccucuacuuucugguaccuaagaauaauguaaauauguauacacauuuuuguuugagcauaugucugugucuguuuugaguguauaccuaggacguagaauugcucaggcauaugguaauuccaauauagaacguugugagaaacugacaagauguguuguacacugggugcaccauucuacauuuuuaccuaguguuuguguucgacuucccggucuuuaaaaagauuguauucuuugagaauuaauguacacauugaguguguuuuguaucuguuggacucuuuuucuccuccaacuccuuucuuaccucccccccaaugcugcuucucagaucaccuccucaacuucauguccuguuuuuuguuuuuguuuuugaguuggggucucuuggucuugguccucauuucuguccaucucuuucucaaagacucgcugauccagcgucugugccggagcaugggagcaugguugacggacagccucccauguguuugcuguuacucauuguucucucucucuuuuaaagacuuggaauuuauuugugugcaugugugugugcacgcaugccuauguguacucgaagugucaugucgcuuacaguuccccguuagguggguccuggggaugagacuuaaaucaccaagcuuagcacuucuuccuuccaagcuguccaccaacccucucucuucuuugaauaacuguucuaguggaaauaguuucuugagagaguuuuauuuuccuauuggcuucugguauuuaacaucuuuucauguauuuauugguaauuuauauaccuuagaagaaaacucuauagauggcuuucuccuauuaaauguucuuuuugaugauaacauuuaaaaacauuugugguuauucucuuuaauugauuguauauagcauuugcauuuucuccuucuuuugagacaagaucucacaaaguauaccaggcugccucaaauucugugauucucccacuccugucuuuuauauuuuuauuuuauuuuauuugaguguuuuucuugcauguauaucuaugcaccacauguaagcauggugcccacagagucuaggaguguauuggauucccccagaacuggaguuaaggauaguugugagcuacuguguggguucugggaguugaacccagguccucuggaaaaguacuuacuuagugcucuuauucauugagccaugucucuggcugcugcuucauucucuuuaagugcucaggucauaggcuuguaccauggucccaggcuuaggauguuacagaguugagcuuagagguuuccugcguaguucacaucuucccuuuuagguugugcuuacuugguuuggaugaugccauguuguugggagccuaaauguuuagcuuguaaugauaaaaggaaaguauuaugcaaaagaagugauaaggcagggaagaagaugagcaacaauauugaauuggauuucaagaauuccuuuuaguaauuuugugaggaggaggagggaagaagaggagagacagcuuuguagcucuuucuuuucuguggguuuuguuuaguuugguuugguuugguuuuuugagaugggguuucucaaugcagccauagcuguccuggaacucacucuauagaccuugcugaccucgaacucagagauuugccugccucugcuucuugaggacugggacuaaaagugugguccacuaccauggacuuuucuucuguuucuguuuuucaugauuggaacuagggaaugauaccuaacuuaaaagaaacuuugcuaagguacauguagguuuuuaaguuuuuuuaugauuguauuuuuuaaauaguagacaaaacugaaguaaagccaaccauaugcuuuaaaaagcagcuggcuugauaaagaagauagagggccaugggagaggggauggucuugcuauuuucagauuuaguguuacacuguuuuacuugggaagacagaucuguaacaguugaaagaagccugggcugcacuguguccgccauucccauagcaccuccugaguggugccucgaaugcaggcuccuguuuuauccugcagaaacccagcugcucugaugagaagaaugggcucauauugaggagggguagguagugauggggcugugggcuccacugggaacagugugcugcaaggugagacaggaaagacuucauucacuggaacuagcauaguccauacaguuuagaaacaaacaagucuuacaguguauauagaagaauaaaaacaaauacaguucuuuuaaaacacaccagcagugucauuuauaaguacucagaauggagguuggcaauacaaccccagauguaacaauguaggccuggcugguagagaaugagaauaaugcauuccagauggaguagauuccaguaguuuccaggauggggauagacauguaucccaugcucuccacccccaguuuuacgaggaauauauguuacaaaaaagaaacaauuaaaaauguuuuaagugccucugcucccuuuuccuagagauggccacugccaaguggcuguaauggccucacagagggcagcuucauggacaauuuucuaaccauguggggcagagggcagaggguaugugagccagagcaggagccuagagagagagagagugaugagaaaugcugaauuucuggucccuugugauagcugugggguagacaggacagggcuaaaagaaaggacaagaagaugguuaggggcagaguucugugacuagauggagggggacagaaguguggccagaaccagagaccugaaccagaucgggacgugcugggcaagguuuggguagacaggauugaaauguaacuauuuuuaaaauuuauauuuuggucguaaguugcuguauuuaguuuucuuauuguuguuacuuuuucuuucuuuuuuuuccuuuuuaaaaaaagauuuauuuauuuauuuuauguacgugaguacacuguagcuguauucagacacaccagaagagggcaucagaucccauuacagaugauuguggucacuagguggucgcugggaauugaacucaagaccucuggaagagcagucaguagucuugaaccacugagccaucucuccagcccuuuuucuuuuuuucaaagcagagucucacuauauauccuugaauguugucuuaguaaggguuucuauuccuggacaaccaggaagcaaguuggggaggaaaggguuuauucagcuuacacuuuccacauugcuguuaaucaccaaaggaagucaggacuggaacucaaguagaucagaaagcaggagcugaugcagaggccauggagggauguuacuuacugucuugcuuccccuggccugcucagccugcucuuacauagaaccaagacuaccagcccagagauggcaccgcccacaaggggaccucccccccuugaucauuaauugagaaaaugccuuacagcuggaucuuguggaggcauuuccccaacugaagcuccuuucucugugauaacuccagccugugucaaggugacacaaaacuagcugguacaaauauccuggaacucacuugguauguguugaucaggcuggcuuacaacacagagaucugccucugccuccagagugcuggauuaaaugcaugagccuccucacccugcucuuuuugguugauaagagcugucaugauaggugugagguaauaucauuguauugaggauuuuguuuguuuugagauagaguccugcuaaguagcugaggcuggucuugaacuagcaauccauuugccucugccuccagauguuggaauuucaggcuugugcuaccaugucagcuugaguuuugguuuugguuuuuauuuuuuuaaaugugugugugcucauauacauguguguguaugugccacaggcauguauauuggucagaagacaacuugcaggauucagggauuaaacucagguuagaaagguuuggugacagaggacauuguugcugucuucagagacaccagaagagggcaucagaucccauuacagauaguucugagucaccaugugguuguugggaauugaacccaggaccucuggaagagcagucagugcucuuaacugcugagccaucucucaagccugacaaagagcuuuuaugugcucaucuuacuggccucuuuuuuucuuuuaggauuagaaaaugugugcaggcuggacggugguggcacacuccuuuaaucucagcacucugaaggcagaggcaggcagauugcugaguucgaggccagcuuggucuacaagugaguuccaggacagcuagggauauacaaagaaacccugucucgaaaacaaagaaaaaaauguuuguaguauaauuaaaugucaguagguuuaagagucaaaaucauaaaacuuuagggauuuuauaauauuguguuguacacgucacuaauuuuuuuuuuuuuuuuuuuuaaauaagguuucacuauaucucucuguggucuggaacucaccuuuuagaccagacugguuuccagcuuacagcauugcuugucuccuucucuggagcacuaggacuaagggugugcagcaccguacuuagagggaguuguuuuaagacagugcguuguuccuuuuuucccuguuacauggugagacuuggaaacauuauuacauaaaggaucguauucuucuaauagcuagcaaguagaucuugaagguuuuuuccucuugguuuuuggagacacuuucucacuguguagcuagacuggucuugaauguaaagcuagcuuccugccuucaccucaauucucagauuacuacccaguuuaucucgaaggguuuuaaaaaaugccuguuauuagagaagagcgaggcauaagguuacagaucuaauucuuuuaccugauuaaacguuuacuauuucauaggaaugguuucugaaagguguguuucaugguuauuuucauuuuacaguauuggaacagauucauuuccaccagccugccuagugugcguuacucauuucagcauuaccucagaauucaaucuugcuguuggaauagcuuuagcuuuacagucuagccccacgcccuuuuuucucugcaucuguucccuuccaggugcauuuuaaauaguuucccccaucuauguucaauaauuucugguucuuaagagagugggcccugaacuauaggacucacgcuucauauuuugugagguuuauuuuucuguuuacuaucuuccauuuuccacauacauguauugguucucuuacagacuuggaaaacaguuguuaguuucaguucauaugagugcacacuucuguggucuguuucccaguagucgaggagcauacguguuuuccuguuuuugaaguguauguaguaaaagucaagcacucaagcucaguuagcauuugaguuuuaauuuuguuuuucauaauugguugcaaaauauaugaugaccugugauacuuuauugauuuucuuguugucugaucuaaagucugauuucuuuggcagauauguagacuuacaucggcauuugacauuuuauguuuugggcaguggaacuuuaaauauacauaaacucugcuguuugccucuguuguguuuggaggucccaggauggcuuugugugugguccucacgugauggagguugcagacuucucagcugagagugaagaggguguugccuucuggugucauugugugugcuggggugggauguaucaagagacagcuuucuguguuaccacgcagcaguuaaaacgauaucacagaugcaucacuuugaucacauuuaugaugcauuuuuauucguuauuacuaaaaccuguaaaagaaaaaaaaaagaaagaaagacguuggagcugcugagcuagcugcucaguggaugcgacauuuggugccaguaagccuguugcguucuaaucccugggacccgugcaguggcaggagagaaacggcuucugcagugggccuuugugugcuugcuugugugcacacccacagaccaguguaacagaaaucagaaagccauagagagcuagagagugacuuucacuugcucugacauuaagauugggaguaacucauaaaagagaacacugguauauuguauaguaugacugugccauuucucagacuuagcugcacugugguuucuucugggaacuuguccaagucauuauucauguuguauucuucccuacugcuccuuuuacugaaagauugcuucacaauaaauagagaggcagccuaauccaugacucaugacuggaggauagacauucuuguguuagguuccgugugccagaaacguuagucuccaauaugcuaauuaccgcucuucccaacuuguuaauaugcucuucucaaguuugugcuuguuuuaguagagaaacaaacacaucccacauacuuguaaaauacauuuuuauagagguuuuuuuaaugaguugcuuuuaaagaaaauaaugagauuaggaucagaaaaucugauauaccuuucuugggcaauguuucuuugaccaaaaaaaggggaucauuuugccauuuaugugccagaucuuauaaauauuacuuuuaugaguuuaugcaaguuuuuaugaauuuucuucauauuacuggaacaauucuuuuaacaauugugcauaggcacaugcauguagcacaucccuaugugugaaugugggucagcauguaccuugaguguugguccucaccuugcaccccguuugagagucucuuuuccagugcaucagcaguguaguggccugugagcuucugcagauccucugccuuugucuccuagcuggcugugggugaacagggauuacagacaaucacauaauacgucaggcuuuuaugagacuuacgggcauuugaacucaggucuucauuuuugcauauuugugugacagcacuuuuaccuagugagacaacuuucucagcucuaguaacuuuguauuuuuguuuggaggcaggguaccaaggucucacuguguaaaccuggcugguccagaacuuucuguuguggacuguguugaacucgaauucucacagaugcuuguaccucggucccuucagugcugagauuaaaguugugcgucagcacauuugguuuacaguuuuuucuuuaauuaaaaaaagaucuguagcagcuaacaauuuuuuuaaaaagauuuuuauuuaaugucuaugaguauacacuguagcugucuucagacaaccagaagagggcaucggaucccauuacagaugguugugagccaccaugugggaauugaacucaggaccucuggaagaacagucagugcucuuaaccacugagccaucucccuagccccagcugacauauuuagcaauauagguuauacugcaaagcauaaaguuaauaacaaugucaguuuguagguagauucugaaugagaauugggguaucuguuuucuuguuuaauuuuauuaaauuuuuagaguaauuguuuucuguccuuuggaaauuguguucuacuagguaucaaguaagugucugugcauugugccugacauggaggaugugcgguucaugcgagguugaguaacguucauuugcucaagacacagccagucagcugaguucaccguuuguuucacuugcuccuaucucuuagcagcaguagguaggacuuucagauuauuuaguggaguaagcuauaccuuuauauugaaacccuguggccuuuuacguucuuuaauggcuacuuuuaauuuaccaguaguaauugaaaauaauuuuccuaagaauuuuuuguacuucauuucuaaguuaauugguuauuuuuuaucauuuuaaauuaugcauauuuaacugugauaugguauauauagguauaauuaagagucucaguagauuaucaaaacauagaaaggcaucuugucuaccuccaccccuuuuaguuucuuugaggaagaugagauuaaauauaugguuauaaagaauuuuaaaaagugugugugugcgcguguguuuguguguaugugugugugcaguggaggugagaggcauuggauuccccugggaacugaauuugguccucugcaagaucggguugacucuuaacuucugaaucauuucuccaggguguuaaccucccccuacccuuuucuuuuugagagagagucucauguagcuuuggcuggguuuuuguuaguuagccaagguuggcagugaacaucugguucuccugcuucugccucccaaguccaaagccuguaccaucaugccuguuuuuaucuggugcugggaauugaaccuagggcuucgugcaugcuagacaaguacuaacuaugccaacugagcuacacguguaccccaaucuguaccauacauuuuacauaugagaccauuguuuucaaagugaugcucuuauggguucaguccuucccauuuuugauuuuacuuucacaauccugucucccuucuaagcuacugacauuuaacaucuuccuuuagacauuaucaaagcccucaacuuuucaguucccuacaacuugcucagucugcuguauugccuagccugcuagcaggagucauucugggcugucuguuguuuuccuguguccauuggcucuguguccuaguugucuuucagagccaucugcucuuacucccuagcuuacacuguugugcccacaaaccugacucucagggucucuguucuucgucacaccuccagacugcucgcaggaacauagccugcauagguucuuuccuaccucgugucuuaggaugaaugaaguccagguuccuuaguacgcuuacuaagguguguguccugcuuguuucuuucucagcgguuuucuuuucuuccccgugcucuaucggccuucagauguauugugcuccuuugcaggugagccuuggcgcgugcuguucuuucucaggaaacaaaaagacaugaaaaacauugcugugcugauuaaaccuaaaucacuuacuuguguuagaauuuuggacccucugcuucacuuguagucucgaaguguuacuuacaugcuuucgguggcauuguagcaugugagaggaaugcagaggcagugcuugaggguggcagaucaguuucuucagugcauuaagucccaugaaacaauagcuauuugcagcuccuaauaaaugcaguauguccuguuggauagugcugauuugcuuugaauuaaaaaguugauuuaaugguaaguuuaaaagauagcuguuuauuauaaauuaagaguagaauggcucauuauuacugguauuuacauuugauuuuaauuggguaaccauuuuauauaauuaguaucuugguuuuuaacuuauuagugacuuuaacucuuggguugacauuugccugaaauacaucauuugauaaggcuagauuugccuaaauguuuuuguuuuuggagauuaggucucuuguagcccaggcuagccuugaacucacuauguaaguauagaugaccuuggacuccuaauuccuccaucuccauaucccuaaaggugguaacaucacgaccauuaaaguagacaaauucaggucaaccuuugugggaacuuuugaaagaaaauugucaauaguuuauguaagaugcauuucucaguccacacagcacauuuuaugaugcagaaaugagauaguuguuuauagcuuguuuucuuuaaguauuguaaugcaggguucagggagugccucacaccuuuuuuuucugagcacuuggggaggcagaaguggacugaucuuugugaguggaggcuagcuugaucuguauggacacacugucucaaacaacagcaacaaaacccagcagacaauaauaagaacuguuguacuagaauggagcgucauucucagaagaauagagcugacauuuugguuugaccucacgauuuacaugcaaugcugauucaaguuucaaauaaaaucuucuaagccaauuaacuuuucucuuguaaguauauuucagagauuguggauauaaagagcaagagcccuuucuuacugcauuaggaaagagacuauaauaguaucuaacaucaaguaggaaaacugccaaaacucccaccuaacuaaaaggauauggggugcaguuauggcucagugaguaaagcucuggcugcacuucuauaagacuauauucuauucccagcacccacgcggaggcucacaaccaucuguaacagcaauuuacaggcauuuccuuucagggcugaauucuugcagugcggggcuguaugacaagauuuuuucccuggggagaugcagcagugcuagggaucugaugcccuuuaucaaccucuccacaggcaccaagcaugcaaauugugcauauauaugcucaggcaaaauacccauccacuaaauaaauaaacaaguaaaugaguaaauaaucuuuuuuuguguguuuguuuguuuuaaaggaagaugccucaguggcccagguuuaguagcacuuuccgugauagaaaacuaaaacauugaaaauguuuaaaaauguugauuuuaguauuuuggaucuuaguaaucuuuuuggguauuuuauuuugaaaaaaauacuuagcauuugagguaauuuuguaaaaagaaucucagaacgaagccggagguugggcuggguauaguucagggauagaaagcaggcguggcaagugcaaagcuuaguccuuaguacaaauaaaccuaggaagcaguauugccugcucuaaugcucuaauucuaucugacucgacagagcuacauuugagaaugacaaaauauuuacauauuuuuuuucauucccuccagacggaaguaguuguauucugguaaauuuuaagacauacugcuuacuguuacugcuuacuguuccagugaaaauauugauguaaagucaucacugucguuuuuauuuuaucuuucacauacuuuuuuuuuaauuguugaauuuuugcagugcaggggugugugacaagauucuuucuagggaagaugcaacaagcaugcacgcacgaaugcacaccucacaugaaugcacaccuuacuccagauagagagucagaguaaaguagggauagcaucagagucaacuuugugauccagugaguuuuauugggguuauaggaauaugggcgaagggguuccuuauaggagcagaaaugacucaaagacagcuuuaucaacaaaucccaccccagcacaggugacagcucacaacguuugggaaccuggugcacacuguacagccugcagacugcucaaccgguuggggaguguccuuuccaagugacucuaaaccccuucuaggcaggugggccgaucucugcuucuuccagguagucacugcaguuuggcuugucugagaaugagccucuccagucuuuaguguuuacucuugggagggagggacuuagugaaucuggucaguuucagggacuuccuggagcuaucuugagauguuuacuuucugucuuaagaugcaggauggaauguuuccaaaggagaaaacugcuauacagcaaaggaaucuaaccugggccuuuauguaugcggguguacuuguuaaucgucuuugacaaccuggugaaaccuauaauuacaugggagauggguggccuuugcacaugccagugggagauuaucuuguugcauuaaucgaaguggcaucauuucuuucuaggauccuggauuguauaaaacagagaaagccagcugaacauuagcgugcauucauucauugcuguuuucuuauuauggauguaaugcugccuugacuuuccugugccuugacuguaaacuaaaguuaaggcuuuccuucuuugguugcuuuugucagggucuuuaccacagaaacaggggaagaaacugaaacagucagcaaguaaguacucuggcccugaacuacuccccagcugcccccugccucccuuuccccugguauguugcccagcggggccuuaaacuuauagauagaaguaacccucccuucucagccuucuguaaacugggacuacagggaugucauacuguugauauguuucuuuaagaggaguuuuucuggauuuucuuauuacuguggaaaucuuuaaaaauuugcucaagacagcgguuacuuaauccguaggguuuguaaguuuguuggcugcuuucucgggauggaguuaaguaugugauggagugaagugauuuuaguagcuuaugauagggucacagaguuuauaaagugcuaacauaauaucuaaaaauaguuuuaacaauccuacaaauaaauuuucauagcuaauuuuucuuuuacugaaaauggauuguuuuuucucacauaauauauccugauuaugauuucccuuccuuccccucccauguagauccacuccuuuucuguuucucauuagaaagcaagcaaguuucugagggauaauaauaaaacuaacaaaagaaaacauuaaaggagaaaacaauaacugucauuagaguuggaaaagacaaacagaaggcaaagcccaagagaaggcacaagaacccgagacccacucauuugcacucaggaauucauaaaacaccagcguggaagccccauguagugcauacacagagggcugugcaguccgggcaugcugccugagucugugugaguucaugugaacuugaucauguugauuuagaaggccuuguugucuugauggccaccaucuccucugguuuuaacacacucuuucuaccuccucuuccuugggguucucugagcccugaggggaggguucugauaaugacaucuuauuuaaggcugaguguuccaaggucauucaugcucuauagacugucuggcugugggucucccacuguuauucacaucugcugcuggagaagccucucugaugauggcugagcaaggcacugaaauagcuauucauagcuauuuucauuugaaccacuguguagucaagaauuugauacaugguaugugguuaccuguuuugggccccuuauaaccuagguaaugcccacaccuauuuguuuugugucuccuuuuacuuaaugggccaagucaguuuucuuagagaauauccuauauauagguaggacuuuuaauaauucuuccugcuggagccuguugaaggguaguaguuacuagugguaguguuuggugcugugaauggguugugauucccauuauuaauuugugggucucaccacuuguucaugaaugcuaauguuuguuuacccucauauucauuacacaaauaauauuacaugaaugccguuaugucaaagagguuuaugaaaccacuggacaccaucauauaaggccaccacuacaccuuuucuuuuauauucuuuuugucaccauuuuuauuuuugugguuuuaacagucauuuaauaauauugguugcaugggggaaaacaaagaaacaucucuuucucccaggcagagagcauggacaaacacaggauuccuucaagaccaguuuggugacccagugaguuagaucagguuguuacaggaaugugggugacucacucgggcagcuacaccucugaggagugccaccccagucagcugagaguaguaauuggaagcuccagggaaaaugggaccuggucauguacaacccagagaaacagccacacuacacugauacaucuuucucuaagucaguuuguuacuuuguguuccugugguacuggucauccagucuguuuaucuguggcuuuuuguuacuuugcaaggugcuuucauuucacugaggcaucaucgcuuuggcaguuccguuaucuucagccaguuccuagauguccgcuauagaaacauacacgugcuugugugcacguauaugaaugcauauuuauguaguauuuugaacauuaacuuguuccaugugcuuaaauauauuuaacgacaguagauaauucugucucugcagugugauggcuuguuuuguaauuugagacagaaucucacuaaguagaccaagcuggcuucaaggucacagaucugccugucucugccucaccaguguugggauuaaacacaugagccacuacacccagcugcaguguauguggaguacauuucuacuccauuuccuuuaacuuuuggcuaauuuuaaacucuccucgaguuucuguaguagucuauuuauauuugcuuauuauuacuuuuuaaucuucucauguguccuguauacugucagguuuuugagaauagcuaucugauuauauauuuauauuguuaggaaaccucugauggcuuccaucauaugguuaaaaaugacagcuuuuuagcauacuaugcaaaaauaaugcucacuuaacuuuuuucauuucauucuugugcucuuuguuuguuuugagacaagguuucucuuuuauguagcucuggcugaccuguguucacucuguagaccaggcuggccucaaagucccagagaacuacugucucccuagugccgggauuacaaguguuuaccaccauacccagcuucuagccauguucuuguucugucugacugucugugugucugucugucucaguuucugucucucuggcccacuucugugugugguguaugcaugagaauauguggguuugugugcuaaagagugugcauacagaguccaggggaaaacgcccagugucugcugcugcucucugucuuacuaccuugagaaagagucucugaacuagaagcucaaaauuuuggcuaggcuagaugggcagugagcuuccagugucugucugucugucucuacacccaggguuggcauucaggcaugaacagcuaagccuuacaacuuugauggcgcugggguuugaacuuagguccuuaacgcucgcacagcagugcucuccacacugagccauugcucuaaucucuguuucuugaauguaguauggauuuuaauuuuuagguuucuuccaaguauuucuggccggacccucucacugcuuaauguucuuugugcucagcuccaaagaaccauucaaauguuacuuugcuauuuaccugaugguuguccauuucuagccuuuucuguuagacuaagcccuucucauguuuaucuuaugucuccucucuccuugcccauguuucuuuuuccucuccuuuccccaugugagagcacauauuaaaccacaucccuuucuagugugccucuguauaaagacucaacaggagucugcuuucauguccccagaacccagcacagagcuuugcauacagcacagugccgagcaaaauauuucugaagggaauggggagggcuuaguggucaagagcacuugugcucugcaagcaugaggacccgagcuuggaucugucuccacauuuaguguuggcauuauaggcccaaacagucaugccagacaauuuuucuguggauccugagggucugaacuugggcccuuaggcuccgguucccagauaaaaaagcuggguaugauugaguauaccugcaauccuagcuuuggguggcagagauagguagauauggagaguugugggagcuugcuggccagucagccgagcugaaacugaguuuccagucagugagagagaacccaugucaagguaguaagcagauaagggaagacauuagaccuccucuccuggccucuguaugcaugugcauaggauauuugcacacucauguuacauguuguauauacacaagcacauuuucaaaauaaaggacaucucugcuguccccugugucacuugugguaagccugacuugaaauuuaugaauuuuuaaaggaggacaaggucuuucauacaagguuugguuuuauacuaaauucuugcugcugguuauguucuguagacuaaauauuuauuuuuuuaaagcucaacauuuuugauagccagaauuguagguauuacugcagauauauuuguuuuaaagucauauugacuauuaagaauuugacauuuuaagaaauuaaauacugauauuuaccagugcagcauugaauuuaagauuuuaggaguacagugagagcugaacuaguuuggacaaaaaaguaagagguugaggguccuauccacauauagccuaauuagugagauuuaguguuacugaaccacaguugaaauacauugaugugagaaucauuuucauuuaaaauucaauucagacuuuaaucagcauauaauuguuggucaggccuugcagugcugccuacaaguccaaguauuuacaaagcaaguucuaggccugucagaacuacacuguguguucuaaggcuagccagagcugcuuaacaguacuguuuagagaggacugggacuguagcucagugguagagcauuuugcucuguauaaaucauacagaagucccugguucagucccuaauacugggaagaagagaggggaaaugguuguauaaagcuaaggucuggccacugaggggaaggaaguguugcuguuaacugagugcuguaagccucuucugauucuguguugguuuguuuuaaaccaaccuaauuugaauuuguaaaauaccuauauuugaauaacaaaugaaggggcuacugaagauugaagauguuuacaggaaaauaaauacuagugcauuaguuuauaaggaaagagacccaguaaaguauaucuuuauaaaggauauaaugaauugauuguuagauuuaaugaugcaggggaaugcugacuuagaaauuuacuauauuuagagaugaauuagauuuacaauacuugguggguggggagcauuauugauguuauucauugaugagaggaaucuaaacuaauacaaagaccuuguuacucagaauuauuuuauuuuuuaaauguaauacuguuuauuuaacuucaaaaacauucagcauucuaaauauacaaaaaauaacagaauguugcagaggguucuugaacuuccauugaugcaguaguucuuugcuuugcugacaacaguaaguccuacaguuucuuuaaaguuucaaaccuauagcacuuaacuaaagaaaaaacuucaaacacuucucaugccagcagaccccuccucuauucacaacuaagaaugucagcagaaugcuaugccacuauauacaaaaacaggacaaccugaagcuaaauggaugcccaccgcaguaucaacagguccagccucacagugcacgcccugagcuacggccccuccaaaaggcaucuuccccucacagccuccacgccaaacauggagcaucaagaaucugucuggguuguuuuguucucuuuacaaacuauagauauguacauuugacaacucaggauuucuagccaguaaccauauauauauauauauauauauauauuuaacacuaccuuacgaguugagaacaaaaugccagaaacaucuucaaaugccuugucacaccaacagcaaagugcacugagugaggaggacacaagagugccuuuucauuuuaaaaauguuuggagcuauguacaacuuugauacaguuuuagggcgcuccagacacccgaggccacuucauguaaaccacugacacucugagaagcuacaauaugaucgugaucaaauuuuguaauuaaaccuaacagcacucuccuacucuaagguauucauucacaaggagacaguuuuuauucaucuuccuccuccucuucuuccucuucuuccaccuuuuuccgggcaacuuuagcaggccccuuggcccccucaaacuucccuuuauacuuccagucagcgacacccuucucaugcuucuccuucagcuuugcugccuuggugacguaggcugcuuuucacucucacugaaguucuuccacaucucacccagauuuuuugccacaucuccauuggagaugccaggguuuguggauuugaucuuggggcagaauucggaacagaauaagaaaaguccagauggaggucuguugggggcauuuggcccuucuucuucuugccuccuuuagcugauccauaaucuuauaucuccugaucauagcguauuuuaucugcuuuugccauuucaucaaacuuugauuucuuuuugcuagacauggucuuccaccucucagagcacuucuuggaaaacucugcaaaauugacuggaaccucaggguuuucuucuuguguucgacccugcaugucugcacgaagaaggcauaagcagacaucuugcccuuuaguuucuuggggucaccuuuagccauccuaacuguauuguucgauagucugggcagcgcagggcaugaugcacggcucccagaauuauuuuaaagggccauuaucaugcagacaagaaaagaaguuucaguuguacuuuuuacgaaugaguauguuuaaaaauacuaaaagcagggguguagaaauaagguuaucuauguggauacacauaguaucauuguuaauuuuuaauuuuugagauuauaauguaauuaagucauuucucccuuuuucucucucaagccuuccauagauucccccugucaaauucauggccucuuuuuuucauuaauugguguuagauguaugugcauauauguucuuaaauacguaaauauaagcugcucagucuguaugcuucauucauauauauauauuauauauacacacauauauauacacauauauguauguauauauaugcauauauguguauguauguauguauguauguauguauauauguuuucagggcugaacauuugguauuggauaaccaauugcuguccuuucucuggugaugccuauuucucccacucucaauacuccuuaauugcuuguagcucuguguagcuucuugggcucccccaccccaucggggaaacauccacuuuacaugucuauuguccucauucaucccguauuuaagcaggcauguuggugggacuuuagcuucugacuuacugggaggcacaaucucauagcaagcucuuuggcucuuagucuuuaggcccccucuucugcaaaguucccugacccuucucuuugggaguuguuuuguagaugucauggcugagacuagcuugcacaacucugaauuuugguugguugugguuucuuguaauggucucuguuugcaaagaaaacuuuccaugaugaagggugaggacuacauuuaccuguggguauaagaaaaguguuuagaauuuguuagggauuguggugguuuucaguaccaggcuugguuuccuucuuguccaguggcucuuaggucacuuagagagcuguugguuauggcaaggaaggugugucacuacugcacccuuagguaaucaugcuguguuggucauuguugugguucauagccgucauagugggguagggcuguugguugcucccuuccuuuggaagcuugcauggugucuucuggugucgugaaagguagcccucagggaggagaaauuuaggucaguucuagcucacaggccuccggacccugugucugaagugucaagguaucuucagcaacaggggcuuaacuucuuaccucugguggcaaccauggacaacagcaaagagcuuguauguuuugggaguuucuuggacauccccgacaacaccaaagaaaguuucucauguccaguguuggauuuguuuagguguuuuuuggcucuuggaaggagccaaauugucagcccagaugaggaaaugucauuuacacuguguguauauaugcacagacuuagcuguauuguagugguuuacaaaguaaauaguuaauaguguuucuuacaaccuuucagcuacucuucuguucucuuacccuucuuucuaccuuuguauuuaucucccuccuagaucccuaauuaaagacccccacccccccuuccaguuuccauggucagaccacuuggacccugcucuguuaucugcugcaccaggaguagucucuuuuuacuuucugguuucuguaguuugaagugugaauuucugguuucuuuacuaacucaguugugucacaugauguuuuuccugaagcugucuugucagagggcaugugauguuuuguugaaaacagacacuugcgagggcauguaauguuuuagaaagaauauaaauggaaccccauaaacgaugagaggauguucuugcguuggcacacugugcagugcuuugcuggucuuggccgaucuucauuuuguagagagaagugcaccaaagaacuucuugugguauucuggcugauucuggaugcuuccacugacuugugccaaauuggaguauguggcaugggaggggccugugguuuguagagguagggauggacagacuagccuaggcacuggacaugggaccuagguuauaucuggcaggaugggaagugucgggcucaguuauggggcuagaccagggagaaggaugucaguaucaguuuuuaacuuuauuuuugaaaaauguaauacuuaaaaaaauuuuacucugauauggugcugucucaaugccuauaacacaagcucucaggacauagaggcccaugaauucaaauuuaaggcccaccuaaccuaccuaccuaacaagacccugccuuacaauguauagcgauuagggauauagaucaauaggggcguguuuuccuggcaagguuuuagguuaggucagcauuagggaaaaaagucaugauaucacaaaauaagaacagugguuccaaauacaucauuacuaccgugcuggguaaauauuuauugaguaauucagaagaguaacuuuggcuuccuguuauuccaaauacuuacucuguguugcuuuuuccuugugugugcuauuaaagcuuuccagccugcagagucggauggucacuuacuaaaggaaagguguauucuagcaucuucuuggaggaauaauaauauuggcaagauucagguaucauagaguuugaagaaugaaugucuuaguggucauauuuacuuuuaaaagcuaacaauguaccacagucuugggacuuauacuuugagagcuauaucauuugaauucucucagguaggauucaggagauaaaucucuauauagacuuguuuguuuuuuaccggcuauggugagugugccuucagaggcagugucgguuuuuugccgcuuuguuccccuggcuuuguuuucuuuuggcccuaguuucuucuuagaccugaaggacugaccuucuucccugugcgcuuccuccaguacaacagcaggacacgcacaggcucacacuuaccaagcuucaguucuaauccgaugccccuuugucuuuaguccuguccugcuccucucucgacacucacgccucagucagagcuggugccggcacuuggaaaggcuguacaauagguaggguaagaccaaccugggcuucauguuggguuugaggguaaccugugcugcauagucacauucuccucaggcucaccccugagggacugacagaccucugaaaugacuuagaggugucugcucuugcagucuuaccuccaugcuaugaagaacauugcacuugguagguaguagaaggaaguggugucaaggcugcuuccacuuguugccuguggaucuucuuaagcaaacggucuauugcgccucacaguuucccugcaguaguuuuacaugccuucauucuuuuucuagaacauaaauguccuaguuuguuuucuguugcuguaaggaaagccacaggcaaaagcaacuuggggaagaaaguguuucuuucuuuccuuuuauagauaauuguccaucaucagaggaagacaaggcagggacucaaggcaggaacugaagaccauggaggaaugaggcuuacugauuugcccuccaugcuugcucaguuugcuuucuaguacaaccccaagaccacccacagugggcugggcccuccccuaucaaucacuaauuaaaccguccccccagacuugccuacaggauaaucugauggaggcauuuuuuucagcugaaguucccucuccccauaugacuucaguuuguguuaaguugacaaaaaagugaaauguaauuuucauugcacuuagaaugaaauuuuaucucuagguuucaaguuaggcuuugccauugucuccuugguggaugguauugccucucagacaagguagagguuucacccauccucagccaucuucuccuucacagacucaaccaaacuguuacuaaaaugucaguuuugauucagaaauauguuuauuuuaauccuuuuauuuuuuagagacaggguuuugccuauagcccuagcuggugcagagcucucaaugaagaacuggcuggccuugaacucacagagaucuagcugccuacugcaugccugccuggauucccugacauccucagcccuccucugcugggagauccucccuuagagggauagcucaugggguugccuuccuuccuccucauguucucugcacucugccuggccuuccuugggcauaacuuccuugggcauaucauguucucugccuggccuuccuugggcauaucuagagggcaaggcacauaggaguuacuuguuuauguuucccacuuaaucacccagaauuucuuuuauagguggcuugugauagccaauauaauuuaauuuguucaucuucagaguuuggcauaguuuugaaagucaaaauaugaacacaguaguuuguuggaauaaaauaauaaggcuuuucuauuuucaucagaaaaaaauggauuuuaauuuuuuuauuaaaagacucaaaaauuuuaaaggauguguuuguaugaauguguauguguguguguguauguauguaaaugcacguguguuugaguguguauguuuguaugugcauauagaggccagaagucccauggugucauucucugcccauuucugugaaguagggucucuuccugcacccacauagguacaugcgccugugcucauacauaccgacaacauucacacguuaagaagggguuacuuuuacuauugugggcauauguguauguagaccagaagacagccuuagguguucuuuaggcaucacccaccuuuuuguucuuuugagacagugucaguuuaguggacugggaguagucaaauagccaaguaggcuagcgagcccuaagaagcugccugucccagccuccccacggugggagugacagagugugcugccgugccaggcuguuuuucccuuccccuuacaggguaggcacuuuauuaugggagcuguccuucuagucccacaagagggugcccuuaugcucugggguaguacugcuaccaccuaggauugcgacccucagcauagaagagagcagcaagcuucccuggcucgugugccugaauugaacuauuucuggaugcaucacuuagcagucuuacaccauuuccuuuacauuuguuugugugguggguguaugugcauguguguguuagacagcuugugcauuucuccuucuauuauguggguccuggggauuuugaacuuagauugucaggcccuagguguucuacuguguagcacaggcuggacucaaaacucaagagaucuaccugccucugccuccuaagugcagagauuaaaaguguggaucaggucuggugccuauggucuuuaugcuaagguuuuggauuugucaaaagaguccaaugccuccugaaaccuccccauuucuuaugcugaaucucaggugugcccuuucaccauuuaccaugugacaaacauaaaaaaauaauuuuagugauauauguacuucauuccuucucaauuuaaaaacuucagaucuuaaaauugaagguuuuucaagguuuuauuacuuuagcauuugaaaguuaaauuuaagcuuucuaagugaaauaauuacuagguuugcuucuuguuucucuccauauaauucaggguaagaggccuaugcuucagucuguucucgagcuuucaaauuccuuugacagccuggauaugaaauuuaaaagcuauuaaugugauguguuaauuuugcacuuuuugacuuacugcaaaaaaaaucuuauaguuuccauagcaacaauaaccuauccagauuguguaauauucuuuacaguauuaaaaauaaaacugcaaauccaugauuuuuggagcaccucauguaggagaacuaggacuugaaagauuucagugaaaaauaagcuguaauucagugugaauaaugugucaaaaagcuuuuuauaauuuuaagaauuaauaucuuuaaauauucaguaauagauagcugguaguuaauuugauuauuaggcaugaggcaugugcauugcauuuccagugucacaagcacacugguuccacgaauucggcagucccuacacacaagguaagaggggcacuggccugcacugcuagcugucagcugcuugugcuuuuaguggucacugaauggucaggaaacaguggaagaaaggggaaagggucgucuaagcuuuuccuauuguuugucuuuguuccucaaaauaugccuuggagccugauacaauagcacacuccuuuuaucccagcacccuguaggcagaggcaggcagaggcagagcucaaggccagccugguccaucuacauacugaguuccagaccagucagugagacccugucuuaaggccuccuccaguaugccuaaauuaaagauuauuugaagucagcagguguuucaggaguaucacauuuuguuaguaccauuaaauaacacaacuuccugcaucuuaacauguguuuuuaauuuuuuggauuacuuucaauauauaguuacauguauauauuuauuuguaauagaauagccucuauuuuuuuuuuaagauuuauuuauucauuauauguaaguacacuguagcugucuucagacacuccagaagagggagucagaucuaguuauggaugguugugagccaccaugugguugcugggauuugaacuccggaccuuuggaagagcagucgggugcucuuacccacugagccaucucaccagcccuguauauuuuuugauaacacauaauguccuaguugcuuucuauggcugagagaaaacacugaccaaaaaaaggaaaggacaggcuuuacuucaucuuacagguccaucacugacaggaaccuggagacaggaacgaaagcaggaaccacagaccagugcuugcucuccaugucuugcucagcuugcuuucuuacacagcccugaagcaucuguccaagaccggggaggugguacugcauaagugggcuggacccuccuacugaucaagaaaauaucacagacuugcccacaggcugguuccucagugugguuuccuuuucucaagccaugcuagagcagugguucucaaccugggucucuacccuggggugaggguggggacuugaacaguccuuuugaaggggucacauaucagauagccugcauuuuagauauuuacauuaugauuuacaacaguagcaaaauuauaguuauaaaguagcaacagaaauaauucuaugguuggggucaucauaacaugaggaaaggguugcagcauuaggaagguugagaaucacugcucuagagugugucagggugagaacuaaguagauagacagcaaauuucccauguuucuagugaccuuuauaacuauaauuuuuuuuucgagacaggguuucucuguguagcccuggcuguccuggaacucacucuauagaccaggcuggccuugaacucagaaauccgccugccucugccuuagggauuaaaggcgugcgccaccacccccggcaauuaagcaucucuuaauuacuuuuuaaaaaaaauauagugcuccuaaagauugguuccagggccuaaugaauuccagagccuuuacagaacauuuggguaaacagaaaauauagcagauaucaaaagaguagucuguggugaacuuauuaaauuauaguuauaggccgggcagugguggugcccaccuuuaaucccagcacuugggaggcagagacacgcggauuucugaguucgaggccagccuggucuacaaagugaguuccaggacagccagggcuauacagagaaacccugucuugaaaaaaccaaaaaaaaaaaaaaaagcuuaauuaccuugauuggcacauaauggcaaaaaauagaacuuuuagacugauggugggaguuaagcaucuggaacucacuuauuuccccuaaauaggugguuaagaugaugauagguggcccuggugcugggagguggugguacaugccuuuaaccucagcucucagggguagguguccuguuguugcucugcguccuguugucacugcaggaugggcucccucagaugcuccagcaguucacaggugggguagauguugggugugcuaagucagagcccuggaccuuggucagcugagagcgccccuucacccccaccaguagggcuggcucucuagcacugccccagcuagcucauccagugcugcagccagcaagggacaggagagccagcucuucuguucccaugcccuugggucuggcucaccugcaggugaggugucuuguggcaaacauucucaaguucauauuucuuuaauaaauaaaacuacauguuccuuaaucuuuuucuggugcucaacccugcuuuguacuccauaauuuuagaauaguaagucaaauguuccuucccaguuauuuccacaucagaagucuuucaucuauacagucccaucucaacaaaaccaaaaauacucagccaggcaaugcacagcagaguuuuaaaaaggaacaacucuacucuuuggcuaauaauauugucuguagugugugucccccaagcuaauaguccuuagucugauucucgacaccuuuuaccaaucagccagcaaaacuaagcuguaacagaugaggaaacuggacuuaccauuaauauacuaccuggccagacaucaaagucuacagacuuccugcaagguguuuuuggggaguuuguuuuuuuuguuuuuuuuuucagcacacuuuuucuugauaaaagagagugaauaaggcagaaacaugggacuauggguauauaauacaagagauccacuuaaaauaagagaacagcaugguguugcacacuuacucucagcaccuggggaaagaggcagaaggagagcuuugugaauuccaggcaagccuagucuacacagcaaguuccaaguuagcuagggauacagaggaagaccugggagauagguggagggggagagggaaaaggagggaaagaaagaacggagaggggaccacagauugagaaccagugucuaauacaaccaaaagauaaaaacuggaggguauagauuaugccccuguuauuggaacaauccacagccugcuuuguguuugccagcuauucaaaucacagucagcuggggccuucuuguggcugguucuggucuguacucugaggauauuuuaucuguuaagauagccacuagucuacuccuccucccauuacugaaacauuguauuauauugguuaaaauccuugguaacuaucaggcuucccuauauucccaauccugucuuugcuuguuuucaacacugucucuuaacuaguagauuucuccaccaguguuuugagaaagcaauguuggugcugagauuugaagucuuaaaggcuuuugcuugaugccuugcaacugggagcuaauuagucauaucaacugguaguuuauaucagucagugacuucuguaguggugguuuuaacagaguacuuguguagauuucaggaaugggcgugcucuaaguauguugaauuuauauuuaugcuguuuacuuuuagagcuggggcugccuucagaguccuguucucuucacugugugcuugcuuuagcucugucuuguguuuauuauaacaggaauuucucuugguauuuuauauuucuauacuagaaauauugucaaaaauaaucagcaaugcauggcauaauggcaguguuuacauauuuaugagagauuaaauguguuuccauuguuuuuguaguuguaauuuuuaaaucuaaaaguaauauggaaaaauaaaagcuguuuuuauuuuuuucuguuuacaugcagaaaagaugaaaaggaauaugcacuuaagcaaaucgaaggcacaggaauaucuaugucggcuuguagagagauugcaguaaguauaguuuauuuuauuaucaauauuggauauuuaguauaaaauaugcauuaauauaugcgauggaugauaauuucacagacucaauuuaaagaauaguuuauauaaaauaggaaaaucuggaaaccuaaaauuaucagucauuuuugagccuuuuauuuuuuaaacuuuuuauuaaauuuauuuauucauuuuauaucccaauaucagucuccaauauuagccccccucacucucuuagaacccuuucucauggauccucccccauuccucccuucccuucaccuuugauucuuguuuuguuuuuuggcuuuauuuauuuauuuauuuucuuuugggggagagguuguaagguggagggcagagaaaaaagggacaggaggaugagugggauugggugcaugaugugaauuucacaaagaaccaauaaaaaguaaaacaaacaaaaaacccaaacacuauagaaaaaggauggauaaaaaaaauucugcuauaucaacaauuagaaauucuuuucuuugcaaaaauucucccucccacacacauaaaaauagaucccauaaccuuuuugugcaguaugcuucaauccaaaguaauaaaguaaauuucaacugugaaguuaguugaacuguuuauuaauaauacuauguuauauggguuauauaauaaauugugaaauuuaacuccucaacacucuuaaaaaaguugagauguuugcauggcaaagagcggcuaagagggcaguuagucagggcagcaggcuucaguuggaguacagguuagagagcugccuuagucuuucugcacugucagcagagucuguaucuggcacgggcugagugcccugguuuauggaugguaggccauccuuuucuuguguccucuaugauugaaagggugcaaggaaucucucuggggucuuuuuuuuuuuaagauuuauuucuuuauuauauaugaguacacuguagcucucuucagacacuccagaagagggagucagaucucauuauggaugguugugagccaccauuugguugcugggaauugaacucaggaccuucagaagaacagucagugcucuuaacaccugagccaucucgccagccccucuggggucuuuuagaagggaaccagucacuuuuacaaaggcuuuguccucaugacuuaaaaauuaucucccgcugggcguuuucucuguaggucccgugcugggcagccuguugguugcuauaaaguucaguggaauccuuacagcuuuugguauagaugaauaaacuuuuccuuuuuuuaaaguuaugaaauagaauugauagaaugcauauuagcugguaauuuaacucugagaaaagcuuugaaauauccaugacuacagcuguguuaaguuuuuaaaauuuguuucuacaaaucuuaaaauuauugcauuaaguuuauauauuaaaaguggaaaaguucaugacauuagacaauaauuuuaagagucuuuauaaauaaagcuuacauuuacuauaaaaaaaaguaaagaaguaucuagccuuguaaggauuuuuuuauuguaucauuuuauguuucuuuuucuuuuuucuuuucuuuucuuuucuuuucuuuucuuuucuuuucuuuuuuuuugguuuuucgagacaggguuucucuguguagcaguggcuguccugaacucacucuguaaaccagguugaccuugaacucagagaucccccucucugccuuccaagugcugguagcaugggugugccccacaaccaccugagaucuguaugaguuugaggcuaguuugcucuacauugagaguuccaggccagcuacaguuacaugcauaguaagaucuuaucucaaacaaguaacaaaauguauuuuuagaagacccuaaaguauaaaaugucuuauggucugauguauguuugugcuugagcauguggaagccaguggggccagcaaauaccucgccuuuuaaaaagaguaauaguuuaauaauuuuucugggauuuauagugucuuuugagcauguggucucagcuccuccuguaucuauccccuccccauuuucacauuccuccaucuuauuuuugaggcauacuuucuuauuuaaucuggagcuugccagucuauaaagugccuaaaccguaaacuuucauguaaaauuaguaauccuagauucacacuaagauggacauuucuguauguauuuguguucacuuggagaguauguccaugcagacacacacaugcacacaugugauccuagagaacuucucuaugcagcuggcucuucucucucacuuuguugagagagucugucuuaguucuccuugcuggacuguacgcugcagacuuagcuggcccaugggcuucggaugacucggcuguuuccaccaaucaucucagcacagaagugagacacagggaucaaucacacaugcuuguuuguuuguuuguguguacacgcuuacaggcacagcaugcguggggagguuaaaggucagacaaauuuaggcgugaauuuuuuuucccacuaugugggucucaggaauugaacuuagauuguccggcuuggcucuucuugacuuuugaaauaugacaugaaaauggugggagcaaacaaagcaaacacauagucuuuuguuuucauuuuaagguaggaaaggacuuggauuuuggauucaaauagguuucgguuguauagacucuuaugcuuccugcaugucuugaacaagcugauaguaguguugggccuuauuuuaccaauuguuagguagcuauagagaugagggcuuuuuguuuguauuuuuuuuaaaaaaagauuuauuuauuuauuuuauguauaugaguacacuguagcuguccucaaacacaccagaagggggcaucagaucccauuacagauguuugugagccaccaugugggugcugggaauugaacucaggaccucuggaagaaaguccauguucuuuacugcugagccaucucuccagcccuuguuuuguuuguuuguuuguuuguuuuuagacaggaucuuucuguauauauuuggcuggccuggaauucaaauagaccaaggcuggccuugaacuccuagaaacccaugugccucugcuucuguagugcugggguuaaagcugugcacuacuaugcucggccuugucuucuuuuguuucuuguuuuguugagcuuuaguuuuauauaauaacgggguaauuuuuaggucacaauucaagguauagcccaucgugauaggaaacggaagaggcuugggcuuacagcugcaugcucucguuucucugaaguugaauugcuaaguuuuuuuuuuuuaaagauuuauuuauuauauguaaguacaauguagcugccuucagacacuccguaagagggagucagaucuuauuacagaagguuaugagucaccauaugguugcugggauuugaacucaggaccuucagaauagcagucaguaaccacugagccaucucuccagccccgaauugcuaagucuuaugaaagauaaauucuguguuuaacagaagucugguaaauacuucuuauuuuauuuaugcuguuuguuuugaaauagguagguucuagcuauguagcuugcauggaauuugccccucaguuggacucgauguagucugcuugcuucugccucucaagugcugggauuccacguguacgccacuaugccugggauauaagugcuccuuucagaaguucagaacuacucuuugugacagauugcacaucaacauuuuuaugcauauacaagucugaguuuugaaaugugaaauaccauuuuccucagaaaacguugaaauaaaagauacuugggucaccagccuaucccaccaaaaccuauuagucacacagguaacuguuaggcugucuagagcugcaguggccacagacagccuguuacuggucucuuugguuuucagucuaucaccagcuuagcuauaaggccuugcuuguugauuucggcuugaugagcccaguucuucccucacacaugaucagcgugugcugccgcucagcuucagcuccaggaggaaguggguuggggguuaaagccuuggacuuguguuuuuggaacaaggucucacuguauagcugagagaggcucaaauuuuccauccuucugcuuuagucuccaaaauguuggcacugaauuaaagucuuacaacuuuaggccacaucucguguuuucauguuuacugauaguggcaggcaggcucuucaggucuuuugggugcuugggguuuauaaaaacuagaauagagacugggaacaauuagacaaagugccagggguauguggcaaccaagaagaaaucgaagccguccuaccuaagcagugugacuauggagcuaguuccuugacuauaagaagaggagaggauuagaaaacucaggguagaguaggggacauggcuccagucaguggcuguguuaaguguuuagaccaguggacaagguggucuaaacaaagaaagcccacaguuagaguguugacacaaaaauacacaugcuagcagaaaacuuagcaugauuacgagaaaggaauuuucuccagcagcagugcguugucauaaagacacagucucacucacuguuucuguuuguguucuggugauaaaaggugcucgcauaaauugcaguuagagcaauucacagucaggaugagacagaguuuuagcagauaccaacaggauuuagauugcacuuggaaagcaugcagcauaaauuucaguuuuauaagucucuuggcauacugaucaggucuggucaucuagaaguuugacucuguuguuuuucuuagaagaauguuuuaauugauuagaaauucuacaccuuguagauuauagugauacauaauuuuuugaggggguggaugaucuacuuucugguaaguuugccaagccauuuuauaugucuuauauauuaaaaaacaaaccagagacauaagccuauauuuccuugugguuucagucuugagauguuuccaacauggguucauuugaguguuuucuuguugagcuuuaaaaaguuauccccauucccaccccauacuguaucuguuuuguuuguguuggacguugaacuuggguucccugcaaugcaagauaggcauguggccaaucacugaacuauacacccagucccaggauucuucaaaguugagguuuuuacauguaaugaucuuaucauguuaucaaauuaaauauauuuuaauacuuuuauggcauucuuguuugucuuugucaauuuuuguguuuuaugucuuuguuaugccgagcacugccuauuuuauuauauuccugggagucuuaaagugucuuuuguucucaguacauugagaagggggcacagagagggcuggucagauucauuuggaauguuagacccuuuuccagcauuauuuacuuugaugacuucuuugaauuuuguugucuaaaauaauaagcacaauuaacuugagaugacuuuaaaagaguugcucuaucaguuucuuuugacauaugcacauccuaaugugcuguagucucagugugaacaaaaaguagcaugcuaaaaauagguuuucagcguuuggacagguuaaguuuguaauggcuaagauaaacauuuaaaaauauauagugaaaauuuccuuccuuuuccacaccaccagaugaacucuaaguugguaucuuaagucucuacuaccauuuuaaaauugcuauauucccaaugacuguuuugcauagaacauaacugugcaaaugauuuaagaaaaggauaguacagauuuuucaaaguaaaguccucugaugugaaagguccauugguuuuauuacacuugaacuugcaguaagaggugcuuuccugggauggaacuaacaugucgguacacaugaaagugccucucuuuaucccaaaucugugauuccaguaaggaaggccagggcuaccaaacauucccagugcaguccuggucugacugaggggcggacauggugcuggcaaaccgcugauacuuggguuucccuugcugaguuuuuauuauuucucccauagcaaccacagugcauguucucaagggugagcaggaccacauccugcuacauucaugcaucagggccuugcccagccaucgucagagacacuucuuccuucaguaaaugggaaacagagaccauaagugaacagugugcagagugggagaccuuggaacacucuacuaaaugggaugucuucaucauccccuccccucauggcucaggggauccuucagagcaggcagaaagaguguaagagccagaggggauggagaccaccaaagaaacaagggcuucuaaacacagaacgacugaagcacucaugaacucacagagacuggcagcaugcaccgggcuugcacaggucugggucugaugggaucccagugcugggagaggaaguggacccacccccauccccaauccagaaguuaucuccagaugaaaacugcucgcucacaagugaaaaacaguuucuucaaugcagucuucacuggguguacauucucuuaaggccaugcacauaaacugaacucagugguauuuuauaaguugucuuccccgccccuaugcccgcgucuguuugggcaguuuuuccuuacucugcaggcauuuuguuuauauauuauuguuucagauuuuaucuuuucuaggggauuuuucuguaccaauguguauaccucugcaccuauaucuauuucuuauacuuuuucuuuguggggaggaucuuguaggagucgggagggggaaaccauaaucagaauauauuuaugaaaaaaaaucuuuucaauuaaaaaagaaauaaaaguagaagcaauaagauucaauaagaaaaaucuaucauaaauaaucagaaaaauauuaaacucacaguagggauuuuuaaaaacauaugacaucaguaauaauaguaaguguuuucaauggaauaaaauacuggaacuguuuauagcacuaguaaauuguaaauuauauuguaucaccgaguaaaacaguuuguuuaucuagcagugauacaguucugcauuuagagccuuuaaaaauauuaaauuauuaauuauauacaaguuuauauguguauuuuugagucacuguuaguguuaugauaaaacaguuuacauaauauauaauauuaauuugugacugucaccacucuguagcugacugaaaaaaaaaaaccucauuuuaccccccagguucuuacugaauuuaaaugucugugaaagcuuaucuguaugcugcuaauaguuuuagccuauauuugauuucugaauuuuggcuuuuuucucucauugcauaggcacuuguucucacuuuuuucuuuaaauuuauuuuuaaaauauguuuucccaagagaucuguccauauccauagcaguuuaugaucccacaaagacuggcaggacuuguuuugugcacuuuauuugcguccugacccucucaucuguucucuuauguuuaguguuuccacagaggacauagguaggccaucuguuauauaaaugauugcucaguugcuaugcuuaguuauuuugaaggauuauuacucacuuuuucucugaaagaaagaugaauacuccugaguaggcuguauggaguugaaguuccugguguuggaagggcauuggggucugucuuaguuaggguuuuacugcugugaacagauaccaugaccaaggcaagucuuauaaaaaaaacccaauauuuaauuggggcuggcuuacagguucagagguucaguccauuaucaucaaggugggagcauggcaguauccaggcaggcauggugcaggaggagcugagaguucuaugucuucauccaaaggcugcuaguggaaggcugacuuccaggcaacuaggguaaggaucuuauacccacacccacagugacacacccauuccaaccaggucaugccuauuccaacaaggccacaccuucagaugguaccacucccugguccaaggauauacaaaccaucacauuccacucccugguccccauagacuuguucaaaaacaugagucuaugggggccauacuuaaacauagcauaaugcaaaaugcguuuaguccaacuuucaaaguccucauagucuauaguagucgaaacaauguuaaaaguccaaaguucaaggucucuucugagauucauucaauuuaauuaacuguaauccccaaagcaaggcaggaaaccagcugggcaaacuccaaacucugcaucucuauggcugaugucaaagcagucuucagaucuccacuccuuuuucaucuuuguugacuacuacaaacugcuuucuccugggcugguuccacucccuguuagcagcuuuccucagcauguaucccaugacucuggcaucuuuaacaucuuugagucuccaaggcaauuucaauguuacagcuucuuguuucagugucuaggauuccacuugaucuuuuggacuccucuuaagggcuggcaucacuuuuccagcucugcccucuguagcacucuaagcucagguugauccacuccacuauggcugcuguucuugguggucaucccaugguacugacaucuccaauacacugggguguuccacuccaacuaggcuucaccaauagccucucauaggcucucuucagggugccaagccucaaauccuuugcaugaccccuucaguccugggccaucaacuacagcugaggcuucaccuucuccaauggccuucccugaccucucacagugcuaagccucaguuucucuucaugaucccuucauuccuucacaagaaguaccaccugagugacucuuuuuauuaccaaguccaaccgcagcaugagguacaaccuuggguaucucuggaacacaacuucuuugugcucccagaaaacaacucccagauuucaacucaguagcuccagcuaaccaacaucaauuguuccaguaguuccuuucauucuuaacucuagagccagagcuacauggcugaagcugccgaguucugcugcuuacaggaacuagaacaugauccccuugcacuauuacauuaucacuggcuuuauguuuucaaaauccuucacugccuaagcuuggcuauccugguucuugcuguggauauugaccuugaacgcagagaucagcaugccugucuuuugggauuaaagauguguaccaccaugccuggaucuaaauuuagcuggguaggaucuugccccaaggucccacucccuuaaucuguuaucuccuaaaacacaggauuuugcuccauuucacuuccugguaccccuuugauacucaaaccauauauuuuauauuuuucuaaguuugcuaugcuuguucaaacuucucuucauaaaacuuaaccagagaacaaagucucuguugggcuuuuuugaaacuuccuuugucaaugcaauuaaucugagucucuucaccuucgucucaggcagacuguucagacaagggcaaaaaguagccacauucaccaaaauaccacaaaaaaagucuuuaugcuacauuuugaaauucuuuuccuuugaaaucuuuugggccaggucaacaccguucaaauuacucccagcaacagucuuccauauuccuacuaggaugacccauuaagccccauuuaaagcauuccacugaguuccaaauccaaaguccaaaaauccauauucuuucaaauaaaagcauggucaggccuaucaauaccccagcaauaccccgcuucugguaccaacuucugucuuaguuaggguuuuauugcugugaacagauaccaugaccaaggcaagucuuauaaaaaaacauuuaauuggggcuggcuuacagguucagagguucaggccauuaucaucaaggugggagcauggcaauauccaggcaggcauggcgcaggaggagcuuagaguucugugucuucauccaaaggcugcuaguggaagacugacuuccaggcaacuagggugaggaucuuauacccacacccacagugacauacccauuccaaccuggucacaccuauuccaacaagaccacaccuucagauggugccacucccugguccaaggauauacaaaccaucaccggguccuauaguuuuuuguuuuuguuuuuguuuuuuuuuuuuuuuuuugguguaguuuucuuguuuucauagacuuaguuaagagauugucugauauagucacucuugaaauuuggaaucuauguagaacauagcuugggacaaagugaguuaauuguugaaugauuguugcccuuuauuuaaacauuauuaguaacauuguaaggcugugagacuuauucuccaguggacuguguccauuacuagacaccugagacuuggagcugagacacuggagaaauggaaggauugugucaaggaccugacuggucaguuacuaguuauagugaaaaaguugguauauucauugagcucaacagagaauguuuugaacaugguauaaaaagaauacauguguguugguuaguuuuaugacaguuggcaaaagcuaggaucauuugggaaaagggaaccucgauugauaaauuaucuccauaagauuugccuauaggugaguguguagugcauuuucuuugauaaugauugaugugggagggcccaucuccuggguuggauggcaccccuggaucaguggguaguauaagaaagcaggcccagcaauccaguaagcuuuuuuuuuuuuuuuuuuuuaaauggcaucugcuucaguuccuucuuggaguuccugcccuguccucccucagugguagagugugacuugagaacuguaaggggaaauaaauccuuucgcccccaaguugcuuucguucauggccuuuaucagagcaucagaaacuaagacaaugugaugcaaaaagaagacauaauagaaaaagaagacacaaaauguggggcacaggucuguagcuucagauauuugggagaccaaggcuggaagacaggaaauucagagucucucugggguuacagggccagccugggcuauuuagugagauccaaucucaaaaaagugaaaagagggcaggcaccaaagcugggugauagaauaugugucuaguauuucuucaaacccuuggccuguauguaugcaggaagcaaagaaacauacacaauacauacaaaccccuuugugcguaaaaaaauuuuuuuuauuuuuuauuuuuacuacuucuuuguuuuuuuuuuucuuuuuuuuucuugugugcguaaaauuugacuuaagaugugucggugguuaagagucuggcggcucguacagagaaccuggguucaguucccagcacccacacaguagcucacaaaucuguguaacucaaguccaggagaucugcugauguccuuuucugaccuccgugggcaguuaguuuacuuacauauaugcagccaaaacacucauacacauaaaauaagaaaauaaaucuuaagaaaguuuaauaauugauuuaaaaaccugugugugcaugcauguuggagcccauagcaugccacugaauaucuccugccuuugcuuuccaucuugguucuugagauagggucuuuugugcacgucuuugacuagacagggagccagccucuucucucagccuccuaguacuguauuaaagggauguauugcugucccuggcuuuuuaugugguuguugaauauggaccucagagucccuuuacaagucaagcagugagcauccuuggcuacacaguugaguuugaggccagccuggacuaaaugugacccuaucuuaaccuucucugccacccacuuaacccuaauuuuuuuuuuccaaauuuguaguucuaguuuccaguuguggccuggcaguaggcuuauuguuaaagaagccucaguguuccaaccaugugucccuugccaugggaaugaucucaccugagaccucaggcaccacaacguggagcgagacuaugccggccacauucuuuuaguuuuugaaaggaugcaaaguagcaccccuaacuggacuaaagccaccugagugcagggauuaaugccaucagaccucagcuguuccugcuccugucucaccagucccuuuccccuuuucuuugggugugcauugaccuuuuucucuuucuuuuucugcugagacugaggcucccugaacugucaggcaugggcuucacuccuuugucucugggcagaaggguuugauaauaucuguuuauuacucaagacaauuggcgcuaauuuaucuuugcuuauacacuccuauuaucuuagaaagcaucucuuaauacuguguuuccuaaguaaagaaagauuacguacgugaaguaauacugcugcuagauucuaacacgauuaucuuggcugcauuguaaguacuaggauuaucuuuuucccagucagauggagucuuuaaagcuacugguauuuaaaaaugauacugaaauugguucccauagcaauacccuacccauuucuuuuggcaaacacugcaucuuuuuacaagcuagauggagaaagagaaguguuucugaguuuauuuauaaaacuaagccaacaagaugaaguuguuuaagauuuuagucuuuaucucucaagagagaaaggacaguuggauuaagcuaaaauuaaugagagauuuuuuuacauuugaauauaagguuagacucuaguguuuuuuccuccucccuccuucccuuucuucuucuuuuucauuuuuugagacaugaaaauaaguuucuuuauguagcucuggcuguccuagaacucacgcuauagaccaggcuggccucaaauucagagauccaccugccucuguuucccaagugcuaggauuaaaguaugugcuaccacugcccgacgguguguuuuauuauguaaaaguuaauauuuuaaaaaaagauuuuauuuauuuauuugaucuguaugaugaguacacucuagcugucuuuagacacaccagaagagggcaucugaucccauuauagaugguugugagucaccaugugguugcugggaauugaacucaggaccucuggaagagcagucagugcucuuaaccacugagccaucucuccagcccaaaaacguaauuuuuuuaagaaugaaaaaaaagauuguauuuuauuuuaugaauaugaguguuuugccugcauguauguauguguaucaccugugugccagaugcccacagauacaagaagagggcauugaaagucccuggaacuggaguuauaggcaguugugaguugggcgcuggcauauugauuccuggucaucuggaugagcagccaguacuuaacugcugagcccuuucuucagcuguacacguugauuuuugaguaagugaaggaauggugagccuagaacuuguuacuugcuagcuagugugcugaguacuggaauuguguuaaaucaacauugcuugucucauaaguagacaugaaacguuuaaauaaaugagaaacuagagauuaaacgugaagccagguuugcccugaaaucauacauguaccauuauuuggacagagcagacuauauuuaguaaugugugugugugugugugugugugugugguguguguuugugcucacgugcauguaggcacauauauauauauauuuauauauauguauacacacacacacacacauuuaugaauacaaagacaguuaguggaagaagaggccauggauuugaaggagagcagcagugguaugugggagggcuuggaaggaggaaagggaaggggauguugugauuaauacagucaacaagaguaacaacagaaucccuaagucagcugucugucguacuugugugcguucccaggacuccacagguggaagugggaggcucgucacaacacagaagaaaugauccgccaaucagccagaccccaccaaaguccuaacauagacggaauuuaaaucaugugagguuuuacugaagguguguaucaccugugcccagacgugauuacagacuuacagcaacgcccgcauggcaccuugguagugacugcccagcuuucuaaggcuauaugggacucugugcaguauuguugagugaggaaggaaguccugcugaugugcacaguguggcuuacagguagcugaaggugcuucuuacuaucuuuagcaauacucauauucaucucaguauuugauuuauuuuucugagaaguaucaauaauauuauucaccugauacuuuauucuuuucaguuuuauucucuaaauuugaccuaauguuuuguuaauucagacuuuugagguuuccagcauuucaaaaguagaccuaauuccauauucuccaguuugguucuuuuuccuuguuguguaaauuuucaaagcaacagauucaaauaaauccuuugaaacuggcauaaauuauauuuuuaagaaguuaguauguaauauccuuuaacauuugguucauuuagcaaauuccacauacugaauguguaauaaagaaaggcacagacaguaauaauucuguccugaugggccuuaccuaguggggucgguugaagugucuuucuccucagagguccucaucuguauugccgacggcacccuccugaaacgguauaacuuagaauucugacugauaguguuuugucuucuauguguguauuagguuuaaacauuuacuuaggcauagaaacaaacaauuuuacauccuacuuuugaagucagugaagaggaacucuuucauggucaaggcuuaucuuacuuagauuccaugucuuaauuuuuuauuucaaaauacuuuucaacuuuagcuuaauuuuuacuugaaugcuuuugaaggaacgucucaguaguuguccaggcuugcuuccagcucucacuguguagcccagggugcccuugaauuuguguggauauuccugucucagucucuugagggcugggauuacagguaugcagcaucaagccaggccacuucuuuuuuuuugcuuuauugccuuugucuaaauucuuaguaucuuuuuuugccuaaccuuuagcaacaauguucuguucuugcuucucuaccaacguguccuaaauauagccacuggauuaaucucaaacugcagacacaauuagguuacucuuuagcugcagaaucucauccguguauauucacaacucugcagaagacacacauugcuuucucucaggauccuugaguuaaguccauaugguguucuuuucuccccuuucacaguagauacuuguuuuguuaauaggaaauucuucuuuccucccuuuuuauuuccagauacuggaguguguaaagggguuguuaacagugguguguuugggugucaaguugggaagggaugaacucaugauaaauugugaagggaugaaccccugauugauaauauugggaagaaggagccucaacugaagaaaugucuccaucaguuuuaccuauagggaugucugugggguguuucuuuauugcugauauauccaggagagccugguccacugugggagguaccauucacugguaagugggcaugcaucagguuaaaaagguagcugaauagaagccugguuggcaccguggugagcugcacuuguucaugaucuuuccuguaguuguuucuugagcuccuucccuggcuucacuuagacugugaccuagaaauguuagccaaauaaaccauuuuuccucaagcugcuuuuggucagaguguuaaugacaauaagaaaaagcaaacugaaaaaaaaauuuuuuuuuaaagauuuauuuauuuauuuuaugaaaguacacuguaacugucuugagacacuccagaagagggcaccaaaucuuguuauggaugguugugagccaccaugugguugcugggauuugaacucaggaccuucagaagaguagucagugcucuuaaccgcugagccaucucuccagccccugcaaacugaaauucuuuagaguauugcuaaagaggcuguguugcacuggaucugugauagaguuuagugaaguucuguguacucaguuguauuuauuguggcucuauuuugauuguucuuuuuaaagccacuuuuuaaagaguacugguguacauagccuccuaguugacggaauaaauguguuccuggauuuugcuaaucacuuacccaaauaaugaaaagggaacauucuaguacuugauggagaacaaaacaucacaguucacacaagcaagcuaacuaguuuucucgugagcuguuuccacgcucuguucauguacuuauugauaauuaaugcacugaagggccucaaaugucacuugugaaaaaucacaaguaguugguaaaaauguaguagacaggaaagcuuaaguuuaaucccaccuuugucaguuuugauucuuagucuacauugacuguacuaaacccaggcucuuuucaagaugaaaauuaaucccuucacucagguagcuuuaguccaguuaggguugcuacuuugcauccauucgaaaacuaaaagaacauggcgggcauauguggugccugaggucucaggugagaucauucccauggcaagggacacaugguuggaacacugaggcuucuuuaacaauaagccuacugccaggccacaacuggaaacuagaacuacaaauuuggaaaaaaaaaauuaggguuaaguggguggcagagaagcuuaagauagggucacacuuaguccaggcuggccucaaacucacuguguagccaaggaugcccuugauuucugaaccuccugucuccacaucuggaguuggcugagauuacagacacaugccguuuuguccaguuuauuaaaaguuucucuccucccuuuccuuccacuucucuuucuucuccucuuccucccuuugacagugucacuauguagcccuaccuggcuuggaauucacuguguaaaccaggcuggccucaaguucacagauaucugccugucugugccucccaagcaguugguuuaaagaaagaccugugucaucagguaaaaaaaauaguuucuuaacuaauguauuuccucccuuaggggcuggaaagauggcugguucagcagcuaagagcacugacuaucuggguucaauucccagccccacaugcugacucacaaccaucuauaacuccagugcagaccuacuucuugccucacccaggcaugcauguggugcacuaaccaggcauguggacagaauacccagaagacacuuuccccgcuuaguuacuugcauaccguuuucuuccuguuuuaauuguaggauagcuuagaaugaaaguaacauuuaguuaggucacuuguccauugcuguugcuugggaagacuguauagaauaguuccacacuuguuaagaaucagugaaaguaaccaggcauaguggcauacacuuuuaaucccagcucucuguaggcagaggcagaugaacugugugaguucaaggacagccuggaguuccaugauagccagggcuacauaauacaguuuuuaaaaagaaaucaguggaaguuugauacacacacacauauauauaauuuuuuuuggucugagccauauacaagugaucauggucuagggaaaaaacagcuuuccccaauauauagauauauuuguagcuuuuagguuaaguuugaaaacaucauccccaugcaaacaucauuucaacaaacaagaaaaggauaaaaaaaaaguaaacaaaaaaguacucuuauauauuguauguuuugaucuuacucuaagauugaauguuaaggggcgcaaaagucauauuuuuuucuuggcaagauuuuuuuuuaaauggaaacaggaagccaauaaaccugaagaaacguguguauguucccauucagaaaacauaucauacagcgaauuaauuaauguuuaauaagaagggcuuacuauggaaggacaaugccucuccuguaaauucccauuugguucagcgugaaagucuuauagaccuuggaagcaguggacaugacgugggauaugggaagugcuggugcggcuuaggagccugugagugcagggcuaaggagcacacuguaggugacuucuuucaggucacacuguuccuguagaguuguugacaucuuauccccugcagguuucuugcauccaguuuucaaaggcaaagucagcacugacacugccauuccuuccaggguauaaacgggauuccagguuuuaugaaccuagcuagcgccagaguccucguuucugaacccacauuggaaauuaggagcaacuccaagccauaaaagcauggaaaacggcuuucacagagccggucaggagcggcccagcucacguacuucugcugcuuuggggaggaagagggucuguguguuucuugaaccacugcuuuauguuggcaucagaggcucugccaggcauugugagagaagucuuauucaagguggugagguuacgguagacucuagucgggccugaaucacccacugccuuguuagaccucuuuaggagcagggguggaauguauucuguugugcccauugagcuucaaguaauaaauugagauccagccauggugaguucauuugcuaucacuaacucugagucaggacucucagaacacguaugaugauguauuagauguuaaaaccauugccacgggcagagucaugcuacucgcucuucuggcucuauucuugcuguucagcagcaagcgguccaauugaaauagcauuuucuugagcuuuguuuguuuuguuuuaauuuuuauuauucuuuuugguauuuauucccuuugcugaugugagcaucuuccccacguuggaagcauucagucuguuugcucucuacuuaauuuugugcuccuguagcuugugucuuuuauuuucuaccuuuucugauuuccaaagaauuaaccaaaucuuccuuauuacuuuuuccuccucaauuacugguucaaaaaugauauuuucuaauuauguauuacucuugccuuuuuguuuguuuugcuuuuuccagagaggguuucucuauauagcucuggcuguccuggaacucgcucuauagaccaggcugccucauacucauggagauccaccugccucugccucccgaguauugggauuaaaggugugugccgcuacugcccaccuuaaucuugcauuuuuauguggaucccuuuucuaaguucauccggugaucuuugccuuguguuuuauuuuuauuguuuaagguuuacauuggcuuuacugaacuuucuucuuuguauuguuuuucauuacagucaagacuuauuuagauuuuuuuagacuuacguaauuuuucuucuucguauacucuuugcuccuuguuuaauuauauuuuagugucaauaaaaccuguggaugguaguauuuuuagucuuuuaaugaaaauguuuuuacuuuguauccauuuaaaguacaucagugcuggaccugauggcuuacaguguagcuucaacuguguugugaggguugugguuuaaggacuaccugggcaguucucaauaugugaugccuuuucucaaaagagaaaaccagacaaguaugucaaaagggccagggacuaucucaguuguacaguacuguaaaauauugaauauuuuggaaauauagcuggguugccuggauauagaguuagaagcaugcagccaucuaggacucuaguccuguuaggaacuuaucugcucauuucauucuuuuugauuugauuucuccuuuugaucaugaaauuuggcucuuauuccauuugugagcuauauuaaaauugucuuagauuaaauuauguauaaaccacagaaauugauuuuuucauaguucuggaaucugggauguuaaagaucaggguaccagggcuggagagaugguuaagagcacugacugcucuuccagagguccggaguucaauucccagcaaccacauggugacucacagccaucuguaaugagaucugaugcccucuucugguaugucugaagacagcuacagugaacucagaaauaaaucuuuaagagagagagagagagagagagagagagagagauccggguacuaacagaucacgugucuagagcuucccucgccccgcccaacacacacacacagccuucucuucaugguuguaugugguagaaggggcagacaagccucguugggacacuguuuccauucaugagggucuacccucuucaagguccuacuucuaguagagcugcauugcaaugaaauuuuagcauggacuuaagagguggcaaacauccagaccaugcaugguacuugugagugaaccuuccucuuuguccuuucagaucugcugaaguauauuuaauggaaagaaugaaggaaaugaaguaguccuucaauuuaaauucuaucuuauauugcugucucugucaacccugcuuuaaagaaaugagaagcugggcgucccagcacuugggaggcagaggcagguggauuucugaguucgaggccagccuagucuacagagugaguuccaggacagccagggcuauacagagaaauccugucuuggaaaacaaaaaacaaacaaacaaacaaacaaaaaagaaaugagaaaauaguuuuguuugagccacauauaagugaucauggccuaaggaaauccaguuuuccccaacauauauuauacccuggaagagcuugucaugauuucaauauugaaguucgaaaaaguguuugaacuugcaggugguccucugugcuaguucauuuuucacuauaguaauagacuaccggagguuggccaacuuuauaaagagauuuaguuuggucuuagugaugguucagaacaucagacucagguuguugguaagucagguccccuguccuccggugagggguuaauuguagaugauaucaagguacagauucagguggaggcaagccaccacauugccaguuggaauccagagaaugacuggggaucuggauuucucauaugugcuaacuuaggaugucacaagaacuaccauaaucuuuucacuggcaugcaugcucccuugaccuaacaacuuuuuauucauaucuuuauugccucaguaaggaccaaccauaacuccagcacagugggcuguuggguacauaccgucucuacaccauacuguccacuguggacacguagaauggacuuuuagaguguaagaguguuuguugucaaccuucucccucaaucuguuuugugcugggauugggguugugugacacuugcuuuggauauaauauuuguuuuaggauggaugguagugguccguaaugauaugguggugaguggugguuauacuccugacaguguuccagaagucauugaauguguuauauaauaccgugaaauuuucaucugguuauuuuuuacuucaguuuaaaaaaaaaaaaaaagggucagguguugcuugguaucuguagucuugcuuuauccaguaaaucuugagaguagugcuucuuuugccaaauagguucuguggaauacuagaacuuagaaauguucauauguuguuuggaaguuuuccuuuggaagagaggauucuaccagaaaaguguacuuagguaagauuucuuacugacuguugggguucauaaugcacuuagcccauuagaagcccugagauguguacagucaggaaguuuguugaacucaucacuuccuaaaguuaagccaauaacugcugcuuacugucauucucaguacuguacacuguaaauaauucagugguguacuuuuauaugagucccagugcccuagguucauuuacacuagccucacuacaagcaggccaguggagacccaugcugugguaucacuggguguugagaagacuuuaacugccuuaaucuuagagguccacaaucacuuauguggccauuguuauuauuauuaugguauuauauagccuguaauuaacuaggauguugacaguauaauuaauaaauaagcuuuaauucuucuuuauagaaaauagcugauacucagcauuuguccacuauuaacauaucaacauuuacacguuaauauuguuauauuucauauauuccccaaauggcuauaguguagguaucauucucauuagguuuauuuauguguaggauuuuggcuucucauauacuugaauuuauuucuuauuuuauuuuauaucaugugugcagaauaaguaagcauucucccguuguuuuggauugcuagcauuuguaagugauauugugguaucccccauuauuuaugcaguaguugaaaauacugaggagauggagcguauagugguauggacuagaaccuucugauuaucuuagugaugcucuguuguggauauuugugucuccaagaguguuuucacauugaaauccuaacccuaaaguuacccugcaauuggugucuuugugagagugaccagagagauuuuuuacgucuuacaucacaagaggcuacaaggagagggaagcuggcugacacagucgcuggaucugcuggcagcuugaucuccagaauucccagccuucagaacugcgaaauaaauguguuuguaggucaccuagucuacgguaauuuguuauagauuguagcucgcauggacuuagacaggaguuauuuuauuuccaccuagucuugcugucuuuuggcuggugcccuagggccauugcugagaguuguuucagugugguuggcuccugagcuggacaagugagucaggccugaccgugacaggcacagggguuucagcgcuuucccacgugcauugcugacaggcuggagcagaucucucguaggcuccucuuggcaguuagacaaagcguguuggcaagacucacauaguaaauuccuugagauggccucaagacuggguuguuuaaaaguuacuguuucugaauuauuuaugcuuccucugguguucuucucaaguggugguuagagugcugaaauuagaauuaauguuagagaccuuuuuucuugaugacacauuucuaaagugaagcacauagucaccuaugaagaacugugaugccuaccgguaucuuggcaaguaucccaagcacauggauacauggcgagcucauaugauguuuucuuucagacacuguuugugguaagguuccaugauauaucuguaacugaaccagccugaucuacaaagcgaguucuaggacagucagggcuauggagaaccugucucaaaacaacaacaucacacaacaaaguugcuauaagauauuuaauaacuaacucuacuaguucuuaauaugacccagcuagcgcaccaauaaucaagacauacuucuguagauuuauuuaaucaguguuagcacaauuacuggguaauuacccucauaaccuuucuacacuagacaggcuauuucucagcagugcuccccaagucccuugcuguuugagucucaccagaguuacuucugcuccaucagucuguccucagguugcauuucucucccugguccaucccaucuaauggagaccuccugcucucuuucuucuccuucccucucucucuguguggggccccaacccagugaaugaagccccaccuaccucuaucuccccuguaauuggcugccagccaccuuuacuuacacagucagagaacauugaugaacauaauuuacacaagauauuugguauaugugagaaugugcuugucaggacugcaaccaguucuggggcuagcauuuagcauuugaauacauagcaaccccagaccaacccccagccagccagcugcagccaccaccaccaccaccaccaccaccaccaccaccaccaccaccaccaccaccaacaacaacaacaacagugggggaaaaccaaaccaaaccaaaggaaaucccccaaagcccacacugucgauuggauagaugcccugcauuuuagccuguuucuucauucuguaauugcaucaaggcuguuacuuauuuucuuccauagauaauuagaaaaacaacuuugcuuugccccuaagaaauuggauugcuaaaacugagggucccggguaaugucuaguuuccuuuuacauaaugaaucugugaauuuucuguuuuuuacuuuauaugcauugcaucuugcacaaggcaaagcuuuucuccuuacucuuucuuaagcagauuuuuaaauagaagaguguagagccaguugaacuaucaaguuguggcuugaauauuuuaagaucugucaaauuaacaacuuuaaccuaagaaacuuaggauuagugugugcgugguauguguuugugugauguacaccugcugguuagagcauaguucuguggggucauuucucuccuaccuuaagguggguucugagugaccagcucaggucagcagacuuguggggcacaggggcuuuauccacucaccaucuuggcccagcuucuugggucuaagguggagacucauccggugcuaucuuaguuguuuucuuguugaaauagcacaaauguuagaaugugaaaauuuuauauuaaucuuucaugaaugagagaucacaaugauaguguuaccauguugccagaagcacauuaaagugaaacuugcuuagaagauugguuagaaaccguguccuuuaagaacucuuacaaguacaugagguaggaugauggugauggguuuggaggcaacaagaauggcgaugucagcagguaauguuuccccugucuuccauccugagggaggcagcucucagaaucagauccuguaagcugcagauagaggucaguaggcgucaugguggauggugguccucaggaauaguaggcagauggacagccuuugcccuccccaagaacauaacagugacugcaugagcuagcagucuaaaccagggguucucaacaugugagucguaacccccuuucacaggacugccuaacaccaucagaaaacagauagaugucuuuacauuaugauucauaacaguagcaaaauuauaguuauuaaauguguguuauuacaguuauuaaauagcaacaaaaauaaauguaugguuggggggucacuacaacaugagaacuguauugaaggguaacagcauuaggaagguugagagccucuugucuaacccagcacugccugcagggacucaccguggggagggaauauaugaugcugcguaugugaggccuugaguuuacuuuuagcccucaguggaacuaggaacuaaauaauaccuacaaaucgaagauagggccuuuuuuuucuguauauuuuuauauuaaagaguuaggcaaaugugcaaauguaugcauuauaauauguauggcauuaaguguauauaguaauuagagcaacaggaaugugcuauuuaaaacaaucuuuuaugcucagacaguguaauaguggguaagucauuaauacuguuuauuaaaauggauggauauugaucagaaguuuauguuacgauauguuauauaaaacagacugguuacaguuuugggaguggugaaaaauguuuugugucuauugauagguaggauuugaaauuggcaucagaagacuugcuuuagacugggggggugggguaagcuccuguagagcuguugucuagcacgugcagggcacccagucccaggguguguggugagggguggggauggagaaaaggaaaugacuuuaccuuugcuuuguuguuagcugugugacuucagaugagguacuucaccuuuuagccuucucagguuuucugcuguaaaagagacauuuaaacauagugccguugcacccugagggacagcaugggacuuuaaccuccgacucccacauagaacacccaccucuccucuaaugcuucauuuuugugggaacugccacgguuuuguguguuugugucuuuguguguuuucuguaauucaccaaagugguaaaaaagugagcaagaggugaggagccggcagugcucuuuacucuccuagaaaccacggaauuguugagagcucuaaacacaugacagaccugccugguuuugccucuggaguguuggaacuaaaaguuuauaccaccacaccuagaguuagaauuacauuuuuuuuuuaauuuuaaacuuuuaauuaagucuucgugaagucccuucauaucugcccuuugccuuuguaaucucuccucuuccccaaagaaaacaaaacaaaaaauaaagauuaaaaacaaaacucucacuguggaagcuguggugugucagugugucacacaguauacucuuucguccaaacagcuucacuugaaaaaauucaucgcagagucauugcuuugguucaaggccccuggcuucugcuacaccaucaguacuggauccucauccuguuguugccugagcuguggagguccugcagcuguggaucugcaggaccaguuccuucacgugcuccagcagcucguagagggggagauguugggaugggccaacucaaaguccuggaucugggugguaauugaguuggucaaccugccagcucucccaugcccaugucaucagggccagcuccugccugcugcccaggcaagggguggggccaacucaccauagugccacagcugacaagcaggcaggccugcucagcucagcccuuggguaucacugugacccaggguggcagcccagaccucagacaccugcauggcuuuuguuaguaaagccuggcugcaggcagaccucuuagaauucuuaaucauaguuacauaagaaagacaucuugcaugcuuuaugcaagggcagaguacuuagaguuacuuggaaugcccuuuuuuuuuuuauuguugggauuguugggacaauuacauacagcuuaggccauucuccaaacuugugugcagcugagguugguuugaacuuuuaauauucugcucaguagcagucuugucuuauaguugcuuauuucugugcuuuaaauucaguaguucuaguaguuaucugaauuaauguacuggaaaagccguuaagguuuaaagcaggggcacagugaaaccacugaacgggaccauccuguugguaagaagaugguuucuuugggguaucugacugguggggaaagccuugucaguguuauggcacaggagggcuguguaugugugguauccgccuagaguuagcaugggcuguuggaguucacuagaugcccuuugucuaggauaguugaccauuauggguggauaauggaaguaauggcuuuuccugacagagaccacuugaugagauuucugaagaguguugaguucaggaguuuguuuaccagacaguaaucgcuaaguucgcccagcagaacugccacuuuuagggcccacuuuggaccaacagaagccuccguugaggguggcuuggguuauuucuaacauuuggcaguggucuuuugcauuucacuuuguuugcuuuugguuuuagacucuagaggauauuagacaaaauuuaaaaggauuccagcccuuuaagaggcauacagaugccuggugcugguuguggcaacagcgguaacagagguggugguuuggggccacagugcacucaggaggcagaguugacagguggaucucugucaguuggagacuagccuagucuacagagugaguuccaggacagccagggcugcucggagaaaccccuuucacaccuuaccccauucuaaccucccucacccacaaaagaggugcacagacugcagcagacaggaagcugccagaagaaugcugggaucagguagggagcugcagugucacuaaugugcaggauaagagaaaccacugacccaggaucauuauucugcuugauaauagcucuaaaaaaugcugagcuuuauuagguauuauagauauaaggugcucugaacaguuuaugugagguuguuuggguuuuuguuuuuaaugguauaaucuuaccaaguuaccauuuucagaauugaaauggugaagguugcccuugguuagauagagcaccuuccugaagggccuugugcugcgacguuagcucugucuucacugccgauccuccacaguaucugucccaacuaaagggacaucaguuuuuguugcuuuguuuuggggugugcguguguaugugugugcgcacgggcgugugugucugugucugucuguaugugucugucugucugucugacagaagcagcugggaagaacgauguggguuacuagcuauauugacaugcuuauuugcuagaaggucauuuugucauaguuaugugcuacuuaauauuuuagaauucauucuguuaaaaacuagaaucuuuaauuacauguuaguuugggcuacagugagcaaauaauuagggaagagucugugaaaucuugagaauaagcuaauuuuccuauauauuuuucuguuucuguauuuuuaaaauguuguuguuucuccuguuguaacaaagccaaaugaugcagagcuucucugagcccuuagugacucucuagucacggccugcuggcuucuguuccuugccuguugaaggccacuuugcuuggguuguauccuagcuguuuguccuucaguuaguuuuaaaaguauuuacagcccacacgugacggcucccuugcugcaaccaggguuugagacagacaugaugcugacugugccauuuaaaguuucaauagugaaagcuaaccuuuuguuguuuauaaauaccuucaauagaaucugauccaucuaguaggaauuccucuuagcgucuaggaugcucuguucuuguucugcuagggagggcacuuugcuuccuagcaguaccuucuccugugugaaggaggcaccuacuuuuuucucuagaauuuuagacagugacaucgucuuucuagauaucgucuuucucuugugucucuuuuaaaaacacuuuaucauuuauuuuccuaaagaguucucuguuuaauucucuuccugucacugggcaccucuucucugcagagugaaucccaggcuccucaccuccugucaagcccuggcucuaagcuccagauucugauggcuucagucuguaacacccgauacuaaagucagccaccccauucggacguguaauguuuucucuuaucucuaaaccauaccugccaggccuguuuauuuccuggccauccggaucauuugucuuugaaucagugacuagaucccauuacuauguugcugcccucucauuuucuaucccuuccuuccuauuacugucaugaacccaccuauacggacuugugcaguuuaugaaauugaauaucuauuauauacauauauaauauauucauauauacauguguauauauguauacacaaugggauauguacacacacacacauauauauguauauauaugaauaauaaacauaagagauuguuuccuaaauuacaaauguaugggguagaaggggauugaggaaguaaaaaucaagaaagagguggcugacugaaguagagaaagguaguguaaaguaagggcuaaagagcuaugugaagucaaauaugaugacauuagccaaagacaagugagcuccugugacucugacugcgccacagucaccaucgguuugccauggugaugaaaagaaagccugagcucaguguccccuguucugcuuuaaacuuauuuauccuuacauuuuuacuuuauuugcugaauuauguuuccaguauuagcuagucauucugugguugcuugcuuugaucaaaggugauugucaaaggaugguguuggcacguccguacccuuggacacaaaaacacuccuuagaguacauuccacaggacauggugguacagcucugcucucagcugugcagggggcugaggcaagaugaccauuugaaccuaguaguuccagaguagcuaggacaguauagcaauaucuuuucuaaaauaauaauauuaaauccauaucuugaaucucucuuauauauauuugggcauugugggguuuuugugguuguuuuguuuuguuuuguuuuuuagacaauauucuagaauuuucagaaacuuugauauuuaaaaaaagucgggcuggugagauggcucaguggguaagagcacccgacugcucuuccaaagguccggaguucaaaucccagcaaccacaugguggcucacaaccauccguaacgagaucugacgcccucuucuggagugucugaagacagcuacaguguacuuacauauaauaauaaaaaaaaaaaaaaaaaaaaaaaaaaaaaaaaaagucuguuauuuuggugaccucuuuauagauaacacaaaaccaaauuuucaaucuuaaaaaaaucaaagacauuaaugauuguaacuuugaauguggggcuauuccaguauaugagcucauuuauaagaaauuguuuguuuuaauguuacauaguuguuuagaguucccucuuugaauuuucagaaaugguauuuuuauuaauuauuauuuugauaaguagaauccuuuucaagucagccauaccaaaaauugucuuagagaugauaaugggcacuggggagaugguucagugguuaggaccacuuccagaggaacuaaguuugguucuagcacccagguccauugacucacaacugccuauuguaaaaauguacacucacaugacacacauaccuuuaaauauaaauucuugguuagacuauuaguagauuauuaagauuuuuuuuucuucugaggacacuuucagaugguaucaauauaauaucucauagcagugguuucccauuuuuuauuuaagacuguguaugucugucuacacucucuuugucuuuuucuucaugcuuagaaccauugcuggcuacuggcauuuucuuuuuuuuuccccuagucuuguuucuuguggaaaagauguuaguugcaacuaacaguucacuaaugggucauguaggcugcaguucaaaccccagugccuuagaauagcuuuucacaaaaauuauuauuuuaaguacagaacaguauaagcuauaaaaccaaaaguuacagugacuuguuucuucaguuaauuuugguuggcauuucaguaguguaugcacagucagacuuccaagcaccauggcaacaucuguauuguauccaagcaguauugugguuaaaaugguagcgggcguuguggggccgcugggugaggugggaugcaggaagucuugauugcgugcaccucacggcaucgcugggugggcugcaggcugugagaagcugcaggacccugcugggggaagggagacgacagguucucacgcucuuggacgccgcagaugccaaggaaagaauggaguaggggcccguggggcuugcucuggccggaugaauucugaagggaaaagggcaggagagagcucuggcugguuccgguggggaagagagucucuggcuugcucacucugcuccaucgcucccaccgcugguugaugagaagaggcagucauugggaugacugaaaccuuaucccacuuucucagggcaaauaccuuuugcagggaggagugucugggaaggagagcuuuguuuggcuaagccccucaggccuuuggguaccucauuaacaaggagaucugucuugaggcuacacccucuaccugcggaggugcuuggggcgaugcccuacuugacugauggccagagaauuauggagaucuaggaucuugggucaggagcccagugucugggggcguggcaaaugccuucuguccuuugcaggaacuucuguugggucuccaggguuuaaaccuagcucagccagaaaaccugccuuucacggucccacucaguguuauaacacuuaaaauuuaaauauuuaacuuuguacauuuacucaauuguuguguguugaauaggcucggcaguaccguggccaacguguuuggaggucagaggacagccuucaggagucuguucucuccucccacugugugggccuggauugaacucaggucaucgggcuuaggcaaguacuuuacccccuaagccaccucgcuagcccauaguauggaaaauuguaaaccuuuguuuuucuucuccuucagcaagaaaguagcuacuauaaauaaguggcuuccaaaugccuuuucaaaauuuucauaaggcuuaaaaaacuccagagagguuauauacaccuaguuuuacuuuugaaguuacuguuauuucuuagugauugaucaucaucaaccaaacacauguaucuuacucucuguaguuuuaauggcucugugcaaggcuacauuucuuuaacuaguuuaacuuuuguuuuugguuuuuuuuuuuuuuuuuuuuuuugguuuucgagacaggguuucucuguauagcccuggcuguccuggaacucacucuguagaccaggcuggccuugaacucagaaauccaccugccucugucucccaaaugcugggauuaaaggcaugugccacuacugccuggcuucguuuuuuuuuuuuuuuuuuuuuuuuuaauuuuuauaagcaauauaacaggcagcaugacaccuugcuaucuuagauuggaugguguucacaagcuugcuguugacuuaguccacuaauauuugaaacacacacuuugaaucaaagcuuuaaauaucaaaacucagaaaucaaaaaagcuugcuuuauaguguguacauguacacuguuagcaaugagauuauuaaaaaucuuugucucucccuccugucccugcucucacccauccuuucugacacugucuugauguccuccaguaucagucuuccaagggcuaacauuaaggcuguucauccacauuugccugauuuucaucauuauaauguaaugauuucuagccuuuuaaaucuaaucauugcuuaguguauuuccguaagagcuucacaucugccaguuuaguucauuuuaaaagauugaaguugggcugacuauacagcucagugguugcaugucugacuuugaacagacauugaauauuuccaacaccacacaaaaauauaauaaacaucacacuguuagcgugaauauaauuuuuuagcauucauugauuagaaauaguagauggauaguaaaaagacauaaauuaaaauuaguuacuucauuguguaaaccagcccucuguuuucucauaaugcacacguagguuucuuagcagacugggaaugaaguaguuuuguguaacagagucaguacaguagauguuuccugaauuggguucaguuuagaccaaugguugacuucuaguuaccucuguuaaaaucucugugagguaguuuagaaugaaggaugcacaauugauugaucgagucuaauucauuguguuuaugccuccucuugaagugucgugaaccagauagcguuuaaucauuucuauugguaguucagugguuauuaguuacuaaugcaaacccuuagcuauaauuuauaaacaaugguguaauuucuuacaguacuuggaguggucacucaaccauuuagauuuagaagauggcagagggagguagggagggggugaauuagaaugcucuugagaauuagguuuuacuaugcagacuccauuguaucuguuucauuuuucauauuuuaacuuugcauauucaaaguccuguugauuuauaagaaaguuuugaaguucucauauguaauguauuacauggaagcuuaccuaaauaaacauacauccuaucacaauaagggcgaugugaacuuauuuauuuuagacuuuacagcuuagauacugcucucagagcaaguaugugcacaacuugaagucagagagaagagcaaccagauuguucaguaggaagagaaguagagcucauguagccaccguaguaggaagagaagcagagcucauguagccacuguauuauggucggcaggcucuccuacugcaggguuucaggcaccugggaggcagcacugugcuauuuuccaucaggcccuguuucuuuaaugaguacuucuuccugccuugauugguuagcuuuuuuaggaauggaaguagaacuauaucacuuuccuucucccucccuuccuccagcuccucccagguacccuccuuucaaccucucccacgcaacccccccccccaaguugaaagccucuuccuuugauuauuacuauuguaacaucaucuuccuucuucuuggauauucccauauauauauauaacuauaauauacugaguccauaguaguccuuaguugccucuaguucuuuaucuggaagugugugugaccccaugggcucucuccccuucugguuaaaaugccuguugauccuugacauuugacacuuuaugaugacuaaucuauuucuagaggaggcuguuucagagcacuuccgggaauucugguucuuaggaucuuucugccccucuucuacaacguuccugagcgauggcucagaacacaggcgcucuuucuuacauaguuauuauagcugccaggacucaccauguuccauugaugucuguacugugucuguuuguaguuuucugcgauaguuuccauuucauguaaagucaggcuucuuugaggcggggguggauggaacugacacuugguuaggguuucaacuaaaguacaguuacagcucucauuuaucaagaauuuaucuuaugcuaugcauucuacauagauuauugcaugcuuguuuuuuuuuuaauguucuugcaaguaaugguaguuaugaguagaaacuauaauuggucaagaguuuggcauugaguuuauauacuuaaucacuguauagucauuuauuuguuaugggagcccguguaaguagauuauucuacaagauucagaguuaaggagcuuacuuugugucaugccgcuaguaaaucagagcucacuugcuuuuguuucugcuugcauuauauguggugcuguauuaugacaaguggaaguguguauauguguaugcauaguggaaccuugcauaguugggcuacugugcuuauuaaaccuccuuucauaguaugagugccuccugcuggaagguuauaauguagccaauaugcuuuugaaaugcuagcuuugaaaaagccagucaaaggggagggcaucuaguuucacuauuaauuacuaacaaucauuuuaggaucacuccccacugauaucaggcaguccuccuaauuuacuauagaauucacugcuucauuauuauguuguuuuaaauuuuauauacucaguacuuucuaaaauaaagucauuggaaugcuuuuacccaagagaaaguuugauggcccugugagucauauuguuauuuaaacacacacacacaaagaauagaaaguugaauuuauuuugggaaaaauaaguuauuugaguauaagaauuuuagaguccuuuuuaaaaaaaagagucuggaacccaagggaguauuauagacaacacgaaaggcaaugugguaaaaauagaaauggggagcguuauaggcagcacaaggagugugggugaaaauagauaugcauguuggaauuggcuugguaaagaguucagggcuucaggaaagaacuuaaauagugcuuuagagaaaaaugguuuaacuuagauuuuguauguguuuaggacagugaaaagaggaugcuucuuuuuuuguuuguuugugguuuuuuuuuuuuuuuuuuuuuuuaaagauguauuuauuauuuaguauauguaaguacacuguagcugucuucagacacuccagaagagguagucagaucucguuacggaugguugugagccaccaugugguugcugggauuugaacuccggaccuucggaagagcagucgggugcucuuaacugcugagccaucucaccagcccugugguuuuuuuuuuguuuguuuguuuugagacaggguuucucugugaagcccuggcuguccuggaacucacuuuguagaccaggcuggccuugaacucagaaaucugccugccucugccucccaagugcugggauuaaaggugugcgccaccacugcccggcaagaggauacuacuucuuauaauuacuugucuggaagauguguccauugaacaucuugacaagguugcagugcaaucagguuaccacacugagugucuagcaaggcaguuagcguucggugugugucacagccuacuuaacagcuguuuaaauggaucugaagcauauuugugguugcaugguaucaugugaagcaaauauuuauagaacuaaagacuaaaguccauugacaaaauaggauuuuuccaagaaguaggccauggcucucuccuuucauuguauccuuucuagaucaccacacacugggacaaggggaguuuuagagaggaagggcugucuuuaggauaggugauguuucuuaaaauaucaauaauguucauuguaaaaaucuuuucaaaaaguaaagugauugucaucucacacggugaaacagguacuauugauauuuugcuauacauuucauuuuguaaauaaauuauuuuuauagauuuuagaauauuauaucaacauuguagcaauauguagcauuaaaaauguauaguuggacuggagcuauugcucugugguuaggagcauacacugcuauuccagaggacuuccacuggauuccaaacccccuugucagguuucacaacugcuuguaacuccagcuucaggagaucugaugacucuuguagucuuguccacagacucccuacaauuuaaauuuuuuaaauuaaaaaaaaaacuuuaguguauauaucugaaccuauaacauauggauauacuguaauuauccauuuugcuauuauugaacacugagguuguuuauggcuauuuuauuuguucuguaaauaaugguagaaggcuuacuuacuuguuuuguugcaaauugaggguagugaauagacuuuuuguguaguguuuauccaggaucuaauguuucguuuguaaacuagucuuaaaaauacaucugagagcugaugagauacucaguugauaaguacuuaucucucaagcgugaagaccugauucaggagcguguccuuuuuaauagaggauaguuugucaaaaaaaucaaaauuuuacaaggcuauuuauuguuuucaugcauaagaaucacacuggcucaacagauuuaagucauucaacaaguguuauugagugcuucauuaugucauaggcaccauuuugagcacugggacuguaaaacaacaaaaagcuuugcuauuaauagacaaugacaauaaacaacuuaaaacgaugucuauuuaaguaaguaccucuguacaaugacgguuaaaagaaugauaauuuuggaaagaugggaaaugaaggaaccaagcggaggcuauaacuuauucaaaggggacucuuuaggacaggugugcauacaaguuaggaacauugaaauaagugugcaaauugaggcacaaccaacuucuuccguggcaucggaaggaaagucagagaugcuggacagcacagaccucgccugacaguagacaggacauuuucugcguuguggucaguuaccugcaguguggacuuauggaccaaucuccauggugcuggggacagggagccaagaugguacucuccuggaagugcauuuuauuccauugaaguagaaauguuuuccuuuaaauuucuaaauuaagaagcauuaguuugaaauuguaaagaggaauacagagcugaaguauguuugaaagaauauauaguaauauacuuuuacuuuuaaaaaaaaacuuuacaucugucuauucuuuccuuugaagacaauuuuuaauuuaguugugaaaaucacaguacugacuggaaagcaaaguggcgaagcgcuaaugacaauuucaguaggagggccagggaggacuuccucaggaagugacgguugagacuagaguagagcaggccccuccuccacuucaagccccugauugccuuugccauuuuccugaagaucagauggaguugaagacagggaaagucaagaguaccaucucagcuuuagccauuagacacugaaguagagaugcugcauuugggggagaguugugagcaggaggcaaacaccauauacaaauuacuugcauaaguguuacuuaaauuccguaaagcagauguguucagcaaaaccaagaacccccgagcuccuucagugugccugggauugugccauucgcuuuuguccgagaaguccaugguugacagggaggcaaauguagacaguuacuaggauaagcuaugcuaacacaaacaugcaccugugcaaaugauucggcaacgccaagucugaugucauucugccucuuacugugcuccaucacguucucagcagcauccacgaaacauguacagaaaucuguccaacuguggaaacuuuuaauagugacugacucuccauuugauuccuagaauuguguguguuaggggagcacuuuauuugucccugucauuggcuaggagcacgugacuaauguagcuuagaugcaaagguaguccuacuugagccaauagcauuggaggcugacacaguuagcugaacauguacuguuuuucccuccccacccaagggggaaggacugucagccuucccugaucuuaaaauaaaguuguaccauacaauuguuauuagaauuaaaugggaauuaaacauuuuuauauaauaauugugcacauuuuaaguauucgauaagcagguaacaaaaaggaaaaaaauaaacaaaaguauaaugagcuuuacaagacaggaagacugcuuaccaagagagaggcuggaguucacauuugguuguuuguuuuguuuuucuuuauguggauggguguuuugucugcagagcaccaggugcaugcagugucugugaggagagcaucggagcucuccggaacuggaguuucagagcugucauguggugcugagaauggaacccagguccucugggagagcagccagugcuguuaacugcugacuugaaaguuugaggcaggaggaucacaaguucaaagccagucuggacuaacauaauuaggcugugcgugcgugugugcaugcuugugugcguguguguuuucuagaggcugaacucaggaucucauauaugcuaggcaaacauuuuagugcugaacuguaucauuuuugcuuuuuauuuuugagauggggucuuacuaaauugccuaagccuugaauuuauuuuauaguccagauagcccuugaacuuccugaguaggccuaugauuauaggccugugugaacauguaugaugagcuucuagcuugaaaaacaaacaaacaaaaaaugaaguauguuucucugugccuauuaagucugaaucccaguugaguggucuggaacuggcauauuaaaggcuuuuaccuugcgcucacgcuauuuucucaaacugcugccuaucaugugcagcugaugaguuuucauuugggcuguccacuuccuucucagggugggacuagaagcuuguacccugugaaggcuauucuuuuuuguguguacaggaccucuaugugagucagcuuuuguuuaugugacagauauuuuaagauaaucagauuacuacaugcaaagcuuuauagugucagagauuucaggucauagcuuuuuggcucuuuugccuggagccagagcauauggcagcagaggccuguuauucucauauauucucaugccuuugggguguaagguggagagagagguagagggagagggagagagaagagagaagagagagaagagagaagaaagagaagagggagagagagucagucagucagucugucugucgguguauuuugagagcuguuuccccuuucaugcugcuucccucaaagccaggcccagugaggcauaccuguccuucaggaaggaggcuaagucaggacugcaguaagaccugucucaaaggauucuguucaugugguaauauguucuccuuucuaaucaaggaauauucucauauauucucuuuuucuauccuuccuucccucccucccuuccucccucucauauucagcuuuugagagaacugaagcacccuaaugugaucgcauugcagaagguguuccuuucucacagcgacaggaagguguggcugcuguuugacuaugcagaacaugaccuuuggguaaguuugaccuccuguuguccuucuauagauauggggcaaguaugcaagcagaauguacuacuaaugcacugagaagaaagccuacuauaacucacaguucagagcaaccguaguaaacguugguuuuaaagaugagcacuaaguuuauagaaaugaugauaucuguaauauuuagaaguaagagaucucgugcacucagcuaaagacaguuugguaaugugugugguaaacacugguuccuuuccugaggugcacacacauuuaaucaagcauauacuugugaguaguuaaguucaaguugauuucuuaccguguuuuguuauuuaaaacuuugguauuuaauaccaaguagaaguauguauauaguuuuuagaaugccuuaucaauacauaaaaaagccaauuccuaacuagagcauuuuaaacauuuuugucucuaaaauuacuaaacaaacaaaccaaccaaccaaauuugacaguuaaauuauggauaaaugugguucccuauguuguaguuugccuucuauauaagugaaaagaucugaguaagaauaacuuugacaggcuuauaagguccugaaugaaccuugaaaguucauuagagagccaguuacugugagcuguuucuggucucuacgugugcuugguaguccaugcaugugugcacacaaaugaaaacauacacauuuacacacacauacguacaugcacgcacacacaaaaaccacauaaguaaaauaggauagguuuuuuuuuuuuuugaauuauuuuguucaucauuagcacuuagauguggaaauaggagaaucaagaauuaaaggucauccuuggauauauauaaugaguuugaaguuacucugggcuaaccugaggcccuaucccaaaacaaaagugguguuuuuuuuuucuuuucuucauuuuucuuauuucuccuuuauuucuacaaagguuucuugacaauguauauagcucacuuuaaacagaaguauaugggcugaugcuguggcccagagugguucagaguaucggcuguucuucauaggaccuggaugggauuugagaguaggcauaggcugggaaauuagacacggccuguagccuuuuccucccuggcauuacaguauuucauaacccacauucaccacgugacauaaagugugagaguugguaugguuccuacuuuccuuuauacggcucuucauagaaugcugaccugcaggggcagccccgggaggaggcgugcuuuccagcagugcagagaugccuucugucugaugcuaucucaacacacugacuuuuuacacacuacuugccagccucuuccucccgcccgcccgcccacccguccucagcagaccaccaucgacacguucuuaggcaucugaauacccacccuucuuaccacuuagaggugauuuacugacagcucugaaugcuuucaguaaaucugauuauagacccauauuaacauggccacauucaucccaaaauacaguuuuuuggauaaccuuauuauucagaaauuuuuguuucauuaacuuuaaaagguaaguguaaaauacagagcauuuauuucaguuuucauuauggugggauuuugguggagauaugagcagacuauauuauuauaguauguuuuaauuuuuaaauuucagcauauuauuaaguuucaccgugcaucaaaagcaaauaaaaagcccaugcaguuaccaagauccaugguuaaaucacugcuguaccagauccucgauggcauccauuaccuccacgcaaacugggugcuccacagggaccugguaagcacuuugcuuuaauuuaugaacauauauuuucuuucucaaauuuaacaaaaucauucauuuugguacaauuagaacauuagcuaagaaaacauuguaaauacaugcaaaaggagagauuaaaaagucacuuauaaccuacaaucaaaagacugggagcugacgaagugucggcucccaucuguaaucucagcacuugagaaacugugguaggaggauugccaugaguucaaggauagccuaggcaaauagcgaaggugccuuccccaacuccuuaaaccuucccucccuccccuuacucccucccuuccucccugucucccccccuucucaccucccucccucccuccuuccccuuuuacaccuuacaaagugcaguaaugcauaccaguuacucagacaguaagauaauuuacaaccagccugagcuacauagcaaagaccuguuucaauaaaaaaacaaacaaacuagcuuaucuugaaacauuuggucucuaauuauuucuuuaaaucaaugcauggcuguaaacuaucagugugacuuuuaacauuaguaguguauaauuuuaaugcucagucaauauguaaagcuguuggacuucacuucaacuuguucuauauauaaaagcacuaauaaugaaaguugaguucuaauuuuucauccccucaggcuuaaauaaugacauugccucugguaaaacacaccuauuagacagauuagccacaaugcaaaugucuggucuuauauuuuaauuugguauauguauaauaaacauuuacuaauaauugacuuauaugcuaaguacucacuugauuugcagguuagauuguuauuuuuuauuuauuauaaacauaagaguauaggacagugguaauccugguaccuuuaucuuugcagguauuaucuuaccccacauaauucgauaauacuuuauuucauuagguuuuugugauuuuagauccagaaaugauaggggcuaguguagguagauugcagcucuguuagcugaggagaguuaugcugcagaaauagugagugcaugaagagcgggcggugacuaucccuugucagucagacuggaaucugcccaggacacuuccuguuguggcauuggaguugaaugauagugaccacaagucagucauuuaccagcaagauuuugcugacaggacacugacauagcugucucuugugaggcuauuccaguggcuggcaaauacagaaguggaugcucacagucaucuauuggauggaacacagggcccccaauggaggagcuagagaaaguacccaaggagcuaaaggggucugcaacccuauagguggaacaacaauaugaacuaaccaguaccccuugaccuccugucucuagcugcauauguagcagaagauggccuagucggccaucauugggaggagaggcccuuggucuugcaaagaucauauaugccccaguauaggggaauuccagggccaggaagugggaguggguugguaggggaacaaggcaggggaggguauaggggacuuuugggauagcauuugaauuguaaaugaagaaaauaucuaauaaaagauucaaauugaaaaaaaagaaacuucgauuuaaaaaaaaauaaggauuaugaagaucuuuaagucuccuagcauccaguucuguauuuaccaugaguuaauuaccacauucugaaugcuucagagacacgugagguuguucuggagugaccggccacguggucagcauuuagaucgcuguuuucaagguuccagucacaucugaaucauuagugagaaucuuuuauucaggguugguuugaguguucaucuuguuuuacagaguuacuguuuuguucucaguggaauaguuuucugacaguccauggacacuaaucaguauaacuaggacuccgauuuucuuguuuauuugcugucugucugcaguguccucucucuugguuacagcaccagccuccucuuggcauccagacuuuuggccuuuuuuguaguuuacaucuagaacacggcauugucaaauuuauauucucucuucuucucagcuguuuuuacccccuguaaccucuuccuuguucaggccuuuauuccaucugucuuuuaucauguuacagcuucuaaaugugucuacuacauuaacuccuuuaacagucuuucuccuuccaguccauguagaccugguaaccauguauuagccuuucaggaacuuuggcauaaguacaguuuucaggaucuuacugaauauagcucuacugacuucagacacuccccugaccccaucccuuucugcuugccuucuacuauugguuauuccuacauuguccugagauuucuugccuuaauggcuugcauuuccuugucuuauucuuguccuugucucuccauacucagaugugcuugucuuucgaggcucuguagcaguauuuaaaacuuagcucuggagccaccucagcaguuaagcacuggccgcucuugccaaggacccggguuucauucccagcacccacauggcagcucacaacugucgaucacuccagccccaggggagcugaugcugucuccuggccuccacgggcacaaacaaacgugcacaaaaauguaugaauaaauauaguaaaauuaaaugaacaugaauaaauauaauaaacugaaauacauuuuuaaaaauuaaagcuuuuuaaaaauauuccaacucaauuuugagaugaaauuuuguuauacauucuuguuauauuucauguucuuuugugguauuguuuauaucauguagaugccuuagaucagugguuauaaaccuguggguugcaaccccuuuggagguugaacagccuuucacaggagucgcauaaggccaucagaaaacauacuuacaucauaauucauaacaauagcaaaauuacaguuaugaaguagccauaaaaaugauuuuaugguuggggucaccacaacaugaggaacuguggcucacacgccuuuaaucccagcacuuaggaggcagaggcaggcagauuucugaguucaaggccagccuggucuacagagugaguuccaggacagccagggcuacacagagaaacccuaucuugaaaaaccaaaaaaaaggaagguugagaaccacugucuuagaucaucucccagacuacggacuaacauuuuugaaaaggcagggguuugauccuucuuauauacaguaaauauuguagaaauagcagaauuugaaacacuguccuccaugaacuuuuagugugugugugugugugugcgcgugcgcuuguacauaagagaaaaaugggaaugauacaggugcaccuguaucagaggcccucaaaggagguggggacuaagaggagcgucaggaccuaccugugcaccaacagauuuaacccagggaauaggaugguagguccuccaggugcauacucagggcugcgauucaagccaagaagaucucuguguguggugcaaggggggggggggugcgguggggggaggcgaggcuugaccuggacuuugacacagaauuuaaaaacuuaaggagggaaggaaugcugguuauaaaaaaauugaaauaagaaauuguaaggugagaaggcacuuauauuaucucagaaaggacauggauucugccuggcucaaguaggaguaaaugguguaauguaaagaaaaacaaaaauacucggguuacagcugggucuggaguuuauucagaggguugguuuguuuuaagauccugaaacuuugugaucaaaagaauggauucuucccugauuacaaaauguuuuuuuuuguccauagggugagcccaaguguuuucaggaguaggauauuuaauccauacauuuacauugucacaguggagaaauggaaaguguauaacauaaggguuuguuuuuuaaaaggagauggagauauaugaaauugauuguagugggcugaagacuagcgcuauucuaugagacucuggagagcuuuuaacugcgccguuucccuuugcuuuagaccauuugugagucacaacugugucuuuguacuuacugucucuagcugaugauuucauaggaaaucaugcaaguacauuaugagaaaaaauauaaacuugcugcuugauaauauaaagaacggaaauugagaguagcuaaaagcuaagguucuagaguucauauacagaaucauuaaucuucaaaaugauuuuuuuaaauuuauuuauuauuauacauaacuacacuguagcugacuucagacacaccagaagagggcaucagaucuccuuacgggugguugugagccagccaccauaugguugcugggauuugaacucaggaccuucagaagagcagucagugcucuuaccugcugagccauuucaccagccccucaaaaugauuuuuuaaacugugauuuuuuucaugucuggaacaguauuucagguauaugauuuagauccuagaaugucauacaaaagcagagaauuuuaagccacuuaaaagauuauuugggucgaggaauuggcuuuaaaaggaaaggcgaaagagcuaaauguauuucucuuggcugagagacaaugaaggagaggcguaagucuauaaauauugaacguguaaacagagagugagcuguaucuuagguucagcaggcaggcuacaucgcagaggaagaugaugaggugccgggugacugugcucaugggauugccgcucgggcuggggagggccaggauggagcuggcagccuuuaguuagcaguggugagcuuccuagagcagagugcacaccucacugccccugcccugcugcugccucaauguguguguucguaagcacgugagaagguugucugcaggcagagcaugugacacuuaacacagacagagccaugcuggccgacagcagcaccaaguagguccacugguccucaguuuuagcgcauuacucccaggucugcgccaugugugaccuacaguuagacugucuuuccucucucauaugcuagagcccagcaccugcucagcucugggcuuuacugagugaagacgggagcgaaugcucgggccuggccuggcucuucucuuucagacaguauuugugcaaguucuguccuacaaguucaacuugcacuaugagguguugguuuuuugucuuuuguuuuauauuagugagcugaauuuauauuuguuuaaaguucagaggggcucuagagacggcucagguugaguguuuugcugcauuuguagaggaccagguuaaguuccuagcacccagauggcugcucccaaccauuuguaauucaaguuccagaucuacacuuuuucuggugccucgggcuccacacauacauguggugcacacacauacauguagacaaaacgugcauacagauaaaaaguaaauuaaucucuguaaauaaaaaguagaggauagcaguuucuaagcuagccauuagacuuccauucccuuuccuguguauggaggucuuggaguuuaugcaguuggcucccuaccuuaacacugaacuucugaaauccuccugccagcccuuccagaggcccucuggacaguccucauuaauucaccagcgcuccagacgugccuuccuccccagcauuccuucagccugacccucuuuguagccucucugcuuaagcagagcucagauguguggggaucauccuuccugguuucuaaaggguuaaacgccaguccauguguccuggagaguacaucugaauacuacaaauauuucaccaagucuuaauauuuaaaauauggaaauuuuaaaaaguuaacuaacaucaaaccuaguaagugcuuugaacagcuuaguuuucauucuucccucuuaaaugagauauuacugagaggcucuagaggcaagaaugcuaugcuagucagaugacuuucuauugucauuugauuuauuaauuguaguuagagagaguuacuacagaagauaguacuuaucugaauggacuuaacuggucugcaauguuuuaaaugucaucuugccagggcagggcugugaggcaguagggcagggcucuaagcugacaauagugaagaaagcuaugcaugcccuguggcuaacugccugaguuccugcacugacuucccuaagaugaugaguagacugaccugauuagaaagccaggcaaaccuuuucuuuccgguugcuuuaguuagguuguuugucccaacaacagaaacaaaaccagagcacauacugauaaacaaaaaaacaagaauggcagagcucugucugcagaggaaguuuccauaauccccaggaaggauuaagcuugauagugugaaugggccuggggccuugauuggccuugagguggaggggagcgagcucuagacagagcagugugggauagggagaaguaaacauggucaggccuuaaagggaaggagaggcuuccuggagaagaccuugguuaggaguaagaaugagaaaaguguguggggugacuugggagaagggaggaggcagcaccagccagccagccgcgagccgggaggggacacuugugcuggugaauuuuuugccaacuugacacagguagaguaaucaucugagaagugggagccucgaaagagaaagcaccuccaaaagauagggcuguaggcaagccuuucuggcauuuucuuaauuagugauagacguggaagggcccagcccacuggugcagugccgcaccugggcaggugacccugggcgcuauaagaaagcaagcugagcaggcugaagggagcaagccaguaagucacacucuuccauggccucugcuccaguuccugcuuugaguuccugcuuugaguuccugcucagaccucccucagugacuuugaguaugaucugagcuagaguuacaagaugaaauaaagcuuuuccacucuaaguuguuuguagccaaggugcuuuaucuagguaauaggaacccuaagaaaguugguaguggggguggggauggggagggguuaauccaggcgguguacaugugcacauuugcacacacacaaagacacauaaacaaaaauaaaaauagcuacaaagagaaaagcagacaaaaccaaaggccauagacaggagcaggagccuuaagguuuugaaggaggcugguuauauuaacacuaaacuagccaucaaucuugauggcaaaauuuauauaaaaugcuauuuccacuuuaauuacaaguugauaaguugugauaaaugguuacccagguggucaccaguacuggcaguguucagaucucuuauugagcacucagggaucucucacguaagacugacacacuuugcuuucuucaggucacgggugacgguucuauuguccucugagcguacauugacuuguagaggcaaggaacugagucagugugccuagagauugccagagcuggccuggggagagucugcgggaggccugaguguucaguuagagagagcucaguuugccgcuguucucugauacgcuuuauuucuuuuauaaugagaaugaacaagacacacagauaaaaauuaaacuaaauaaaaaguaaaagaggaagaagcaagcccguagauggggcuuuggacugugagggcugugacuaacccuggaacagagacauuguuuuucuaaguuaauuuuauuugaaugagugucauagaugcaaauagaaaacuuuuuuguuguugcuucugugggauguauuucuuaaugcugaaccugaaugccggugcgguguuauugcugcugcugauagcagugugcaguauaguuuuauuuucuccucuggacuuugaaguguauuagguaaauagccuuccagauacaugcacuucuuuugcaccgagcuuuuuuuuaaauguugcuuuuuuuauugguucuuguuagagaagagaaaaccauauccugcuguucaggccuacgaucacuucugaauagcagacaaagaaguccauuguuaaugcuggcagugcuaggcuggcaggcauuguugaaugugaguacuaggucggauuaacauaacugauauauuacagauaagaccagccugguuuuaagguaaaaugaaacuagucauguacuuagaauuacacguuucuaauuuacacauagcuuacaucaccuauagacacaaaacguaaaagggaagacuuucuugccuacagauacauuagaaauacauuuucaauaauggcuaggugcuccagauaaagaagccuuuuacccuacaaugugccuaauauguacuagacacuguucugagcacuugggaauguaagaaucaauaacacauaaccuuucccucauuggauccauuguggggaaauuuauacacagguagucauaaaaaugcuuuaaaagaaacuacaggguaggguuguaguucacagagaacucuuaccuagccaugagcaacaaggcucucauuccuaauacucaagugcucucccuuuccuucucccucucccucauacccagacacacucagacacacacacaaacccagacacauacacccccccccccacacacacacacaccauucaaggacuagcucagcguacaguacugagaacacggaaguggagccuaagcagcugggugagggccuuggaacacugcacauaagcucauauggugaaagcagugggucucggagcauugcaggcagaagaaauggcaccaauaaagauguagacuaagaaacuaccgacagguugguaucacugcaaaagagaaaaggcaaaaaagcaaggaagaccaguuaugguggauccuaauuguugucuuuaaaauauggguuuuccuaggccagucaaguuuuuaagcgagauggcucaggguuauggagcugguauggacucauaggcagcagcucuaucaaguagcuguagucagcuggugagaaaacaugaagcucugagcaagcugaugaguaaaaagaggaggaaaggccauugugaauacuuaguucuuaagaagcagaggagcaaugacuagauucaaggacagggccaaggucagacuucugcuuuuguugacccaggaauacuaggaaaagacaguuuuguuagggagaaggaaaaauuaaucuuagauggaaggaguuuaugguacuugugaauaugaucuauuucuaagauaacaugggagauuagagaccuaguagucuuaauuuggggaucauuaguguacaugugguuuuuggaaccccggaauaaaauccaaaauuuuaaaacauaucagaaauaaucuuaguauauuuuaggguguucauucaucucuugauacuucuauuaaaauugggauguuacccaucaaaggacacuuguaccuaaccccauaacuagguagauugugaguguucaccauugggaacguacuucauauuuuguuccauagccgacuaguguauggcagggcucuguucucuaaugucuagaagcgugaagucgcauucuugcauuucgcaccucugccuuucccaucccucuuccccacuccuuucccuuuggcuuuuuguuugcuggcuuguuugcuuguuuugcuuuguuuuuagguagccuuagcuaucugggaauucauagaguuauauuugccucugcuucucaagugcugauauuaagggaguauuccaccauguccagcaaucucuauuuauucguuuguuuguuuguuuggagauuggcucucguuuccuagacuagccuugaauuugcuaaguaaccaagaaagacuuugaacccugcauccacuucccaaaugcugggauuacugguuuagucacugugccuugcuguauuuuuaaaugcucagcuauccaauuaaugaaguuuuuuaugguauagauaauuacgguagaguaaugucugcaaaugacuacucuguuuguucaagaaaagaaagcacagugcuuccuguuggguaguuauuuguucuguagcacagaaucuuauuuguucaggggaacaaugaagaacagugugcaaaauaaauauccugggauuugacuucuguaucaaaugugaggggaauuguaccacacuguauuuaaaugaaagcauaguuguagccauuaauaucaggccagcauuguccauuguuacagcaacuaacccaacuuaacucugagucccugucccuaccauucaagacugggucacucgugugucugcuguuggucuuuggugcuguuaagagucauacugagauucccagauaugcugaaguagggagugcaaagcaaacggaguagaauguuuguggauugcugugguuguucuauuuaugauaaaccaauuagcugaaggaaauuuaacccugcgaaauaauugauccuauaaacagaaaagcagaucaggaguacauauaaaguauccuguguaggauuaagaauuacuaaauucuguagaaauaugaauauuaaaggacuagcccuguauaaucaugcuacuguugcauauuuucaugacuugccuuuagaauagaauuuaacuaaaacccuguagcuuugauuuuugucuguuugauuuuauugcugauaacuugaggcauccagcuucugccauuucugccguuucuauggcaacuaaagugugcaagcccagcaguaucacuuucuuucacagcuggcauuuuguguucacaguaaggagaagaguuuuggugaagcgugcgggucugugcuaauugggauguaacugggucagaacaauuuugguuugcuuuuuuugucuguuaagguuuguggugguuguguuagguuuggguauugaauaccucaauuccuuuuuauuauuaauuuauuaauaguaguauguaaauaaaaauauauuaauuauuaaaguuagucuguuaauaauuaaaaacucagagacacaauccaguaugaaaucuugagaaugggauagaguuguucuaagccugguuucguagcccucuauacccugauuauuucuaucuuuaaaaagugugaaaaaauucucugaagaguuaaccauauuuuaccaguggauggccauauuugcuuguucugaggggacagcaggcaaucccacuuaaggaugaacaaugacuggguaauuguaguuauugccaccugaaggccacccugggagugcugcucaggcucugcauuccuuucuuggcuuguacaagaauugguaggacgccccugcuccaggccagcuacugccccugccuucaugucagccagcacaugguucaugggcuuugaguaugcggucacaaggacacccuggagccuccugcucuucccugcaggcucauuucaugguggugccagcacuguuuuucaacauaaccugaccacaagaacuccuaaugagcuaaguggcacaagccuauuuccuguccuuacauuuuauuuauucuaugaagcuauuugucguucccaggucacagacuuuguuguacuuauaucuuagaauuuuaaagugcuuuaaaaaucucagaccuuaggaguuacaaguguuaugggaaagaguaugcaaaauagcuuguacaauaggaugauguuacaguguaagcaucaugaccugucagagguucucacuuacggccuucagaggcuuccuuugaguuugccuuugucuucuuuacacuaacuuguuuauuuaggacaccuuggcuucuguaauugaagaaaaacuacuuuuacugggccaccagugaccuacucauucauucuggucauguccucagauuucuuguuuacaucugacaggcacgcagaggggcucugugcacucuagaugcucgcucaucuuuucuccucugaccuuucuccagcuuccugccuccccuccucucaagcucccugcucaccugcaccucuguggcagcccucugccacucuggaaauacagacucaagaauguggccaguuuuuguuacucaaagagcuugugcuaaaaaguggaaccacuugaaacaggaaacaaagccuuccuugguuuccuuuuuauacuggccauccuucuagucugccuuguaaccgccuugcuucuucagaucuuguagcucaccaggaacguguuugccugggauacucacguugcucuuuuucucccuagaugccccuucccugagauagccaggugucacgcucccuccugcacugccuucagaucuuauaccaaaugcuaccuccucaaaggggcuuucucuguagaguauaaaauaaugcuuaaacccuugaagacaaugccuuucaaucccauuccuuguuuucuugguugucccaucaucuuaauaggcacaugcaaaaauguuugcuauauuuauguaugcuagacccauaaaaauaccaugaccuaagaaccuuccacuuagcaaguggagagugcuugcuuuguuuucucccuguccuaggaucuuccucuuccuacgacuuagcagauggccuagauuuugaaacauuuauucucuucagucuaaaaauagguuuagcuuacugcgcguaagcuuaaauaccacauuuaucucugcuuggguuuaagcuauaugaaauaguguccuguuacaaguaucauuuaagacuuucuuuuuucaugcaguauaauacuuccaauauuaacagugcauuaauugauaugucaauaauuuucuuaaaaugaagaacugcaucacaaacauucucugguaugauguaaaagugaaauuauggauucaaagugauucacuuacucacuuuugcaagauuaugccaaauuauuuuccaaacacauugugucagugcauucccagucgacuggacggaguuagcacggcugcgcuucuguugcucagguguguuuuuggaaggauaaaaaggauagaggauaaaaaggauagaggauggggcuggugagauggcucagcauguaagagcacccgacugcucuuccgaagguccagaguucaaaucccagcaaccacaugguggcucacaaccauccguaacgagaucugacuaccucuucuggagugucugaagacagcuacaguguacuuauguauaauaaauaauaaaucuuaaaaaauaaauaaauaaaauuaaaaaaaaaaaggauagaggauaaaaagccaccucagugcuccugcugacuuagggcaacaucuuuccauuuguuuuuuauuaaaauagauuuuuuugcuauaguuucaugucaaaauuuuuuuuucuauuuuucaguugacuuuucauuuugacuucuagaagguaucuuauaaauaguuacccuguuuguguugaggacuuaauuuucuuugguuuugaugauuugagauuuucuuaauguagcaaaauuuaucagucuuuuguguuaaaaaauuuuaaugucuucauaaagaaauuugcucagggauggagagauugcucaguagucagccguugcuucucuugcaaaggaccuaaguuugguuccuaguacccacauuggguagcucacagccuccuccaacuacagcucaagcgggucugacaucuucuugcuucuguagacacuguauucgugugcacagacacacccacacgcacacaguuaagaauaaaguaaaaagaaaccuacaccaaaugucauaauguacccgcugaggcaggugcguccugaaucugaaaccaauuugaguuagaugaguuauaggccagcugggcucuguagaaaguucuuguuuuaaagaaagagagagagagagaaagggaaagggaaagggaaaaaagaaaggaaaggaaaaaggaaaggaagggaaauuuuuuuguauuuuuuauucaaacuuuuggccuuuauuuacauuuuauuacucuugaaauugaagugugugugugugugugugugugugugugugugugugugugugugugaugagggaaggacucauuuuauuuuuuuccaucuuugggugacccuuuccuucaucauuuuuuaauaguuucuccacugacuucaaguucauauuuugguccugggugguuuucauuuuuguauagcuucuccuuuucccuugaaugcuuuagaaguguuuuuuaaguuuccaaauaugugauauuuuggcuuauguuuucauaauugaccuuaaaaguguguguguguguguaugcuuggauauaugcacucucaucauaagcuggugcgugugcccucggaggccagaagugggcaucagacucucuggagcuaguugcaaguuggcugacauggguucugggaacugaacacccuagaagagugacaagcacuuugaacugcugggccaugucuauguuauauauugugagcgugucuuuguaggauuccaugagcaugaagugauuacgcuugucuguuaauauccuagccaucuuuacuaaaguuaccuuccuaaauauuguccugauagucaccaaaaagaguuauuauucccucugcaguuuaauacucuauucuaaaccucucuccaucuucuauacuugauuuaagcuccuuagaaauugaaguugucacauauuuccuuuugauuccugaaagucuuuuuuuuuuuuuucucuucuuuuuauuagguauuuuccucguuuacauuuccaaugcuaucccaaaggucccccauacccacccccaguccccuacccacccacucccccuuuuuggcccuggcguuccccuguauuggggcauauaaaauuugcaaguccaaagggccucucuuuccagugauggcugacuaggccaucuuuugauacauaugcagcuagagacaagagcuccgggguacugguuaguucauauuguuguuccaccuauaggguugcaguucccuuuagcuccuuggguacuuucucuagcuccuccauugggggcccugugauccauccaauagcugacugugagcauccacuucuguguuuucuaggcccuggcauagucucacaagagacagcuauaucugaguccuuucagcaaaaucuugcuaguguaugcaauggugucagcguuuggaagcugauuaugggauggaucccuggauauggcaaucacuagaugguccauccuuucgucucagcuccaaauuuugucucuguaacuccuuccauggguguuuuguucccauuucuaagaaggggcaaaguguccacacuuuggucuucauucuucuugaguuucaugcguuuagcaaauuguaucuuauaucuuggguauccuaaguuucugggcuaguagcugucuuuagacacacaccagaagagggcaucaauccuauuacauaugguugugagccaccaugugguugcugggaauugaacucaggaccucuggaagagcagucagugcucuuaaccacugagccaucucuccagcccgaaagucuauuuuguaauggacccaguuaucaaccauuugguaguuagcaaccuugaauuguacagguugggcuuuuccccgugcuguuguguacccauucuggccuggccuucuccuugguuugguugucacacuccucuggcagcgcacccugcucccauucuguugucuaguguggcuugacgucucauguuaccaucuccugcucuguugcccuuucauaguuuucaagcucuauaaaagacacagucauuccugucacaugaagccagagucucagugugaucuuugucaugguuucugguuuuguuuucucucagucacaaagcccuguaaacuuacuuuucuaaacuguucucagccccaccagucccuccaugcuuccuuaucucuucacagcagcucugcucucugcuuccuguucucacugccugcaguguagcggucagacugcuucacugggccuuuaagguugcuggccugaaccuucuccucaaggcagacuuguccccgucuccugggcacaccucuucgcagcuuugcuccccugcccccuucugucuguuaucuuucaggaucuagguaaugauucuguccccacccucaccucaguaggcauagcccuuaauaaaguacuagucacuucacgugaaggcuuguuuucauggaaguauucucuuaaaacaaaaaucagcaacauggacaccaucuugggggaaggggagacagccagagagauugucucaaaagaccccucaaaaggaaacucacugccugucuguccgucugucuacucugaguaaaugaguuauauacauuucccuccagguucucagaggagaugggcucaccccccaucuguugccuuaaucugucuccacacacuugcagaggaaggcggugugagaggcuugcagcuccugcagcuccugcagcuccugcagcuccugcagcuccugcagcuuaugcuuuauggggcacuccauuggccuggacucuuacuguccuacauuuuuaauuuguauuuggaguuuguuuguuucucucucucucucucucucucucucucucucucucucucucuuucuuucuccuccuccuccuccuccuccuccuccuccuccuccuccucuccuccuccucuccucucuccuccuccuuccuuccuccuccuccuccuccuccuccucuuccuccuccuccuccuucuucuccuccuccuccuccuccuccuccuccuccuccuucuucuucuucuccuccuccuccuccuccuccuccuccuccuccuccuccuccucuuccuccuccuccuccuccuccuccuccuccuccuccuucuucuaauucuucuucuucuucuucuucuuccccuccuccuccuccuucuccuccuccuccuccuccuccuccuccuccuucuucuucuucuucuucuucuucuccuccuccuccuccuccuccuccuccuccuccuccuucuucuccuccuccuccuccuccuccuccucuuccuccuccuccuccuucuccuccuucuccuucuuucuccuccuucuuucuccuuccuuccuucuccuuccuucuucuuucuccuuccuucuucuuucuccuucuccuccuucuccuuccuccuucuuuucuucuuccuuccuuccuuccuuccuuccuuccuuccuuccuuccuucuccuccucuuccuccuccuccuccuucuauuuugaaagauuggaaagauuuaauaucaacuaucuuaggcguauuuguaguuuuucuuuuccuuuuuucuuccuuuccagauguguguguguguguguguguguguguuguuuugucuuuuugacacaggguuuuucuguacaacucuggcuguccuggaacucacucuguauguaggccaggcuggccuugaacucagagauccuucugccucugccucccgagugcugggagugugccaccacugccaggccauauuuggaguugcuuacuuuuccuuuuauuguaauugaugugaauucuaauugagucuauccauauuggugguguuuuugugaugcaguccaaaaauacuuagcaaggauacucauuugguugacuuaagugagaguaguuauauugugguuugaaaauuucacauuaaaaauaaguauauuugaguggugcagguuuuuaaguuaggggacaaauauaaaugauaauuucaauuacuuuguaauuauuuauaugauacaacuuugaaaauaaguauguuucccuagcaaaaaaauguuuauaugaauuuagugcuaaugucaagaauaucaaaugcuuuaacuguaaaaaguacuuaaucuuuaauuaguuuagacugaaugaaaauacauaaaaauuauauuuucacaugaaaaaauuuccauuuuggagcaugucaaaaggauaaaguaauaauuugaaugcucuauuuuuauuucuagaaaccagcaaauauccuaguaaugggagaagguccugaaagggggagagucaaaauagguagguaacuauuccugagagaaccgaugaagaaacggagugacuucuaauauguuuuccuuuuuaaugcccucauuaaguugccgauuuuaaaauuacuuucuccauauuuguagaaaagauguuggaaaauguagguagccuguaaagccacccauucuccacaguccuuuccucaaaauaagauccugucauugcagacugacguaccccauggacauuugcucacuuacaguaugccuagugcguguuaugucaccacuacucuccagcauaacacccagcuuauaccguuguuucucuagcuugccaguauccuguucccaaguacaucgcccuaacccugacuuaaugacagcaccuccuaucugcagugugccuuugcccagacacuagcacaccugugacaugaaugcuuguagcaccucacacucacacucagcugggcuccaucaccucaggugggaagggauucggggaaacuucauagcuguuggaacagggaugcugaggugauacaaauggugcugucacugggacagaguccaccccuugcugaggcagccuguccaucuguccugcugcuugcuucccacuucuucauccucuucccaguuccagaagcugcucuaaccuaauaacccugcucugaaccucugccuggaggugauggaauucaccuucauugauaacugucuugucacgaaggacugacaguuaagucgcuuuuucccccuucuugguucuuucuuauuauuuguucuauuuuuauuuuaccacucauauguuuucuuuuaggcauuuauugaagacauacauuugcuuggcaaagcugaaaagggcuauucccucccaagagaaacagucauacagacauuuggcuaugcagugggguagauucuuuauuauaguaccucagccacagcugccuucugaagguagagaaggaaaacuggacuaaaagcuaugccuugcucacucuuugaagucaugacuaaggcuccuguccugagacuuuucucuccggauagccuggggauagucacugauuuccuccccgaaagggcugacugacaggugccugcuaguugcccuuuguagcuucugggaaugaacugcuuuucuuucuuuuuuuuuuuuuuuuuuaaagauuuauguaaguacacuguagcugucuucagacacuccagaagagggagucagaucucauuacggaugguuuugagccaccaugugguugcugggauuugaacuccagaccuuuggaagagcagucaggugcucuuacucacugagccaucucaccagcccugaacugcuuuucuugagucccugcauuaccaucugccacguagcccuucucaagcugccccucuucucugaaacacugauggucuuccuucaguuuuaaauggaaucuuaccucugcacaccagugcaaacacagcucuuacccccaagugaaaagugccaaacaagaguuacugugaccucccaguguggauucagguugccuaauagcuuguaggagcaguuauaacaaacuuuuguagucacagaacaaaagaaagccuucuaucaaggcauucccaaaugcaugggcagaagcaucagauagacagaugcuuagagaggaucuuagagcagagcuggguggugggaaugugaugaggacgggggcaggugggccgcucugcugugggcucaguacccuagcuggugaaguucugagcugucagaugaugaaagcuaguggucugucaaauuaguccauugagagguguuccccagugguuaaaaggauagaagaccagacacagaaaugaggaauauucugagcucacuuggcccuggaccugcaaaauuccaguuuccuacaacaacaagguuguaaggagucaucagccuuuguugacccuuuagugugauguuucucagagagcuugaguucacagcucccauucuugcacauuaacagaucuggacggacaugggagaggcugaagguugcuuugugugcccgaugcucagaagacucauuucuugcaucgaguaaaggugaagcuaaguaggcaggaaacaguuuacaggagaggagauuguugaaaaccauuaggaagaagccccaugucacauaacauugcugcuaucgggaucuaggucagaauuuuuuucccuuuuuuguccucuguaucugacauguauauuuacaugugacagauaauauaaacauauguaaagguaaaauaaucaagaacacaguaugaacuaaagaacuaaagguagcagagcagaauaauagacacuuuuaaccaaguccccaacucaaaaaaggccccagugccuaucuguaaucacuuauauccuaugaaauauuucauuugaaacuggaacaccaagaaguuauuuuguaauuguacccaccaauuuacuauucaugaucagaauagcaguauuacuuaguaauuuuuaaugauauuuuauuuauucauugacaauuuuauauacuuauaaaauuuauuuugaucaucucuacccuaguucccacucuaugcagacauuccuuuaaucuagcucccucccaccuucgugucccuuuuaaaaccaugagcacucggaguuaaugaacuaugagugcugccuauaucuguacaaagguguagugcugacccuggauaaccugccaauggccauucucucagccccaacccucacuggcagccuucagcuuccaguaguuucugagcuagagauggggucuuguaaacagguuuaauccagguacccauugcugugaguucuugggcccuguggccaugucgugugcacgaggcugcauuuuacaaugcuuuuccuguccccuagccacugcauguuuuccacccucuuuucugcccugaaugucaaggagcaauguuuuuauuuuuaacaucuuggcuuguucuacggaacacucugaagauucauuuagucaggaaacaugauguuuaugguauggucucuuagauguaaguuucuucuuuuggggagaauaauuuugcguuuaaauaugaauccuuuuuaaaauguauguuuuaaaaauuagucuuaguagauuuguucuaaaccuaguuuagaagcuauauuugcaggaaggucuccuuugaugcuagcguuugcaguuuugauacagugcagugauugcuguugucuuuagaagacugggaguuuuguggacuuugagucaccccagagccauuggugucagugcaguaggcuguuguacagugaguaagucugaguaggcaauaacacaguaaggcaaaugguugggcccagauaauauuguuuccuuuuucuuauuaggaaguaguuugguuuuaggugcuaauuuagauuuaaaauugaggcaucccuaaaauggaguuccauuuggaaaauuuaaaauaagucucugucaacaugaagauuagauuuuuaaaaaguuauacugaaaaaugagaaguuguuucugugaaaacauaugagucauuuaaaacaucaagaguuaagucaaguagaugauuggguaagcagacacucaaugugugauuaaugaaaugaggcaauguuguugccuuucuuugaaguuuuauuaaaaccaagauuagcaauuugucacuuaggaaaaugaaauaucuuagacaguuuuugaaauauuuaaauaggaaggguuucuaaaguguuauaaaaggugagaguuaggacuguugucagaguguuucaguucugucuucaguguaguggcaggagagcuugugguauguccuuggaaacugguccaaauuugagguaaaaaauacagauugaaacauuauccucuaaaguuuucuaacaugagacaagagauacuuugagauaccucacagaguccuuccuauccaggccaaaaggagucuaaaacacuggauccagcugacaaucacuuauuuuuagcucuuguuacuuagcuuuucuccauguguucacugcuggaaaacucuauuaacaguuauuuuauauggagauaaguauguuucccaaaaggcauaaaucuuagaacuuaaaagaauuaaugggaguguguucggcuaagaaagcuaaaagcuuugauaaaugaauuguaacaauuaauguuuuacuugcacuuuaaaaaauuuaaucaccuauccaaaggaucaaggguacuguggaaauuuuuauaaauagauauaaauauuuguucacuaaaacaaguuucacaggcacuugucuaauuuaguaguaaugcccuaguucuuuauagugaauaauuacuauugaccaauuuaaaaaaaaaaaaaucucauuucuuauagguaugggcauuuugucugcaugaauguauguacaucaugugcaugcuuggggccuauaguggccagaaaagggugucauagaccugaaccugaagucauagaugauugcaagccaccacuggggugcugggaauugaacccauguccucugcaagaccaauacuaacugccaagccaucucuauagcucaauggucacguuuuaaaugaccuguucaguaaaggauuaaaacauccuuaaucuuuaagccaauuuuuuaugacuauaaaaacuuauaagcagaaaguagguuuuaguuuuguaccagugcauuugauuuugagcuuagaaaauccuuuaauuguguuuugaaauaccuuucggcaaaauuuuuuagcauucaggaagcugcuaugaauucaaagucagccuggacuauauauaguaauuccagacuagccuggacuagaaugagacccugucucaaauuaaauaaagaagugguaaguaaauauaaaauuuugaaauuagacaauauuuuugguaagaugaaauacuuucugucuaaaaaaaaaucuuuucucacugaaauagcuuaaagucguucauauugucugcauguggaauugugcauguugauaacugcggggcaguggggucugucccugcucaucaaggcccgccgugcuugaccggaugagcuaggcuuucuccuaaugauccgccucuaaccucccgcuggaaagucuuccugcacuccagccacagacggaccaagggcucucgccugcgugggaaccaucaccugcccucucuccccuugcccucuccucccuucggccccggggcuuagugcugcuccagggcccccguucuguucucagcuccuccgagguauccagugugggaugccggaagcgggaaaccuggugccuaggacugacccuuguccaccacccuccgagcuggggucaguagcuucacacagucagauuacccacccggggccguaagaaaagugugcggcagccuuccgcguccacccacccagagcaccagaacucuggcaggacgcagagguuucucccacuccccuuuauucccccagcgcccacugccccacagauaacaauauuaauucaaaauauaguuaucuucuuagcaaagaaucagaaagaaagcugucuuauucuaccuguuggcaacuuaugaaaacacauuugguagagucccaaacacacaaagaucuacaggcaacuaaggauguccauuaacccuauggucagcucuaaaaacauucaucggaggagcaguaugagacugagcagguguuucuuuguguauccgagagaucugccugcuuaugccuccucagugcaggguuuaaaggccugcaucagcaccacccagcuuuuaagccccaucuugucucuauagguuucagggcucuuuuugguucucuucuguaaauuugcaguguuauuguuuguuaggugcuuucauauucaaauugaaguagucuuccauucaguacauuuccuuuauuuccuagaacuucuagcuuagagaaacaacaacaacaacacugaauguuccucauugcaugugagggauagggauagauaaagccgaguuauaguuugguagguuucccuguuuuuccaaauaauugguaauugaaugacuauuaaacauaaagccaggugaauuccagguggcaguuguccccaaacacuuccuauuuugaauuucuguuuccccuuguuuuggugaagguaucuuuuccuugaaaacuguguagucuuagaugcuaguuagagggauuuguguuuuggaucaaauuuaugugccacuuguagaaaaaauuucuuuaggucucauaccaaaguagguuccuccaaguguguuugggguuuauuugaauguuuacaagaacaugaggggaauaagacauugggugccuacaccuucauaauggcgcugauaaaauuacuucucagaagggggugguguaugcugucucacucccuaaggcuagugcucaucuugaagagauccugauacuuucaggagaggagaggggaggggaggggaggggaggggaggggaggggagcuuaucauguuaauauguuuauaacuaaugauuguagaacuuguaaccugaagggauuagguucuggugagcuagagaggacacagagaaguuucacacucagguucuggagauaguagcaaacacguacucugaaaacaaguaucaucaacagaugcucaugugggugcucugcgauaaaguaagaggguaucugguaauagucagcuagccucaccaaaggaaaggcucaggccccugaaagaacucaccaacauuacccaaggggccagugugggugguuggacauacaggggaccuguugauaccugaggugguuccucugaggaaagcagaucuuccauggagccucaugguuuggaaccaaaacuguuggugcagaguagaguuuucaucucaaagugagcaaaguagcuuauugugagcagacaugaguagacaucaccaagaaacacacauucaagucuccacuccaaaguggaugugguugcauggacuuuuauucucccagagcaaaucauaaaucaagguaucucccaaauauguggacggggucauaucaacauagauaaauugugcuauggguuucagaugucacuuaauaacauucuucagaucuagcuugugccugugcaugauuccaaagguuuuaccugauguuugaaagaaugguaagucagacagaggugcagacaacagauggcuguucagggaacuagagagcugagauaguuuggcucugggucugcagcauuccaacucugcaaucacaagguuuacauugguggguuagucuuguugugacuuuuucugcaccacuucaguucauaccucaucuuguuuucuuuagcauuuguauccuuguaccucauguugcugccccuaccccccauugcuucuuuacuucuaggauauccuuacuguucacccuuuggucucacucaccauaacuuguuauaaucugaccuuugcccuggcagauccaguggcuugugugucagucacuguuguugaucccugcguggucuggcccugaggcuugcucugucuuggucugcguguuccucugcccugggcugcugcuguucuugcgcuccucggugugcugcuugaggacaccuuuagcaccuguuugggacacagcuucccucuauaauuguuucuucaagggugugacaguguaugaccucaaauguuagcuguaauaaaagugagucuacaauucgaugucuguucucucucuuuauuuuuccucgcaacccaaacgccauuguccuccagcugacucaucaucuucaucuuagacucugacuuuugucaaucacuauguuccucuuaaucacccaaguguggccaacauaaaauucaguucucuacucagggaauuuuaaagaauuuuaagaugauagcuuugauauaaacaauaaaauggagcaauaacaguaagaguaacuauaauugguucaguggcuuauaaacuuugucuuaaugccacguuccugugucuaugguacuggagccucgugcacaccagauguguacuucccccaccaugcuauuuccccagccccagaauuacccuuuaaagacaggaaaguggggacuaaaggcacaguuuguggcagggugcuugcauagcaugcaugagacccugggcucaauuuccaggguuuaaaaaaaaagagcagauacuuguugaagguuuuaguguaguucucauugggcucagaacacuacaguugaguggaagaggaggugcauuguauccgcuccugcccagcauccucaagcacccugcagucuggcuuaugcccacaguccuaguacucagagguggagaagagaggauugucuggggcgauacuguuuagcuguucuuaccuaacaucccugcucccucccuaacucaaaagauuucaacuucaaaguccagcuccacuuucacuuuccuuugucugcuuccgcugugguuaaagcauccuucuaccagggacuuuaaaggagauguggacccccugcccuggcucuuagugcuccuuagggggaaccagcagaacuggcuccugugaaaugcagacugcugggugcuaggcuuuggugcugccccucaucugaugucugauguugccuaguuagcaccacaaacauccauuucauuagacacuuucacaugcauuguguuuuagaaaacagccaaaacuaugguuaggucaguaauuauuuggaaaggcaccuguaaaguucguucaguagaauggaacugugcuuauuuucuucucgccuuagcuccauuugacagugaauuaaacaaaauuaagagauggugucagguauggcagcacacacauuagucccagcacuugggaggcaaaggccagccagaguuaacauggagaggcccugucuccaaagcuaacuaacuaacuaauuaauuaauuaaaauuuaaaaauuuaguuaggaggcaaagaaaaagaagagaaacauuagcuuuugccuuuacuauaacacgcuuuucagugggcagaacagcauccuacuguacauuuccaucgucauacuuuaccaacagccacaguuagcuucuaccuuauauaaaauagugcugucaacauuguauaauaauaaaaauagauguaauauuggugaaaauauugacuuuuuguuaucacuagagaaauuuaguuuuuaagggguaaacauuagcacagauuuccuugguuagcuuuucucuuuuuaagagcucaauacuccaaagcagcuucaugaagcauuauaaauuauucaaacucuaaagaaacaauauagucaauuauaauuuaaugcauauuacagcauacuuagauuaaaugauccauuauaguuaccugcauuuguacuuuuuauagugcauuuggguccauuacacauucaaaauguacuguguauauuguguauuuuaaauuauagagauuugucauucuugugacucugccuuugugguuugugauuaccauguauauaacuuacuggaugucaaucaauguuaagaaucuagcuacuagaaggcuggcugaugucuuaguugaagcgccuaacacacaagcaugaaagaccugaguucagacccccagcacccacauugaaaguuagucuuuuacccuagagcuaggagugcagggguuggaaacaugaggauucuagagcuuguuggccagccagccaagccaguguagaaguauugaguucagggagagacacugucucaaaaaauaaggugaggaguguugugugacuaaucuuucuggggaaacucuacacacucaaccuacacaccccagauagggagcucaugacagagcagaguacagccgcuaccagagaacaucuucaucgcucauugguuacuuagcagaauaggugaaagguugcuuauaggagcagaaaugaucaaagacagauacaucaccaaagcacaccucagcacaggugacagcucacaaaaaacuggaaccuggagcacacugugcagcuuacagguagcucaguagguugaguguccuuuccaagugacucaguugguuuaaaccucuuccaggcaagugggcuugucucuucuucguccaagcagcugaucuggucucguucucuuuuuugccccuuugccugucugagagugaccuuagcaguuguuaugguuuauccuugagagggagggcccuaguaaaucuggucaguuucagggacuuccugaagaguuuugagauguuucccuucugguucaaggaacuuuucugcugggguauauuguuuaaucucugaggaaauggcuagacaacauuguguaauauaagaagacuccuaauugcugggccgugguggcacacgccuuuagucccagcacuugggaggcagaggcagguagauuucugaguucgaggccagccuggucuacagagugaguuccaggacagccagggcuauacagagaaacccugucucaaaacaaacaaacaaacaaacaaacaaacaaacaaaaaaagacaccuaaugucaaugucccccgccacccacccacccacacacauacguuugcacaccuuuaauuccaguacucaggaggcagaggcagguguuucuuagugacuuccaggcuagccuggucuauagagugaguucuaggcccauuacacagaggaacacugucucaaacaaauaaaacucaaaacacaaaaagaauauggcuguuaaaucaaaacauauuuuuuuaaguaugaugucuuacuguucuugugaacauggacaaguaauucaauugugcuuuggcuuuagguucuucaccucagaagugagaagcaaaguacuguucuauuaugaaaaugaaaugacauuguaugauguguauaaaugccauuuguaaauuguaaauggucuuacaaauacaaaguacuucuuuaugaaaucauaaaagagaucucuagacccuuaauagugacaaauucuaguuuuauauaccccuaaugcuuaaguaaguuagcuuucauuuacaucuuuguuaaaugaauuacuauagcaauuaucuauuauauguuguauagcaauuauuuauuauguuuuauacauguucucaggauuguguacaaugugcuguugcaaucaacuuuguaggggaaaggucccaguaugccauuuuugguuuuggaugcucugauuguccgucccccccccccgucccccccagccgauucugugccuccagugugcugucccugaacacaguagggaagauacauauguaacuugcagcagcugauuccagugcauacugaacugagugaugugcagucagucucagguggaugggugcacagacucagguggaugggugcacagacucaggugggcaggcgcacagacucagaugggcaggugcagacucaggugggcaggcgcacagacucagaugggcaggugcagacucaggugggcaggugcagacucagaugggcaggcccacagacucagaugggcaggugcagacucaggugggcaggcgcacagacucagaugggcaggugcagacucaggugggcaggcgcacagacucagaugggcaggugcagacucagaugggcaggcccacagacucagaugggcaggugcagacucagaugggcaggcgcacagacucagaugggcaggugcagacucagaugggcaggcccacagacucagaugggcaggcccacagacucagaugggcaggcccacagacucagaugggcaggugcagacacaggugggcaggcgcacagacucagaugggcaggugcagacucagaugggcaggugcagacucagaugggcaggugcagacucaggugggcaggcgcacagacucagaugggcaggugcagacucaggugggcaggcgcacagauucagaugggcaggugcagacucaggugggcaggugcagacucaggugggcaggcgcacagauucagaugggcaggcgcgcagacucaggugggcaggcgcgcagacucaggugggcaggcgcgcagacucaggugggcagacgcacagacucaggugggcaggcgcgcagacucaggugggcaggcgcgcagacucaggugggcaggcgcgcagacucagaugggcaggugcacagacucggaugggcaaacgcacagacucagaugggcaggcgcacacucaggugggcaggugcagacucaggugggcagacgcacagacucaggugggcaggcgcgcagacucaggugggcaggcgcacagacucagguggauggguguacagacucagauggguaguugcacagucuaaacaaggaggcucagucuuaacugcucacaacagcuugggauugcggcucaggcucagguuuuacuucugacucugaacuuaaaucuucgcucucaggaaguaaaacuuaagcuuuaguguuuggucaguaaauaaaguugacaggguagaagacucugucuuaauacagauaaacaaaacaguuccuaaccagcacacaguuucagaggaaaaguucaucuuugaaagauuaaaggcgguuaccaacuccugcaugacucugaucauauggcaaaaugaguuuuauauauuuguuuuauuuuucagcugacauggguuuugccagguuauucaauucuccccuaaagccacucgcagauuuggauccagugguugugacauuuugguaucgggcuccggaacuuuuacuuggugccaggcauuacacaaaggccauugguaaguguugagaugauuggcaaucugcacacucgugaaugugagaucguucauaauaaagccagggcuacaggaagaacaugcacgccuuccuugcuuuaugcucacauagcauauuuaucugaagaaugggaaaucaaguuagaacugucuucauaaaaaggaaagcaaggcaggaguguugugccagagaaaagaucauuuccaagugucccaaccaagacauuguacaacgugccaucucucuuguugcuauggucugcagaauggcagcuuguccaauacagcaggaaauacaguagguaggauggcucuccucaacaaccugccagaccaccaagaagaagaaagaacuagagaaagaaaagcagcuaucagcauguuuauuuggauuuaauggucuuccuuacaccaggcacuuggaagauucuaaugucugaaggcugagaaaccucagcuauagguugagagcuagcagacgagaaucuuccucagcucuggaaaugucuauauauggaagaaaaagaguaggcaaagaaggaguggacaguagucacgaggacugggcuucuagugccuuucuuguggggacgucccugcauauuccuuuccucaaagcuccugcuuccugcugcugggcaggagauugcugaucgccuuagcuguugcacuaagaguggauuugccacucaaaauccacuggaagcacaauccuaucucuguuuaacaagcaucugaaaacgcuguaacccucaaagcacugggaaugcuguaccuguguuuagacuuuuaauuaauucauggguaaagauugggcacauauuauagugccuucuuuaccaggagggcugauuucuucaaaauccagauacccaaaguacuuagauuauaucauagugcugaaauaguauaaaacguuugugaauauuacgaaacauuuacaaaaccugaguggucucagaauuguggggauaaguauguuugaggagugugacuaugacauucaacucacccguguccaaucagaucagaggcuguggaggcccugcuguuacuggaguaccuaggcuguuuccaggacugagcuaaaaaccugcauagcucuuuuguauuccaaccuagugggauugcuuuucuuguuaucuaggucuuuuccuucuaacuauugagaacauuuccuuagaaaaccucaaaaggcagcagaagauaggaggggcgaagucugagaggguaugggguguguguguguggguguguguugggacaagagugacagacagcuugguguggcagacaaggaaggauuaaaaaguaggugcugccuguugguguauggugcuguggacauucauggcagugguaccuuggcugugucacugaggaagauuagacuguauuuuaggcuguuaugguaaacagcaguguuugagagcccauuccuguuacccagagguugauguuggugcagggaagccccugaguggucagagaagagagacaucacaacacggcuuucuguucgcaguuugcuuuacaacagagcauacugacauuuguuuuagucaaugaauauaauuaaaccauuugcuuauuuaguuuaucuucaggauguauuuggcauugugguauacuuuuuuuuuucuacauuuugccauauuccuagauauuauuaccuacuuuuauacuuacuaaauaacauuucucaaaauggaaaaauauaaauauguaucucaaaagcuaacucaugggccuggcaagauggcucagcagguuaagagcaccaacugcucuucugaagguccugaguucaauucccagcaaccacaugguggcucacaaccauccauaaugagaucugauacccucuucugggguaucugaagacagcuacaguguacuuauguauaauaaauaaauaaaucuuugagcuggauugagcaugggcugagccaacaguguuuaccggagugagcagagguccuaaauucaauucccaacaaccacaugaagacucacaaccaucuguucagcuacuaauauacauaaaauaaauaaauaaaucuaaaaaaaaaaaguuaacucacuuaggcauagagccuauaaagugaguucucucagacuucuaccuagaaagaauccauuguuugucaaguuuaguuuuuucuaagccugucucuaccaggaaauuuauaaguaagcauuucuuuuauuugacguccaaucuguuaaaugaugauauaagcaucccauguuacauacguuacugguuugucauuaaggggcacaggugcaagugcacacgugcacgagcucgugugugugcgcaugcgcauacacacacacacacacacacacacacacacacuccacaguauacaugugagggcagaggagcucugggguuaaccucaggugugugcaugcacacaccauuagccauccugcuaucucuguguaagucuuauuuuuguuuauuuaaagagggaucucuuauauuucaggcuggcuuugaacuuuugauauaacugaggaucuauaacuucuacuucaaaguccuaagcuugcaggugugugacgucauagccugugguuucauggugcuggauugagucuaagaccuuguacacucaaggcaagcucuuaccaagugaaguacauuccagccucuguugguuuccuuaauaugcuuauuauauuuuacauauuggccuacugaaauguauuuuuguuugaaugucggaauuauauccaggaauuguaacugaggauauuaaugcauuuguguaauaggcuguuuuuucuuucauagacaucugggcaauaggcugcauauuugcugaacucuugacuucagaacccauuuuucacugucgucaggaggauauaaaaacaagcaauccuuuucaucaugaucaguuagaucgaauauuuagugucaugggguuuccugcagguaauuuguugcucuuuucaaaauacuauuuugaauuacauuucaaaaguguuucuuuauaagugcaugcauaaaguuuguuuuuuauuuuuaaacuaaaaaauuaggagacuuuuaguaaaauaaaauuuaaauuucuauuuaaaaaaaauuuuuuuuaaagauaaagacugggaagauauuagaaaaaugccagaguacccaacacuucagaaagacuuucgaagaacaacguaaguaacuccagauuaucuuagcccgugagugcugggaaacacagacaaaacucugagacuaaguaguugaugaacaacagaaauuaauugucucacacuuccagagccuggcaaguccagggugcaugugccaggaggugucugcccuugcugcugugguguuucaugguagaaggcaaaggaugugaacucucuguagagccucaucuauuaagacaucagcaccauuuauggaccccuccauuacaaacuccuuugaaggccucccuguagauacaugccagagauuaggucucagcaggaauguuguugugaaugauacaaauacucagacauguuaauuauagauuguagcuucccuagggaaauuuauuguuuuuuggggggcagggguuuugagacaggguuucucuguauagcccuggcuguccuggaacucacuuuguagaccaggcuggucucgaacgcagaaaucccccucccaagugcugggauuaaaggcaugugccaccaccacccagcaaauugauucuuuuuuuuuuuuuuuuuuuuuaaaguauauagauuuaaaccagggacucagaugucaguucacaugccaugccugugauuuaaagaauauuuuccaaaugauuuuaacauauauaccuaauuuagggcuguaauauuuaaaaacagaggccaggccuggugccauucaccuuuaaucccagcauucaggaaacaaaggcaggcagaucucuugaguuuuaugccagccuggucuacagagcgaguuccaggacaacuaggaaauacacagagaaaccaugucucaaacagccaaaauacaauaaaaaguuaaguuuuaauaagauagaggccuuaguucaauccuaaagcugugauuuuauuccugucuggguaauggucaguggcugagaugcuguagugagaaagcaggcaggaugguggcauggaggaccaugugguccagagucagaguggaacagacugcugcaugaugaguugacauggagggggugcagaggccagcuuuauuagucacgauucucuaaaagaacagaucugauagugcaugcacaaguguauuggagaacagggugaagucuaguuagcucagcaaugguccucucauacuggagggacugaagaucuggguguucaguccgugggccuggauguccccgcugagcugccagucuucagucuacauugacauucccaagaaguugguuuuaaugguggugaagaaauaucacagcaacaaggauaagguagacuugccaacaagagugagagcaagcagguacaaagaaguuugucuuuuaugucuuuuaucuugaauguccccagagagcugccagcauuuagggugggucuuccugcuucagauaauccaguggaagaaaaucccucucauucccagugccuccgugguggcucaccguuguucauaaccccagccccacuggaucuuacaccuucuucaggucucugauaugcauugcgugauaaaaaggagagggauuggagagguggcucucaucagcagaugagagcacucacugcucuaagaggacccaggcuuagugcaguugaccaccuucugugacgcuagaucaggggaucugacuugucuucuuggccucugcaauaucguguacaugugcaaaacacccacacacacucaaaacuaauaaugauaguaaaaaaagauugcucucaggaguacucgaguggcuuguauuuuauuugauuuuagaauugcagucaagccgggcgugguggcgcacgccuuuaaucccagcacuugggaggcagaggcagguagauuucugaguuugaggccauccuggucucagagugaguuccaggacagccagggcuacacagagaaacccugucucgaaaaaccaaaaaaaaaaaaaaaaaaaaaaaggugggggggcagucaaguugacuaccaagaucacuucagcuuaccaggaaaauuucaguccaagauggcugguagaaaugagagugcagcccaguucauuucugguuucucauucacacagccuucagcaggaacccucaccucugccuucggaauaacacacauuucagauuuuggccugggcuccuuugccacugcacauuuuucccggcaaagcgcacaguuuugaucgccaucuucaccaccaguuaagcugacugaucauucccaguuuguauaacuucugucucuuacccaggccaggggagguggcucagggguauacacaguugcagcucaagaccaaugaccugauugugggaagguagaugugucucguucuccagcucccuccacaugaacauugugaugcaugcaaugaaaaggcgugcgcacacacacacauauauuuuucaaaguguaguaaaauccuagaaaaauauuuuagaauugagggauuuuuuagauucuaaaaaugcuuuggauuucaauuuuuaggguuagagcugucuaacucauauaucuuacucggcuuuuucuuaguuuucaaacuuacuuauuaaacugccaguggacucucagcccaaaaauaggacuccugucugccucuugagccuuugugcucuguauucauguucuaggaaaugguuccaugauuguugaagcccgagacaugacgcagaccuugcugucucacucuugucauuucuuccuuugcugacccaaguagcagaucuacucaguucuuucuucuagaaaugcuuugacccaguuucuacauaucacccuugccaaguccgaucagaacaccaguaggcuuuccuuacagcccugcaguggccuuuuccuugugccuuugucccuguucuuccuuccagcucuuccuguguugcaguguugacgaaagcaaacuugaagaaauuaggcaugguggccagccuaggcuaugauguagugaguaccaggcuagccauggcuauauaagcaaaacuccugacacagcaaauaaguacagcaaagugaacacaccacuuuugucauaaguucucauugcuuuccauuucaugaccguugccaaaccuuggcuccuguaucaccagauuccuucuugaccucucccuguuucauggucuauagcccagacauuagagauuuuaagcaucucacauaccuucggcuuuuucugaccucuggaauuuuacaugcauguuuuccuaguuuucucucaccccugccaucauacugauuguugcgcacucuuuguauuuacuccuuaggccucagcucucugacccuccaagucugggcuacgucacucccuuuguaccucugcauccugugcugcugcuguaugaaccguccauacagcauuacacauaucccuguggcuuagcacauacuguaugcuuauuaguuuaaaauuaacugcuucuaauguaaugcauagcuaauguacuauagcuuaauggagugcuaaccuagcauauacaagguucugguuuuaguccccagcaaagcaaaaaagaaaagagcgugggccagugcccacccuuuccccuguaacaaaugguggaagacaggcccagcaggucugaugguuguccacugacuucugcagugggucugauagagcacagaaagguuauugaaguggaccaugcauuaacagcucauggggaggccugagcacuugggaggaugagagaucgagucccaauucagccuuccacagagugaggcccugcaaacagagaaggacagucugagcagaguggcacauacuuuaaagaagacuaggcuagccuggccuacagaguguagauccaggccagccagggcuacaaaaugagauccuuugucaaaacaaaaacaaaagaaacaacaaagaaaucacuaaagcaaauauacugaaaaaaacagcucuacagauuacuauuucacauaaauuaguauuacaaaaguaaaagaauauuaacuugcuuuaccauaucagagaaaaagaacucccagaauacuuugcacauaaauugcuaagaagacaguagguguuucauaauuguuaaugugucaauuccagggagcucacuagaaagcagggcaaggcugagggagccaugcggcuuacuggacaguguucagguuuaauccucaacaagccagaaaagaggaagaauguauacgaaagagaucauuaccuuuacuuucaaaaccuaaauguucaaggaaacacaauuugauaaauacuuagcaaguuuaugucaccuuggaaacuuuucagauccuagaacaggauaauuuaaagauaaucaguacaguuuaguguucacacagguugugguuguacaauugaauccagcagaacaacaaauuugggcuuuuuauaugauagugacaacuuagcauccugcguuaacucaggaagacaguugacuggacagagaagaccuaagacugauagagaaacuugauuucucuguaaacuguccugacuucuucccauuaccaaacccaguaucugccuuguccauacauucucugauacacaccuaaguacuguccaggguacagaagaccggacaccuguauuucucuuccucugugagaaugauugcuccugggagcuuguuacacguguaacugaacuaacugggugcuguugucccacacaccuaagaugcugaaaugggcacuacagcaaaauccugucuuaaaaacuaaacacgguuagagagguggcucagcaguuacaagcugcuuuugcagaggaccccaguuagguugccagcauccacaugguggcucgaaaccaucuauaacucuaauuccuagaacucagagaucuaccugccucugucuccugagugcugggugccaccccucaccuccuacccuauuuaaauacucuuaagaggcaccaauucugcuucaaauauaaauuauaaagggcuggaaagggaaauuaucacacacuaacaauggguuauauuuuuauauuuugaaaccauuuaaauuuuaaauaauauuaacaauugauguacuuagcuguucuguuucuucaguggguagagauuugguuguuuauagguuggggauugguaggggucuuuuuuauuuguuuuccuauuccaaaaauguuaguaagaauauucuccuguguccugauacuuaugugucucuuacgcugggccugaugacaaagaccugugacccuagcugcucaggaggcuaagaugggagggugguucaaggccagccagugugaacagcuuagugagaccugucucaaacagggaaaaggguagggagaugaugucuagcuguaucguacuugucuaacaugcaugagcuacucaugaucucuggcaccacaaaaggagaaaagagcaagccaucucuuagaugugacuugcaucagagcagagcugauggugguacauaaccauaucuaaagggucuccagcacugaaacccugggcuguaguuuauacagccccgccugcucaccagugucagcagugaguaacggugagugagugucugcacauagacccuaaagacacuugccugaagagcuuuccuuuugggaugugaaucacaugugguccuugccaugugcuuguguccugcagguacgccaacagcagccucauaaaauacauggagaagcacaaggucaagccugacagcaaaguguuccuccugguaggugcuucucccagauccagaccucacaagccugcucgcucuggaauugucccaucccgccuuccuuuugaaaggaaagaaggaaugaauguaugaaugaauggauggaugaauggcuggauacaugagaaauuaaauuuuaaucuguugaggaaucuuccuugacuacuagucuuaauuuauuaaaugauuuaugucagaaaagaauuuuaaggggccuaauugguaauuucaggacaaucaguauagugcuagguguacaguacaaggugaugugagagcuggcuagguggcucaguggucagggcacaugcugacaagccuugacaauccacaaucccuggaacccacagaagagcagacuguauaaacacaugcacaugcacacaugugugcacauauguguaagauauauguguugauaaucauguuagacauuuacacaaaugucagguaguuggugugucagcauccuuuucaaauguugucacauuuuuuauuuguuguuauagcuucagaaacuccucaccauggauccaaccaagagaaucaccucagagcaggcucugcaggacccuuacuuccaggaagacccccugccaacauuagaguacguauucauuucccccuccauggucuuugccccaagucaaaggugcuggaugcugcugagaggcaggggagcauuugccugacucguccugcuuugcucaugacaacugccugcagagaaagccuccucagagaggccaugccagauucauagaugaaagucagacagagcaggugugacucagaugccaggcagcaggaucagagauugaccaaagggauggagcuggugacaccugcaacccucucccuucucaccucgccaggcgugcacucaggcucuguauauuagaaaugcacuuguuuuucugcaggagaaaugaauuuucauguugaagcagauacaaacaguuuagauuggugcugaggaagcaguguggacagaguucugugucucacacagcucgcuagcagcaguccuaucuugacauugaaaguggcagucagcaggaaaggcaaagggugccuugcuccuuccuuauugcuuaauauaaugguuggaaaguguccagcaaacaccagccacaguaaggaagaggauguaaguuaagaaagaaaaaggaaacuuuuaaaguaagaugauggaauuacagacuucagguacugauaugaacuucuuuaaaugguuuuaguguguucgcuggcugccagauuccguaccccaaaagagaauuccuuaaugaagaugaaccagaagagaaaggugacaagguacaagcuucuucaugcaacacuggcuuucaggaagcaagagcggcagaaagauaacuggguguacacuugaagcauguauugagguuuaaacugagcuuccuguuuuguuuuagucgcccauucuagugccaguuguuccucauuuuguuaaggcagugccagccccacccugcuguacuucucccucccacuccacugucccccaguccuuuauguuaagagaaucuuagccacuccccaucauuccuuuccagaguccugacuggaagggcuuuugguugcuuuaggagggugagauauugcccugugugccuuacagcaccccucccacccuccaacucccgauaacuguuuaauuugaagauguugcacaguuucagugaacuccagggaguauuauugucccgggauugcuguguuaugcuuugggaaugcuguguuuugguguuuacccgucucggucauuccagucacacgugugcaaccaggcuguguaccccaggugugucaccaaucacaccugugcaaccaggcuguguaccccagguguauaucccuggucacacaugugcaaccaggcuguguaccccagguguguaucccuggucauaccugugcaaccaggcuguguaccccaggugugucaccaaucacaugugcauaucgagcauugaaaggaacuucccguuuggcgucacaguaaaauuuucaaucuuucuucuccuuaaaagaaccagccacagcagcagaacccacaucagcaaccugcagcccccgcacagcagacagcagcccccccacaggcuccuccaccacagcagagcagugcccaaaccaauggaacugcugggggagccacugcgggaggcgggggcgcuggagcggggcugcagcacagccaggaccccgggcugaaucaggugccuccaaacaagaagccccggauugggccuuccggugcaaacucaggcgggcccguuaugccgucggauuaucagguucaccccagaauuuucuccuuuuugaugcgaauauauuuuaugaaaugggaaauugacuuuuaacaaauucuuuuagaauugaauaguucuuagcuccagagucuucuauaaaaauuagauguugcgagccgggcaugguggcacacaccuuuaaccccagcucuugggagacagaggcaggugaauuucugaguucgaggacagccagggcuauacagagaaacucucucggguaaaaaaauuagauguuguauuucuagcauuaaaugaaaggaugaucucuagucauauuucauauacuugugagauauuuuguaucaugacuuguuuaucauaaccccaaggagagaaaggagggaggccugaggcuccuuacagaaauguuacccauauuggccacauuggguaagaaagacaugacauaagcaaagugucuuacuugaacauaaucaagaacacuugagaagauuugcucucaggaggaggaaauugucaguagacacauagacauggggagcgguaaaggcgauuguaagccauacuaaaguugugaugacacuagacaagggaauuacaucuguaccacacagcuuccgauucuaggguuuaccaggaauaaaaugccuuuagguuuguuuuaucauaaacacucuuguuuucuuguauucaagccuggguuacuuuugccuuguuuauucagcagcacacugaacuguugugugaggacucugccuuguguaguaguuucccugugugggguuggggcuguuugaguauaagcugugguguacacuucagaaagaggagcauggugucucacaccugggaccucagcacugagaggcugaggcagagggauugcugagccagcauggcccacggagugaguucuaggccaacaugggguacaaagacccuggcuucccgcugggcacgguggcacaugccucugaucccagcacuugggaggcagaggcaggcagauuucugaguuugaggacagccuggucuacaaagugaguuccaggacagcuagggcuacacagagaaacccugucuugcaaaacaaaaacaaacaaacaaaaaagacccuggcuuccaaacagaacagaacacacacacacacagggugggggugcgagugcagauuuuucuuccuguugaaaaagaaaaugucauuuuaaaaguuguuuuagcacagggucuuagcuaaaagcuguucacaccugaucuauuaccugaagcauuaggcccuuacuacuaguguguccugucagccuuaccugcuugcuuguugguagggccccagugucccuggcuucugacucuggcugaaggauugguuuucuagucaccacuuacuauugaaagugagaaguugcaggaugugguuauaucuuacugauugcauuuuuuuuuuuauuuaccaaauuguuuuguugucagguauuagucauguaaaagguuaaauuacaucucugaaauuuccuuccugccuuucuucacuaguguagcucccuuccccauuaccuagccaaagucagugccaaccaggguagucacggucucacaggcuacaguuucagauaaacagaacauagcaggagccucaugaugaaaguagcuaaagucucuguuguacuguaacugguaccuugaccccucacuacagucacuaacucccuuuuacguuuuuuuuccagcauuccaguucucgccugaauuaccaaagcagcguacagggguccucucagucccagaguacgcuaggcuacucuucaucucaacagaguacccaguaccacucaucucaccagacccaccgguacugacccacucccucugcuuggccuuggacuccagcagggugguauuuguguuacaaagacccccagaaugaagacugacaccaugcaaagugcagacccuugagaggaaaccuuugcaugcuaaguguuuugaaggacuaagcucucuucuucauugacuaaaagaggauucuugugaaguguccccgcccucuucccccgcaugauuuccucugugacuuuccugaugaagccucugaucuacccagcacuucugcauccuucagcagucucugagggaauuucuggugcaccuuucucacgcuguagcaaucauuauaauuuaucuuuucuuagaguuucaauguuguaggcacaggguuccagugguguauaguuuuauacuucaugaacugauuuagcaacaccagugaaaugcaccuuuuaaagcacuccacagucuccacagacuaacugcucugcucuuggaagucuucaaaagaaacuguuacugucccaaaguacuuuacuauuauguuuuuauuuaucucuuucagggaaggugaaagacagugugggacagacggugcccacaaccaaaaacaguguaggucuuugcagcuaccugcuuaugcuaugaaaaacugaaguacuuggugauuuuuauauaaucauucauggggaacucaguucccagaaucaucauauucugaauaauauucaguaauuaaaauuauaauuuuaacuucauguagcuaagucuacuuuaaaagagguuucaagagcuuugacggaauccaguccuuugggacucaccugggaagucugaagagccuguuuccugcacuaggaccucacaaggagucacgcugaucaaagcacgcuucuuccacgugaaggaaaagcuuuucccaugugugucuucagacgcuucucucaaggggcugcuggcucuucagucucuucacaucuggucagcaugaguaacuuucuuccauaaucaaggauacucaaauagaagcuuguucauucaucugcaggguuuuccauuuguguguacauuaagcauaaagugacuauuuuuaaagcauguuaaaauuuuagguuucauucauguuugaaguguguauuauguaugcauaauuuugcuguuacugagacuuaacgcugucaagaaucuuuuguauugcacugaaugcuuucuuuugccccuaggacaaaaaccuuaauaauugugccuaagaacuaugggcagauaguguaaaguagaugaggugaauauuugcauuuccaugaucuacgaauuagaggggaguucuauuuuagcuacuuuugaggaacccccaccuccagaaucaagaggaaauguaaaggcuuagagcucccaguguagugcaggggcagaacaccuguguucugaugcuccuagcagcaccagccuuguuugcaauguuucuugagcuagaaaaaaauagccaauuguauaugcaaacuauaugcauuuuuaaaaaacuauucuugugaaccuaucuaccugguuaugauacucugggguccauauacaaguaaaauaagauuuuuagaagccaguauacauuuugcacuauugaugugauacuguagccagccaggaccacacugauuucagcauaaggaugcuuauaaacaguaauaaaggcuguaugguggcaugcauaccagggccgaaaaugaagucauugacaugugacaugcuucacugggaggaaucucugacugucuccuuagacuuuuuuuuuuaaucccuuauauuuuuuuaaaauaagaaucagccuugugcauaaugucacuaucaauauaaaguucuguccugugcccuggagccucuuuguccagggccacugcucccuucucacaggcucagugcucugcugggaagaaaacauaaagagugggagacauuuccuuauugcagccaguccagugaucauaagcuccugugggcugugcgcgcccugugacugacuuauaaaugcccugugagaugaagguccuuuguuuacuucucaacccacuuggauaaguaugcuuccgacuuuuaugguaaacaguguuauggggaagcaggucugugucugagcacuugaggagaaagccagugauuagcugucacaaaaggcaucuaugcauauuugaaauguucacagcagccuucagcagcaguuggguggcccuuguggacagagcauauucuacuaagugguuguagagaauuacaaugaaaauagaagcucuguucuugcccucgaaugagcucaauuuaauaaaagacauuagccccuagucuguguauguauguguauauauauuaaaacaguucuuuguacacaaacuggauacacacuucuggcaguaugcacuuacacauucacaggacuguucugguaaaacugacucaaacagggcacuuugucauuugcuuccaauauaguguuuuccaggacauagccagaaaacuccacucucuguacagcugggugccacaucacugcacugauucuggcccuuugauuuucucuucuugccucaggguugguaaugugcccaguacucucagaaauaauuucuguucauuauuuccuuucucugugaaggaagcgaagccuuucguauacaugaaggccauagucuaugggguggguccucuaauggggccugugaagcuucuuaaggguggagcuuaccucuuugagccucgagugaugguuauuucucuuugaacauucaguagauacuauuuuguucucuacggacacggggaggccuccucugaccuaggagagcuucagagucuagggaggauugacgaauugaguugaaagguuucuggucuuuguauuaagucacuuuuagauguagcuuuguggcaagguguuugggagaaggauucgggccucuggggacagaguagcucaaaguagcguaaugugagugggugauggaggcugaagcaguccaucgugagugagugaugcgauagaggcggaagcaauccuuuugauggaguaaaccgugauuugagcugcagagaucaagagacaagucuauuuauucugugcuuuugaaaccuuaggacuuggagcucugacauuuugcacucuguaacggagcuucaugaugggaaggaauggccucuuguucacacuugcucgccgcuucauuccucguucucuugccucuaagaugaugcucugcucugcuaaaaggaaugggagaguagggcuugaagcuugcuuugcuucugaguuaagauguagcagcaacuaugcauuguucccuaggugacugagaaagacaacgaauggccauugggcuuaauggaggcucggaggagucgaguacaaguaauaauuuucuaaagaguguagcaguuuagguccccauaaucaucaagaauaguuaaaaaacaucacagccccaaaggcucgggauuucagaaguguaugguacccggggguacuuacccuuccaggcuguuuucuauagggagugaugcuaauguguuacaugggaaauaccuaaugcacuguuaccaccuacauagugaguaaauuaauacuauuuaauuuuuuuuaaaagcuuugucuggguagacacuaaaagcauuauauacaaagccaggacugagauguccuuuuuaauaacaacugaaaguacuuuuuauauauguuauacaguauguccuuucuaaacuaguuuguauuccugauaauuccuauuugugaaguguaccugucuaucuuuuuggucauuuucugcacgcacccccucuguaugauuagauauugccauggcucuccuugcucugcugugauguguguaugccaagccugcuacccucagcccacucuggggaugcagggcgcguggucucuucagaacugggugcuuuugcucuggauuuauccagccacccuucucaaagugacucuuccagcugcgauaaguuacaucacauuuauuuuauauucuugguugaaauaaaaauuaauugacuugguu

SEQ ID NO: 5476 - RNA, 1801 nt, Mus musculus
aggcgcugcgccgauuggaaguuccaccacuaccgucaccagcacagggccaaaccgguaacucuucagccaagcccuccggaggguccccggggaccagaccccuaaacuccaccuccaggcgcggucuccacccgccgcccgcuguuaaucacgcagccgcgacuccaggcgggaccgacgcccccgacggggcugcgccguacgacuucgaggggcgcgaccggccagcggggggcggcagcaccagugccuccgaguuagccccgggacgucgcucugcgacccacgccgccucgucccgggagcuccgacccacccagcccuccggggcuccgcagcggaggggacgggacgagcccacuccccgcucgcgcucuuacccaucuuuccgccucgccuuguagacaugcccguaggugccgcgucccacuuugcacccuucguacucaaacagauccuccacccgcucccgcuccgccgccagcuucgccuugaaaucauaauccauugucugcuucccccauagagaaaccgggacgcgggggccgccgccacucagucccuccuccaccgccgccgcuccacuucuccaacagccgucgcucgggcgcgcgcgcgccgcccgccgcuccgcgguccgccuucagcaagggacuccucggcggccgcggcagccaccuccuccgccuccuccuccuccgcggcggcggcggcggcucccgcaggcaucuacagucccgccuccucccuucauuuccuuguuuuggaaccuggugggccgcgccgcggcuuucucgaacucauuaaggaaccaagcgucccgccccaaggucgcgagccauucugggaaauguaguucaagagggcucgugaguugugcuaccuccucgggagcggggaauacaguucccagaguuccuggggccuuuugggccacgccuccacaaggcauguacgccugcgcucugccgccgccccacccccucagcgcgcgacugcuguuccuguaaacuguagcgcaaaguugcagcgggauuuuugcgagcccgugggagcuggcgggaaggacaccuuugcugagcuaggaaguagauacccggcccugacugucauuaggcuagaaaagcgggaagcaccucacgagagccuugcucuagagcucauuccggcgcauccggagcuuaggacugggguuuagacaguuguacuacacauuguuuguuuucuugggcaauugauccucugguugccccgccccuugccucggcuuauuggcagagacugaagagugacguccgcuuuggugccugguuaucuccggcuuuggcuguuuucccgcucuugauugguaauuggaugugcucgguucuuccugauagguuaaucuucuuucuuuacgaugcaaaaaccguauuucaaaaccugaagauucagcgguuucccagcucuugcuaggggaaccguguaacuucuacggcccacagccaaucaucuuuuucuuggcgcucuagucgguuuuauccuaacauaugcgggugcgguagccuagcuuuagccaucugucugagaacaauuaaagcgcuuggaagauugcaaaaaugcagcguuuuaaaaacaaucguuuuugcuggguaguaaagcguguuuuacaguaauggcgaggcucaccuagggguuuaagguauuuaucuugcucaugacguugauucguuauggugucugaggcucagaacccaucaccucaaaguaguacuguaagaacuuagaaagugccuuacuaaaaaugugacccacugca

SEQ ID NO: 5477 - RNA, 2022 nt, Mus musculus
cuuauuuccaaauccuuuauucugacaaaggguguauauauauauauauagagagaggagggcccuagagguucucaaauuguuacagaaguccacguugucaaacgccugugcuuuucacgccugugucugccgcaagucaaauggauuuuauuuucucacuagucuaugcaagacauaaacguuacuggucaaguuguagaaaacaaaugaaaggugguuuuaauccaaacuauaaaccaucuuccugaaggauuugaucacaaacaggcagagucaagucauccuacugacaagaacuuucacauauaccuugagacacgccaucgggggccuccuggagguggacaucuuacaucaauaagaacuauuagugacaacaucaccagauggcugccacuguuucuuuggcuuuguacagucuacuaaaguugagacuauggcuauucuaugccucugccauguucauuucagcagggccaaagaauuuccagguggagcauuguuaaucaauagagugucucagauaggcaggugcacagagaugcuccuagcaguaacacucagaauugugagaacuagaagcagucagccugcccaucaauagggaaauaggugaaucgagagccaucacacaguagaauuccacacgcaauggaaaugagaaauuguuguuacagaagaacaauacagaugagucuuccacucauagugauggaagccagacacacaauuugaauccauccacuguaaccaggucaaaaagucuugaucaauguagauacacuuggcccguauuaucugaguuacagaauuccuacaauaaauagaaaaugaacaguggagacuagagucauugaaucuucucaagcaguucuggggaacuuccuguccucaccaccauccugucuucccuucagaccugggggggggggggaaaggucagaagccaaaggugaguaugucuuuccacgaucccauagggcugcuuuaaguuaugagaaguaccugggcuaccugggcuugaacuuuugagucucgaauuccaugugaccugcuuccuaaggcuuuucacuugacaaaaaaauugcaugccaaggaagcgucaaaauucuaucaagauuaauuaugcaauuucugucuauaaaugacauaccuccuguacccagugaaacccacccaugcacuaauaggaugugacagccacaucacuaacaaagccuccuccgccucaguucccaaaggugaguaccugcugcuggggaggcacugucaccccaugggggaagggaauuaaggauggugugagaacccagguuugccaaaguauggcucuguacaggcggguggucaagcagaagugcgagggagugcagaggucaguggaccccacaacauuuuccccuuuugaacagaaauccacucuugcugaaggcuaugaccugcccucuuccuaugaaacugugucuaaccacagcaugaggcuuuuccauugcuaagguuaagcacaguauauuucucucagucggccaggaacccgggcuccccucucagcuaugcaugugggggacucuggacauggaagaccucaaauuaugauucccucugagacaaagggggaaagaucuguccucuugugucuccuugucucuuuacccguuguggaugacagacaaacaaccaagaaggacagacaacaacaguguaugaguuuucauggaaaccaucuuuuuucucauucuuuuccaguauaucugagcuggaagaaaagauuuaacaaguacaucggaaaucuuaaaaagcaauaaacucucuccaaauccccuugcucauuucccacuggcuuugaauauggcagaagagaugagacucgccaggauaugcaggcgggaggggguacgguucuggggugaagagacucaccaggauuugcggguugagcugggagauggagcuggggugauugcucauuucucuucacuaauguuaucuaaagaacucuccuuaagugcagagguaaaa

SEQ ID NO: 5478 - RNA, 115092 nt, Mus musculus
ugguugggaggcggggcugagggaauccggaagcagccggcgagcccgcugcugaacguuugguguucugacacuguuuuugucagcugugucuggugugcuggaggucugcggggucuccucgcucugucuccagggggaaccccgccgcugucacgaccugggccgcggccuggugcccuguggcggggccgccauuggcuggagccaugcccacggccgcugcccccaucaucagcucgguccagaagcuggugcuguaugagaccagagcugugaguacccacaacgacgggacggggcgggaggacugcgcugcggggaucggggcacccuguggggucgucgggaagaggcagcaccccguacucccuccucuccucccagcgccgcugcaggcucggccgccagggccaugcagucaagcacuggaugguuugcaggucugucuugcuuaggaacauguggcuggcuggaagaagugcgugcagacaggugcuguggcacacaggaacugcacacagcuucugaaagaguuccucuuuucugcuuucccauaaucuugaaguucuugaguccacuccuuacaguaaagucaggggguaugaaaaaaaaugugaacuuggcccagguagcuucuauuuugcgauuucaugguauacuaucaccgugauuggucuuaaucacaugcacuguuuugcugggauucgagguucugugacccggacgcaucuguuaauaguucucuggcuugcagagcggugcuaauagaacuuauuuuuuucucauuucugugcuugggaaacaaaguugcuauagugugguuuaucugaaucuggccuucacuaugauauuagggugugaguaucucguuugguauauucagugaacuguggcuagucuucaauaggagaguaaauaaacugucacaugggaauuuuagcccaccgguaagcugagcauucugaggcccuggcugagaugcuauucuuuauaaaacagaauuucuuuucccacaagucuucaguggcacccaugaaaacucgguugcugaggacgacaaacccuguuagaaauuuuauuuaauuuaauuuauuuguguguguguguagugcauguacauguguguggguaugugugcccacguggaggaguuuggaggccagggguugacccuagaugucucucauuaaaucuggagcuucccauauugcuagacuggcuggccaaugagugucccucgcccaggcucuaccugucuauacgccgcacccccaacccuggggucagagauguguuauuguguggggcuuucagugggcccugggaaucuuuacccacuaaaccaaguuuccacaccaguguuuuauuuugaugaaauuuaacuuaacuauaugugugugugugugugagagagagagagagggagagaguauaggauaguaucaaaaucauaaucuuccugucuugaccuccccagugcuagauuuauaaacaugggcaagauuuucugacccuuauuuucagugugugugugugugugugugcuuacugcuuuucauguucuuugcuuguucccaggccaugaugauauuuugcuuugucucacugaaaagauucacaguuuuagccuuuauguuaucauguuuuauauuaaauucauuuauaauauaguuagggcuacuauugcugugaugaaacaaauaugacuaaagaaacuuggagccgggcgugguggcgcacgccuuuaaucccagcacuccggaggcagaggcaggcggauuucugaguucaaggccagccuggucuacaaagugagcuccaggacagccagggcuauacagagaaacccugucucgaaaaaccaaaaaaaaaaaaaaaaaaaaagaaacuugggaaagaauuuauucagcuuauacacccacaucauugcccauuacugaaggaagucaggacaggaacccaaacagggcaggaacauggaggcaggacugaugcagaggucauggaugggugaugcuuacuggcuugcucuucaaggcuugcuaagccugcugucuuauagacuccaggagccaucagcucaaggauaacaccauccacagcaggcugagcccucccccaucuaucacuaguuagaaaguguccuacgucuggauuuuauggaggcauuuucucaacugagguuccuuccauucauaugacucuagcuugugucaaguugauauaaaacuugccaggacaacuaaugcaggucuuacgugacuuaccuauugcaacaaguuaccccccagguuaguggaucuagauaguaauuucaguagacugagagucugaucggaucugccugaaggucucagaaguuacaguugaaaugucaccuguggugcagucaccuggaggcuuagaugccaaggaccagccucagccuggagacggguucugagagaaggggugucuggaagcagugaaaagaaggacaagagaaagucagauuguggauccaaguuguguucugcuugauccaguuuuccaggcugcuguguuccgcuuucucccuggagaucucuuugucuauauucuaagagaccucucuguccaugcucuucuugcuugugugugugugucuccauccgucuuucacucugucucucucuguaugugugucuauauauuuaucuguucuccaagcaguucuuuuuauccuaaauucucuggauagcucaucuccuguagaacacaaaguccagucuuauuuuacauagcaauccagucauuuacucuaauucuuaagagacagcaagcauacauuuuuuuccccuaauguagcaaaagaauucagagaucugucugccuuuguuaagcacaaaagaucuaguugggugggaccuugcccugaaauuacaauuucuaccacucgugggccuaaccuugcucugucugaccuugaacuugcucugccugccuuuguaucucucugacaagcuggcucauaguguaccugccuuuggucuuuagauucaugaaaccccucauacuucauauuguauccuuauauuuugcauaguugaauauauauaucacucauguauuuagagcucuuuucugcagccuuaagggcuguccugaaggucccagaauuuuccauuuugcugagacauuagccacaccuucaccuccuggacuuaugcugucagaucaucauggagucacuugcucugggcaagcccccgagggucuucuuucuuguucuugguucauuuugaaguagcagagggggaagaacaucggugaggguaauaugucuuaugagauauuuaggguuguuguacaauaagaaaauguuuaccucuugucuuaguuaggguuuuacugcugugaacagacaccaugaccaaggcaucucuuauaaggaugacauuuaauuuggggugcuuacagguucagagguucaguccauuaucaucaaggcagggacauggcagcauccaggcaggcauggugcaggaggagcugagagugcuacaucuuguucuaaaggcugccguggaagacugguuuucaggcaguaggaugagggucuuaaaaccuacauccagugacacacccacuccaacagggccacaccuucuaauagugccacucccugggccaagcauauacaaaccucacaccugucuuaagucuaagucacuuacuuagcugauagcuaaccugccugccugaguuccucugaggugagaaacuguuuagcauccccaccauaaacagcagggaauaagugaaaagauuuauugcuggugcuccuuucucuggucaaucagcuagaaauccuucuggcuaagcugguuaacucuuugugaaccagauaggaaggaaaggaaaagaauuaagaugcuguguagaggcaaauaugcacagacagauguacauuuaaacauucauacacccacacucuggccugcccugaccaucugucucaaucaacuccacacuuauucauguuuucaugcaugcuuacauauacacauauauauacucucacacacaaacauauagacagauauauauacauguggauggauggguggauagaugguuggaugggcccauggauggauggaugaauggaugggacaaagcucuggaagccaaaucauucaaccaacuacuuuauuucuuuucucuggucuuuuuauaccuacuuagacaaaaaguucuuuagaaaauuaccucagagauaaauguuacauaaaauuggaguuagagaaggauguugauauuaaguucaaagcaguguuucauuguauuauacucauuaaaaguucaaagcaacaguuuuuacauggccuugccuuaucauagugcauaccugugacuuuauccuuggaccuaauguuuuuccuuuaguacaaaaaugucccaagucuauuucucuuuuuaguguaauuauaaaagugcauaugaagcuuuuacuuacuauucugaggagugggcacauucuauucuggauucuaaauuuauuacaucuuucuggcaacuaagaccaucucucaaaacuuucuuacuaaaauuauuugaaucaaaucaggaauucuauagaaucauuaucuauuugucauuacuacaagauaguacaucuucauagaucugcagagaucugcuuaaaagagugggcuaauaccuaguaauuguuauguaugcuuaaugauaacaggaaaagcauauagcaauagcagaagucauuccuaaaaugaauuuuucuuaggccuugccuaccagagcaaauucauuguagauuuuaauccaagguggaccccucucaagaaggucaccugcuagguuuuaguuucugcuaugacgacucuugacagucauugacauuaauagagaggacauuccuccgaagaaugugugaaauauguacauuauuauauaaacaagccuuaagcccacagcagucaucgacacuuguggaggcucacaccggagcccugucccagggacaggaaccaugccacuccguccccaccaggaccaugccaggcuuggcacuuagaugggauguaggauuuauuucaggucaccuguccagcuugguaaaccuggcugauuguuuaacaagauacaugaguucuuugcucauggaccugucuguaagacuccuuagguauccuuauguugugguaacuggcucuaugggucuuccacaggagagggagagaggaagagaagagggaggaagggggaacgguggugcacagcuguaaucccagcugugcagacagauagaaggcuacugagguuuguuggcaagccagucuauccaauccugagcucaagguuaaagagacucuguggagagucauucggaaaaugcccuguguugaccuuuggccucugcauacuuguacacauaugcacauguaccaggacauauaugaacacacacccacccccacccccacucacacacuuccuguuaggauuuagauuucacuaagucuguggacagauuuggggagaauaaaagugucauguagaaugagguucacuucucucugccuggguaccucuuucuugguucuaguacaaagcuaaauuggaggucccuagagaagacacacccaucuccucuuucuuaggggaaaaguacucagccuuucggcaguaagugaugugcaguggguuuuccguaggugccuuuuauugggcugaggaagauucuuuuucuauuuuuaguuugccaagaacuuuuuuuuuuuauuuuagauuuauuuauuuuguaugaguacacugcagcugucuucagacacaccagaagaggacaguggaucucacuauaagaagaaugugagccaccauguuguugcuggaaauugaauugcuggaagagcagucagagcucuuaaccacuaagccaucucuccagcuccagcaagauaacuuuuuuuuuuauaaggggauaaauaaauguggcaguucaccaugucuguaagucuagucccuggggccuucucuuggcuucugaggggccuuacugcacaaacaugauggcaaacccccuuccccuguacacauaaaauaaaaaauuuuauuaaauuaaaaauuacaaauaauguuaaaauuugucauuucucaucuuaacauacaauuuccuagcgguuuuuacuauagucaguuaaaucaauucauuucauuuuaaauguuaaacauugaauuacagaaauauaucuuagccauauuauacuauuuucacauaauagauuuuaugcacuaauuaacauuuguuaaagauuuuauguuuagguuguugaucuaugauauuuuauuacacaccuguuuuugauagaccuaguggggaaacccccacucaauucccgauucggcgugcacccaaaaaaucacgaaggaccaucuugauguaaauacaugaggacguuuaauuauggagcuccggacugacgugcauccuacacaggagauaacggauuucggccacgaggcucgaaagcuagggguuuuuaugggguaaggggcuuagggguguggaauucagcauagggacacacuauuggcuuauucaaacaucagcagaaaaauuacauguacgugcagggugucagaguucugugaguuguugacucaguucagauagcccuguuaugucuucacauuccccuuuaucuuauggucaagauguucccaggaauguuuuaacuacgaggcauacccagguuuuuuuuucucuuuucucagccccaggcagccucuaggcucacaaacaaccagcaauuucugaguacuuuauaugacuuacaggucuugaaauuucaucuuucuuucauuuuaauacuuuuauaucuauuuuugugugugcaucugacagaguguacucagagucagaggguaccucuggaacguaguucucuccaucuaauaugucagugguucucacccuuccugauguugcaguccuuuaacauagugccccuauguuguggugacccucaaacauacaauuauuuucauugauacuuuguaacuguaauuuugcuacuguuaugaauugcaauguaaauauguuuucugauggucuuaggugaccccugugcaagggucauccacaggcugagaaccagugcguccugaggucucagguccucaggccuggugacaagugccacccacugagcccuugucuggcucuuacaucaggacucgaagacugaaaugcuccgucuccuuucugaagugcuucuguaugacggacauuucuguuuucaguguuuguucuaauccacucaugaagcuuguguuucaguugcuuugugggugagauggaaagauuaugugaauugguuuuuaauugaucuugauuuuugauaauuuguguuuaucaagaaauuugcaacugggcgugguggcguaugccuuuaaucccagcacuugggaggcagaagcaggcagauuucugaguucgagacuagccuggucuacaaagugagcuccaggacagccagggcuacacaggguuugucuugaaaaaccaaaagaaaaaaaaaaaagaaauuugcccauuucauuucaguuguugaauuuaucagcauuaaauuacuaauaauaucauguuuuccuuucaguaucuuuuuuuuuuuuuuuuuuuuuuuuuuuaugaaaaauguuugccuuuuugcuccugauuucaggcuuuuuuuuccuuccuauccaugugugauggcuaguuugaccaacuuuacacaacccaggguucccugggagaggagucccagugauggguuaguucagugaugggucucucagugcaccugugagggauagucuucauuauguuaauugacaugggaagccccacccucugugcauggcccugcgagugggcguggcccugaguuacauaagaucgaagucaagaagucaaucugcugagcggagacaagugcuuuuauuccucugugcuucuagcuguuggcaccguguaaugggccagccuggugcuccugcugccauggugaugaacuguaaucccuugugagcuaaaauuaaccccuucucuccuaaacggcuuuugucaagggauuuuaaucacggcaaggggaaguaaaaccaagauaucuuuuagugccugccugccauugagacauuuauuuguguauacuuuguguauauuuuuuauuuguguauaccuaaaaaguaggauccuuucuguggauuuucauauuguucuccauggccugugacgccagcucgggcuguaagcacuguggacgacacugaccggguggggguggauuguuaucauccagauggauaagcugcgcauccaccuggagccgaucgcggcacagcaguuuucucaguucacaaccaucaaucauuucagcugauuucagucugccacugcgaccuugcuucaucgucagaguuagacauuggacaguggcuugggagcagcuuagcgaagacucuugccuuccuucucagcauuguugacagucuucagaaaacaaaacaaccaaacaaacccagugaggggugcaugagcagugacaguauuucuuacaguuccagggacacagagaggcccaagaugaaggcacagacagguucaguguucgugacggacaaguuguguccguaucacugaggauguagauaagucccucuggccauugccauaguggugucaauccugcccagaccaagucagguccagaaggccucacuuguuaguauugcugcauuggggguuagaucgcuacacauuuagaccacagggacaagucuuuuucuccagcuucauaagguggguccugacuuauuuauauccuuuccuaguuuaaaacugcaaauacaaguuaaaaaauaaucaaaagccuaaugacagauggagggaguacuaguagccagaauaauaguguaauauagccucacauucuaaauauuguauaaguagucagaaaaauaaagccacuugaaaaggacaagguaggggccugagagacagcucagugguuuagaucccuugccacucccgaggaccugaguucagugucccugcacccacccuaggugguucacagcuacugguaacucuagcucuaggggacccaagguucucuucuguuucccuggagccccuacauguaugcuccuaauucacccucacauaaaugaaaaggcauuuucauuaaaagccuagcuaguaaguagauaauccagcagaaagaacagugaguauuaucagcuauccagcucaccaguagauaaagcauuaaaguggaggucaacuccuguuguuaccuguuagagucauaguugacaaguauugaaagacgugagcauacuuguuuugguugggugaacgugugguuuggaguuagagcaauauagcaggcaagauggcugccucucgugcccagccuucaucuagaaagguaacugggugaguuugcuccugcuccaaaguucccguugucacugucuccugugcagagguaaaucuggagagauccuuggugaggaaugggaaggguugguguauggcacaccaaaggcuccagucugaaguuugagcucccuggcaaauguuccugcuccccaacccccagcccccucaggcugccguuugcuguggacauuuguucuagccagugagagcaggaguugcucuaggggguuuagcagcugaaguuauccugggugaaucugcaguaugccucucucuuauggguacuuaguggucgauguucugaggugagugcauucccacuaaaaggacuuagggagccagccacccuuuauccccaaccacaugggcuugaguaaaauaagagccacaccacaaggaaugccucuuaaccuuuauugcgugacuggggagcaagagaggaucguacagugugguauguuuggcugagggacaggagcagggaaccgaugucauuguccugcagagagaagcauaguuaagaguuuugagaugugguggagugauggaauuucacacucacuucugcagggaaugugaaaugugacacuccccaucagucaggcugggucccgccugucagggaggcaugcuugugaggcuugcuuucccacuucugggcugcguuagcucaccauuagcuuggcuugauaaaugagacacggaaccggcaggcuugcaacacugugaaagugcuggaaacaacuuccagaugccuuuaaaaacaguauguuuaauaugaaaguucagcugaaggugaacauuagcugaagcugccguacaaccugaagucucuuccuuuucaagaaggcugauuuuucuucccucagaugaagagugaaugauuaauuagccugucaguauaaaaggagagaauguuaguagauucugcguuuccuuuuaaacggguugccuauuguauuccuuuccgguuuccugcauagauauuuuagaaacacauucaucuuuuuaccucaccaccacugucaaaguuaccaacacauuuuaagucuucuugaacaaugacaauuuucagaagagacucaacucacuucaguacagcuaguuuuuuuguuuuuuguuuuuuuuguuuuuuguuuuuuuuuuuuuuucaguaucuaaaugucugccucaccacugucccucaacaagcucugugugcugcagagagcagagcuggagaggugggcugcccaggccccuuccccuagccguguggauuucaugggccucauucauaagacacacauucagguuuacaugucuggugaggggagauggugugauccaauuacugugcuuuuaaaaacaaguugugugugugugugugugugugugugugugugugaacacagagagaggcagaaagagagaggugccguggaggccagaagagggugucagauccccuggagcuagacuuaggugguugagcugggauuugaacucuagaagggcagcaagugcugcuaacuguugagccgucugcgcagccccaguugcugcuccuuucacuccguggugcuucugggcaucuuuuuucccuuccaccacugggacuguggccugccacugccaaagccucugcuaacaccuaggaugauuuuuuccucccucccaaguccuacuuguuacaaugacuuuauaggaaguuuagccccagauuuuuccuggguguguaaaucuccuuccagcacauuuauguucuagguauugcacaaauuucaucuugaugcauggcucggaucugcgcuggccauccccauuucuguguacagcugccaccuggguucuuccuccaaggacauguuuccucuccuuguuaaugucccuguuuuccuggaucacacaauuuccuauuuuuuuuuaaauuuauaucuuuuuuuaaaaaagauuuauuuuauuauuauauguaaguacacuguagcugucuucagacacaccagaagagggagucagaucuuguuacggaugguugugagccaccaugugguugcugggauuugaacucuggaccuucugaagagcaguccggugcucuuacccacugagccaucucaccagccccuuaauuuauaucuuuaguuugguggaaaauuucuaaaaauuagaaagcuuuuguguuuuuuugcuugcuuguuuguuuuuuguuuguuucuuguuuuuggccuauacauggucuaaaaaugucuagguucuuucuuugauuaauagugaaauggaggaccaccagacuaugaucuuuuuuauuuuuaagacuguauguauagcuuuuauugucauguugaauugcuugaauuuuagaaacaucucguaacugaaaauauauuuugcccagaaguucugaaacuggucaggugggcgugguuuugcuucccaagaauaauucuccauaggugucagugagccaucugcacuacugucuuuauacaugaggugugcagagguccaggcuccugguggcaguggcaccucuugcugcuuuaucuguauaucugaauguccucagggaauuggcccaguacagguucacagucaguuuacuuagaauugauugcaacgauguagcaauaagcaauggagucugaauuacaaaacagugcacccugcugccacucuccagugcaacugacaauuuaguccugacuuauauacugaaauggaugcuguccuuuaauuggaugguguuaccuaccugucugucauaacucugugcugcaccugagaauuucuaauguuacuuuguuucuauauuucuaucaucucuaagaauuucauaaguuguguuugauuguauccacacccuuccucccccagcucuccccagauccaccccuacuuccaucucccuccaacuuuguuccuccucuuuuagauaauaaccuagugaguccaguuugugcugucuguauccuccuuggguguggagacaucuacugaagugugguugguuugccagagcucaugcccuuaaaaaaccggacucuucuuuccccagaagccauugauuguccauagcuucucaguuaggggugagggcucauggucccccucccggccauacuccggugcugacuggcuugaucuuguuuuguauaggcagccauagcugcuaggucuugagaacaggaguccuaucauguccugaagacauuauugcucugaugcucccugccuucuaacucuuucuagaaucuuucugccccuucuuccaucaugguccuugaacuguguguaccuguugcuacaggugucccaguuguaaguuucuucauuagcuaaugucuacugcaaagugaaacuucucuggugugauugagagcuagccucaucugugugaacagagcuaagacuaaaggacgguuugauacuguguccguuuauuauuaauuauuuauuaauuauucuccagaaaaauagucguaggucuaccgcuggugagugugagcucuucaaccguggguucugggccagaucuacagcaaucgagccagacagcaguggguuaccccauucuugccacuauugcagccauggcauauggagaggggugggaggguaggggugagcaggaagugaggagagggaucaauaacucuaaggauguuugaaaaagcuguauaaaaucuauuuuauaagauauguauaugaaauauauauaguuauauaguuauauacgaaucaagaauauaaauauauaugcauuuaauuggaguuaucuuauacaguuaucuguuccucucagaaucccuaaguugccaacuaagcagagcggcagguauuggguccccagagcuguuggucagagcuggcugcagaccccucagugcaggauuuuuccuucuguucagcagaacuuguugguuagacccugucgcugagggaagacagcacacacauuggucacagaacauagaaaaagucaaguugguucugagcaguaagcucuccccugcuggcuggcuuucauagcaguagaaaguacuguguaggcuacuagaggugugguggggugggggucaccauugucuaaccagcugugaaccccguaaaugacaacaauaacuggcaagacaagguaugucaucuuagucuugguuuuuaguuugaaucuugcuuuuuuuucuucagaaacaugugccgacuuuguguuuguuuuuguuuuuuuuuuguuugguuucuuuuuuuuuuguggagggaugagagugaugucuucuuuuauuuuuauuuuauuuuuuuaaauuuuuuugguuuuucgagacaggguuucucuguguagucuuggcuggcuucgaacucagaaauccgucugccgcugccucccaagugcugggauuaaaggcgugcgccaccacucccggucguucuuuuaucuucuaguacucugggguccaugggaccccaaucuguuucugcuggaggcucauucauguaaaucguuucucuucuuggguaagccuuuccauuugcaguuauucuucugcuuccucccguggggagauccgucuugagugguguuauccaguaugccacagugugaguuugcguggccacagaauugcuguauucaacaagaagaacacgggacugagugggaacagcucuuucuggaaaaauuaccucucuuuuuuaaauuaaaaaaaucaaauuaguacuagaguggauuuuggcuagccaucagagggcaguguagacagugauucucaccguccccacgccggucaaagccucagagcagucuccacacgagggcgcuauucuccgcacaaauucuuuuaagggaccauuucugagggcagagccuguggauagucacaugacuucccgucccuguuagggcccacucucccugcucucccugugagagccugcugccugugagggucuucucuauguagggccugcagugagggccugcucucccugugagggucugcuaucugcaagggaacacucugcucaguguguuaggggcucugugagcaucuucuggcuucaucuuguuuuugcuaugaacauaacaaucccuuucgugccuuuucuugcuagucgcucuccugggcguucuuuaucaucaugaccucaguaagguggcucccuuucugguaacaagaauaaauagcuugcaaaccauucuuucuaauuuauuugguuggcuguuuuaucagauuggucacccccuccucuaggcagugaguuggggcucguggcugacauucugaguuucuuucccucaguuucccucucugucuggcuguucccccagugccuagaguccuguuacugcauuccccaacuuuguuuucuaauuguuauuaaaaucacuuuauuccuaccuccuuacuacugacagugucaaggaaacccugccuauucuaggauaccaggggcuaagcacuucagcuaguuaucuucuaacugguaucagccagcauauagguuuguuuuucauaaccuguggguagaucagaccuuuauaaacaaagucauuguugcuuagcaacaggauacauucugagaaaugugucguuagaugaguuucacugcaaacauaauaaaaaaaaaaccacuuacccaaacuaagacauaguuauguugcuauuagacaaugcaaucuuauguccccauggaacaugaggaacaucuuuaacaagauguuauuauugcuguauuauuaugugacacauguacacuuaguaaaagcuucagugaguuuuauuuauccuacagauuuagauagaaaacauuguaacagaauucugcauacuguuauuucuuagaauuguacucauucuugaaguccaaaugcuagacucuuccaucauuguauacagcuccagcuccuucuucagucucaucugcuuuggcuuccaauggcggaugcuuuccagcuugaccuuugacauuguccagcagacagcuguauguaguguuuaguugguuuacaucugcacauugcguaaccggugacaugguaaaaugcuggcugacuauggcaguaucuucucacuuuuuuuaaauggguuauuuuauuuauuuacauuucaaaaauauuacuuuuuaaaggacauguuuaagcaaaauaucuuuacaguauuuacuuuugauaaugagauuuuacuuaucuucuuuaaaguaauuuaagaauaauugaauuaaggagauagcuuggcagagugugugcuuagcauguauggggcucuuggucugauucuuagcacuacccaaaaauaaagcaguccacuuaguuuugcuuaugaacuuuauguuuaaaaaaaggauuguugugggaaauaucaaaaaaugaaacugucauguugcuguguuugugccggcaacucucugcccugguggccuggccggcaguagccggacggucuuuaucucauggagacucugacucaaagcaccaaaaucucuuuacccagcuugcuggguucccacugguggguccuuaccacaccaaccccaugcuuccaaucccccacggccuuugugguacacaucaggcaaacccacgcuuugccgccauacuuuucucucuggaacccugaugaucugcugugugaaagaaaacacaacacaaauacaaacaacaguaacucacucacugggcgcaacaacuaaaauccuaaucuuguaagccuuauuaaaucuaaauccuccggugccgaauccugacagauccgccauugaaacugggagacacucguagcuacaucuuguccucacgcuaucccugcccagaaaggaccuaacucucuccuguuuccugucuuccuccgucuaaccuggaaguccccccuacuggcccagugauuggcuccuuuauucauuaggggauugaauauuguuuccaggaacuucuuugggaaaaguauggggacgcguggucccauguuuuaccucucuucugguggugucugggaacugccuguauugcucagggauggggaggaggggcaaggugaaguccaggacagggggucauauccauguggggcagcagagcaaggcuguaugccaggcuggaaggggaaaguggggccugcggugagcaggaccuggguccaugcugaaugccaagugguggaggggcgggagaaggaaggccuuccuaugagucuuaguuuuucagguugcuuaggcaaaguucuuccucauggcaaccuuuaaugaagcugcucccugagauggucugagcuuguucauauuucuuuauuggggguggguggugugggugugaaugcaugugcuuuaugugggaugaaccagggauuguaucauuuuggggacuauccaggaagggaaggucauuggcugaaggcuaaggcuauugagaugccucauuagcguggagaggcuguccgggugcuguuauaugacugacuucccaccgucaucuuagcugagggucuugguuacccacuccagagcaggcauggaggcagggaggagcagcucuguucaugucaucucagaucucugagauguccugggguuugagcaugcuccaccuccccagucccaugccugucugguggcagggcccacguguccugcagggacugugcauccuuacaggcccuuggauggggcaagcccucagaguuccccccucacagccauuuuccuacucaacacagaagacuuucagacuuauuugucaaacuauaauauuuaauagcuguaauugucuaaacguccuaauuauauguugagcuugcucaugcuugucagcacuaccgcuuccaggcaaagcuuaaacaucacauaagccagucucuaauguuauaauagaauuaaaugcaucugaccuggguccugugcuuauuucagacaucggaaugauucuuaucacgaagcucuaagaacauuucaauuuaaaaauugaccuuuuggaaucggucccucuaguccucuaguuguacauaaucaacauauacuuuaaauaguaaccugacuuuauuaauguuucuucaaaauguaacaugguuauaaaaugucuguagagcaaaaugccuuuaaaaugacauucucuuucuuuauagagauacuuucuaguugggagcaaucaugcagaaacgaaguaccguguccugaaaauugauagaacagaaccgaaggacuuggugguaaucgacgacagggugaguaucguuaggcucccugcccggcccucaugcagggcuccagugucuguuguucugaggaggugaaaccacagcucuuagugggauggugccucacuuaugaguccugcaggcaacuggcaguuuucagaggcagauaaauaacccagggaggccucacagauggccugugcuugucccacagcacguguacacacaacaagaagugagggaacuucuuggccgccuggaucugggaaacagaacaaagaugagccagaaaggauccuccggguuguuucgagccgucucagcuuuuggagucguagguaagaagugugccucccuugccuguuucuuuauuuugguacagauuacuuagagagcucauauggcucuauagcuauauagucuuaacacauccccgucaaaugucauuaucaaucuaucagacaauauccacucaugugcucggcaccguucagguuuauauagagauaaacaaguagagaaaugcuuggaggugucugaugucuggcuugcuguggaaugagaaguuaacacuagcgugagcuauaagcaucuaucucacugccuaucagucagcuagaaccacagauacaguaaaacuugcuuuaaauugaacaggacagguuacaguauagccggucacagacuuguucuuuggaugacgucuuacuugaauuuucuuuguuaauaggaugaccacagacaacacuugaggaaaugguuuauuuggcuuguguuuauagucagagaagacagggcagaaacuagagguagggaugaugcagaggcuauggaggagugcugcuuccuuauggcuugggcggccugcguucuuauacauccaggaacaccagcccaaggguacuacccucagugagcuggacccucugcacgcaggccaggccuggagaagcauuuucuugauuaaaauuucuucuugcuaaugacccugccuuguguuaaguugacauagaaacuagccagcacagugaccccuuucuuacucaaugagaaaguuucuucaggaucacagagagaaagauucuauucuuacuaugacucagagaugcgauuuccaucuauauauagcaaggucgguagaacuuuagguaagggauuccaagcugugcuagcuuugcagggcaacuggacuuuaguucacauuaaagaccuaguguugaucuccuccccaaccucucugaggcagggucucccugucucuggcuggccuggaguuugcuguguagaccaggcugcccuugaacucacagagauccuccugccucugccucccaagugcugggauuaaaguuguguauguccacagcuagccugauauugaugucuuuaaguacagucugcuuuagccugugccugcuccuucccauuuuauuuaggcucugucucccuuucuuucccugcacuuacaugcucuguguuccccuucucgugacagaccauuaaacccaucugugcugcaugauggcauguguuacuuuuuucauggcugggaggaagcagccuagaauggucuccuugguucacagucagagggcacagcccuucuuggcagagaaggcacaacagccaugguaggaggcagcuggucacauggcagccacagucaggaagcagggaggagugaaccucucccaucuucuccuucucauucagucaaggcccccagcccaugagugagggcuccugccucuguuaauccacucugggaagagauuugucuccuaggugacauuagcuaucacagauagcucugugccugauggggcuaggacagaggagagaagccaguucacagucaaggcaacuauaggcuauaauuacacagccgaguccuauggugaaguucagacauguuggaguuuggaauacucagaucuggauggcaggagagcuuuccaggaaaagaggagauuuacaccgcauccugaggguggagugugguccgggagaaaguaggaagagaggugagggcuccuuaggagugacagcagaggccguagcuaccccauaccuguaguaucugggggguuggcaaguagucaucauagcaaaggcagggugcucagggcuuugggagcuugaauauggaaaaagcagaauauuuacaucacagccucucagcggcuggaucuuaaaccugcuauaguauacacugggcauugcuacugauguuaacgauggauaugggcuucauguuauuucaaguuuccaauuagcacuuucuauuuuaaugcugcuuauugaaacuuguacuauacucugccauaugugaacuauuuuguuuucucaguguggugucucagcuucuacauucauguuuaggcccauuuugggucccggugguuacccaugaagacagagugguaagacguguguaaugggcaaucuugauugccaacuagauaggaaugagaauuacuacgagagucucuguggauaugucggugggugugcuuccagaaagugauaccugagcaggaaaacgcccccucccccagugugggcagggccauccuugcucccucccccagugugggcagugccauccucuaggcuggggucucagacugaacugagcaugauggcauuuuucucucucugauuuuuuuuucacuguagcugcagugugaccagcccccuucuuccccaugcuucugugccauuucuucuccacccuguggacuguaucucuucaaacaaggagccaaagucaaucuuccucccuuaacgagaaaaguaauaaaugcagcaccguuggcuuccucucuuggcuccuuuuguuugccuucuccugagucuuggcaaguccuuugagcuuccuugauuaguuugagggcgugagaaggcucauuuaauaucauauacauccauccguuuacauuaguaaguuguuaaaucaaguacugauuauauuuuaaaauuaagaaaaaagacuuaaaaggaauaggauuuaaguauaguauuuuucaacuuaauaguuacuuaguagucucaccuuauuauuuuaaagcugauauuuuacuauaacuuaaaauaccuauuauguuuguuauuuuguguauaugauuguuuugucuacauguaugucugugcaccaugugcacgccuggugccugaggaggcaagaagaggauguugcuucuccuggaacuggaguuaaaaaugaugcugagccacuauguggaugcuaggaaucaaacccagguucuuuagaaaggcaaucagugcucuuaacugcugagcugucucucuagugacuagaugggcuagagcagucauucucaaccugugagucauuacucccguaggucauuaucaugucagauauuuacauuaugauuuauaacaguaacaaaauugcaguuacaaaguagcaaaaaaaaaaaaacuuuuauggauggaggguggaggugguaaccagaacauaaggaacugcauuaaaaaaggcagcauuagaaaggcugagaacacuggacuagagucuaguccaaagaauuuauuugugugugugugcgcauguguguguguguacauuucuaugaaagugcccacagaagucagagaagacaucagauccccuguaguuggaguugcaggagguuguuauccacuugauguaaaugcugauauucaaacuugggucugcugaaagagcaauuuguucuuaacugcugaaucaacuuuccagcccauaguacaacuuuuugaugauaauuuucuaagguguauguggaauagaaugccuuauuggcuagcauucaaaauagaaauuaccuugauuaaguauacaaagugaagggagauuauuaaauuacauuaaaauaggugcuguggguauucuggcauuguuuugcacugguuguccuuauauuaaaugaugucuagacuaugcaauguugguuuuuguggcacuuuuugguaauuuuuuuuuuuuuuuuuugcucucgucaugcuuucuuuuuagcagucuucuuugccuaauuuucuauuggucaccaagauuucaauaguagaaagcuuauuugauuaacugauaaguagguauuaauuuaacacacacaugggcucuggauggggccaucuuagcuacuucucucaucguaagcucucuggcuggaggcugccccuagguggugacaacagcucaagcaguuauacaauguaccgaguguaguuacugacuagagauguguuucaugcucaguuuacccagaugaaggcuguuucugaucagugaacacuaaauagagagcgaaugaaaguuucuguuuuuuuauagucuuguuuuagaaauaaugaagggcacugaaauuauagaaaauguuuaccuuuagaaaaaguaucaucucacugucaaaagaacacuugugugugaaaugacugaaauuuuacaugguuacauuacaaauggauaccuuguauucuaaaauaguuucucugcuaacuuccagcaagccaaguuuguggauguuuuuguugugcuauuuuuaagcuauuauguuuauacacagucuauaagaauccagagcagcccuccucagcuuuuuguaguucagcgccagccuucccaccaguauuuugcagagucaaacauagugcugugauucauagcuuguguguguagugugccaugugugguaugcaaucuccucuaugcuugauuagagugagcucgauagagcauccauacagguguuguggcaaccucaauguuguggauugcuguuuguauggucuguucccucaagaguguccacauucagcuguggucagguaaaaucuuaauuagucagauaaggcuagagccugugauugggcaguggaagggaagacggagcugaaaguuuuagagaggggacagagagugagggagagagaagauggaggaagaagaugagccagaagcccauggccuaagagagacacagguagcuauagauaucauagaagggcaauagagcaaugucaguuacauuugccccuucuagguaugcagcucguguuuauaucaguugaguuuuguguucuuugugcaggccuuuugggguuggagauuuaccguuauaaaucugguugcuauauugcaagcccuuaguguuaucauuuuacaggguuaaagggauuugugcgagcagcagcuggcuuucugaaggcuagccacagggggugguuggccugggaacaucugagcaucucagagguggcaucaagccacgggaaccacaggggcuggcuggacggcagcugucggugccuagcuggagauagcuuaguguagacugauuuuuccuaacuacaaucuacaacucaaaggcacagacauuucuaagcuaucagucucaguuauggacuugugccucugcuggagccucuccauuguuauucagugaccagcaagaacuguggaaaccacagguagggucaggagcacugucacaaacuuguucuaucugucccugaagcauaugguuggaggucugccguccuucugagacuuagcuaucuguucaguguccuuuccuagccuuugccaccucuuggaggacacucuugguauguugaaggggggguggcaaaaauauacacugaaccaagguaaaacuaaagcaccauuaaagaugggguaauggggggaagaggaugcagggucacagugaaaauuacaaccaagcaugagccucagggagguuugguuuuagggaugguguuugguuucccaggagcugugcugugggaagguccugggugucuugugagggucuucacacuucucuguuggagggcuaugcucacugaagacuuuuagggaggcuggcauaggagcucucggguuggguguugacucuggucaguggcugguggaguugguucuuccuccaguguuccauaaacucuguucacacauucucagcccagugucuccaauaccacacucaagugauguggccuucuuuauauuagagagagaggaaccacuuuuaccugaggacuacuaucuagucauguaggaagcacucagugaaauuggccugggaucaagggcuucagagaaugaagacagagaggcugauauuuaguugauggcguuguacugaagcuaaguuguucuuagcuuuauuuggcaggaauauuuuuacaaagagggucacuuauacuuuguaguaaaaaggaagaggaagcuaaaaugacucaaugccauugucuugggaaguuucagccuuguggggaggaagcaacaucuauuucucuccccagguccaagugacagaccagaccuuagccccacccaaacuccccugaagaacugcuguguuuauugagccuacagaaccuuagugagagguuacugacaggaacauguaaccccccucccccaaaagcagcuacacuguaaaguauggaaccagcauggauaguggcuucccuaugguugcccaaauggaguccccuuccuucaguccuaacccauaugcacuaaccccucccccagacccugagcccaugagaaguuacagcaaaauuguaaugauugguuggaaggagugucuagauacucagcuuaaggucuggugacccuccccuucugugaggggagggcagcagucaagcccugggugcugccuuuugcaagcaggcgcagcugaacugcugaagaugguggccauugagcacagagaauagucacacacaacauagccugcuguucuuaacacaguuuuucuugaauaaacauuuaugcauuuguuuauacaucaagacugaacuuccaguguuuugcuuuguuuuaaaauuuuugcaagaugugguuguuucccuggggcaagagucuggcuugauucucccauugucucuucaccaccagcccccucuccaccucuagggaaguuguuuuaacccccagagauggaguucuguugguuucauaaguacuaggcugcaacaaaguaucugacucuuuauuuagucucccauauaggauauacacauuccaauuauuugacaaaaaaguaaacauuguuuuguaaacucuuuagaauaggcugaauauccuuaauuaggaaauugaaaguccagaaugcuccaaaaccucugaucugcgccagcuuuucuaaguagcucaugugauaguuaccuuucagucgcugaaugugguguaguuagaagugagcuccuugcuguaucaauuaagaaaugcagagacaaguccgaaugguucagagggcaucugucugcgucuuaugugugucuuuuauguauggauuuaucucacucucccuuuucccagugcugaugaucaggccucggggaaugcugggcaaacaguccaccacugagccacuuucccagccugaugauguaguuuuuacaucguuuuccuuuacugcaagcucuucuuucuuucauuuguaucugugugagugugcauguaacuccguguguguguguguguguguguguguguguguguguauguagaaauagaauuauggcauaaaucauaaaauguucugucuuccucacuuuuaaguguauaauucaguguguuucuuaucuuuauugacagacuuauagacgguuuuccuuauaccgaauugaaaguauucccucaaacaacucuucuuaauuuuacauauaauguguauguuuauacaauacguauucuauagguauucuauaugucuaaucauauauauaggacuagguuauaggcuuuccccaaacucacuguauagcugaagaugaccuggaacaccugaucuuccugcuuucaucccaaggcuaaaacgauaguccacgccacugugccugauuucaucaguguugggacugugccagacuuugugcaugcgaggcaaguacucuaccaacuuagccacaucuccagccaccacccaaaauaauuuuaggcuauguaagugccaaaaauuuauaugacuguaaaguuauaaaaguguuaaaguaggaaauguguaaagucuuugguaaauauguuucuaaaaucauuugcauugcuaaguuuaugugacauuauauuuguuuuucuuauuuacagguuuugucagguucuuagaaggcuacuauauuguauuaauaacuaagcggaggaagauggcagacauuggaggucaugcaauuuauaagauugaagauacaaguaugauuuauauccccaaugacucuguucggauuucucaccccgacgaagcuagguauguaccgguauuggcaacuuauuauuuguuuuugacagcaacagaaccaaagaaauacaaauguuuauagaaacauugaauguuggaucaauauuccaguuucugcuagggguuguaaaggucuuuucugaugguccagugaggaucagcagucaccgcugaagcugccaggugugggaaacaagguucacauggcgucagcaugcuaaaauaaguguauagcuuuugauuauuuacagagaugaguaaugcuuucuuacauuaaaacugguagacauauuuagccaaacgaugacacuuagagucaccucuucauuuauuuguuguguguguuguaugugcacacauaaguguguggguuugcaugcaugcagaggcuggguguuggguguucugcuguauuuuuuuuucugcuguauuucuucaagacauggccucucacccgaacuggaacuugcuguuuuucuagcuagaauggcugccauuggccccagugaugcuuccgucuccucaccugccuccuagcucuggcuagaugagccugcagccauagcugggguuuuauguuggugcacacuuguuaagcgucucacucauugggcuuucucuccagcccuaauguuaccuuuucauuugaaacaaugggaacaacacagacuaccuuaguaauucugcuuaaaaaguuucacgcauacagaaauaaucaggcaaaucuauagagugggaccuuuugaaaagcaguggucuucaagacccuuacaaaugugcaagucaucaaagaaaagcauagacguguagauuuuagaacagacaagauaggugcauccugugacucucacuuagauuuccagugaagacauggcaugugugcacacacauacacagagcuauaaaggacuacugggacgauguuagaaggcauauggacuauaacuaggcuucaguuaaugccauguauaaaaauucaaaggauaccaaggcauaauuauauuuuuaugguugguaauaguuauaauuuagcuaugcucuuucauguuuaauauagugauuugauaaucuucgaauaaaauuaucuuaugauuagugcuggguacuauguagacauuaucuacaauauaguacaauuauaucaauagcuuguuauacgaggaaugaaguaauauuuccuaauauaguuauagagguaugugaucuaguaauacaguaagaauguuuggaaagaguaucaggaaauaaaaugcaaacuacuaagcauguuaacauuugguaagcagaggcugucugcacugcaugcuuauaucgacuaggaaauuuacuggaacaguuuccacuuuaagguguuguugaagagaauuaugaacaucuucauagaaacagaaauauacuuggcaaaauuccaggucuuugugaucaaauuuuaguuuacaguaguguuucucaaccucuagaacaguauuuauuaaaagccuaugauaaaaauuauucuuauaacaagacucuaaaagcaaagccuuugauuuagguaaggaauaagccaccauaacuaauauucaacauuguauuuagaacccuagcuaaggcaauguuuauaaaauaagaauccaaucagaaaaauagagaauuaagcuaaaaaagagacaaacgauuccaagacugccugucaacuuucagaaccaaugcaaacguucagcagaggagacugaggggaaauagucaguguguaagaacaguguguaagaauaguguguaagaauaguguguaagaagcagugacucuucucuacuaccugcaguguguugucggcgucuccagaggucaugaguuacaggaugaauucuguauauagccaggagauucauuagaauggcaucuuacaggcuacgguccagcuaauccaacaauggcugccugugaauggaaauuccaguagcugcucaauccauuaggcucgaugucucagcuggucuccuguauaugccgcaguccugaagaaguaggcucuaaugccagugaaggaauggguuugccagcaaggccagaacaagcaugcaaagaacaaaagcuuccuucuacugugcccugucuaggcuuccagcagauuguggcccagauuggggugugucuucccaccucaagaccuggauuaaaggccugucuucauaccucaaagauccagguuagaaaugaaucuacccacuucagauuaagcaaagggccuuuacaggugugcccuccauuuuuggauuuuagcuaguuccauauauagucaaguuggcaaccgagacuagccaucacaggcaguaaccaaagagaaaaaugaauggugacauucauagugcugaagaccauauguuaccugggaguaaauauggcaaaagcuacaugaaguucagugcugaaaguguaaaacaguacuagaacaucuuuaagcccuaaauaaauaggaagaauguccacuuguucauaugugucuaggcaugagaagguuuaaaaucauaagguuagcuuuguuuuuuguuuuuuuguuuuuguuuuuuuuuguuuuuaguuaauugagagauauaaugcaacugaaauccaaauuccaaggugauuucagaagaaauuaggacauacaaaccuacuugaaauucauauugaggggcuagagagagggcucagcagugagaagcacuuugccugcugccuuugcagagagaggccccagguuugcuuccagcaccuacaucaucagcucacagcugccaguaauuccagcucaggucgguccaguguccaguucuggccucuguggguagugguacucaugugcacauaacccuagcauacacuuaaauaaaacuuaaaaauaaaggcuuuaaaauucacauagaaaaccagaaguuagucuuagucuagacaacuaugaaaaccagaaacaaaggacaaagaggggcuggagggauggcucgcuguuucgagcaugcaugugccgcuccugucgagccuucuguaacucuaguuccaggguaucccacacugucuuccugucuccucgugcaggcaaaacacucauacacauaaaguaagaacaaggcaauuugcaaggagaagggaaaugacugagcagauguagcacucacaggaauuaaggagucaguuaucuguggggacaguacugguuauugaugaggccacugacauugaucaguacagacaaggaacccaggaaaugacccacuuuucauaggaaacagaucccacagagaaaagagugcacuacaagucaucauggagaagacagacuuaaguuuuguguguuuuccauuugacagaaaugaaauuagauucuaaucucuaauaaaacugaagaagcaauuucagcaguacacagacaauuuuaggagaaugauuuuaugauccugaaauggaggaagauuuuauaauuaaaacacagaaagcauaaggcaggcagaaagcagugauguauguaaaugcucucaaaauuaaaaguguccuuggaauauaggcuguuuauaaggcagcggucauauagacagaacacaccuaacaagguucagugcagagacuucugaagggcugcucuggccagcgaggguaagaccagcccagaaaaguccuccagaggaggggcaggcagcacacaagagacugcacuugcuagcaaucaaaucuaacaggggcuaguuccuucucuuagucgauggcaccugcugucaccagaugcuagcaggacuguggcgauguauuuacccucauaaguagggcugcacggcccgaggaugggagcaguaacucagaaguugccucuggagagggaacagggcuggugggucuagagagaauguuaacuuugaaaauuaugauuuaguaacuuaccuaagugugaaagugaacgcaugaguaacugaaccgaugucuugugaggucggcugagguauaguucauucuguccucuucuguuuccacgcuaaaaauccuaccuuagaguuacagugacccauggggucuugguuacuuuuguggcuucccuuucuucaucugcugaagauuuguaaagcucacugggaauaacagcaacaacaauugucuuucugccucacuugcccccguucccugcccaugcacugccuggcugggaggcacaaucacugcauaaugggguacacgcuguguuaaaggugucuagcuaucugagcgaugauuggcagaugcacacccaagccagagauggcugcgauuguucagcucagugagcacacuuacuagggugaggauaucucugacuguauguuaagccaugaaaaauaacauuuuauguuuauaacauuuuuuuuuuuuuuagguaucuaaggauauuucaaaauguggaucuaucuagcaauuuuuacuuuagguaaguuucuuccuuuuaaaaaccugauucuugacauccuaaauggauagaguaaagguacauauagccacuauaaaaaucaccuuuguuucaggaagaaauuaauacgacuuaaagaaauaacuucauuuuggaauuuuuaaucauaaaaaugaaauuguauuaguucuaaugcagagguguaacagugccaugguucaguuucagcuaaugaucuggcaaaauuaaguaaaagcuaauuagaaauaggaaaauagauuucaauaccgauguauugcugguggcccuguaagugaauaguuuugcuugaaugaauguaccauuaagcagauuaaaaauauauccuaagaauauguuuugggagagaaaacagaaaucccucuugguacagagacauuuauggagaucugacauuugugaagaucuauuuaacacagccagcaagcagacaagcaagcaauaagcaaaugguagagcaucgugagcagucugcaggccggacagacagacucaugugugguagauggaggagucugucugcuguagugucuaaacugagauguggacgcgagaguguucaccaguaacgaccugaucuggggcugagaugggaccugcagcacagcauuugugugcauuggcggugcacacagaccagaccggcgcuucacauuuuuaaagaucuaucuuuacucguuaauagaguuaaucacuuauuuauaaaauaaacacaaacauaauguaaagauaaaguuauuaagucauaggacagaggguucucagugaagugcuuuuuaauccacaggugcuuaguggcuugugugucuccaugugugucugauucaucuauuucacauaauacugugucgucuuacgcucgggugcugugaguuaaugcugacgcuugguggcgcugcuguuugaaacgggcuccuucuugagccauucuuggccauacuaaauuuaaucaagucauuccucaaguuauaauauauauauuccauuauuauuauuauuuuauuaauaugcugggaucucagggcugcgucaugccaacuagaaauaacuugucuucauucauggcuaagugguauuaaauggaucuaucaagcaaaggugcuaaaaccgaguguaacagacaaaacugaaauuaauuucagucaaauuauggaacuaaacuggggaaauaauaauuaauauguggcucuccuaagagaauuguaauacuucugauauugcuuaaauacuguacuugagucucaagauaguuucuggaauucuguguuaaaauggauaacuagagauaauuaaagacuauugaucuguguaaugcauaugagcccagagagacugcaucaguaugcacaggccugcuccggucugcaucagaugggguccuagagcuggagggagaaguggacaaacgucucauccccaauucagagcuaucugcaggugauaguuuccucugcacuagucucacuggggaaacaaacuacuguaaggauaggcuucaugcccaguagcagauaccaacagaaaaugaacucagcagcaucuuuggagguuccucauaaugucuugucguggaucuuccauuauuauuauuauuuuauuuauauauucuuucucugcucuuuuaaccuucagguccuuugaauauauauuauggcuuccaauguaugggauuugugagugugugaacugugggucucuuugggugcuuuuccuucuguuugcuuguuuugucugacucugguguguuaguuuuuguuuauuauauuauauuauuagugcauaaagaagucuguuuguuuuuuaaugaaaaacagaagagguuggaucgagauggguggagagguguggaggaccugggaagaacagcgagaaggggauauuguaaucagguuuuauuaugugagaaaaaacccuauuuucaauaaaaauuguugaucuuaugaaauuauaaucauaaauguuauuuauacauaggccguguuaauuuuuauauuauucucacuuuccuaggacaugcuucacuguaagagcuuacauaauauccuuaccccuguaucauuaugaagcuugcaguuacuuuugcucauguguaaacuaugguaugaagccaugugaugaggauacuauauucuaucuauagaaccuaucuauagaaccacauucaugggcauaaggcagugugacuuggaaugagauacgagauugauuucaucaugaaacaaccaaaaaacuuugcauguuccaaucaaugaauggaugugacccacaucauaaauguguauuucuggguugcaugguuaaguuggguagugagguuuuaauuuccaaucguguuuguauuugacaguguuugcaacacucauuuaauagcauugcuucaguggaauaccaggugcaaaguaauuuagcucacagauuguaauuccccuugggagccaagaccgugaaaugucugugcuuuuguaauucuuacgucuaaauucuccucucaguuacagcuaugauuugucacacucacuucaguauaaucuuaccguccugcgaaugccccuggagauguuaaagucagaaacauccaaggcgugccaggagagcuucgacaucuuugaagaugaaggauuaauuacacaggguggcagugguaggugaauucugcauauuugguguguuagaauguggcaucucaucaaaguccucccauuccucauccuucauccuuugauggccuuuauccuuuuggguugucuuagagacaugaacuugaccaauucauuuuuaaagccaucauuuaucacuguggcuggcauuugcuauguuguggggucuucuuucuuucacucuucuccaccuuuuuccaccuuucaacuccccaccacucgauaggagaggaaaaaggauaaagggagagagagcacagagcaggacuagagagacaacaguggaaggagcaggacuacauucuggucuaggcuuaagaggggaaaccaguucugugccccuguuguuagcuguggccuuccaucccacagcaagcagugcccugcuauccugcuucacuuguaagaacgccaugguuacagcgggucuuguguaugagucacaagaaucugggcucaaggcuguuggccuaaugggcuucucuuccuccuugucauuuaauguaaccuauggccaggugcuggugacgaggauuuggacauuuccuguggcucagggucauucugucuggggaagcugguagagacggggagugaggguagaagguggaaggguagguuugcuaaagucuccaguuucacuguaugucaggugcauuaaggacuuuacagaagcucccuucaguccagacuccugugugacgagcagcagcaccuccugucuacaggcuaacuagugcagacauggagauaguuauggacaaccgcacuaacuggccaauuaaaaguauuuaaguccuuuuguuagcaaugaccaagagagggaccacaccuggggauacagcacuuuuaaagacaaaaccauaauuacauuuguauuugaaaggggucggagcagcaucuguccuuuuggagaaccuagcaguauuucacagauaccacuugacaauuauuuuugacuggcuuauacuuucucuuaguuaucuuaguuuuauguuucauugugcacaaacaucacuuauugugguuaauacgucagggcagggcagggaccguuccaaaauguugccaagguggcuacggccaugagagcagugguggaaggcugaggaaggucuagaaagacaggaagucaggacuaagucacuuguguaaagugacagagcggggagugucugauacaacaauccccuacccccuagggugcccugaucucucucucucuucucuucagggucucauguagcccaggcuggccucaaacucgccgugagcugaggaagacccugaacuccccuucugucuucuccuuguggggcagccaugaccacggugccugguuuauguugugcuggggaccaaacccagggccucaugcaugcuaggcacgcacgauaccagugaggcacacccgagccuguaauacacgcacacauccugcacauaaaaccccuucucucccugaugcacugagaggccacuggacucuaggcgccauguuuguuuauguguuugcuuuuuguuuauguaugguaugucugugccccaugugugggcuugaugccaagaggucagaagaggacauuagauccccugaaacuggaguuccagauuacugugaacuuccguguggguccugagaaucaaaccuggguccuuugcaagagcaguaagugcucuuaacugcugagccagcucuuuaaccccuagauuuuauaaauuaaauugaaacacauucagcccauauacccagcucacauuuugaagggaagacaaugggaucaccugacugcuguuaucuagagcuuuucauccauuaguauaaaaaugccuauuucuuauuuuucacuucauacagguuuugugauacucacugauauuuaauaguaaauucaucuugauaugccagaauguuugaugauuucuccacaugaaagaguccugauauauuagcugaugccaguugggaagaaagagcagugcccgcccuacugugaacccucaugugcuuucucaucauuucauucccucagugcugccuguuagauguggacgaggcaccaggcgguaaggggcacucuggacccuccuuaccacggcagcggaaguccuagagccagucgcccgccguaaccucagacuauguucucuguggcucucuuugcccauuugccuucauucaugcaucugucaguacauacauacuucauuugauguacucccacuuucuuuugauuuaaaaacuaugauaagucggaaaacccauuuccuguuugacuuugaaggaaacagcacaccacccugggcgcugaagcucaccacgguggaccgccauagggaacagcuaccggaagcgcagugcuguccaggccugcaucugaucuugaagcagaaguggaagaacguagcagugugcgggauaucacucaauguccuuauguccuugauacaaacuuuuguuuuucagguguauuugggaucucuagugagccuuauaugaaguauguauggaacggugaacuucuggauauaauuaaaaacacugugcaucgugacuggcuauuguauaucauucauggguucugcgggcaguccaguauccuuuuuauaagcauuuaagaugcacgucauuaugcugugccagcauguaggaaggucaagcaucauaguauuguaauuaacacucugaguaccuguccuauuuaggguuucuauugcuguggugaaacaccaugaccgaacccacacugggagcaauggguuuauuuggcuuucgcuuccaucauuguucaucaucugaggaagucaggacaggaacucacacagggcaggaaccuggaggcaggagcugaugcagaggccauggggguggugguagugguggugcuuacuggcuugcucuuuauggcuuccucagccugcuuuuuuuauagaacccaggggcaccugcccagggguggccccacccaucaaccgccauuuuccugcuacaugaaguagcaaugagacagggauguauaucagauagaaaaggcugcgguaguaguuguggcacaauggagugcagaccuugauuggaaaggauuguaauggaaguccuugagucaggccucggagcucaguuugaugacaccuuggcuuuucuccugcaggcugacuucucacugauucuagauguugcugaaggcuuucaauagggugccaucaagcuguucggaggaagaggaagugaaggaggagaaggagggagaggaggaggaggaggguggggcgugcuaucuaguacugcuucaguuuucuuuuugagacaacagagggcauuugugaauucuguguuuacuugauacuuucccuucugucuuaagcuuuaaaagcauaucguaaaaucuuuaaaggaugggggggggcauuacaugggcugccuucuuauaaccucugggacauuuguaggggcuugaggauuggccaugcugcuuucucugugccaaguguggggaggagaagggcgcggcagacacagggacuuugaaguggagguuggagagacucguggcgcacuacuucauagucauuucaaccaccugacgagacuguccugaaucacuuuugccucuguccaaaaauacagucuuccugggaagagugucagauuuuccccaccaaagagaacgugcuauggcgucucaagacuguuucuaaagugcaguucuagccugguuuguauuuccagggccuggcaucuaguaaucauaauaaauguuuguuuuuaaaauaucaaacagcaucauggauuaucauuuuaaagcucauuagucuaacugaugagucuggcugcuggugaucaggcauuuaaugaacucuggaagccugugugcugguaggaguaauugguguuuauuaagcauuuacuacaggccaggcaccagaaauguuacaccaauuaccucagcugauccucccagcaacccagcagcaggacagauuagugauuauuuuauccagcaggcuuacaucuagaaguguuucacaguuuggauuuuuuuuuuuagauuuuagaauauuugccuaaaccuuagauaacuugaagauggaauucaaguuaauuuauguuucauauauaucuugggacugaagguguuuaugugcuauauuuaggguaccaauguuuugauugacccacaagacaaggucagguauagaauuuuacacuguugggucauaguggcacucaaaaguuucagacuucaaggcauucuugauuuuagacuguaguugcucggccuauagcugcuuuuugauugauuuuuucaguaggugagguuauaacucagaaaguuaaauaagaugauggaaagaagcuguauauuggccaagcaguucacuucgacaccuuccuggguuuaagcuuuggauucgccuuugcagucugaaacccagucuuucccgcaguguugacaauucuuuuccuaauuuccacguaacauuaaaggacacgugcccuuguggaggggcauggcuccaggaaggaaggaguaguuguacuuuuaacaguauuacuugguuacaaggagagacauaauacaguaagucauagaaauuaccacuugagcaugucggguguugccauugaacuuggacagaucuggaacuuucuggcccugugcuauuauauucuccauggagcuuuuagugccuuaaggcuauuggauaagauuauuuaaaugcauaaaggguaaggauucuuguagcuuucuguccaaucccaaaugcugaaacacuuuaacuuaauucuuaagagcuuuugaucuauggacgaccaguguaugugacccuaauagccaggagauccaguagguuugcugggacgcgcuuucucaagagaggcgcaaacugugagguaagaugacaaauugcauugcuguaauguuguaaccuuuaaugucaguuucacugaugaugacaaagcuguggacuucuaaggaacuaacuucuuaauguccgaauguauuuuauuuaugugcaugcacaugugaauugguauguuuguaggggucugagcaugcacauaugugugcaugugguggucagagggcaacguguagcagucauuucucuccuagggauggaaucagauugccaggcuuggcaggcagcaggugccuauuuugcccaccgagccaucuuaccagccuacaaaaaucuacaaauguguugagcaguaaacuaucugagaaagaguugugcaauggcgcuuugaaauguccauugauuuggaggaugagccauaucugaaauacuuggaaaauguagggacaaaacauccaggcacccucugaagaaagaggagaggaagaguaugugugacgggaaggcaguguacagcacggcaugggaaacuucucccucuuuccuuucucucucauacuuccaugucggcucccaggugcucuccucugcagcagagugugauagaggcaucgggcuuugauccuagcuuuaguagcaacaguuuucguaaauuuauaucagcgcuuccagcuguuuuacuugguacguuaggaacaauuaagaugcuguggcuauauuacuugcuuuucaguagugaaaggauaaccaagcccggucccagugcuucuggaagcgucccuucuaucuguaucugcuucuguaagccacgugaccgccaauggcgccugucuuuccccuugaguccguccuuccgaucaccaguguuacucagaucuucaccuuggucuucagaagugaaaguuuuagauuuuuuuguucuuuaucuccugcauaauuaauuucacacgauuguuuuucuucucgcuggcauccuaccauuugcacuggucaugcgcuguuugcuaucuguguuaacuugauuuuuuuucuaguccguuuucugcuuuuauuuuuuguuuuuugaacaagauuauuaauuuauuaucuuauuugcuaguagcacaaaggcuuuauuaaaauuuuuauugagcuuauuuuuauuuguaucucuucuguuuagcuucucuguacuuuauugauuacccacaucuauuaauuuuuguuuuucugcuuuucuuuaucauguuuuaaugguucugcuuuuccaguguguacuccaaacaccucuuuuaagaggaaucaaguuauaauugcauuguguacuugaguuuuuucauggaaaaguucuaagagcacaagcuauguuuaauugcgccuuucuuuucagggugacguugcaaaugagguggagaccgagcagauccucugugaugcuucugugaugucuuuuaccgcaggcaguuacucuucuuacguacaaguuagaggauccguucccuuauucuggucccaagacaucucaacuaugaugccgaaaccacccauuacacgugcgugggccagccugucgggaguugcuuuugucugcugucauucaagaugaugagugcugccacauagcucuaauaaguggcuggguuugggugaaauguuggucuuugagcaagauuauauggaugaguagcuuuuauuaccuuucugcagugaauucauucuuuuuuuuuuuuuuuuuuuuuuuccauuuuuuauuagguauuuugcucauuuacauuugcaaugcuauaccaaaagucccccauagccacccacccccucuccccuacccacccacuccccuuuuauggcccuggcguuccccuguacuggggcauauaaaguuugcguguccaaugggccucucuuuccagugauggccgacuaggccaucuuuugaugcauaugcagcuagagucaagagcuccgggauacugguuaguucauaauguuguuccaccuauaggguugcagaucccuuuagcuucuuugguacuuucucuagcuccagugaauucauucuuaacuuuaacuauuaguaaguuguguguuacuuugcuucaggaauggcagacgcauucagauuuaaugcugacugagcguccauggagcugcuucagagcgucuggggaaggaaagcacuucaugaguugaacugcauuucuuugcaaugguuggaaacccccgagucuuugauuuuugccucacagugccacuccccucuucuguccccaguggaccaggcggaucccuuugcacacguggcugcucuucacuuugaccagaugcuccagagguucggcucccccaucaucaucuugaacuuagugaagguaaggugugcuucucagacacacuaauggccuuucuaaagaccaaaggcauuggccaacugugcucugccuuccccaggaaaagagggaaaaggagggaagaagagacgagggcggggugcagagggagaggaagaaggugagaugucugcuguguuugagcuacuguuaacuuccaugucacuucuucugggcuugccuuggggaacugguacuagaucuuucugaaggaagagcgugauuuagucuacucggcuccugauuuccucgugugaacuagaucuacauuaaauuccuuagucccacacuuuaagaagaaugcagaucaaauggguacacccucaccuugcuacagcccacucccuugacagucuguaagaaccacaaaccgguguagcaacaggaccaaaaggcuucauucagaaauaugguuuaagaaucaggugggcuugugaggagcucaggcaaggugguguaauugucucucaccuccccaucagaguacacugacuaguccguacagggugugucuuagucaggguuucuauuccugcaucgacaucaugaccaagaagcaagguggggaggaaaggguuuauucagcuuacaauuccauauugcuguucaucaccaauggaagucaggacuggaacucaagcaggucagggagcaggagcugaugcagaggccauggagggauguucuuuacuggcuugcuuccccugguuugcuuagcuugcuuucuuauagaacccaagacuaccagcccagagauggcaccacccacaaggggcccucuccccuugaucacuaauugagaaaaugccuuacagcuggaucucauggaggcauuuccccaacugaagcucuguucucugugauaacuucagccugugucaaguugacacacaaaaucagccaguacagggugugugcauaauuggacaugcaggucaguagagggcaauauaacccaauaaauuuuauuuauauccauuguaccuaacugaauuaaaagcaccucagcuaguggcuaagaagaccuugaaaacaucaauauaaagguuuuacuauauuauguauauuaauauacauaauacacagcaguggccagcaauauagugcaugugagauuauucugagagguugcuuagcaaauguuagcuuaguaaggaagcaaacaaacaaaccaagggagaugagggagagaacgaagcaguuguguccuuucgguuucugugaucacaugcagccaaggacugcuucacaacugucuucaugaaugcagaaguuguauauucaugucucauucccuggcugcuugggguaauauaaguuggaaauggauaaucuauaacuuucaacauugaaaaguagcaguaauguacacaguuugaaaauuaagguagaaaacuuuaaugaaaacauuuguucaucugcugcuaggccugguaguacaggccuaucauuccaguuauucaagaagcagaggcagggggaucacaaguuuaaggccuaccuaugcugcagagugaauuuuagucuagcuugagcagcuuagugagacccugucccugaguacaaggaggccagggguggaugugucucaguguuagagcacuggugagcacgugugaggcccagguuucagucccugggauuguacaaacugugauaaguaugagugcuucuccaguaaguauagauuaguaguauagaagcaaauuaacagcaaagcagagagugauggucuauuaguggaacaaauaccuaccucuagaugaguggaucuuguuccugccuuacagaguauaauugaaaacuucuuguaaauggagcccugaauaucuauacuucauggaauucuguguuaauuauguacauuaaaaauguuacuuaaugccuguaacugaacccagccugguuugccucccuaucaucagccaguguaguuugaagugaguuuuacaaaaacauuuauuuacaagguggucaagcauguggagacaggaaagcuagccccagagcccccucucuugcauaagguauaggguauuugugguuaaagaggcaggcgcggggguggggguggggguggaggggcagggucuaaggcaugaggaaggauaauuggaaguaaccaaaaguggacacauugaugaucuacacugugcagucggauugcauggaucuuauagaaugugaguccagaggacuuacuaguguccuaguacucugaggguggacuuuggucuccugguguuguuaugcccugaguucaagggaaacccagaugagcccaagaacuuugaagucagcugcaacuugcaaaagagccuuuuaguuugaacucggaucacauguccugcacugcacucacagggugaaugcugacaaacaaugucugaguguggaaagcacuggguuuauguauaguauaguuaggaauccccugaaaguucacagaaaaggggaguggagggcuguaaucggaacugaagcugggagggggauuaaugagugucugcugugggguuaucaggaacuaauuuuaucgcagguuguaacugucugugaccucugauuaccuuuucuccaugauuuaaaugcagggcccuaaucuccuuaguuuguuauuucucugaggucucaaggacaggcaccuggagaguucguaguuuaucuggaagaguguugguuucuggagauacaaaggggaggaugucucgugcuagaguuuggugccucaggaugucuccauuaaggggaaguuuuauggguagugccauucuaaagcuaggcuggguucccuuggaguggccagggaaggggagggagcccugggcuugcugcaggagacggcagcacagaaaccagcugucugcauauuguguuugcugcgggcugcagggaucagccuuuucucuccccagcuuucugauucccucaugcuuuuuuacuuuguguguuuacugagacuagcaaggggauuuaaauugugcuuuccaauuaaucaaacuagagagcaauuagagauuaaguuacuguuucauagaacaggaaagucuuuucauauguggcuuuuuaacaaaauaaugaagcaauguuagaguuuacuaagaaaaugucuuaaugaagauuuuuaaugugaaccuaagagcaaggacugagacaggaugacaggcauguaagagagucucugugcuagcacaugcuugcaaucugugugcaccucuuagagagagucaacggaaugauaagguuccauuugauuggcuaauaaugagguucaaaccuaggaccucucacaugccuggccagagcccagccacugggcuacacccucggcccugucaugagcuaccugggcuacacccucggcccugucaugagcuacucugugaagaggaugaagcaggugcugcuuguccucacuuggaggaaggucgugguuaaaccaucaaggaaugucugugucugccucucacauggcuacugugugagguugccaagaagaaacaugcuuuccuuugccccucugccuuguugugagucccucccucugugggcacccccucucuggggcccgcugaugcucaggaugaucgguaauucucuguucuuaugucuuauauaauuucucuauuuuuuuuaucagcugugcaaaaaaauacccuuguuuguuuccacaaugguuauuuuccaguuggugacaauuggaaagcagucaccaugauugaaaacagcacaggaguacuuucuuuucuuuuuaagauguauuuauucauuacaucuaaguacacuguagcugucuucagacacaccagaagagggcaugcgaucucguuacagaugguugugagccaccauguaguugcugggauuugaacucagccagugcucuuaaccacugagccaacucuccagccccaacacaggaguacuucgauaccagaaguagcccuauaugucacuuaagucucugcuacaguuuuucuuucuuuuaaguaaaggcccaaugaagguaacaguaauagcuaauuuuucugaagacucugcuaugaacuuccaauacuuuguugcauuuaaaccccacauuacgaaugaauauggggcauauacugcuguuagcccaaggaaauguguuagccuugcugaaggguacugggcaguagcuuggagcuguacauagucuccaugagugagaggcagugugguaaccuaggagguguggcuggcagggagacagggcaaggcucuggucuaugagugccuuccagccacaggucguucugacacugugaaguggggaagugccuguccuacuaccucaugguugcuuuguggguuggguuugaaaaagcacuguaguccucuguagggauuuccuguccagaccaugcuaauuucucucugugcccagcaacugccugguugcagugguggguucucuucugguccuggauaaaugggcuuugcuaccagaguaggcuguggaugugugggccaggcuuguauggaacacacugggaaugcugacagaucaacagagagaaacccgaccuccguggcucuucagagcugcugacccucacucugugaagaugucuuaauuugaauuuauauuguuuucauuuuaguaacauuuaccauuuuuaagaauagauuuauugacuuuauguguguuuugccugcaugugugucugugcacugucuauuuaguuccugaagaggucagaagagggcaucggauuccccuggaacuggaguuaugcaugguuaugaaccauccugugggugcugggaauugaaccuggguccucugcaaaaguaauaugugcucuuaaccgccgagccagcucugcagccccacauuuaagacuugaaauguaaaaagucucucaaaugucuuugauaaaggagagggagaagagaaagcacgaaaggauccugagugaagagcugguggcugcggucacuuaccugaaccaguuccugccaccggagcacaccauugucuacauccccugggacauggccaaguacaccaagaggugagugagagcagagccuggcugagccuccucggggacacagcuccuucaguguccuuggugagacuuaggugaggauguugugucccagcaggugucagguuuccccugaaaggucugucaccuccuuccuucuguuccugacgggcaccagugccgccauuuucuguuucuucucuacucucgggucaucucucuccuugaagaguaagcagugagucuguugauagggagucagucuccucacuguguaucaagccccgucagcuggcugcuucuggaugcuguaccuuaaacuuacucagggcugaucuguuugagaaagccuggucuuuauugccuauagcuagucccaccccagggugguccuguugcccugcugcccaccuccacugccgcccuguccugugcuuccuuucuuaaccuccaagauuugguucaaaacuaaccucuucuaggaaccuuucccacugagccuccaggguuauuuacugucacuguaagacucuggugacuuaacuuaccggagacccccugagggaacaauguggaguugggcaucaaugcaaaagcaagaggaauuuuacuguuccagcaugucuccaucccuguacaggaaggagaaagagaacaacccccgcacagcgacuuuuuaaacaguuuucagagcagcagccacuaggcaccaugugauuggcagaacagugugacuuuuaaacugauuggucuuuagggaaugagguggcaaggacuuggcuugucuguaggugguuaauggucagucugcugugugaaaugugucuaccugcucugcgccucccccccuucccacagguggccgauggucagucccccacccccacccccuguggucugaggcacguaauuagccucucccuuccagaggggaggaggggagggaugccuaagugcuucacaaccucucucuucuaagaggggaggggucagguggaauuuucuacagguccugagcugaccucuucaucaccauauuguuuuguauguguugugguuuuuuuuaugcugaaucuuuuuauggaguuagugcugcagacaugcacacgagcacccacuuccuggagcauguuaguuaaauaguuugaaacagucauauuagcuuauguccccauuuuucucccccugcugcugcccugugcauaguccuugccugguuauguagggauuugacugacagcuacugaggaggggaaggcucacaggaacguugggugccaagagugaggaauaugccgguauuugauauguuauuggcuuguuaguuauugaguacauauuauauuuccagcuuacuuauuuccauguuucuguuucauaaacuacaagauuaaaacaauuaagucccugaacguaguuacuauugauguuguuugcucuagauggaaaaguaauuauuuguugagaccuaaguucccucucuccugcuuuccucucucaguaagcugugcaacguucucgaucggcugaaugugauugcggaaagcgugguaaagaagacaggauucuuuguaaaccgcccugauucuuacugcagcauuuuacggccagaugaaaaguguguaugauacuuaaaaucuuacacgagagauggggguguggaauauucgcuauacaagcuugaucacccacguucagccccuaaagccacaccaccacaccaggguggcaugugguugccaacccaagcucgggggugggggugggagcagagggaggcaaauaccuggggcacaguggcucagcaguuaaaggcuuuuuccaccuagccugcauccugguccccauagauuaggaaaugacucccgcauguuguccuuugaccuucguauuggguacugugagauacacaaaugccucacccagcacaccauuaccacauacacaaagaaaacguaagucaagguauuuguucugaguacagauauuguagggguuagggagagaacuuagugagugacagcaccugccuugcaagcuugugaauggccugcacccaugugggaaccuaggcauggcugugugugccucuaacuccagcacucggaagccgagagucgcuuccacauguuugcagcucgcaagugugcacaugggugcacgcacacacucaaaauaucaugaguacaagaagucugugcuaacuagaggacggauggauggauggacggauggacggauggauagacgaauggauggauggacaguguuuggaacauucccugugugcuugggaacuccugcagugguuauguaccuucagauggaaaccaugagagucguauuauccucuguguagaagaaacaugacauaaaaugugcauaaaguaaacuugucuguagugaauucauuguuuacuauuuaguagaccagggaaguccuucuggcugacaguggauacuuucaugaaaguagagucuggcagccugucauagugauugcucgcagcuuguuugcugguagcuuccgaaaaggaugcauuccuuauuuauauguaaaggaaccaauaccauguauuuccagcauuugauucucaacauaguuaacuaugguggugggaugaggaaacccgaaucaaacacugucuacguuugcaagaagccuucugcuaucguuugcaggguuugcauuucagggaaucuuaagguacauggagaagacaaaacuguggaaggcuuuacuagggaggcgccugcaguugugcagguuacagagacuggagaaagauaggggcuugaaggaaagccaaggcacucugguagaacacagagagggugcccaagagggacaugggcaccuugcgaugccuccaucccaagcuuucuuugaguguggugacugccugucucaguuauucccaucuaacagagcaagagagcagaaguauccgaugucagacaucuucccuucuauugcuguagcucuuagaauuacagauauauauuaugcaauccccgccccuuuaaaaauagaaaacaggguugggguguggcuuagucuuagugcaugugcucauggagcccaggguuggguuuaguucccaucacuggacgacaguggaauguaaagcaucuauuuuuacgcacagguggaaugaacuaggaggucaugugauucccacuggucggcuccagguauggacaauguuauauucacaaugaguacaaucgguguccauggucgguaauguuuuggggguuuaggacuugguuuuuguuuuguuuuguuugagacagggucucacucugcagcccaggcuagccagacacucacucuguagaucaggcuuuccuugaacucacagagaccccaccugcaaacgggugcugggauuacaggugucugcugccauauguacccaauucacuuuuucuauuagcaaauaugaagagguauugaugcaaaauuauugauaacuuggaaagauuuuuaaaaagccuucuugcuaguguuuaaaucuuauauaaauauguauagcugauacuauacagccuauacauuuuucuacauauaaauuuuuacuacuggaaauuaaaaacaagaauauggaacuaauaggugagauugguuuuauaaaacaagguagugugcauuacacuuguuagcuaugcuuuaagcauggcauggcuugugacaaugacggcuuucugcucuuucaaaggacauaagcuugguucccagcacccauuccaucccacccuucuguagggugacucugcuucagggaaacugaugccaucugugaccuuugugggcacuagcacauacaggcacucacacacacacacacaccacaaauacacaucuacacgcacagcuuuaaccacuaaaugguugguuuguaugaugaaggagcacgaucagauaaaaauccauaucugacuaauuaguaaauauaaagaauaguagauguuugcuuuaucuuguucaaaguaaauucaaauauaaacuggguuuaaugauacugucagagcaacauuaagugaacaguaaauauaaccuuauaugauuagcaacuuguucuuuauuauuuguucuuuaaacucugaacuauaccaaaaauuaauacuuguucaggauuagcacccacagcauuuccucuguuacuucaagggaagaauuucucugugcuuggaaguaguccaggugucuaaacagugaccugaacaccucccugugcucuuuguagacuggcauccuucgaaccaacuguguggacuguuuggaucgcaccaacacugcgcaguucauggugggcaagugugcccuggcuuaccagcuguauuccuuagggcugauugacaagccuaaccugcaguucgacacggaugcagugagguaauccuuaucugcugccauucggaaggcagccgugacaaaagcaggcuugacucacaaggacuuuauaacuccuuucuacuuuuagcuucucugagguuuauggcuaaaugauagcauucaauuuucuucuauuuguacugcguguuuguauauuacugccauuggguauuucuugcgcgcgccggacucgaccagcaagaacgacgcugcaacaggauccuucugcacacguuuauugggagagcuugauugcagaggcgaaaagaccccgagcccagaacuggugcugcuuauauaggccuaggagaggcgugucucacacccggauugguuaugcacucugccucauuugcauguuccucaucugauuggcuacucucuguaccucacagagccucauuaucauaccucauuugcaugucucacaucugauugguuauacucucaaagccucauuauaaugcccaggccaggcagugccuuugcaaaaaacuuuacugcauauguacacauugguuguuuguccaaacuuaugcgugguggccagcaguagucagugccacucugcaacggcacauguggcuucccacagguauuguguuguuugcuugucuuaucauuaacaaaguacacagacaaacuaguagguuaaacuaaaacccaaauggcaugauagauggugcagcuucugcacacaugcugagcuggagguacaaagcgugugagacagguucuucacccaggauuauuguuccugagccgaugguuggcucugugaaaaaagcaaguauaucgcuugcaugucugcuggcguccagaccagaagguuccagucacccuuagguccacauugaaauccucacccccaaagugcuggugucaggggauggcaucuuuggacaugcuuaaaucuaagggcagaaucccuaucccuggggcuagugacauauuaaaagugaccaagugacauauuaaaggugaccgaggaguauuuaugagccucuuccucacucgauggcaaagcaagguggccuugccuuugaauuaaaugggccuugcuagauggcgaauguugaaguguuuaccuuagaugucguaguagcucguagcuccuagaaccccaggaaauagaggcuucuuuguuagaagucaccuugucuaugcuacaccguuacagugcccaaauagaacuaagcgcugucuguaacaagaccauguguuuaacagcaacucagagggaccagauggugucaugggaagugaguuaccuuggcagaccguggacgauaggagugcuucugacauggcuagacacaguuugcccagcuuuagcaaguuaccuuuuuggugccuaauuuucucauuggaguuuucuguaugaaacaaugcauuuuacacucacacucauuucaagcugcugaagaguccacaugagagauucagaaggauucauaaccuaagagacuuuucccaagccuggccuccuggacggcuugugcaaucauuuggguuaauuuuucuuggugauggagacuguccccagggcaaaugcuccaucgcugagcucugcccaaucccucucuccauuuuacauucuggaaaagagucuuacuaacuuacucaggcugccuuggaauuaacucugcguccaagcaggccuuaaacuugugauccuccuggcucagccuccuugguagcugggauuauggaccuggugacaacauugccuaauguguguucuccuucuguguagguuguuugaggaacucuaugaagaccauggagacacccuuucccugcaguacggaggcucucagcugguucaucggguaaagaccuacagaaagauagcaccguggacccagcacuccaaggacaucaugcagacucugucccgguacuacagcaacgccuucucgggugaguaccagcagugggcgguccuaccacucacacuucagcugcuuuucuucugguacguggacucuucucuuuuuagcucuuuacuuaaauaagguuuuaauuauuuauaaauuuaaauaaaauggacuuugugacugagaagguacucaaaaacuauuuauucgauacauaaguaaguaaauauuauguccuuuuugagacagguuuuacauaucccgguuggccucagucuugccgaguagcagagggugaccuugaacuucugaucuucccgaaugcugggauugcaggagggccccucuacgccugauguauagggcgcuggggacuaaacacaaaagucucugcguguuaggcaagcagucugccagcagcuacugugcccaggcucuguguuuuaaagugggaaggguacuguugcauccugccacucaggauugcagugcuuaugugauggacguaguuggcuuucuagucucuucuuccuccugugucuuucuccuucacugcuucugaauguagaagcuggaaaguguugaaucauuuuuuucaaaaaacagggguuaacauccagguagugauuuaugaaugugucacucaauuuaaaaaugucagcuagaagugaauaaugacauuagcauuaaauuacucaccuaaucauacuuuuaugaccuccaaguacuaagucguuugaguacagguuuccagugguccuuuuccccgucuccauucagaagccaucgucaauauauguaaugcauaucacaggcugaagcaauuaugagacacauuucccuacacgguuccuccaggaaggguccagggguuaauccgaugagauuuccucucuugaagggaagaggggcaaaaccuucagggacugugggaggaggcaaaguuguucucugggauaaacuguuguugcucuccugugccucacucccacuucuucaccucaagugaagagagagagaggcuucagcgggcucuaggcgcuggcuuuggagggaucccauguguucacgcuggauggcuauacaucagaucuacagcagagggauggcugaggagagugcuguaugcugagaaccgccugcauacuuagaguaaaccuuacagaacaggaguguuuaaugguaaccagauggaaacaggcugacggcuuugggguguccugggcccuagcuagugaguugcuccggaggaccaagaggcccugacagccacggaucagggguuagaacuggaagccuucucucaaguaaaaugauacaugugcucacacugagggaguugcaagagagugauaggagccugagaaacaucccuaggcaucaacuuuuauugucaacauuuacaaggcccagagcaaauggaagugagucagcuauggcuguuuguaugcaacaaagaaccaugcacagcaagggaaagcaaugggcuauugucuccacagucuuugugggucagugggccaggcacgguuggggguggggcuggggucuucugcuuagagucugaaggcugcaguugggauaguaaucaggccaucucauuugaaguccuagcuagggaaggagccaucuccaagcccuuguguuuguugacaaauuccaguucuguccugagggcacagaacacuugcugcuucacaaauggcuauggaaagagccuguuagugaggcugcuggcaggacagucucccauagguuacuuaauccugagaaugacaucuuaugagaaugagcaugccagagcucacucaucagaagcaaaccacaaguccugugcacagaacuaaacuaucauaaccagcagacacugucuuccaguuguggaugccugaagucuuacagugucagucgggcaguucccacugaaagcuguggaugagaaucugcccuugcuucugucugcugguggcugcugacuggcccggugguccuccuauagccucugccuccugucuucccacacguucacuccuucuguugagguuagucuuugugacguucucuuccguguuucccuuuccuuuucuuauggggacgccaacuagccuuacuggaucaagagccugcuguagcccagugugauugcaucuuaauuugauuauaucuacaaagaugcuguuucugaguaugaucauguucccuggcauuguggaguucaggcuuccagaucucuguggagacagaagacagaaggcuacauguguaugcagcagggacaggcugcugggugugugccuccgugauaaagguuugggacuguucuuagagaagcaguguccaucuaccuucccggcccucuccugucuccauugcccuugcaauggggauccugacugacacuuaaagaccaaaguugcuuagcaggacuggaagacagaagugaauguagguauauagacgauuuagaaagacaggcacaguuuagaggguaaggccggugcuggagaucaguguguacagauagugcuuuacagccaaguuaugcaaacuggagggugagguguuaugaaaggcuccaugaguaacgcggcuguagcacgucuuuauuuuaagaagcauggugacacuggagugugcaccuuauauugucauaacugaguauuacauaaggcugaguauggaaagguuuucuuucagucaguccuaugugaugccucugggccgagcaggaagauagucaggauuaagacacuguaguacugaaauuaagugauugggaauuugguccuguuuguauagacagaugguugcugugugaaccacucuuuggaccucuuguuggacccauucuaaaaauagugcuuaaaguagacacuguuauucaggccgguggucccaguugaguagcugagguagaaagacagucgaaccuaugaguuugaauguagccugggacacauaacauggucuaucucaaauacacacaugcacacacaacaguucuugaggucacgugucagugugcucagggcuuugucuuuagagagcaucugcuggcuuccaaccugacagcuuuccuaggugugugcagggugccuuacuggaaaagcacaguuacccaggcaucucccuuagaugccaggaaggaccuuuaauucccugugaaacuguuccccugccccccuuuuuaauauuuaaauuuugccaagccuauaguuucuugcuucagcaucuugauuuuaaauccuacuauaaggggaaaaaacagacugcccacuguacuuaauaauagaacacacacacauacacacaugcacacacacaagcacacaugcacacacaugcacacacacacaaaaugcauguguauaauuuaaguguaguaaauacauagaaguggaccauauucuuuucaaauguauuucaaaaaauaaaaugcaugcucacccagugaagacugccaugcucacucacaggcaguacugagcugaucuccccagugccaggaggagcccuucgggugccccucauuuucccuucuugacuuauuucugaaagggaacaugaggggaaugcauggagaacacuuuggcuuaucacagauagugagaugaccuuccgaggucaucggcaugacacagaguuuaaugaguaaacccuauucuuuggcuauagcagaaaaaaagcaauugcaaaaaaaaaaaaaaaauguccucauagcaucuggaaagccacugaugacugauaaagccaagucucuccaccccuugugccaccacagcaguuagacgugacaggggaagcucuaaguugucucucucagugcagauuggagggagcacacugcagacaguguggcagucuuaugacacuauucccuagcacagccuuucuccagauccccagaaugacugcuccaugccuuguccucuccucugugaccccgaaccccugccaacugcagaaacugcauaucugcacagagccugccuugugaugaugucucugcccucugcucgguuccgaguugcaaccugcucuugcauuccuauaguaugccucucuucuggccugcgcagacucucuuguaccuaugucaggauugccagcagucuccauguugccagacucuggguggcugcucaaugucuaaaccuuccuccucucuucuccuucugcacuuuuacccucaggggggcggggggccuccucauauauuugaugaucagacacaucugcaugccugccucacccuccuguugacuaacuuguguucucuacugaggagaaagccggaaugacaguaaggccagcaugucaguuuaccugcugugaugugcaggcuuccugacucuuuccggcuaguggcagaauuccaugcaguuguggggcugaggccccauguucucacgggcagcugcucugauuccagaggugaccugugacuugcucuguuuuauagcccucauuggcacacugaauccauuuugcccuucagauuacuauaugacccccucugccuuccucuucugccuuuaaaggauucacauaacuacagauaauugagaaaauuucccuguuauuuugaaguuguuaugaguaauucaguuauauuugcaaaguaacuuuuacaaugcagugaaauauuccuaggucagacacuagggaacaaggguguuaggcccagauuauuuucuuccugccauauuucucuaauauaugagucucaaaguaaccaugcuuggugaggugcgcuauaaucacagcacuuggggugcuaaggcggaaugaucuugaguucaaggccauuuggacuacacaguaaguuuaaagccagguuaagcuacacagugagacccugacucacagaaacaaaagccagagauuugguuuauugguagaacccuugcccagcauguguaaggcccaggauuugacuccuaaacaacacacacacauaccacacauaucuaccacauaacucccccccccauacauaccuaccacacacauauaacauaccuaucacacacacacacaaacacacacacacacacacacacacacacacacacacacacauucugagccaaauuugccauuucugagccagaaacucuuaauuaucuuuaaccuguuucuccacucauuuuuuuccaccucauaucuaagaaccauccuuaaauccuucagguuccuuaucagccaucuuaccacagucuccuguguuagcaaaucuuguugacucuguguccuaaauacgaauggaagccuucuguuauuuccugccccccuccccucccaucuucuccucucuucugccuucccugccuuucauagugggaucaaacucagggcuuuuacaugccacauaaguauuuugcuacugagauguacccugagcccucuccacagcagacaguuugggcaacagcaucucucagaagccacgguggcucugacucaucucggagucuacuaucgcuaccugcugcuugcucguaggcugucugguuuauuuauuuuucccagaggaacugcuuaugcugaggaugguuucuucuuuauugauucuuucugaauuucacaucauguaccuuaaucccacucaccuucucaucccuuuaugucugcccucugcccuugcauccucccccaccaaaaaaaaaaagagaacaaaaaauaaaaauaaaauaaauaaauaaaaacaaaacaaaagagaaagaaagaaagaucuugccauggacaauacacagugugucauacaauauacccuuugcccaaacaucuuuacuuugaaagguucauugccaugagucauuggucugguucaggcuucuggcuucugcuacacuaucgauacuggggccucagugggacuccucucggaucuccugcugcugcagcuuuguucugcaggaccugcuccuucaugugcuuuggcuguucauagguuggguaaauuuaaaucugggcuuggguggcagcuguccugcagcugagccccaagagccagcacuccugucugcagcagccagcaaaauaggccagcucucuccugcucaugugaucagggccagcucucuagcacuguccuggacaggggugggggucagcucuccugagugcuacaacuggugagggguggggcuggcucucccaugcucacaugaucaggcccagcucucuuacacugcaggugaggggcgcagacagcucugcacuuagacaucaacguggcaccccaggccagggguguccgaacggccuuugguggacacgugggccauggauauuaacacagauauuccugcuccugcacggccauggacccagacaagggccuccauguuggcacaggccggggcauccccguggccucagguggcagcguagacaggccuccaguucugccucacuucauaguguacacaguuccucuucccuucccucccaucucuccacccacacuuaacucagcauuguugugcucacccacgccacauucgggcauguaugccucucaggcaaugugacuucuauguucuaaagucaagucaguacaggaaagcuggccaaggcagcuacccacacagacccagauucagggcucugaaccgacccacccuaacauccacccuaucuaugcacugcugcagcacaugaaggggcagguccuacacauccaaagcugcagggucuccauggcacaggguaacagcaggguaucuaagaggagucccagugaaguuugcuauugauaguguagcaaaagccagaggccucaaaccagaccaauggcucaugacaaugaguguuugcaguaaagcuguguggacagaggguguacugugugacacacugaugcaccacagcuuccauagcaagaguugucuuguuuuuuuauguucuuuuguugagaggucacaagggcagaggguagauaaaggguguggacggaacgaugaguggaacuggggugcaugcuguggaauucacauucauuaaaaugcuuaaaaauuaaaaauaacuaaaaaauaaaguuaaaucagucuuaucacucuucucuucaaaacaaacacaaacaaagacacuuccugggguuuccauuacuuuuaaaaucaauuuucuuccuaugacuugggagcacgggcuguggcuccaucugucuguaauccuuggcucuuucugcugcuaccacccugccccuucccugggcuucacccuguugugguuuugcucagcuugguucccuucaggucuuugcaguuaggucuguagaccacaaccuccucccuucccuaaccacuccaccguguccccuggcucuucccaucacacgcacacacacacacacacacacacacacacacacacacacacacacacucacaaaccagcuucuuaauaaauuauaaaacuucaacagccagguucuuguuaaccuuguaucugcaauaaagaacauggaagguucuagaaggauugauuuccuuucaauuaaacauauuaugagucaauuuuagaaaguacagaguaucucacaaauaacucauaauccccacccccagagacugccaguugcucauguuuaggcaaacaugacuguacuucuguugugcauaugauuuauagucugcucuugcccuuugcggcaaugugaguaagccuuaugaugcuaacuguucuacaacccgcuucuuaguagcgguauggugcuguuaguuaguuaucgugauuguguguccaggaugcuccagagcaaaugccuuugaagccagccuuuugcuccccguguaccuuugcucgugugaaguucagaagcacauuucuaggucagcgguagaaaugccuuucagagucuuacugcaguagucucaccacuaacaaaaugccugacagaagccuaaggcauggaagauccauuuaguccaucucucuguaggguuuggccguguuuguuuggcccugugugcuucagcaaagugucacucuagugaaggugcacuuucccgucuaagcagaggaggagacaggaugcggacaggcagggcaguucccaaggacuugucccuauagaccugcccacugccuacuuuuuaccaccacaagugaugccacagccuuuggaagaccaacugaggugugcuucacuaaucuaggagccucucaguccagucagguugacaaucaaggcuauccacaggcacggugucuucguuucaguucauugcugugaagagacuccaugaccacagcaacugucacaaagaaaaacauugaauuggagcuggcuuacgguuucagacguuuaguccauuaucgccguggcagggaacauggaggaggcgugcaggccggcauggugcugcagaguucuacaucuugauccgcaaacagcaaaagaagacugugugccacacugaguguagcuugagcauaagaaaccucaaagccugaccccauauugacacacuuccuccaacaaggccacaccuauuccaacaaggccacaccucccaauagugccacauucaaacacaggagucuaugggagccauuccuguucaacccaccacagacggauuuccucagaaaggaucgaucagcuaauguuccuuccaguacagcugagaacacucagcuuggaaguuuuuaccacuuugcuggaagugguuuaguccaaauuuuguggauaaauagcaaagcuagauuuuuauguguucacugguucugcugcugugugucaggguugcuguguuugcuccuacugcguguugaucugggccauucuuagauuccaguaguauuucucucauuaagugguaaaagauggaugucuaauuucuuucuuuuuuucucccuaacaguucaaaauacuauuuauuaaacugauaaauaaguguuauuuauauuacugguaaaagaggcuacucaucacaaacuuaauucuagaauaacagauaaucuaguuccaaauuuugggggaggggauuaauuuaaaauuauuauauccaguccugugucauuuaaauauaauuaguaauaaaacuugucaguucuuaauggcauuugaauagcuucuagguguucugcuuuuaaaguguaauugaguauagaagcaggcacucacuugucuucauacuggccucuucagacgaccauaaccaaaggcuaccuugcaggaaaagcuacuuuauuuuacaguuuaaaguguccaggcagacugggcagagcugugcaggccuuugaucccagcacuugggaggcuggcaggucucugaauucaaggacaaaauagucuacauagugaguuccaggauagccaggguaacauagugagaccccugccucaaaaagccagaaaaaaaaaaaaagucggguugaagagcuggcucagagcacuggcugcucuuccgagguccugagucaauucucagcagcuccauggcagugugcaacuguguaacgugugguuucaugagaccggaugcacucuccugguguguggaugugugcagacaaaacacgcauaaccauaaaauaaauaaaccauaaggacaaaguacauacaacaacaacaacaacaacaacaagugcccagccagugcucagucuugaaggguggccuuguagcccaagcucaggugacugugccaccauagagacacugccuguugugacagcagcagcagcagcuucaggaccacacagugaucugugaaggguuacccaugagcaugauguggcucugucaccuccucuguguugacuguauucacuaacguuuuaaggaagaugucauuuaaaaggugagagggacucguugaaaacauggcuggaaaacggaaagcugcuuuaggugacauuagcgauucugggguacuguaggaaaugaauuaccaagugccauaagucucuucaagaaggacagaacaucguguuuacuucagugcugugugcugaggcaaaaauugggguggugcugccugugucaugugacacuuguuuucccucagcaaauugauagaaggucccaaagacacucagcauacaagcacaucccuuuucuauguuacuuuuaggcugaaaggcaaagugcuguuuuaauggagugcuuccugccaaaauauuaaucauaggcauacauauuugacauuucacuugcuuuugggaaaauaagauaucucaaaacugauuucagguguguauauucacuguagcuguuagaggacaauacacuuuauuuucuugguccugcagcgggcacuucugcuuccuucuuaggccuccacuguuucagaaagaggcuguuaaugaauauccguggaccacuugacuguugaggccucuggggcaagaacggcaagaaggaaaugaggggaagggauaaagggagcggggaggagaaggugcugacuagaaagggcaggcugaagagcgcgguucagugugcuuguuuacuuccaagcauauugaggaaaagggcggaggacaugugccaggcagguuugucacuugauagcacggugugggaggacaguguugaggugggugaagaguggcaugagacugcuggucauugucacaggaggccaggcuugcagcugaggggcagcagugcuuuaaacagaaacccugcuggaggaaggguguuuggaguggcagcugagcagcugacuuggccaaggucacgcagcaggauuucuguaggaauugggucauuuuccccccauggccucacuugucuuuagaacaguauuuacuugagaugaguuaauaaauccugagggugaguuuuuauuuuaaaaauaaaaccacucuaaauauugugugacuuuuaugcuaacacucaagaagcagucucuguccccugccccgcguguuagagaagcaugaggagagagggaagcagcacucagaggcaaggcuuucagucuccucagaucgugcauggcugggcgugugccuguguguaugaaauuggaaguauagaugugucuucuuuccagcucuguugcaggaaacacagugggauccaugucaucugagcuguccuccuggggaggcugugucaguaauggguuuucugaaaucuauauuuuuugcguuuuagaugcugauagacaagauuccaucaaccuguuuuuggguguuuuccaccccacagaagggaaaccucaucucugggaacuccccacagacuuuuaccuccaucacaaaaacaccaugagccuuuuaccccccagaaggaggugaguaucugguccccuuagacuaccauguacacucacaguugccgcuguauugaauaacuguuguaugagaugagcgcguagcauaaagcuaugagucuuagcaugugugcuguggcuuccggcuuggugauuucuggcaaaucaugacugguagcuuguuguucugcauggucccugaaauccagauaagucucccagauguaucuggaugugggauguggugcagagccucuaaagcaagccagcaacuucauucuugaauguuccuuacaaaugagaaagaaauccaagacucaaggagcccaucucggagugugggggcugagcagugcuuacuuuguuacauuaaagccgcaaaauguuuuccaacauaaauagcucuggguuaauaguccaaacaggaaccuaaagcagugacuaugggcagauaaccacuccugccaaucuggccgucuggaggccuucaccagugcaggccauuugguuauaguuaaaucagugaugauacucucagaagagcugugcauggaaggacuugccuuuaaucuuagcacgcagaugacuaggguggugggauugcugcaaguuuaggccagcuuggccuccauaguggguguguguucaccuuuagcccauaagauuuuucugaaaagaaguuuccccagagcagcuuaauauggugucagguaaugugagcauacauguugugugaauuugaguuggaguaucuauaggugugugguguuagaugauuucugugaccucucugacccucauuuuccucaugugcgagaugugaauggcugggugcacaccccacagauugucaugagaacuuagcuaccaggcuccuucgaguuuuaagugaagaguucugugcugauauggugaguugugccucuugagcaacauguaagaaguuggaacauggcuuauuuucccugaaagcacguaaugacaucagauuucccauagugccuucuucuuacagccucugguagauacagcaaaguugcucaggccacagacaaucaaaaccacuaguguagucugcugcugcaagaauauuuaaaauauuagcaaagcucaggcuuugcacuuuuuuuguucauuggcucauauuagaauaaauaccuuaauucaugauuuuucucuauaaaugaagcucugugcauuuuaaaauuaugguuauuguuaauaaaugauuauuaccaaccugauugacagaaauuuugaguuaauuguguuuaaugaaguguguguaacacuugcacuuagcuuggcugguaacugaccagaggucaguacaguugguuuucugaaauguugcauuaccuacaguacugaaacaauuaaugcccgacauggaaacaaccaacgcucauucucgcugcaggaaugagcugcauguuuacaggugugaagcugcucgcuugcuucggguuacauaauugaagcaggugguuuugggggccuaugugugggaacaaaaggaagccgguguuacagcccauauccucagauagggaacugagguacagggagaauaugugguggcugagacuauugagcccgaguguguuacacacaguaguuucugaccuagaaaacacuguuugagcgcgguagacaauagcgcuccagcaguuacucuacugcacuucuuuauccuccgcaguagcagacggagccugcuggauugaaaucaccacucgacacugcucagaaacagagcuuguuacuuuaaggugcgguuaguguuuggguugggauuuuuuuuuuuuuuuucuuuuuuagugucacccagcuguauagguuauuuugaugacuguuaaauccggauaauucccaacauaaaugaacaguuaaaccagaggcaguaucaggcaagaguguggggcucagccuagcucacauggugcugaguuugaaucuugagaacaggcauggauaugguuacuuaccccugagacccugcuuuuccgucaguggaaaggagauggcacuagaucccacacggcuuuuacuuacugaguuaauuauucucucauuuauuacauccgaccacagucuccccucccucccauccucccagucucucccaucuccccucuccuccagauccucuccuccucauuucccuuccagaaaggaaagagcaggcaggccuccuggggauggccacugaacauggcauaacaaguuacaauaagacuaggccccugcccucauauuaaggccagacaaggcaccccagcaggagaaaaagagucccaggagcaggcaaaagaguccgagacacccaugcucccauauuaggacucccacacgaagacaaagcuacacagcuguuacauguaugcagagggucugguaggucagacaauacagaugcugauugcugcuucggucuuuugaggcccucugaaccuugcuuaguuaauucugugagccauguucuugugggguucuuggccccucuagccccuacaguccuuccucccaggcagugucagguguggacucccucucauggcaugggucucaaguuggaccagucauuggcacacgucugugccacccuuaccucagcacaccuuucagacaggacaaauuguagguugaagguuuuguggcugggcuggugucccagucccuccacagaaagccuugccugguuacaggagauggccauagggcccuggugcaccuccugcugguugacacccaaagucacuguugaccgucagucagcugcacugauucuguuuccugaccugaaaacugugcuguccugggcaucagaugagaucauuuaaaaccuuagcacacagaacaccugcugguguucguauuguucucguucacuagggaaauauuuccuacuuuuaagcauuuacuaaaaaccauacaggaugcccauaaaaucuggaaacuugggcacuguuucgucauuuauaugaugcaauagcagugauggcuugauuauguauucaucuguucuuauuccguguuuaccaaugacaucauguuuuuacugcuaacagggggagggacauagaacccacucuaguagcugccucugugacccugaaccccguauguguuugaagugcucaaaccauccucugagccuccgcucaaagccuggucaauaugucuuacaugaccucagaugccagugaaguguuuauauaguccccagccuguuuuuagauauuacacauuaguuacguuguuuauuuuuagaguugggagauuuucuggcccugcucacagucugguaugugaguuuccugucuauccagagucgccaucuuuccuauguuugucaagucuagguuugugguuagaaugugcccccuguaaggagcugguuguugacacuaccguuugcacaauuguuucucaccuugcacggagaucugcuucacugaaaucuuauaugcugacccuccucagcccaccaugcccuguguguuccaguugacauuaaaguguauccgaagcuuguggccaugucugugguaguggucacagguuggcuggauuuuugccagugauugagaccacugggaucaccgcucggugucuguagucucugcucagcauuaaguguaagacuacuuacuuacuguagcuguucucagcauugcucccuauccgccagaagcaccgcacccuuaacuauaucacgcggccauauggucaccauucuggucaugcaauaguauacggucacuaagugcauccuuuuuauuagcuaaauacgccuaucauauuaagaagucuauaaaauacuucuucagauuuaaucagauggcugucuucaucucaucuugcaugaagagugcugaguaaaaguuguggugugccaucuuacaacucuauccaucuaacacugugugguacuucuucauugggguugguuagcaguugucagucuuaaggaugcuauuacccuguccaugguucucugccuuguucacagacauuggcuucuuuguugauguucauauaucuuguuuauaggacgucucagguaacuaggaauguuagagacgauccaucuuaaauuucccuuugauggaaguaacccaguggaauucagcacucucaauaauagggacugaaaagaaaagaaugauuuaugagguauuauauacaauggaagaaauucuccaauauucagucuccuguucuaugauuccuugccccaaggcaguuucauucccugugcagacaucuuaucugugagcaaaugcgccugguggcagauggagguauaagauuguccuuguccuuugcuuggcccucucauccucucugucucaguccauccucuccaggacuugucuuucacgugugcuucuuuauuucugagacacacccaggacuuaggcuuuucagaaaauauucuuaaaaucauuuuauauuacuuaaggaaaugcacccuaguaauaugguuuuaaaaccuguugccugguuucaacucacugagacaaagguauuucuuaauucuaguuguccaucugucuuaguuagcuuuucugucacuguaaagagacauuaugaucaaggcaacauauaaaauaaaauaaauuguuuaauugggggcuugcuuacaauuucagaaggugagucugugaccaucauggcagggagcaugguggcaggcaggcaggcaggcaggcaggcagagcaguagcugagagcuuacuucugauucacagcaggaggcagagagagagagggagggagaaagggagggagucggaaagagagagaggaagagcggggagacugggccuguccugggcuuuugaaaccucaaaacugucccacagugacauaccuccaccuacaaggccacauguaaugauuccuaaaucagcccaccaaccggaaaccaagcauucaaacauaugagccuaugggaccauucccauccaaagcacacaucuggauaguguguucuacauuaagacucaguccuuagaaaaugcuugcuucuuuuuccuaagcaugcaaauuguaagcaacauaauuuuagugaguuccuucuggauugucugauaucuucucuacugucuuucuuugccuggguuaggucaucagggaagagaagauacaccuacucugccuuaugugcaugugggccccaucagacccacccuucugacaguuggucugugccuuucucugaccuaauucuuugccccaaaaaguaaaugaaauuaguaugaauguagcuuauuugaaugugaauuuaucuuuuuagguuucccacguuugauuucuauggaaaauuugauucuuuaauguugcugggacggaggucuccuuggcugacuuacaguuguugggaucuggguuccugucacuuuggggcaugaggaaugaguuuaaccacuucugaugaaguaagauucaggucucaccugcuccaggacacuugacuagagcuggucuacugcuuaccucuucuuccgcuguacacgcucccucuuaccuuguguguggcuguuauuuucagcauggcucuuugaacgcuuggggcagugucugauacaguauaagugaucgauaaauguugagcaauuagauuaagucccuacaagcagcaggcuuaucucuucucuguucuuuucaugucccugggccuugcuguugagaaaacagcuuaggaaccguucuucagugucgccugguggcuuguaaaagcaucaggaaucccgggccagccuucugacucagacuugauuuguaggaaggccaaggaauaacugggcacagaggauuuggacaagaaaaugcgcgaucagccuccaggaagccuuuuccucugacagcacacucacaccccaguuccccgggcuuccugcuccuuugccuguccuucccaguggguucagcuugcugccuucuccgggaggucccugucaucuucgggagaucccugucuguagugacuggaugcuccuccacuuuuuucauaauuaggaauacucaagaucauaauuucagcauuuucaucuuuuaaaacccaucauacuaauuuuucuuuauaguauuuugggccauaggcuuuauuuuuaaacuauuggaaauuugacuuucuuuuacauuuguguauauuaauuuacuuucuagcgcauaaaaauuuugacagagcucuuucuucucuuagaaucucuauuucauuagaaucugauaggcaauuaaacucugggucuuaggacuuguucuaguucucucuauaugucagagaugaaucucccagagaaggccagacaguugaaguucccuaaccugaaucuggccucugcacauagcggcccauguucucagcuaaaaugaacagcacucauguuguacccuaagggaacuuuuuuuaaaaguuuuuuuuuuuuuuuuuuuuuuuuuacuauccauuuauucccugaugguuucauugaacugcuucauuaacuauacacacacaucccauagcaguagaaaagcagccuuagugcucaauaacaagacuugggucauggccucucuguuuaccaggugacauugucucuagaggagcaaccucgagucugcauaguuuaggaaaauauguuuuagccaaaacuaaacgagagcagagugucuuggcauuuguaaaucucuggagagaugaagcagggaaggcaugagaagcaguucagcgaugaagaccuacuaagucaacagcucuccaaaugugccaucacaggaggagaccuacuaagucaacagcucuccaaaugugccaucucaggaggaaaaaggaccuuugaaggagaaggcugaggguuuauuugguggcuuguagaaagccagcauuuauguuugguccccuugucccuuuggcuuuugcaguuauacuuacugguggacgccagagguggugaagcaucugccgcugccuuacgaugaaggugaguaccugccucgcuuucacauuuucugccacguauuuugaaacuaugccuagaaaggcuuaaagcauuugaugcguuauauuauaaaagaagcugacuaguuguuauauugcuguuuuguuaggggaccguguaucucuuagcaucuucuaggaggaggugacuguauuugccuucucugagcaggcccugcccccugugcugugguuuaugcuuauuagauaagcagugcaaacguuugguugacauaaugauucauuuucaauuaggacucauauuaaauauuaaauuuuucuaugacguuuuagagagaugaagaggaaguaaggacacacuuauaagcaggacauauauuuucauaucuguaucccaaucacauugaaacuaaauguuauuaaugugugagaaaggcaggagaaauuauauaaaggaauacacuaaaauguacugugcauuagaacaguuuuuccagguuugaggagauagagagagugagguccccauucugugacuaucuugguaauuuacuauuuugaucuugggcauccaauuuaccacuugaaaaaguguagcaggugaugagucuacuuaaucuaugcuucugaacuuugggggaguucaggacagguucccaagguuauuaaauuaucaauccaucucccaaguaugcaaccugaagcucuggacagaaucacuaguaauauugcuaaggugggcugguuguuuuagagaaaggaaagcacuuuauuuuauguuuguguggccaugcacauguauggggaggcaugucauggaaaguguguggcgaucauggaaucuaucaugaggguucccagauggagcgcacgucguuagacuuggcugcaaagcaccuuuaccuauggagccaccaaccuggcucggacaggaauuuaccaaugaccguuaauaggaugugaauggcagcagcgaguuagugaagagcugcuguuuguuugauuaagauagacgguauaaaagaauugaagaauaaaaauggauuuaagggaacgagucauuaaauuucugaaguaauucugcuccuaccuuggacuucccaagacucuccuuagagcuguuacgggcaggucuguguugguuuuugugccggagucucuuuccugaguaaguacuaggaaccggagcugaggaaacugggugagagcuguguccagcacaggcugugacaaggccgucugugagcaccgauggcauugcacacgugugcugaagguacuccacuagugauuuaguaacagcaaguuguauuucucaguuaucugugcugcaaacuuaaagaaguugauggugaagaaauuucacagaugggaagaagagauugauauucacaaugaguucuuccggccguaugaauugaguaguuuugaugacaccuuuugcuuggccaugacaaguucagcacgguaugucuuggguaccucagaacuguaagcacuaggaaacucacauuucucugguucauagagguaugacuguucugcaagcugcucagagauggggccuugagaauucaagaugucuccugugauggggagcccgucaccucaaauuccucauuaccaacuggguuaauuguucuuauuugauaaguugaaaucucucuucugcuagcuguaauuugucauuugucaucaacucaguauuuuucauuccccucuccucuccuccccuccccuucucuccccuuccuccccuccucuccccuccuuucccuuccucuuuucuccuccccuccccuucucuccccuccccuccucuccccuccuccucuucccuccuccucucccuuccucuccccuccuccucuccucucuucuccccuccuuuuccuuccucuucucucccuccccucccuuccuccuggcacuguguuaauagcuaaggcacuguaacucaagcuuaucuaaugccuguuuucuccacaaggcucaccacaggcuucuuauuguuagaaacacuauauagccacagccuugugcucagggacaguuuuaaacagaaagaugaccaacagaaaagacacacaaauaugaaagcguagcccugaauagacauucauuuacagugagagcaaagcaagacagagcccacguucaggccugcugaaccucuucuggagcaugugaacugggugacucaggcuugcgcugcuccuuacagacacgugccuguaacagcagcggggugugaguuugggcuacacauagguuuuagugaguaagcaaauucacacucauggaaucuucggauaccuucuccuucuucuccuucuccuucuccuccuucuccuucuccuucuccuucuccuccuucuccuucuccuucuccuucuccuucuccuccuccuccuccuccuccuccuccuccuucuccuucuccuccuccuccuccucuuccuccuccuccuccuucuccuccuccuccuucuccuccuccuucuucuucuccuucuucaucuucauuuccuccccuccuguuccuccuuucuauuuauuuagaaacaaagaaaaaugcaauugcauugccaagaaauuuccagacuauucaauagacauuuagugagguggcacaagucugucaacucagcauuugggagguggaggcaaggacauuuuguguucauggccacacugggauauggagugagcucaaggccagcuuugucuaugcaguaagaccuugucuugggaaaacaaaacagaacaauaauaagguaaaauuugauagacauuuuaaagucagacccaagauuauuuuuuucccaggggcuuggggaguagcaucugggcacagugugggagaaauaccaaaagccagggaccuuagcagaacucacacaacuccugcccugcuggcccaguugugaugugccuggcuucuuuggugacaggaagauagaccuugaugcugaggaagggacuugggcuuaacucaaugaguggccauuaggucagcuucuaugugaagcguccccacagagguaugugagugaacccugguugaaugagguaggugcugccuuuuaaugcaugccccuguucuuugaucaucacaucuacauccuucaguggucuggcuuaaaguucuggugcacagaccugagcagcuuacuggucuguguaccugagaacugacugugauaucuagccagaugauuuguauccuaggcaugccugggaucucaucacuuuccagcaaacacgacuuuacguuuagaacuucucagcuccugcaguuaugagagaagucaccauagucacauggacaucacccagagcuauuaguucaugagcuuuuugggagccccaucagcaugaguacuugaguuaaaauauguauagccauggaaaacagugagccaggaucaucuacauagacagugaguuauacaguauuuuaacuucuucaucuuuuucuagugauuuuaugccuaaaacuguuggcauugauccaaguccauuuaccgugcgaaaaccagaugaaacuggaaaaucuguacugggguaagauuugcauauagaaugaaaauuuagagagucauguaaaauagugcuugcaguaauauuuccauccagaacuaauaaugucaaguugcaucauugaagucuauuuguugcaucuauauugguagcuuauuuauagcacuggggccacugaaauguucacuguugaaaacaggacuuacgguaaucucagcaacaugguauauucuauuaauuccaauugugaacauaacaugugguauaaagaugaggaauagauguuucuuuguuucucagcauaaaauaauuaaaaucugugcuuauuuuauuuauuguauugauuuuaguugaaugugaaagcaagcguacuauaacugagaacuugauagguuuccuugcauggcuauaacauuguuugcaggaagaacauuucuauaucuaauaacaugaagggauccccccuaccauguuuacaucuucccacugagagacuggaguaaaguguguaguguucugaucaaagacucucauuugccuauggccugcguguuacagugguaacauugcuccucaacuuggagcgggagucauggugagacuguagauacaguauccuaccuguauuuaggauuauaaacccaacuggauuuuaguugcauguaauuuacacauggggucauguacaaauauuuuccagauguuucugugccuuaaacucaugaccuuucaggaguuucacauuaagcccugagcagaugcuaagaguuuaaaagaaagaaaguguugaguuuaaacccaaggagauccugggauagauaaacaucuggacagccgggugggauagauaaacaucuggacagccgggugggauagauaaacaucuggacagccgggugggauagauaaacaucuggacagccgggugggauagauaaacaucuggacagccgggugggagcucagcacagagacacugucagauuaaguuuuagguggagaaggucagaaugguguuuuuauuuguuuguuuguuuguuuguuuacaauaucuaacucugaugagauaaauugcauuuuuuuucuuucuugagauuuuccauaacauauagugaacuauuuuaacaguagggggcagggcauggggagacacgcagucaguaaaaucccuguucugcaagugaggucucugaguucuagccccagcucccacaucacaaacuguaagaccucaagcagaguccucuuucugaguuagaaauguagacagucccacuuucaguuccagaagaugcuccaagagccccuggggagaaagcuucugccccucccacaccauguuuggcuuuuuuuuucuuuaaaaauuuuauuuauuucaugucuguggauauacuguagcugucuucagacacaccagaagacagcaucagaucccauuacagaugguugugagccaccaugugguugcugggauuugaacucaggaccucuggaagaacagucagugcuuuuaaccgcugagccaucucuccauccuggcuuauuuuuuaauuacagcuauuuuguuauguguagauaaauacuggcuuuccacuuaaaugugacuugacacuagcuucucgaauaucguugugcuuccuaggacuuuggcucaggccgcagccaugcacagugaugguuaaaaguucagcuugaagauguuucacauucauaucuaucuccucaaaggaacaaaaacacuagagaggaagcuguccugcagcggaagacggcagccagcgccccgccacccccgagcgaggaggcuguguccagcagcucugaggaugacucuggcaccgaccgggaagaugaaggcuccaucucucagcgauccacuccugugaagaugacugacacgggagacagugccaaagcgacugaggugcgggagcagggaagcauaugugaucuagccugaggcucuggaaaaugaucuuuaaaauucugcuuuugcuuaaaaagccgagagcaggaaaaugucauguuacccaacucacacugcuuuagugcagugccccaggugaggcauaggauggcugcuuucuacguagaccucuucuuugucguggugaguuucuugccgcguggggagcuuuaagagaagcccguccuuccuugagcaucccacccacucggagccuguuauccccaauggacacuuggcaugcaggcuuggaccuggcucccccacagucuuuggauaguccugguggaaaugaguccuguccaaaucaauguacuaaucuaguaaggaaagcaaguggacagaaacaguugcuuucuagaaauagcuaaaggucacaaugcuguaagaagucauccugcuaauugaggaguuaguggagugacauuggccaaaucuagcccacuugauguuuguggaaaucaaguuauuuuggaaaccagcucugccuacucauggugcucacgcucuaugccagagcugagcaguagcagcagaagcuguguaacccaccaugcuuagacuacuuacugucuggccuuugacagaaaaaauaaaaauaaaaaauaaauugccaacuccuacauuauauacagcagccauguuuguuuagcacauuuguaaaaagccuuaaacuaagccguuuuaguaagaaacaagaaucauaauuuucuugggguuuguauuuuuugggaguguacuuuuuauuguuauguuuggaggcagggccucacacuacauuaugcugugcuagaacuuacuaugcaauucagaugaaccucagauuuacugcaauccuccugccucagccuuucaacucccaggauuauaggcaugagccacugaucccaacaaacugaguuuuugaaagccaucaacugaagcuuaaugagcaacaugaaaaaaaaaauguacuauugcuucuauggaaacauucuuagacucauuuucuguaugacuggggauauuaacauggagaauaucugaugauucuaaccaguucuuguucuucaaacucuagaaugugguccagcccaugaaggaaguguauggagucagucucuccaguagccugucagaggaggaucacuccauuuaugccagguaagagaccgaagcacaggaaggaaaaauaaaggggaaucaugggauuguugugacauacacugucaccuuucugucacugugauaaauacugagcaaacccgaguggaggagggggagaugguuuaucugguuacaggucacacacaguccaucccuggggaagucagggcaggaacucaggcaggacccacggaggagcgcuucucaguagcuugcucagcuccuuuucuuacguagcccaggcuuagcugcccagaauggcaccaaucacagaaagccgggccuuccacuuccaguagcgcuuaagacagugccccacagacaugcccucugaccagacugauggaggaagucccccagacugauggaggaagucccccagacugauggaggcaguucccccagacugauggaggcagucccccagacugauggaggcaguccccacacugauggaggcagucccccagacugauggaggcaguccccacacugauggaggcaguccccacacugauggaggcagucccccagacugauggaggcagucccccagacugaugaaggaagucccccagacugauggaggcaguucccccagacugauggaggcaguccccacacugauggaggcagucccuacacugauggaggcagucccccagauugauggaggcagucccccacacugauggaggcagucccccagacugauggaggcagucccccagacugauggaggcaguccccacacugauggaggcaguccccacacugauggaggcagucccccagacugauggaggcagucccccagacugaugaaggaagucccccagacugauggaggcaguucccccagacugauggaggcaguccccacacugauggaggcagucccccagacugauggaggcagucccccacacugauggaggcaguccccacacugauggaggcagucccccacacugauggaggcaguccccacacugauggaggcaguccccacacugauggaggcagucccccagacugauggaggcagucccccagacugaugaaggaagucccccagacugauggaggcaguucccccagacugauggaggcaguccccacacugauggaggcagucccuacacugauggaggcagucccccagauugauggaggcagucccccacacugauggaggcagucccccagacugauggaggcagucccccagacugauggaggcaguccccacacugauggaggcaguccccacacugauggaggcagucccccagacugauggaggcagucccccagacugaugaaggaagucccccagacugauggaggcaguucccccagacugauggaggcaguccccacacugauggaggcagucccccagacugauggaggcaguccccacacugauggaggcagucccuacacugauggaggcagucccccacacugauggaggcagucccccagacugauggaggcagucccccagacugauggaggcagucccccagacugauggaggcaguccccacacugauggaggaagucccccagacugauggaggcaguccccacacugauggaggcagucccccagacugauggaggcagucccccagacugauggaggcagucccccagacugauggaggcaguccccacacugauggaggcaguccccacacugauggaggcagucccccagacugauggaggcagucccccagacugauggaggcagucccccagacugauggaggcagucccccacacugauggaggcaguccccacacugauggaggcaguccccacacugauggaggcagucccccagacugauggaggcagucccccagacugauggaggcaguccccacacugauggaggaagucccccagacugauggaggcagucccccagacugauggaggcagucccccagacugauggaggcaguccccacacugauggaggcaguccccacacugauggaggcagucccccagacugauggaggcagucccccagacugauggaggcagucccccagacugauggaggcagucccccagacugauggaggcaguccccacacugauggaggcaguccccacacugauggaggcagucccccagacugauggaggcagucccccagacugauggaggcagucccccacacugauggaggcaguccccacacugauggaggcaguccccacacugauggaggcagucccccagacugauggaggcagucccccacacugauggaggccgucccccagacugauagagacagucccuuaccugaagcuccuucuucucagaugacuccagcuuaugucaacuggagucgacauaacagacaugacagaaaauugaccagaaagucaaaacagugaugcagaaggcggcagguucgauguggagcaccggggccuuuaaaugucggaaucugaagcgcugguuugugcuggggagaggaucuagugcuucagacacugccucagagggagggaucauagggcauuuaugucucaaugcugcccaugucugagcugcagcuagauacagaagcacagcuaugcuccccaccucucaagaucaacguaccuucucagaacugaauccugaaccuugcauucacuuucucucuggagugguaaaggguggcagaggcagggcacagguucaggauguguggauaagccagacugcacugaaaggagggugccaucaaaaggcauuuccugaaauggugccaaauuaggugaguagugggaagagugagacuucuuagagccucuaagggaucgccguuuccccuggaaacguaaaggacuuggcaggaccaccauaaguaccccgugagcccaguacaaccuccagacgacuguguauuccauggggacagagccccacugcagucauucauguuugaccuaugagagcgacugcucagcuucuucucaaggagggccuuuccugucaggaugcacugaccccaaggaugccaguuuccaucucaaacuaagaucuaauccauggugcaugaaacauaaaauagguggcauauuccugacuauaaaaucagccuucauaacuugguacauuauaagccugcaucacugucugacugagagccaagucagacauuuagaguggaaccacaugugcucacuccugggcacgugagcacaguuccucacuugccugcucuuucgagcucuguaacugagcugugaugcagugcaccugugagcagcguggucuggaaggacagcugaugggguccguagcugagugcuguugccacuugcagaguaugagucugcuuggcaaggacugaaggggugggcuugcuugaaacaaaaaggaaaguguuguuguuguuguuguuguuguugugccucagacaaggcuuccacugaugucugaugucuuacuggcucagacuauaaggcuacuucuuuugucuccuuucaggagugacacacagggguuaucaggcucaucaucccugggaacacccagccuaagaaggcuggcagccagugcgcacagaagggaugguugcagggagacaucuacccuggaauaaguuucauucuuaugacccuugguucauauacggcuugugguguuuuguucgcucucuaaacaccucuguaguugauuuaaaaagagauuuccagccucugucaagucuaaagguacagagcuguucagugacuacugcagaauacaaauucuaugcuuccugggugggaaucuugugauuuagacaacauaucuaaauguuggcuucuugguucucuugcuccucgcggcuguugaugcuuacagugagugggggaaggguagggacacuggccaugccuucccucugugugaguggccccuucugucugcuggucagcucucugcugcuauaacaaugaugcuugagauaaucagcuuauagggaagaaagguuuuugugacacaccaguuuggagauugcggucugugguugguugauuauguugccuuggggccgguggcacggcagaacaucagggugggaagcagauccugaagcacauuguuaucucauggcugggacacaaacaugucagagaaaaccaggguccccagcuccauccgaggucaugccccccaaugacccaaaaccucugacuaggccccaugucuuaagguuuccaacaccuacuuuccaguggcccuguucuaagaacaaacuuucaugcaugaacccuugaugggaggcauuccauccaaacuccagaaguuuguaugggguagcuaggccaggggugacccagccacgcucagggacugccuggcuccacucuugucccagcuaggugccuccuuggaucaagagagccaggaaagagcccauguaguuaaacuccaauggagccuucccacccccaggggagugcacccaauaaacuggugcccaaugggguuuguacacauggugauggcuuauacaccaagcugacuuggggccaccgaacacugggaaggagagggcaaagcugacucggggcuacagagcccugggaugugggggcacagcugacucugggguucagagcccuaggagggagcucaccacuggccccgccuugcagccuguccugccucucuuucucccaccuguuuuucuugcaugaagcugcaaccaucaggauuccucaguuucgugguuuguucugaccucggagccccgcucuccuucauuucaccuuuccgaugaggcgacuuuaguuuucuaucuugaccacaccugaaagcuuucuauuccaugaagccucauacagaggucacgauggcuuugcuuuauuaauuaaauuugacuuuuguaucugcuuccccugcauguaugugugcgucucccuucuuccuuccugccaggagcagaagagcagggaagccagaagagggcacugggaucuccugggacugaaguuauaggggguugugagcugccaugugggugcugggaauggacucuggguccucuggaacccaggcagugcucuaaccaugagucuccucccccaauguguuuuauugugauagugauuguacacuucaucugagacauuuuaaaugugucuaccuagaguuacauaauuucuccaucucuaaacuggacacaauuggucacuugccuuaguuuaaagcaagcccuagagaguuucucagcugcaccauaagaaucucucaguuguugcuccugaagcacgugaccucagaaaagcuuaugaaaaauaaaugccaaggcuauccauagucaucaaggaaaauguuuuaagcgggagacaaacagaaaggaaaucagcuuccugaugcugccugucaccucaggagaacagacugcaucucucagggggaaauugggugugcaugguaucaaccacccugcaggcaggaguguggcuguccucuuuggcucugagucaaugcuuggguuagugccauaccauccucccuggagaggggugauacggcaucggcucaucagcuggcuuccucuauuugauugacagcaguuuuccuaggaguagcuggagugcacuuggaagugaggcugggaaugaggggauagaggauuguuagguccugaggaagcugagucaacgcuguggccucuuagcagcuucccugccucagggccggucucuggccucaucccucuccguguuacucugucauugcaagcacccaaccgaccccaugcuuccuauauucuguguugauaauggaaaugcagacgugacuucacuugugucaccacgguugugcaagcacacccugguuggugugagccucuggacucaucccagguccuucugucuuuggcuuaugcccguccuuuguaauccauagguuuguucagcuggggcaaagucaacauaaacaggaccgagguaaccagcagcuguguucccguugcucagauggaguuauaaaacuguaaguacacuauaacuuggaaguuuuuuauuucauuuauuuguuuuguguguguguguguguguguguguguguguaugcauauaugcaccacaacacacauguggaggucagaggacaauuagaaguggucaacuuucuccuucuacuguguggguuccagggaaugaacucagguuaucaggcuugguggcaagccccuuuacccaaagaacugucuugcuggccuuauauuuaaucuuaaaaaaaaaauuucagugugcaugccaauuguggagugucuggugacuuguuaggggaaauauccauucuugucaccaacuuaguauaauuugacacacagaagcauucuuccugcuacuuucuuuacugaaaacugucuugggagaacaggggguggggguggagaagagguuacaaccuuaaacugcaccccuuggcuuuccuccaugaacucugcccugacuuggguagagaggggauguugaagcaauuccagugccagagagacuuuaggugucucagaagagccuccaggggaguggcucucaaccuuccuaauugucaccccugaauacaguaccaccauguguggucauaaccccaaucauacaauuauuuuguuacaacuucauaacuauaauuuugcuacuguuaagaaucauaucguaaauaucugauaugggguccccaugaaagggccaucugacccccuguguugcaaagcacggguugaaaacugugcuucugagcguggguggguaagucucucauugcuccauaacccuaugagcacuaaugccuugguggacguuaaacaggagcaaauucuuagcuaaacagaacuauguucaaauuacgccacuuucuggguuguuaccuugaacaaacaacucacacuuuguguggcuguuaccacagcaccugcugcagacgaggguggcgcgaaggaagccaguauacuuugcacagugucuggagcgagugcguaguaagucaccaucaugguugccaucaucuuucuaugccucaucaugucugagugucaggacaaagcauggaggugacaaggagagguuccagaccacagucuguaccacuccuucuguagagggaggcauaguggagguucaccugggucuaugggaggugucugggcagggucuggcacugcuggcacucagucaguacugucagugugugcuuaauugguaggugcuaggugcuggguuucugccccaaguguggugguuagugaggauggaggagcaugaaguugugcugucacacccuggaggucccuuucuucccugccugccagcauccuuucaguccuuacuuuacucuggaggcagggaagcacaucagcucauucauuuagaaaccauuuucuucacuauagcuucuuaacacaucgaguugaaauugacgagacaaagagcaaaaguguguuaggauguuagugagagagaccggagagcuaagcuaggucaugugaugcaaaccgacccuuccaguaaaaugggaaggugcagcucauuaggagaugguaaugaugagagggaaggaguaaaagcuucccuccuuuucccaaucuuagguaugguaucugucguacuuauuacuuucuugguucuuacuuauucauauuucaacauuugcucucccgagccccggcgcaggcgaaacccaugucgaucuagaacuguaucuuaaccuuucccacuuaauuagugaagagucuaucaugagcacguuuuugcacaucauccucagcaggauaacaaagagcuuggugagggcugccucaugcugucauggcaacugccaaguguguuuuuagagaggguugugugugugcccuuuaaacuggaacucuauaaccagguucguaaaaugucagcuaucauuuuagaucucuagagcuacauccaaagcagcagaagcuagacuugugcgaggcccucgaagccuccuugucugcagcuuaggcuccagugcauuuaaaaaugaugagagucuuguaaguucacaugccucuuugcuggcucagcucugccaacuucaucaucucccagguuuuucuaaaauucugaggcuuaccagcucuccuguuccaaacuggagagaauaacauaaaauguuacauguauucucccuaagaaaacucccaagaagcccacaggauggagguuuccuauuuuguagguacagcaaccgggguggggaucuagacgcugcugcccaggaccuugcaggccauugccuagagggucgugcuaaauccacacugcucuggauccaacacaguugucuguugccagcacaaauacccaaagcuguguuugauccaaguuugacagcuuucugguucacaccagguagaaugacaucacccgucauuuacuauacauucagugugugguggccucuguccuauguacuuuaaccuauauuuccuguguuaacucaauucccaaagacauuacagagaaguagcuuuuaucgugucuucucuacagagguggaaaacugaaguaagugcacaguugaugucauuugcccaauuugaagcagccgacagguggagggaugaggagugaagcccagacugcuugcuucugguaccugugcugucuaccugugaccuacagacacuuaggcuuggcggcuaccuuuuaaaccacuugaguagaaauggaggcuccgugacauucacaauacacacuggucuuguugccugaccugggacuguagacaccguuugaugucagcacuguguugcucuugacuuuuguucauauuuaaagaaaguaugccaccuuugguuugucccggugcccccuucucucucucucucucucucucucucucucucucucucucucucucacacacacacacacacacacacacaugcaugcacacgugugcgugcacacacaccaucuuuccuuguacaguuauacugaaacuuccuugcuaaauaucuggguuauuacaggccugcuagaucauucaaugaggguaaccugucucugaguccccauugaucuucauaacaggccuuaaauugugugcuugguaaauauuucuugaaauauacuaaaccucagcccaccuccucuccacucucccagagucuguaugaaguccccguguccuaccaguuucacugucuuccugacaccaaguguaccccucuucuguugcccccucaccugccauggucugcccuuguuucuuugaucccugaugacuugugacauaaggaggcuuuccacauugccccuuuuccuuugcaccuguggcacuugccaaguuaaaaggacccaaugagacuuuuuaugccuaucauuggggggccccagugauauuugccucgccugguguugggggcccaagugagacuugcuaugucugguguugggaugucugagguagguuuuugucucucagugcaagaccagccuguugccauuauuacuucccucugaauucucugggaguucuuauacugcagucagcaguagguugaagacagagcaugcaauuuucuaaaugccugcuucucuguggcuuaccuauuccagggagaggcuucacucauuuaaaaaucccuucuaagaaauggguccaaauacaagauguagacuuuguauggaugcugucugauguaggauucuucuagaacaggaaaggugaaauguaauacaagguaaggaaggaagucuuaggcuuauggcagugcuugggucuccugaggguggcucaggauccugccauuuacugacacuuaagggauguucacgagucaggaggaggacgugaaaagggcaugauccaggaagagucgguggaggacgauaggggauaaauauaugaccaaguguauuguguguguguguguguguguguguguguguguguguguguguguaugugaguguagguagguaggcaggugucuuuuuugagacagucuuacucuauagccuaagcucucugggaagucaauauguaggccaaaguguccuuaaacucaaaacaguccuccugucuccacaugcaaggugcugggguuauagguaugagccuucauaccugcugaacuucaugaauuaaaaaaauuagcucuguuuccagcauuuaagaacaaaauaaauugugguagauucacagauacaacaauuggaagcuuugggcaauacuccuguuauaucccaggaauugacacugggcgcucacaucagacuguaccucucuacccuagagucuccaguucugccucuucauggugcccacauccauuugguuuuuuuuucucuuccauuucuccacuacuuacuugcucaucuuaguagugaccagggucucugagugucugggaucaucucaggagugcugugcccugcuuguacauuauggugccagucaagggccaucuugggcaugaguucccugccugguccuugugguaccugucuggucaucaucugaggcuggcuccucaccagggaccaccugaggggccccaugcaggggucaucuaucucaggcucacuugcucuuggaacccauaucccaagggggguucuucuagucuccagcucacuccccaucuugggagcucagccacacuugucuggucuucucaggcuaguucccuguccgggcccccugugcuggacuggugcugucucaagcucauguuugucagggaguguuaggcugccaaucauucagagacucacagggcagaacccugaguguagacauagccucucuccucucugccuccuaccgaugcacaggugacacagcagccacaucugcagugucucuagggaaagucaagauggauuugcuacuucagaguggggcuauccugaagggucccuugcauaaugaacaauaaauguaauuguagauauugcugucacuaacuuuuaagggauguaaaaugcccgauacuuuaauuuuuauguguugucugucuucuuuguggaauaagauaugccauauguuuauaugaggucccaggugguccuuaacaugggugugugacccugaacucucaucuguacacuccuuuuaaaggccugcuguagauagaucucuuuggaucaguguaacaaaauagucgaggcagcacucuuuuguuuagcucacaguucugaagacuuaagaacauggcaucauaacuguucaauucuggagaagggcucaugucaggcaucacagugauaggaagugagagaguucacaugguaacacaggacacaggaaccaagagacaagggcaagaccagccucacgcuuuuuauuaaaacucacuaaaacaucauucuuccugccuaaagaucuuaccaucccuacacuggggcccaccccuaaaauguucaccaccucaauaguacauugggaauuuaggauagcaccacaccaaggagucaggcuccguccagcguaugagccauugagggggaggggaucaaaucacauccaaaccauaggaagacccagaagugaaugcauccaguuuaagaagguagugaggggcaggaggcauguacaggugggaacaagacuggaagagacuggugaggcaacacgaacuuuagcuucaaagcuguauuguaaucaagagagcggugagcuuguauuugcauuuuagaaaggucaguuuggaaaugguguggagaauggauuuaaaucaaggauaaagagcauaucuacuggcuacaucaggacaagaaaagaagcaccucacuuagagaaggggagcagggcuugguggugcaggccaauaacccuggguacuagagaggcugaggcaagagaauuacaaguucaaggccacccugagcuacagugcgaucagggccagcccauguaaccuagggagacccuaucucaaaucaaaaacuauaaagagggcuggugcuguugucaagguagaacacuuuucccucgugccccaagacuaaggggcacuuguggucuuccugugucagacucccaaaugcugggauuacaggugucugccauccuaccuagcucaggcagccaggaguuucaaccaggaguuucauagcacaguugaccagauaaagccauguguugccagaauagccagggcccagugcagaucugggagcuaaauuggugagccucagacaguaacaggacauccaaaugaggugcuuguuacccccaaaaggucuagauuaaagagacuuaggaauuuaggagacuuuucuauucuugguuuuaaaaaucauuucuugcuuuucuuuuaauucaucuaggguaaauggauacauguuuuuaauucccacccccacccccccccaaggaucugugaacacauuaaagugaaaaaacucuaaagaaguuuauuacaguguuagaauauauuugggccaauagaacacugucuuucccuguacauggggagcagaguugggcaucugaaaagaccaccuaagggauauuccuguggggcagggugcguguaguauuguauuuaagaaccaugucuguaauaauuuagccuuuugcuaucuugcuagcuggauggauaaccgugaguuuugugugugguggguggguggggugauuuggggcacauggagugauagugguuuuaugcugugucacugugcugugacuuccugacaucacaauauaaauauaauuauauuuaaaauucaccagcaaaucuuuucuuacuaugcaguucccccauguuuaauauuuggauguuauuguucuuuuuccuuacgcccaugaggaagccugugguguaacaucagaaaucacuaaaacuaguuacacauuuucauagguaaaaaacugugcuucuagcuaccccucucauuuuuauaaggacagacaguccuuagcaaauugaugcuacuguguggcagguugguucuaaaacaaguuugaaaaaauaaguuguuugaaaguuaguucaucugguuuauaacuccagucuuuagggugagaccugauacauaguguugcuuucaaucuaaauaaugacauucaguaguuuucccucuuuuaggaauaguauacauuaaucaaaugugagagaaaugcuaagacaaauagauugaaauuuaugguaagacaaccacaguuguaaacuuauauuuuauugugguuuguuuuccauuucagacuuagcagcucagagcuuagugagugucucaugauuguucucaauggauacuguuguuaguuaacguaugcauuagugagaugggguaaaauggaccacagauugucugauguuuuuauuaccuacuacuaccaaauuguugaggcucuuaaugggagaauucuuugauguauuauaaccaguucuuuuuuuuugagacaggguuucucuguguagcccuggcuguccuggaacucacuuuguagaccaggcuggccucaaacucagacauugccugccucugccucccaagugcuaggauuaaaggcaugcaccaccacgccuggcuguaaccaguucuuaaaagcauguguguaaccugcauagaacagaaccguaauuucccaguuugcauuugcauuugccuuuguucucagguaugcagagcacuuucacauuuaccuuagaguuaaaaagagugugagagaguggagauguggcgguuaaauccucacucucaaacugcauucucuucucuaguguuagcugagccaguuuauagccaguuuguauucuguauguucgagguaaccaaaugcuaauuaaaccccaaacaucccaauaaaugcauccugucuuuacccauaaagaaaaggggauugagacuuucuuuuuuaauaucauuuuaauuuauaauuuaauuacaucagucacccccuuucucauacucucucuagccccuuuucuuguuaucccucaucaaacucauggguucucuuuuucuucaacauauauauugagcauauauauugaguauagacauaucuaugcacauaaccauaugaauguaacauguugcauccguguggcuguggcuguggucucaggauugaccacuugccgcuggauuaucaguuaggggguccucucuacagaauacuaauuuucccucucaguauuccgugguugccugugguucuuugucuaggguuggggucccugacuuuuuuaaccauuuuauguuuuguaauuauguuagaaacacauuacuuacuauagaaauaaaauaaauuaaugcuuuuuugacaucauacuucagaauaauguauucuuucuuugaaaauaaaauguugaagcuuauuucagaagauaaauggcuaaaccauuccugugucauauaguuagaaaauagaaaauaaauuagcuaauuaaguuagugugcucaacugaauuuuauuuuuuauaauaaaauagagcuaagaaaauggaucuaaugaucuugaaagcagcagaaagagggaaagcugcauuuaaggugucucuuuagcaagcauacacacaauuauaccugaagccucucgggcgugaguggggagcuuuuucuguucucugcauuuuccaugggcuccgagucugcgcuuccggucgguccugugagcagccuugguaagauggguucuuucaaagccaggauuguuagagauguugcuuacugaguuaguucuugcuuccuuucggccuugagucuaguuuuugucucgcaucagcaaccuugguuauuucucaacggucucauaaaacgucuacuagcaucauguaaauaucucacauacugauuccuguccaaagccugucaaggaugacaccuagggcuucacaauacaaccaggcuuggggaaggacuccaagauggcauuuucagaagugcuucgauaugaucucucucucucucucucucucucuguguguguguguguguguguguacauacgugaguaugugugucuaggaccauaaaaucugagaaucagaaaauauggagauugucaaggucaguccccuaauuuucuaagauaagcagcuuagugggucuguagcucacucagaguuacaggaguuuugaguggugaaacugagccugaagcccauuuuucugacacuggagccgagcggguagaacccagcccaagugcugugguaagugcuucugaagggagggggugccuacaggacacacagacagugucauguggcuauagaaaugguggaguuugucacaggacacacagacagugucauguggcuauagaaaugauggaguuuguaaccaaaggaacaaaaggggcaacccaaagcauuuguccuccaaaaauggucugcagaucccuggggcaccaaggccuuuucagugagccgugaaauuaaggcagugccaccaagcccuagagcuuagugucccuuccuugacacuagaggaggguugggugcaggaggaggagguguggaugacagugacaaggagaaacaccuuguaugcuuaagucaguugauggauuaguaaagguugcuagguagccgugccugugucaucuggggacugugaccacugugaaaugcauaugcagaagguuucuuggcugcugcucaguccuguggcucugagggaagggacuucuacaguugucucaguugugagaggauuccacacuccccucccagaaccagacugacugacaggacugugguucuccaggcuuaaguauuuggcagucacuuccacagaaaugaucaagcaagccugucauuuuaaggaaaacagccugcagaauuuauuaccaauaacagcguuagaauuuucaagugaaaagcagaguuuugaaaguaugcauguaguaccacacauaauguauacagauuuuccugauaagauuagaagagauuuuaacaaauaugauuuuuaagauuuauuuauuuuauauaugugaugagauuagaagugauuuuaaaaaauaugauuuuuaaaaauauuuguuuauuuugugaguacauuguugcuguccucagacacaccagaagagggcaucagaucccauuacauaugguugugagccauugugugguugcuaggaauugaacucaagaccucuggaagagcagucagugcucuuaacuguugagccaucucuccagcccaaaauaugauuuuuaaaaguaauacuauuaaaauaaaaucuguuaucugcccaagccaucaccucacagagggagccacggcucagacaggcaggaaucaaaagaucccugggcuagaaagaucaucaaagcucagaggauuuuaaugcaggcuguuaaaaaaucauguguaggugaaaaauaaaagucucaaguuuaagauagacaguggauuuuagauaagaguguggauaguuugucaauucauauaguuucaguuccacauugcaaaccuuuaaaacacuuguuagauucuauacauccagaauuaucugcaagacccuuaagauagcuccuucuaguaaauuaccucccugcggacuauagaaguguuuguuuauuuccuaugcauaaauuuucuuuuuguuuacaaagcaaaggaagcaaauguucuguuuauaaagcuucucccaaaguucccuggacuuuuuagagugcuucuagacucaguuaccagaccaccuaaguccucugguucaagcaguaaagucauuauugucuucccugaaaggcaaggacagggcccccaguagagaggguucacaagcuuuguguguucccggggugcugucacagaauccugcagccucagaaggaguggguuucauucuccugcccaggaagaaggagucccagugcccaggguugggucacaugccaaccccuguuacugcaugauuuacugugauuggcuuaaaguuguuauuuacacugugugcauauagcaagaccaccacagugagucaguuauuaaacacaaauuaaaacagaguccuccauguguggccaguugacugcaguuuguuugcccaagcaucuguuaagagaggcuucaugauucuggggucaggacuccggggucuggcccccacacugccauugcuaacugaaucccuaccugucugagccguggcucccucugugaggugauggcuugggcuagaacauagcucugugaggcguggcuccugaugcauuccuuacucacucuguaauacccacugauggauggcuuucucucuuaugcaagaugcacuggagggugcagguggucacuaaaauauucucuguggaaccacaggagcagucuacccuccugcgccaugaacauagugaaaguccaaaggagaggacaaugaaaaauggcuuuuuccacauagaauagucaugaaauaaauuguuuaaugcccucagcaaagagccccugccacaaagcucuuuagcgaacuauuacaucacauggguuuucucucaucuuauuagaauguaaaauguguucagcagagaaaauauaaagccacaaauguguuuggaaaaugauaagucuccaggaggaugcuuacgagccugacuggcuaugaauguuuuagcucgcucaguaucagaaagagcaugcggcagagaagcaagcuguuccagagaguaaaagacagccugagaaaugagaccguguucucugaaagcccaagggugugcauccuguagcucucagauaagaugcccaggaagguuuuuuuuuuuuuuuuuucaaaccaggcuacugaaguuuuucagcccuuucucaugcucacagcuuguuaauuuuucauauugagagaguccagggggcuuaucucagaaaagaggauuagaagucaugugaucauuuccuugaguaacgcuugaaucacugugaggugaagcaggguuuuuauguugauuuagagaccaguaagugggacauaucaggaugaagauuucagauuccugaaaagaaaaucuuugcagugguuagcacuguccauggugcuaagagagucucauguucuugcauuacccagaguacgcaagugaaagcuguguuguuuguggcaauguuguagcaucucuucauuuggucugagguugggcaaagugaucugaaauaaaaguaauuucuaaaacuguauaauugucaugaucacagccacaagucuagcugggauuauaaauagcuugaagcagagagugggcgguucauuaaugcacuagcuauguauuaaguacuuacacugcaucaggcacugcucugucacugggcagacaguaaaggucaagaccaucugaguucuucagcauccuucugaccuggggcgugcagauaggacgaaucaguaacaccauaaagaagacaauuccaucuuggaacaagugccuugaagacucacaaaccaaagaaauaggagaaagugguuggggcaggagcccaacacuguuuuaggucauuuguuugcuuguuuguuuguuuguuuguuuguuuaguuugggguuuugaauuuuuguguguuuguuugagacaggaucucacuauguggccuuggcuggccuagaacuuacagagcucuaccugccucugccucucaaaugcugggauuauuugagugugcgcaaagcugaucucuuggagaagcugaccugagauccaacuugaaagaaaucugcucugagauggcuggagcauguucagugcagagagagcacacacuaaggaguaggcaggaaccaucuuggcacauccaagaaguaggcagaagguggugagaaccacagcugaagggcucuggaguagggugggguugaguggggcaggucacaauagauugccacaggagcuuaggugugagcccgugacugcucguucauucacagcucucacaguuguccugguaacauccuugucuaggagaaggucuaaccuagaaccucacacugcauuuaauuguuaaagucuccuuuauucugaacauaccaccacccuuccuugauuuuuauguccuugacacuuacacuuugaagaauacagucaguuguuuuguagacuggccguggguuuaguuugcucuaauuagauccaagcacagugucuggccuucaaaucggcccuacauguauuuauccacaccccaguaucaucccuaccacuuuguaccaggaguguuuuagucaaacuuucuaucacuauagcagaauaccuaagacaauuagcuuguaaagagaaaaguuucuuaggcucacagccucaaaagcuucgguucaugauccaucagcgaagcagaacaaggugacaggagaguguggcaggcagaccugcuucaagaggaagggguugggguugcauagucccugcugugcacccaacuuucuucaagguucugucaccuccuacaagggacccaagguccaugaaacauaggccuuuggggugauuuaaaauucagauuauuagccaagugcauagaggagaaaugauuggguucuaaagugaucuguggggucacuguuuggggaaagcaagcuuucacacuggagcagcccugugcacagacacagaaaacacuagagcaucugaccaucacaucaaccaagagaaugagcugagauuaucagacgcccagcgccagguaagucuugaguugauaacagcuauagccagggagcugguagcagcccugugacagaccuugaaucauaaccaaacuaggcccuuccuaagcuccugacuaguuccauaugaguagccauauacuaagacaguaaaugucuguuggcuuaggauacaucaugaaugcaggcagaaauacuauacaugggcaucagaugacauaaaaguucaaauugcuuguuucaauuucuugacuaacauuguauguccugaacucuucuacugugaaauugcuccuuucauuaaugaauacuuuagggaggugcuuugaaauuauagaaauagccuuuauucaucaagccauccauuuugucguuauguuuauuuuucucaugaugucuuuacuuauuauacucagugagauauaauucaucaucaucauuauucuuucugauacuacaauuguccccaauucuaccagagucccuucagccugccccguguccuuugaccauguccucaucuucccccuuuucuaguacaagaugcuuugagcucaucguguuccuugccuguccuagccuugaaaucagucacuucuccaagggucucugauucuuuuuaguggaaaaaucauauuaaagccaagaucugggcacuagauguaccuauugccacugcagggucacgaauccaggccaacucaaauagcgugccauguugacaugcacagauguauauacuauauacaacuauauagagaaauacauaugugucuauuacacauuuuaauuauauaauaugaacauccaauaucuuuauagauacaaacaaaauauauuugcaucuguagguugguaaugaugcuuaauuacaaaguaucugguguuuauucuagacuucuccaacagggagaauuugacuccaauuacugcuuauuugguuaguccucauauguaauuaaucucccaucaccccuccuccgggauugucuccaguacaguccauucagacugugacuccuuaauagagucaccgaccucaaugacgcccuucucaucuuaagugugcccaguacucaacccagcugccccagugcguguguacccuuaugcugcuuggguucuggcaugcccaggcugucaaagacugccuccguuugcagaugucuguccauggaauggauggcuuucgugcugggucaaguaggaggggugcaggaguguggcucaaucauuuuguaaugaguuucaacacugaaggagcauccuguucacuacaauuuaauuugucccaguucuuggguuccagaaaucugguuauacugaagucucaugguaucuuaaucacuguccuacugcugauuauuggaauuggugucaaggaaacaagcaggguccugucaccuacacgugagaggcaagacacauggcuguuucugcacacacuggauuucuaggagugagaagccacaccugcugcuguuccaggaaaugcaaggacauaggagacacaaguccuaauggucugcgucucagaggugaccuguugcccugagggacuccauauaggagcagucacauacuuuacccuuugaaaacaccugucuaugcuuggugcuaccuguccuuugcugucagaagugcccccuuugaacagaccagcccugugcaagaugaccaaccccuguugccugcagggcucaaagccaagcacuuucucauuaaauagcuguugaaucuucuaguuagaacccucaaaaugacccagccaacucucacugcuacuuccccaguguuuauauaggcacggcugaggcagaacagcucguucacauuugguagauaauauguccagcuaauaggagggaggcuauacuguucacgaacugcauccuaaguuggaagcauuuuaccugcuucaggucagaaaacaauuaucaugccucauuucccugacaccaguucuguaaaaggauacaaagauacaaaugacaguuuaauuuuagaguucuccaggagaauauaaaaagugaaucaaaaauaccagugacuguggcuugaauauaagaaguauugccacugccguuugugugugugccagaaguagacugucccuucugucuccuuggagaacaaacacaugugccugccucaagaugggagucacccacaacccgguaccugcugcagcugagauaagaggccuggggcgggguguggcugggugugcuuuaucaucucgcuggcucugauggacaggagucagucacagacagcguggugcucuguucuaggcagagugaacagagugacuuagcuugggguuuuccggaucauggcagggcaguagaaacagacugcaaaucagacuugcaggaaucauucccugaaccauguggcaggcugucagagggacugccaugcugccuuggucaggaagcuagcugucacagcagcugcuggcuccaaaaccaaccgccuccaccgucuugagaaagucacugcagcucuggccaagucaagagugcagcugccuuugccucugucuacaaaguagaucguucuguccaugugacccaguuacaaaucaaagcagcacucgaauaccuccguaaaagagccauggccacauuuugaaaucaaauuccaagggagucuggggaugguuggcuuuuaguuuuuguuuuuccuuuucagugaccuugguauacuggaagagucaauacugcaggaucuaaucugugcugucacucugucccucuagccuccuagcuacccacucuuuguuaggguagaacauaaaaagccccaguccucugagugcgugcagcucuacucuucuggccgcuugugacccuguaaccacuaacaaagacugucgggaugcucccagacacugcgguggcagggaaaauaaacaccuucaggaacgcagauaagggcugccccaucugaaugccuguggugggugcaccauccccaaggagaacaaggacugccagaggagaagugggagugaucuucugagggagcagagagggcauggcagugccagucagcagugaggcuggcagagccacauaggcacaagucuuguauuuaguuguccauuuggaauaugagugaaaaauauacuuuuaagauaaaugugucugauagguuuuuguuuucuguuuauuugaugugugugugugugugugugugugugugcgcgcgcucgcgcaugugugcaugcauacguguaugugcauacuacuaugcuugugugaaggugggaggacaacuuggggcaucagcccucucccaacauggggguucuagggaucaaauccagguugucaggcuucgaagcccacaccuauacucacugagccaucuugcuagcacaaauacaauaauuuuaaaacucuaucuccaaauguucacacaaaagcggaaauaguaggguagcaaaaguagugauguuugucacuagugauuucuguaacauguaucugauggaaaccauucaaaaagaggguagaucgauuuagggggucacgauuucagaauuauuaguccauguguggcugguuccauuauuucuggguuguggcaaaccaaagccuuguaagcggggcgaggcuguuucccuuacagcaggcaggaggcagaaguagcaggggaugagcccaggacaagaacugccccucagaagcuuccuccaguugggcuacaccuccugcauuccacuucuuuccaguaaugucaccaaauuaugacaaauccaucagugggucagucagagauuaugucagagcccucaugauacggucaccuccccaaagccuuuuaacacaggauacacccaaauggcaucacccauggacggcacucaccucagaacauacacagccggguauucuacaaaucucauaacccaggaagacuggggugccaggguuugugcagagcacuggggacucugaugagcucagaauaggaggaucuaagaauacagguaccuauuggaaguuggcacgugaugugagcaugaaaguggccacccuaggcccauagggagugacacuauuaggagguguggccuuguuggaggaagugugucucagggugugggcuuugagguuucagaugcucaagccaggcgagugucuuguucucucuucuugcugccugcugaucuggauguagaauucucagcuccuccagcaccaugccaccaugauauccaggggcuaacccucugaacuguaagccagcaccaauuaaauccuuccuuauaagaguugccuuggucauggugucugcucacagcaggaaaaccccaacuaagacaaugagaguggcugcucauucagggaggggcuuaaccaacucaguaccagauuguccguugcccuugaugaauucucaaagggguuguagccgagcagaucacuuaaacucuugaaaccaaauaaccacagcuccucuccucgauggcugacagucugaggagaaauuguugcugugucgacacugaggaggacauuggcagcagagaugagggagccaggcagagacacaugacugcuauccuggcacuugggaugaaagcagaagaacugagcauucaaggcuacauagcaaguucaaggcuagccugggcuacaugagacccuuccacaaaaaccaaaaagaaauaaaaagaugcaagaauuuacacaaaggaagucucagagggcaagcugacaugccuugguacauauugaugaaauaagaaaagggaguccuguggaguuggcgaagucuccugagccuccccucccacugugggcucaggggagcucgcagagagcaucaggagagugccagaggccacccuacauaaaguuauuugaacaagaaaacauggagccuacaaacaucccauaaacaaccaacgugcccauucaaaauaagcuaaaauacaaauaaauaccuauaaauaauaauaauaauaauaauaauaauaccuauuaacuucagaacaaaagacacaaagaagauuuaaaguguuaaaugcugacaacaggcaaaaguuuaauguggauaaacuggcaucuuuaaaagagagggaacuacuaggacagugaugcagaaggaaauucucucuuggacugcaacuuuccuucagugucggugugguaagagcacaccaacgaccugagcguauggccuguacuggcuagagccagaugcaggguaaccaaaaggggaaaauauccuuuaggcaucuauacagaaagacuucuuacagaaagcuuagguugcugcaagguguaguggacauaguacuuaauaccaggaaaaaaaaaagaguaauguguuucuaacgcucaagagaagaaugagugagccacuaauagcuuaagcuuuuaguguaaaacuagaucucauugucaguaggagcccacagaguauuguuugcaugggcguaguagagaugcgcuuuagacaacauggcuagaaacauuccuguggcuuagacaagugaccccaaaagcccauguuuuaagguccagcugguggcacuacagagaggcagugaugcccguaaugaguggccaaguguaaggaaguuaggucaucaagaucauggcucuccccucuucucuuccucucugcaucguagcuacucccaccauucgcuccugccagggcaugcuccucacugcaggcccaaaggcaacggaccaagagaccacggauucacacccucaaacuugugaaccaaaguaaaccuuccucucguuuuaagcugauuaucccaauuauuuugucacagugacaggaagcugauuagcauaaacacugauauaaaaauaaaccacgguucucuacagagacaaaauaaagggcuaaagggagaggcuaaggcgccauagcucuguggugaaauagugugccuuacuguauguacugcagcucugagcaagcugaggcaggaagagcgugcacgcaugaaaucuguucucagggagcauaugauguggauaccauuagcaguguuauucugaggcucuuguguguuuacuauaagauaaaccaaagaaagcaugaauauuuauaaauucugccauccucuuuuguucauuguccuugauaucacacacacacacacacaugcccacacucacaccccucacauucacauaaauguaaacacacacaugcacacacaaauauacacauguauacguacaugcacccaugcacucacaaacacaugcacucaugcacacacauacucucaacccacaaacacaugcacacauucacacaaguauccccauguguacacacacacacacccacacaugcauauacauaaauaugcacauacauacauccaugcacacuggugugcacaagcacacacaugaacacccauguagccauacauguacauacauacguacacaugcacacauaggcacaggcuugauaaugagaauuucuagacuuacauuguagucuuagaauaucaguuucccacuaagagggacccaggcuccuggaagaaguugcugacucugggcccauguugggacacauauacaauaaaacugaaacuugucauugauccagauggcaagaaagcucuuggagaaaagugggguccuuaagaaggacucgguaagccugaagaaguccccacuggacaaggacaggccaacguggacccuguaagaaugacagcugcagcagggcgaagcucaggcagugcuuaaggcugugugcuuguaagguuuuaagagugucacucugaaggggaacagggauucaucuggugacgugacaaggagaauagagcauuacaguuauaugaaucguagcagugagugagcagaggagagcagggaagcaguguaguuagggacugagugacauuacugcugugugagucacauuuauaugagggugacggcucaccgagacgaaaguaccaaccaggaguuucuaggagaaacagaacaguaaagacaugcuagaacagcaccccacacacagcguccuacaguaacaccagaaucauaccacacauaguguccuacauuaacgcagggacacuucuacacuuccuuacacagaggccacuggccaccuguggccaucaugcacuugucaaguggcaaaugauacugaaaaccaucuuaaguauacuuaauuuaaaucaauuuagggucaauuuaaauugucacauggcuaauugcugucguauuguacaagggcacuuugagagcugcauuuucgaucaaggugucuauauucugacccuuggaaugugagccagaugcagacacauuuuuuuuuaagagaacugaacauauuuucacuauaucaccuuggcagacucaagacuaggcugcaaaguaugaaugccguguuggaaagauacaacacugauggaagaacuagagagaugcaauugacaucauggaaagugugcaaacaguuuccacaaaccaaaggcuggcaucccugaggaugccgaggacugggaaaagcucugguuggaaguguuugccaucgcacagcaucagcaguuugaugauaagagcccuuagcuccugauggagacuucgaaagaaggcagagcucacaacaaacacgugucacuaaggcgcuugacaaagucuugcuucaauauagcagaugugucuuacgugucucaguauacccaaauuauaguuuugaccuaaugaggguuuucuccuagaaagaauaaggcaaaacuaccuucugauccucagcguaauaucuggguccucuggcuaagaugucgucaacaaggaaacauuugaugagaugaugauggugaugaugagguggaggaggcucaacuuugugggagauacugaaaguuuuaguagcaacagacagagcacugggaagggaaauggaucuuaugagucaaacucuuacuagauauucugaaaaugcuacaugagguuugaaguaugccaaaauacugaccaaagcaagggguuaagguuuuaacauaccaaaaagaaucacauaaugcaauucuuaaaauuauguaaguauuaucuaguaguuuaaccaccaaauuuugucuacaugaugucaccgaauuccgaaaacaucucagccccaagccagugaacauuuacugguuauucaauccaugcaagccagaaaagucaucuuauuggguauuaaagucuaaagggcucaaacauuaguuccgcauuugaguauaagguagagguuuuuuuuuuuuuucuuuuuuaucagaaauggcuguguuaaaagcagccccacugaacaaagagcauuaaagggcaccagugagggguuuccuuaaaaccaucuagugugucuaaugaauuccugccuggaguguuucucugcugcugugagagccgcaguuaagggugaaugucaucagugcucaccaagcgauguguguuaagcagcucggaaacgaauggguaaauauauuauucuaaauaaggcugcaccauuccuugggggaaaauacagaacacccugcuagcgucugcaauguaauuauaauauuuuauguccaaaaauacaacuggcauuugagugcggggcaauaggucuucucccuuugaggcugugaggagcuuaaagcuaaauucccucugcucaugcccaggagacaaguguugauuuuuuuuuuaauuuuuauuuacuuuuugucaccaaaguacacuaauaagcuaggucacucuacuggaauccauaaaagaaauuugucucaccauuucuacagugugugguauuuaaaugcuaguuuuggugguuuuguuuuguuuuaaucuggcacccagugcuaccacuaugauaagagauugucugucugugcuggucuuuaacuucacucggucucuguccaacagccucugagugguauggauuuuguuuucuuucccaccucagaaaugcauaugucccuugagaaguaaauuaaauaaauaaauaaauaaauaaauaaauaaucucauuagaaaaucagagcugaaucuguuauugcugcucaugucuuuauaauuaagcauuaaacugugcccuccgauguagggcuagugguauuuugucauuuaaaagaaaccucauguucuaugcucccaacacgugggacacagagggaguaggaucagaaguuugcuagucuguuugagucagacacgaugguaugcccccgcaacuccugcauucagacaucugaggcuagccugggcuacauaauaagauuggccagccugcugccacaagauaugagugucuaggggacacccagaggcccgcccacagugugugugagcagaagacacccagguuuccgucagcuguguguccugcccacagcagaagccaucaaggugugcaagugugugguggacagaggggagagaaagaugaguggggugguuugagcucuaugaagaggaguggaacugggaggggaggguggagagaguugugaguagccugggcugacaccugaggccacggugaagucucugccuguagugccgcuaugggccauguccauggcucagauuaccaacuaaagacccuaugaaagucccuggucugaguuggccauggucugggaccagguugauguccaagggcuaggaagagcuggcucugucccucacuggcucuggcacuugggagagcagggcccugcaccucacuuggcacaguagagcuggcccugguggugggagcaugggugagcaugggagagcugucccugccacauaagguggcauggaugugguugagcuaccccugaggguaugaaagcaggagagcuggcccugcccccugccggcuacagucuuaggugagccagccaggcaguacaggaaaguucacccugguggugugggcgcaggacagcuggugggcugaccacucaggcccagauccccauccuggaguugacccacaccaacauguacuccaucuaugcacugcuggagcgagugaaagagcugguccugauaguguagcagaagccagaggccucgaaccagaccaaugacucauugcaaugaauguuugcaauuaaagacguguggacagaagcguauacuguggaacacaugcgacacacuacaacucccuggacgagaugguuuuuauguuuuguuuauuuuuuuuucuuuuguggggagguugcaaggguggauaaggaggaagggagaggugagugggauucggcuacacaaugugaaacugaagcaauaaaaaguuaaaagaaaaaacuguuuaaguaguuagaguauggcugagcgguaguauguuugccuaagguguccagaguccuugguuugauucccaucacuguaagaauucaagcaagcucauauuuagcauucuacaugucucaucuauauaacugaugguggccaugauagaccagaagcuggcaagcguuccuagauguuagaaucgucccgcgggcucagcagcugcccucucggucagguguucugacuuagucugcgguaggagccgggagucuucgggccacacagaacuccagcuuaggucuaugaggggcucccugugacuggaucaggaaacagugguucuuugugaauccauuucuuccugcccccuguuaccccagcaguccuggggauaucuugagcuuuauucugacucagaugcagcaggaacuaucucaacaucacagauguauuguucaauguagcacugggaucacgggaggaccugccugcugcuugauaaagccaugccagcuaggguuggcauguccuguccguagaguuugucauuauuucugugagucugcuuucaguggaucagguucugagaagcagagggaggacucccaguuuauuucuugauaagaaguccaaguuguuggguggagugcauggcccuguuuguguugcccuggcccuaccaccccugggacggcagggucucuuccccugcuggucuaaggcuuuaguucccagacggugucuuugagcagccauuggauaucugcuuauucuugccaggaauguuaugcacaugcgguucuaugcagaggucaagggucaaagagagagcagggaccaucaguucagcuuuacaaauagcuagcgcaucugaccgcuagagcagguaaaacugggcuucccuccuccaaagcggaugugaaagcuaaauaucaggauggauguguaagggcuccgagaggagcagacgcuggacuaauguaggccgugugcugccgguggaggccaagagcugcuuugguagcugacuugauggcuaucucugaagacuaacggagccacuuuauagaagggccugcuuaaaauaguuuggcacugaauacaaccagccauuaaagaauccuuacugcucaucuugaauuaaauuaacuguagaguuucaguauuguucugaggcaaaauuaugaauagauuuguguauuaucucaaccacccaccauaauaauguguuaagcacagacauucaguagcccuguaucuguccugugaaacacaguccugccagcuggcauacaaugagauuuagcugucuccaaauuccuuuaacuuggcucuucuuccuucuuccccuccugccuuucauuccucccuuacccccucauucucucucuguuugugugugugugugagagagagagagagagagagagaggaagagacagagagacagagacagagacagagagacagagacagagagacagagacagauguuuguacagguuugcacauguguguaaggccagagguuggcaucgagagccuucuucaguugcucugcaccuugcuuuuccuagggcucacccauugacuggcagguuagcuccagggaucugccuaucucugaucgaaaccacugucucaacacuggcuauguaccaggcugggguuacgcaucaccacauccagcuuuaacugaggcuuuaaacucaagccgccauccuaguguggcaagcauuucauugacugagccaucuccccagcacuucacugacugagccaucuccccagcacuucacugacugagccaucuccucacacuucacugaugaaccaucuccccacacuucacugacugagccauauccucacacuucacugacugagccaucucacacuucauugacugagccaucuccccacacuucacugacugagccaucuccucacacuucacugaugaaccaucuccccacacuucacugacugagccauauccucacacuucacugacugagccaucuccccagcacuucauugacugagccaucuccccacacuucauugacugagccuucuucccacacuucacugagccaucuccucacacuucacggacugagccaucuccccagcacuucauugacugagccaucuccccacacuucauugacugagccuucuucccacacuucacugagccaucuccucacacuucacugacugagccaucucucacacuucacugacugagccaucuccccagcacuucauugacugagccaucuccucacacuucacugacugagucaucuccccagcacuucacggacagagccaucucccacacuucacugacugagccaucuccccacacuucacuggcugagccaucuccucacacuucacugacugagccaucuccccacacuucacugacugagccuucuucccacacuucacugagccaucuccucacacuucacggacugagccaucuccucagcacuucauugacugagccaucucccacacuucacugacugagccaucucccacacuucacugacugagccaucuccccacacuucacugacugagccaucuccccagcacuucacugacugagccaucuccccacacuucacugagccaucuccucacacuucacugacugagccaucuccucacacuucacggacugagccaucuccccagcacuucacugacugagccaucuccccacacuucacugacugagccuucuucccacacuucacugagccaucuccucacacuucacggacugagccaucuccccagcacuucauugacugagccaucuccccacacuucauugacugagccuucuucccacacuucacugagccaucuccucacacuucacggacugagccaucuccccagcacuucacugacugagccaucuccccagcacuucacugacugagccaucuccucacacuucacugacugagccaucucucacacuucacugacugagccaucuccccagcacuucauugacugagccaucuacucacacuucacugacugagccaucucccacacuucacugacugagccaucuccccacacuucacuggcugagccaucuccucacacuucacugacugagccaucuccccacacuucacugacugagccuucuucccacacuucacugagccaucuccucacacuucacggacugagccaucuccucagcacuucauugacugagccaucucccacacuucacugacugagccaucuccccacacuucacugacugagccaucuccccagcacuucacugacugagccaucuccccacacuucacugagccaucuccucacacuucacugacugagccaucuccucacacuucacggacugagccaucuccccagcacuucauugacugagccaucuccucacacuucacugacugagccaucucccacacuucacugacugagccaucuccucacacuucacugacugagccaucuccucacacuucacugacugagccaucuccucauacuucacugacugagccaucucccaacacuucacuaacugagccaucuccccacacuucacugacugagccaucuccccagcacuucacugacugagccaucuccucacacuucacugacugagccaucuccucacacuucacggacugagccaucuccccagcacuucauugacugagccaucuccccacacuucauugacugagccuucuucccacacuucacugagccaucuccucacacuucacggacugagccaucuccccagcacuucacugacugagccaucuccccagcacuucacugacugagccaucuccucacacuucacugacugagccaucucucacacuucacugacugagccaucuccccagcacuucauugacugagccaucuacucacacuucacugacugagccaucucccacacuucacugacugagccaucuccccacacuucacuggcugagccaucuccucacacuucacugacugagccaucuccccacacuucacugacugagccuucuucccacacuucacugagccaucuccucacacuucacggacugagccaucuccucagcacuucauugacugagccaucucccacacuucacugacugagccaucuccccacacuucacugacugagccaucuccccagcacuucacugacugagccaucuccccacacuucacugagccaucuccucacacuucacugacugagccaucuccucacacuucacggacugagccaucuccccagcacuucauugacugagccaucuccucacacuucacugacugagccaucucccacacuucacugacugagccaucuccucacacuuuacugacugagccaucuccucacacuucacugacugagccaucuccucacacuucacugacugagccaucucccaacacuucacuaacugagccaucuccccacacuucacugacugagccaucuccccagcacuucacugacugagccaucuccccacacuucacugacugagccuucuucccacacuucacugagccaucuccucacacuucacggacugagccaucuccucagcacuucauugacugagccaucucccacacuucacugcugagccaucucccacacuucacugacugagccaucucccacacuucacugacugagccauccccucacacuucacuggcugagccaucucccacacuucacugacugagccaucucccacacuucacugacugagccaucuccucacacuucacugacugagccaucuccucacacuucacugacugagccaucuccucacacuucacugacugagccaucuccccacacuucacuaacugagccaucucccaacacuucacugagugagccaucuccccacacuucacugacugagccaucuccccagcacuucacugacugagccaucuccccacacuucacugacugagccaucuccucacacuuuacugacugagccaucuccucacacuuuacugacugagccaucuccucacacuucacugauugagccaucucuccagcccaccuuuauuauuuuagccuuaaaugaaccacucuaugccaaacuugaauugaaacuguaugccaaauuugaauugaaacacauuauccugagauaaaaaaaaaaaaaaaaaaaaaaaaaaaaacaaccaaaaaccaaaaaccuaaguuucuuaaaugacuaaucccuuccagguuuauuuuauuucaaugagauguccuauaaaguccagccaucaugaaauaguguguguuauacacaaaggugaaguucagugagccaccucgauugccugccugccugccuuccuuccuuccuuccuuccuuucuccuuuccuuccuuccuuccuuccuuccuuccuuccuuccuuccuuccuuccuuccuuccuucguuccuucccuccuuucuuccuucuucccucccucccuuucucccucccucucuuccucccucccuuuguuuuuuaaaagauuuauuuauuuauuuuauguauauguauaccauugcucucuucagacacaccagaagagggcaucaaaucccauuacagaugguugugagucaccauguaguuacugggaauugaacccagcaccucuggaagaacagucugugcucuuaacugcugagccaucucuucagcccucuuucuuuuuguuucucuuuuuuccucucucucucucucucucucucucucucucucucucucucucucucucucuuucucucucucucuuucuuucuucuuuugugaauaagcuuauguauaugcauguuugcaugugugggggcacauguguaugugcagguaugcacauacaugugcauguguauguggaagccugagguugggaucaggaaucugccuugauuagucuucaaccuuauucuuugaggcaggagcucacaaucaaaaccagagcucacugcuacagccagccagcuugcucugggggaggaggguccccugucuugucuuuccaaagcuggaccuguguguccauggccaccuggcacuuaugugaguucuagggcucugaccuguggccuucuugcuugcagagccagcauuuuccccacugagccauccauccccauagucugucccuuaaugacguucuagaggaguaagaaaaguccacaucuaaaugcagcacaugcuaugaaaacagagcucuugaacaguuucuccuguccuucauguuaccacacugcccaguuuccagaagaaugcuaacauuccagcugcuuccgauguccacugcuaacuacagaucccucccauagcuccagagucccagcuaagcaaauagcccuuuccucugugacucuucccagacccacaggagcaaggcugaguccccagcccagcagaauguugucuguugcccaaauaugaagaaccgucuuggaggauggucacgugaugaagucugucaaccuauguccaugaccuucaccauaucuuuaguuuuucauccuuucucacuaguggcaucuccuugaccucugagcacacaagugagcagcacacaccaugcacacguguauccucuguaucaauucugaauuuucaguugacucaucccaagggccugccugcccccagcuaaggaugcaguaaccaguggguguucaaauggcuguaaauugagggugugucagacaccacuaugaugaauucugacagggccuuuauagagacagugucuuccucaaggaauggauuagaauucuuuuuaaaaaauuuuaaaacuuuuuauuuauguuuugugaauuuuauaucaugcagcccagucucgauuuucucccuaucccuucauaucccccuuuugccucugcaacacccccuaguaagacacacaugcaugugcguguguccacacacacacacacacacacacaccaccaccaccaccaccaacaacaacaauaaccaaaaauaaugaagcauagcaaacaucucaucgcggaggcuguagugugucacggugcauccacaguaucuuccucuguccacacaucuucacuugcagauguucauuguaaugagccauuggucugguucgaggccucuggcuucugugacgccaucaacauugauccucaccuggccuccucugguuuaucccguuguugcccugugucauggagauccugcagcuuuggcucagcagcacuggcccuuucacacaucccaaccaucugcagaugauaaagauuugggaugggccagcucaagccauggaucugggucugcgugguagcugagcuggcuagcaugcuagcuuucccuuaucugcaucaccacagcaagcucuccagcacugcucaggcuaggccaccugaugcugccacugguaggaggcagggucagcucuccuguucucgugcucuuggggccugcucaccacacccacauuuccagggccagcuccuuugugcugcugucaaggugcagggcugggggcuuauucucaggugcuucagaaaggaggggacugucugucacagauccaccguuccuuaccuuaaaaacagaggccagauaugcuguagaauuagaaagugggcauuagcaccccaagauauagucaccucauauaaucuccccaguaagaucugaggccaugucugauguaugacauguuaacauuugcaugucagagaaugggaaagaacugagagcaggguguuuuaggucggcuggaagucucaggcaguauagcuuuugguugucaaagcuuuuagaauuuuggaacuucaguaaggaauuauaccuaaaccgugauccuauuuacugagugcuuguauugggccaggcacggcacugagcagacauuuuacugccauaaauucauugguaagaauuaucacuaucucccacaacauugauuucuacuuauucauucuuuaaaaaacaaaaaaacaaaaaacaaaacaaaacaagagccugcaaggacaaggaacaaaacuuagguauaguaccaccugaagcuucuuccagugggagccagcaggacacgcaacuauagagcugacauucuauaagggacaggaccucugcccugccuggguaucagggacagcuucuauccuuuggccucccaggaaguaacaacugcagagguugcccuugguuggugaagcccauguuguggugagaaguuccauaacacaguccugucuuuccucuuuuacagaacucccaucucagcuuucucgcaagacaacauuuaugaaguucagccuccaagaguagacagaaagucuacagagaucuuccaggcccauauccaagcuagccaagguaucaugcagccccuuggcaaagaggacacugccauguaccgggaguacaucagaaaccgcuacuuauagagacggccucgaggacaguguccucugugagaaggcgugccccagauccugagaugcagcucauugguaaaggacuccccagcaccuguaucacagccuucggugauuccagcuaccaggaauccaguguugucuuccagauuuuguaggcaccuauacucaaguaggugccugugugugcacacacaugcacaggagugcauacacacacauguaugcacacacacaguaaaaauaauaaaaguaaaaucuuuaaaaaucaauucauccaaaucauguaucugaaacuuuucaccucuuuguaccaugcaaaugacuaauugcagguaauaaagaaaugcugccucuuuug

SEQ ID NO: 5479 - RNA, 12239 nt, Mus musculus
cagagagacagacagacagacagacagaccuucuggaguccugaagcucuguggcucuaaggugggucuuuaacuagcagcaaggaaagcuggaaaucagcagguuuuuaagagcugaggaacucguucugugauccuuuuaaaaggcagccuucacagccuuuaaauuuguugcucauagagccacacaacccuguuuggcuacaacugaaagucucugggggaaccugggucuuuguaaacaagacacaguaaguugcuguaguccaucugcuaauaaaagggagaggcaugauccugaaagccggaagcccaucucuacugggcuuuuuagaacauuuuuuacacuguguguuuaaguauggguguguaugacauucugcaaauuuguuccaagcaaaaugaugucacucucaggaacacaagugggcccagcucaaaggcuuccuggcuuccaaaguguguggccuggcuggauuguuggccucuccuggcagagggcuggcauuuccucuugcuucucucucugccuucuuaucagcugcagcuguguguguuuagagcucaggacuuacuggguaccccaguauaucuggacaaaaugcaaaaugauuuauucaaacacaaacccaaaaagauagccacuggaccuuggcuuuuguuggucccuggaccucaagaagagagauguagccauuuuuuccuagguuaagcacuucugggguagcgauuuuacuuccucaugaugucaaaccuuauuucagucccgugguuuaacagugguagguugggauccagaaaggccuggggcugauagcauccaugccacuggcuggugaacaugugcagucaugaagccucauugacauuucaguaaaauagguuuuguuaaugcucaugcaauaaaugagaacugcuguuuuauuaacuuuaaagcugcuugauuuugaacaauuccuuucaugcuacaauuucuuaacaggaaauacuaagaauuugauuccaaaguucccuagcauugucugagucuugacuuuaguucugcacauugaaguuuuauccucucccacauacccuuaccauccuguuuuucuuaguugaaaacacacacacacacacacaccugguuguguguguaccugguugaaagauguggaccaggacuuuaagcuuugucuuuagccugagccugggagccagccgaccugucccaggagagauggacccccgcaacuggaucgccuguggcgccaggggugugaauuuaucggugggagaggugaagagagcucagacaucuggcgccacucucgguucuugcagcuucaauaaacuucuugccggaggccugcgcccgcucggccagcucuuggaaguggccuacagcguggguaccaccggggcggacucaggcacggucacucaagucucugcucucccugucccugccuggccagaccguuuggaggcccccagcagccccugguguaggcagaaccacgcccuacagcaccacccggcaggcgugggcgggacccaggcuguccccagaggaggacugcggaguacggagguucggaguaagucuuccucugugcucugcgcuggcgcugcgguccaaacucuuuggaacuccccgguuucugccaccaggcaucucuugcuuucccugcgccaccccuuccucugccccuaggccugggacacccuuccgacaggaagcggcucuuccagccccagaaacgcugguaaguaauccagcgaugccugcugugcguccuccugcucgcugggcugggggugaggauaaggaaggggguggggagcgcuuccggggaaaugggguagggagccacgccuggcugguuuggcggguccucuugccggcccuacccagaugagcgccuuugugcagauuuugcugucuagaguauugggagcucucacccccgcugcucaagguccagcucuccaucccuuuagacgcuccaccaauggcacauccuuugugcuuguuuccagucuggguaccucuuuuauuuccuuuagcagaggucgcuccaacccccagucucccacuuccaagagggacuccuguccuuucugaagaucuauccacucuuguccuagugacccccuagggcaaccuuugccuccuccuacuacgcgggcaaugaaggggcugcugggggaugauagaucggcccacaacccccccaccccaccaccuaguugccucucccaccgagagcaacccauccccccauacucuucaucucuuccgguggcagcgugagaaagcccuccaagagcccuuaagcugcgugugggcuggagggaaggaaagggguacaaagagaggccuugucuccagagauuccugggagagcacagaggaacgccgugggagugaggcuaggggucgauuagaugugagggucugcggaagggguugcuaaccccacuccuucccacagcccguuggagcagcgacgcaaucucuucucaggggaaguguuuugaccacagugagucagaaggucugucaugcagacaacagucacaacauucucaggcuauuugugaggguaguuuggguggcugagaaguggaaucuacacaggcaguguugccccuugucaggaggcaagcacguggaaaagaacuuugccuuuggggagaggcacauccuacaaccagcguggcacuaaguucgccaaagggcgcuggcgaacagagacuuaggaagaaaugggugugugucugugaggcagccgcaguugaacugggguguuaguuccugcugucuacaagaagggaaaccuccgcccccaccccaccccuggcagcccgcugagaaacucccccguguccuacuuacagguccuagggaacgcccacuacaauuucuuguccccugggccucggagaucgcauaugaaagcugccaugacacuggucgacaggaggcucccuuagcauccuugugcccaggacuacuguguuuucauuucuaaauuuggcgaauuucacuuuauaagagauagcugcugucucagaaggggucggggguguggaucauggccugggaguggacuggaagcagaaccaaucagagguggacccugagcucccuugugacaacggccugcgcugcuggcuccucccccuuucuuuucccucccuccaaucuugccuucucuuuuuuuucccacagacacuggguuuucucccagcugcuccugcugucaacaggggcccuacauggcaucacccgccuccaccaacccagcacaugaccacuuugagaccuuugugcaggcacagcugugccaggauguacugaguagcuuucaggggcucuguagagcccugggaguggagucuggugggggauugucccaguaccacaagaucaaggcccagcucaacuacuggagugccaagucacugugggccaaguuggacaagagagcgagccagccuguguaccagcaaggccaggccuguaccaacaccaagguagauauguagagucugggaguggugugagcaucaggggagacagaaggagacaggaugcuacauacccccccacccccaccccccaccccggugugugugugugcuugcagugucucgugguaggugccgggccuugcggacuucgggcugcuguggaguuggcacuguuaggugcccgagugguacuuguggaaaagcguaucaaguucucuaggcacaaugugcuccaucucuggcccuucaccauccaugaccuucgggcacuuggggccaagaaguucuacgggcgcuucuguacuggcacccuggaccauaucaguaagaacuucauguuggcccucggguuggugugcccaagucuagagaagggagacugcagggucaggcaaaagccagggugaacaggcgucacuguaaccaggagaccuuuaagaaccggaucugacaucuguaaaacggacagugguuuuucuuauccaaguaguaacccugccugguuucugagcuccaauguuaucagguuuucagaguuguguggucacagaugggcucaguggucucuuagccuccuguagcucugaacagaagcacaguagagcgagagaaggcgugaguccauuccuaacgccgccgccucacuuccaggcauccgacagcuucagcugcuucuacugaagguggccuuacuguuggggguggagauucacuggggcgucaaauucacuggccuccagcccccucccagaaaaggugaguguuucugagaucuccuauccaccaaagagagaacccuacaagaugcuaagggaggucugggugggagucagcugacuccuuccugacagugaagucugggcagcccuagccucaggcagcgagucugagggaaaagcaagguaggcagaguauggccuuccuuaccugccugccuuggcagccaggaggugugaucugauaaacuacuuuccaggguguugaguccuuuacgaauuuauuuuguuucucuagccugaccugggagaguguagggccccucugaccucuacaccuuuguggcucucaugcucucugucucagggaguggcuggcgugcucagcuccagcccaaccccccagcccaacuggccagcuaugaguuugauguccucaucucagcugcaggaggcaaauuugucccugaaggugaguggcccuuuuccucauagauggaugauagcuggaugauaguuagauggaagccagcauccuaggcuccccggagccuuccuagaaguauuaccccaccuuccccccacuacuaggcuucacuauacgagagaugcguggcaaacuggccauuggcaucacagccaacuuugugaaugggcgcacgguggaggagacacaggugccggagaucagugguguagcucgaaucuacaaccaaaaauucuuccagagccugcucaaagccacaggucagggcccacccucaaaaggccuucccuucucuucccuuuacugugggauguuucccacuugccucucagaccugggauggcuccaaggaaccucacuuuuguccauccuugguggucucaacagcaaaagaggaagaacuguccuccagggaccaaguagcugcucgcuuggcaugaaagacccugggacucuuaaaugccuggccuuaaaugccuuugcuuucugcuccuucaugcuggagaguaagaaugauguacauugcaaauguauguucaagaggaugccauguuuacuuuggcuuuauacugcuacuaugugacuaagugauacaggccucccagcugucauuccaccuggcuuccccucuugccucuggggccaggacagauggcccuuugugccagcagcucugugagggacacucagccauggcgugggugcuuaaggaggugauguuugcaguaucacugaagacucaccuccgguccucugcucugccccaccagguauugaucuggagaacauuguauacuacaaagacgagacccacuacuuugugaugacagccaagaagcagugccugcugaggcugggggugcugcgccagguaggcccugugcccaggagggaggagggaggaaggaagagaggaaggaggccgggcugggcacagucuaccccaguuauggacggaccccauccucuccggccuccagcaggcaguagcuccauguaacaagcucuugcucccugaauguagguggcaguaggaauccucgucugggcuaaauuuacagaccugguacuacucuaacuccaggacugagagaguguuuaucucuuuuccucuugcuggcuguuaguucccagggcuuagccugguaccugaugaguaguuacgaaccuacuauggacucacugaauggaugaaauagaugcaugccuuucuuacguguacuaaguacuaugcugaguacuauguacuuguacacuuaguacuauacuaaguacuaugcugagagcuuauaaguacguuauaaguuguguguuguuuguaaaugcugaacaaacggaggcuuugaugagaucaggacaaaaucuaugacagcaaugacauugggcuuccuggaagagcagggcuugagauccuccgaaguagggugagaauugaggagggaauuugaauaugagaaucaggcugcuagaauucuaugcccagccuugcuuucgguuguuauguagucuaucuagucagccucucccgguccuaggucaguccucuguaaaagggugaagcugagcgugugacucuccucucagagggcuccucgggcucuuaucuuuccgccgcauaggacuugucagagacugaucagcugcugggcaaagcuaaugugguaccggaggcucugcagcgcuuugccagagcagcggcugacuucgccacacauggcaagcuugggaaacuggaguuugcucaggaugcacgcgggcggccugauguggcggccuucgacuucacaagcaugaugcgggcagagaguuccgcucguguccaagaaaagcauggugcucgccuacugcuggggcuggugggggacugccuaguggaggugagcauaugggucccacaguucaggagggagcgcucuuauugggggcggggcauguugugggaggagcuuaggggcugcuugguggaaggaaaagcugugugggguggaaaagggucuuccccaccgcagauaucagggcuuuggacauacucauuggauucuuauugauuggcuucuauuccuccuacccuguagcccuucuggccucugggcacuggaguagcccgaggcuucuuggcagccuucgaugcagccuggauggugaagcggugggcagagggcgcugggccgcuagagguguuggcugaacggugaggccggggcucagagacuagucaguacugguagggaagacaugauucgggacacgggucaggaagagggggcaggagaugcugaagguagggauggaggcacgggacuacaggaaagcccugcaguugcucaggggugggugcugacagcucccuucgugucugugcacugccuuccaccaccaccaauagcgagagcuuguaccagcuucugucacaaacaucccccgagaauaugcaucgaaauguagcccaguauggguuggacccugccacccgauaccccaaccugaaccuccgggcuguaacccccaaucaggucagacucucuacccuacccucccgcccaucuucccagaucaccucccuuucccaugccaggucuucccuccuuagcugcugucccagcagggggucagcccuaccacagcaggcuccucccugggggcugaagggguaggugguccgcugccuugagacugagaggaagcuaccucagguacaggaccucuaugauaugauggacaaggagcaugcucagaggaagagugacgagccggauuccaggaagacaaccacaggugaacaggcuugcacgggcuagcgaagcaucuucugcaugcagcagggcucuaggguagugguuuguaccccugugcuguguucuacuggcagugcugaguagccacagccgugcucugcagugccagcgcuucugccaaccccuuccugcggccauggguguaaacccagacuaccuguucugugagccucugagcuucgcugcccuucuguuuccccuccccuggcuuuuauggagcaaggguuuagaauggggaaggaggccagcagcaggcgugugggccuugggcacagcauggcucugcuccccuaggguccgcaggcacggaggagcuucugcacuggugccaggagcagacagcuggcuuuccuggaguccaugucacugacuuuucuuccucgugggcugaugggcuagcucugugugcccugguacaccaccuacagccuggccugcugugaguccugccucucucccgggcccagcccucccugucacugcuugguaagaagaugcugggcaggaguuggcagcccagcgagucccagcuccaccugucccuagaguugguaauccagucuggcucugcucagcagcccagcaaggcuuuacagagucuaaugcauccagauagagaagucagaagcuguggaagacugggaguggagugcagggguagagcauacuugcuuagcgugagugaaaccucaguucaguccaacacacacacacacauugcugcuaguugugguguugugcaacuauaaucaaagcacuugagaagcagaagcaggagaaucacuguaaauuugaggccaacccuaacuacauagcaccaguucggcucucccagaacccccacucaucuucccaaaugaacucccuuccccaaccaggccuuccuugcugcuccuggggguuaguccugccacaggagggccugucccuguggguuaaagggcugaggggucagacauguggccaaggagccugugcaaaggaagugaugaguggggaacaaaacaccacacacaaugacauggaggcaggcaaccaccaacagacaaccuucaugcgcucacucaccccuuugcuccuccuguggagucaggcuagugucucaguggcauuucaucugaugccccgcagggaacccucggagcugcagggcaugggagcucuagaagccacuaccugggcacugaggguggcagaacaugagcuaggcaucacaccaguguugucugcacaggcagucauggcuggcagugacccacugggucucauugccuaccucagccacuuccacagugccuucaagaacacgagccacagcucaggugaguuggaggguaggugggcaggaaggggguggagggcagcuauguaaaggccccagugcugacagcuggacucugucugcaggccuugucagccagcccucuggaacccccagugcuauacuuuuccuuggcaaacuccagaggagccuacaacggacccgcgccaaggugagaagacugagcaggguugaggcugaagaagggaugcccagugagguuccagggacgauagagaauacacucugaggagaggggagagcugggcuuagguuaucuucacagucacaggaccuguugugggaccacagggaggugcuggugaccaggaccucccuugcagguaaaugcagacaggguaggagaguccagcacuguuucucugcucuguccuaccuccucugugcccugcccuccguugccggcucuacagguccugcuccugucucccugucuagucuuacucccuacccugccaggcuucccuuucuguacacaucuacuccccugcuacccgagcaucaccuccuuagguagacgaggagacuccgagcacugaggagccgccugucuccgagcccaguaugucuccaaacacuccagagcucucugaacaccaggagguagguccagggcccagccugcaaacacgccugagagggugggaaagggcuacgugagaauguuagaccugggcaguuggcuuuggaucuggcugacccucuguccuggggcucugugcaggcuggggcagaggagcugugugaacucugugggaaacaucuguacauccuagaacgcuucuguguggauggccauuucuuucaccggagcugcuucugcugccauaccugugaggccacauuguggccagguggcuaugggcaacauccaggagaugguaagugggccugggagaugcuacaggggacuuggggcuuucuuggagacaaggggguggggagggagagggagacuggacaauagguagaaacagcccccuccaaagcuuuacguguggaguccuaagaaaucuacuguaagccuccaccuucccucugagugucgagcaguggaccuaaugucuucuacccuucccaggacauuucuacugucuccagcaccuaccccaggaggaccaaaaggaggcugacaacaauggaagucuggagagccagguuaaaacaaaacucugugugaugggaugugggaagaggcagguguccccagaucagugggcuuugcaggcaguaaaugaaugcuguccuccacugaaggacacuugucaccagagcugccugacagugucuacuaggugggguccaugaccuuaccauauggugggcuuuccaggagcucccaacaccaggagacagcaacaugcagccagaccccuccucuccuccugugacgagggucagcccugucccaagccccagccagccugcacgucggcugauccggcucuccaguuuagaacgccuacggcuguccucccugaauaucaucccugacucaggagcggagccuccucccaaacccccaaggagcugcucagacuuggcccgagaaucccugaagagcagcuuugugggcuggggugugccaguccaagcaccacaagguaggugcucuuccuacagaugugcucuucucggaggcuucgggcaggaugggcacuagaauuuuugccacagggauucugggaaauaaaaacagaggucccuggacuuccaacccauaccucccucuccucugcuaaguuccugaagccauagagaaaggggaugaugaggaggaggaagaggaagaagaggaggaggaggaggagccacugccaccuuuggagccagaguuggagcaggugaguagcaggaacccaugaucgaucuaucucaugacucugugugagccuggaggcaucuggcagguauuucacgcccugacuacagaaacaccaagagcaggcacccuccucucuaaugucuucucacagucucacaaguuugccucuaagucuuuaucaggguuaucagaauuuaccacuuuccaucccaguuuuucacccuuccaguuuccuccauucuuaaccaugggccagaccuuauugcugacuggcccaaccuucccacagacucugcugaccuuggccaagaacccaggugccaugacuaaguacccaacguggcgucgaacccucaugcgccgugccaaagaggaggagaugaagagguuuugcaaggcccaggugagccccgggcaagccccaggcaccagaguucugaaagggucaguuaucugagcucagagcacauucagugcucugcuccugagcaguaaaucagugcucugcuccugagcaaucaauccggcguguccugccuuacaacccacaggccauccagcgaagacugaacgagauugaggccacuaugcgggagcuggaggccgaaggcacgaagcuggagcuggccuugaggaaagagaguagugaguaaugucauucgggagugacaugcgagcacacacaccgucucucugugacaugcuagcacauaccaucucucugguucaggagugacaugcuagcacacacugucucucuggcucccgacaacguggucagcccucagcaaaccuggggaccaguggauguguacacagcugacuccaaugauggccuauugucccuggguccugccacccugugaccccucccaucccuuucccaucuucucaggcucuccagaacagcagaagaaacucuggcuggaucagcugcuacggcucauucagaagaagaacagccuagugacugaagaggccgagcucaugaucacguaaggccggggguggggugggggggguggagguagggggguggcgacauggcaugggagccaggucccaucccugugagugcccugccaagcugugcaucugcugucucucguuuccacagggugcaggagcuggaucuggaagagaagcagcggcagcuagaccacgaguugcggggcuacaugaaucgggaaggucugugggcuaccucaugaccuuggauacugaccaaggaacacaguccucuggccagguuccuguggucuaagcuucaucuccuuuuagaaacuaugaagacagaggccgaccugcagucugagaaccagguccuaaggaagcuguuggagguggugaaccagcgggaugcucugauccaauuccaggaggaacggaggcucagagagaugccugcauagaugggagcccagggcuagaagaugaugguuagcugccucccugccccguaagcaagacaccaucacaagggcuguaccuccgccaucuggacugcuuagucagaggcuucguuguuuacaauaaaaggauuaugaccaugaac

SEQ ID NO: 5480 - RNA, 11637 nt, Mus musculus
cuuuugaucaagagacuaauaaacauuuauuuuaaaucaguuugguacacauacauauuaguuuuguaguuuaaggaacucaaauagaaacuucuaaguccagcagugucugcuugugcagcaaguauggcaaagguaaaauaagguauuugauagaacuagauccucaggacaaaucagaugaaaacucugaaaaggcuuuuauauaccuucuggauuaaaaaacccaaaaucauuaauggcucaaaauaccuugcuaaagaaagauggugaagagucagggcagcagugaauucuguggcaagagcuuuuguagagacuugcaaaaugucacuaacuuccuacaauguuagagcagugcucaaaauuucaggagcuucaaauuaaguuacauucuuagaaaacuugcuacauaugcugacauuuauauggggcaaggagucacauggagguaaaugacaaaccaauuuugccaccuuuauaaggaauggaaauucuguguacuuuuaaaagaacuuuagcacucacuuaaaacuaacagcuacagcacugaaauagauuuuugugaggaaccuagaaauuacaauggaaacauaacugugagguaaaccuaucuuuccccaaaaaccuuugaagucagaguuuaaacaaguaaggcacuugaaaacauuagauauauguacaaaugugcaagugaaacaaacuagcuguaccagcaagugacaaagagauagauucauuaguuucacuuuaugaaccagcccacagcaauccgcuguuucguauauaaacccugggaaccaagcgcugaacucuguaaccaaaugaaagccccaaacuugaauggcacaggaaaccaaaagccuauuuccaauuacagccucuagacgugugcagugugucagaggcaagggagaaguaacuccaaaacugaaaacuuagugcuuucagaagcaacugaaguaaaagucugcaugauuauaaugauagcacaugggaacugaaaccaaggaggaagaaaagaaguaaaggcccaaggaagagaaaagccuauucagccaggguaucgucauuggaaaucuagagcaaccucucucaaacccucagauuuuuuaaguuacacaggucacaucuauuagaaaacaaagugauugucucauuuaaagaacuagaaaaugauucuaucuacaacuacuuccuucuugccucauguaaaagccacuuuucaagaaaaccugguaggaauccuuaagguauaauauuuggauacuuuguguacagagagaaagauaaaucaauuuuaugucuaguuuaacagcccuaagaaaaauguuagaugguuugauauaaggaagccuuucagcucuaauuauucuuuagcuucuauuucucagcucuagaaaaaacaaugcuuuuaauuaaauauuaacaguauguuaucuauaagcagauuucugcugcucacaucaacaguuacauucucagaccaagcuuugccucccacagugugaacacauuuuucacgacgucucagucugucuuaaggcacuguucugauuucuuaauacgguacacuuuaugaguaugaacaagaccuguugcagauuaaugucuguguauccuuucuuuaaucuaaaucuggauugcccuguguggcaucuuauuucuaauauauaaaauacaacuugucaagcauaaaaauuuacucuagggauaguuuagugcuaaacaaauuuaaucuauguuugaagugauggcccucaaucugccugacggguggucauuuggcacucuucucaauucuggccaccaaguuacaccuggaacuaggaugagaauaacagccuuuaggauucuaggggacuacauuucaacugcagucagaagcugccuacacaggacagcacucuccaccacuuacagaaguuacauuuggcaugucagaggaaaaaacagucccacagcagcagccaugguaaacaaagacgacagccacacggauucaugcagaauauuuuaaauauuccugaugaacuaaaugguuuaacugacuuuucuucgaggaugaugcuccaaaauauccuguaugcauccuuuggaaagguaaagauccuggaacagcgucuuccaugugggacuucuucaauauuuugguuucagugaguugcacaaguuaacugccaguccacauuaauuuaacaggucuguuuacagaguaugguaauuucguucuuuagauuugcagaacuuauagagaaagaaaauuacagccugcacacccaagacaaggacgaucccuccaaugaagcuggcugcaucaaaggucgacuuccgcucaggcugggagguuggagucagugugguauuuguugucccugcuaugaugauaaacaaagaauccucaguaaguaucaugguauuuauaauucccagaccccccaggcaucaacugugcuccgaguuauauucuauacaggucuuccugagucaugucuucauaacuagaauuuaucuccacuuaaggcagaaugccauccaucauucuguccaggacaugauaaggguaauacugcuacaaaguuucaaauagguaagagcuuuuauggcauauaaacuguccccuugaaaacuuaucaaauacuucuaaaacaugcgauaauuuuguuaaucuacuuugguuaauuguuaaaauaaaugcuuguuaaaacuuuuugguuuuacuagauagacaagguauuuaaaaauugaguugcuguuuuucaaguuaacaacaaaaauaauaaucuauaauuucaaaaaacaaaauaacacauaguuguaaauauauucaauagcauucugcuaguuuauuuugcaucaugagaaagcauuauauagccauaagaaaaacaaauuugaaaacuagaauuccuacaaacaacucauaagaagcuaaaaguaaugucaguuuaaucaaucagaagaccauggaaacuaacguuacuaagggaguaauauguuucaauaggaaacaaaaaggcuaugacuguguucaacauuuaaauaaaguacacuucacuguuaaacuagauccgagucgcugggcguggugacgcacgccuuuaaucccagcacucgggaggcagaggcaggugaauuucugaguucaaggccagccuggucuacaaagugaguuccaggacagccaaggcuauacagagaaacccugucugggggggggggggggacgacacgggacggggacgggacgacaaacuagaucugaaucaucaucaacugcaggcucugaagguuuugguaagcugaccaacuuuaacauuagccaggaguggagcuuaaucagcacugaaguucuaggcacuaaaaacuuuucaaacaaggacaauauuuggacuggccagaugucuuggucuguaagaacauguauuguucuugcagaagacccaagcucaacucccagcacccacaucaggcugcuuauaacugcuuguaauuccagcucuagggacugucccuaaccucagacacaugcacauacacacauggacauguaaauaaauaauacaaacaguuuaaaaaauucacugcaaguauuuuguauccugugugugugugugugugugagagagagagagagagagagagagugagagagagaaagagagagagagagagagagagagagaauaugaaugugaaaacagcggcuucuaugaaacugugaaguagcacaagcaggaagccacaacaaacuuaggguagaagaguccuuggauccaagcaagucuaagaaaacaagucuaagaacaacuuaagaaaaguagaaagugcaaaucuuggcuuuucagauuggucuaauuaaaaacaauaguuuuccuuucaccaaaccuauuaaugguaccaacuccuucugaguaacuuguagucacaagucagauuuagcaucugaguauagaaggguuuuagagaaaacauccuuacuuagucuaaagggccaggccauaacaaacagaaaaggacucccgucgaccauccggagccaagcacugccuugguguucuauguuaaaagcugcuucgguccagaacauccaagaguagaacuggacccugguggcagcucaagaaacacacugcaucccugguaguuuauauagccccgauuaccugaugugacaacugagggaguagguguaggagaggaaggccgaguugugggcuuagcuggaaugaaaacaaaauguauuuaacaaucuuaaauuucuuccuggucuacaaagugaguuccaggacagccaggacuauacagagaaacccugucucgaaaaacaaaacaaaacaaaacaaaacaaaacaaaacaaaacaaaacaaaacgaaccuuaaauuucuaaccucacaauuauccuacauguaguuuuuaauuuuuagagaacagaagccaaauuuaguuaaugauccaauauaaguccuuacauauauucugacacauucagccagcauaaacuugcuuuucuauauauacauguaagacacaaagucugcaagaagacaaagaggaacgagccuauuuagaaagagaauuacagauuucauucuucuaugacaaauuaugucaguguacacaacugaaauagacaagugaguguacuguaggcagguaccaugcuuugcuaaggggcagaguaggaugcuacacuuuggaaugcaaagucagucaaggacaaggaaagcaggcacaguuggguuccaacaaaaccuuacuaauugauuagcaguagcacccaaggcuagcccaauuuggaugauacacucucccacucuguaugaggcaaaaguaccaacuaaacaugaaaugaccucuggaaguaagcacuugauuacgaacaucaacuacuaaauguagacucaaaaauccuuauaccaguucuagaaaaaaauuaaguuuauacaaauuaauauuugccagguguagugguguaugccuuuaaucucagcacacaaguuccagaccauccagggcuauacagugagacaguguuucaaaaagcacagaaaacuuuuaaaauuacaguuuauugugucugugaaucuucggaugggugaacagauggcagaggcacaaguguuuaagucaacuagcagcugguuuguuccuucugucaugugggucucagagauuaaacucaggucaccagacuugguggcaaaugcuuuuaucuucugagccaucuuaccagcccccaaguucuaacauaaaagaaaguucuguucuucaacaguaauuauacaccaacauuaggcuuuaagacaaauguaacuagaguaugcagaacuccccaaaaggcauugcugguacuccaaaguuaacaggacccuagcaggcuaauucucauuggacuguggucaaacuuuuaaguaagaugugauagcccagucaccaaaagcacuugcuguguaaaccugcugacaagguucaaucucuauaccuaugcaaaggaaggggaaaacuggcuccaaggcuguccuauaccuaugcaaaggaaggggaaaacuggcuccaaggcuguccucuuacagccuaccucagcucucuuuucccuaggacagagccccuugaugaucccccuaguuauccaauacuaacuggccaguccugaaaucauauacauacaagaaacacuaaacggacaaggcaaguuguguacacacagacacacccugaaccccaaggaccacaugaccccuaaaggaaguaaugacacaauugcuacauuagaagguaugaucauucuaacacuuuuauuuccuuuuguaguuuagcuuuaaaaaugaaauguuaucaacuucuuuucaaucuuaagauacuaguuuuaugugauguuauggggaaaaauccuauagauuugauauuugguuuucacuauccacucuugaaguuagaugaaaguuaauucuucacaaagaguccauuaagcuguauuugguagugucugcagguuucuguagcauauacauuucuacuauagccgacuucaagccuacuuuggucuuuuacucugcacaggccauaacaacacauuuauuaaaguagaagucuggucaugacaagguuagagaccaucuaagucucuucaacaaggcacacaggggucccucaguuucgcuucugacugucaggugcagcaaacacacugucacugagcacaagauacuuaacauuuaugucacuguccccucucaucuccacucugugaaccacccugcuucgucuggcauugaucuccccauacuucccagggcugccauuucugccccacucaauacacaccaaccuacaaauuuccaacguacagugagugcucucugacuuuacucaccuaucugauagcaacaaaggacuggcuaaguuccucaucucggcuaggucuugccuggaauaaacgguucaccacuacuacucccuuaagacuuucacuguaugagugagauuaacuaauuguccaaccaugaguauaaggagaaaguacagcaccaucuaacaguaaaagggaaaaaacuccaaaacaccuaacucauccauuuucauauagaauacacaugcucaguuauauauguaaaaagacucaagauaaguaauuucuaaaaacauucaggcauacuguuuaguaaugggaacuguguuaugaagcagccacauaaggcaguucaagggcucaacguacuaaguaaaccuguugagagucacuaaaaccaaaauauuuccaagaguuauauauaccaucacaaaggauacacauuuacacugcuacuguggcccacaaauaaauaacaucucuuagcuaguaggcuaucaacaggucuuuaaaaauccacaaggaacaagaaaaaaaucaucuaguauuaccuguagaauugguuggcacuggagugguaggagguauuacugaaaaagaaagacaauaaguuguguaaaguaagcuguaacaacaguucccacucucagaguacaacuuguuuaguuuugcaacauaaacaucauucuuggaugagccagcuccccauacccaacaucaguuuccuuccuuagaaacgaaaucaucacuuuuuguggcaucucacuuccccauaagacauuucuaggcaugcucacagcuaauuagccacacacagcuucuaacaaagaucuacaagauggauacaggccuuacguuuucuuucccuucuuucaggcagggggguggggggaaacaucaauguaaugauuggaacaugaauacccacuuuagacaggaaagguuuaagccauuuuugagaaaugacagaaagacugagucccuuguuugauuuccccauaacuuauagcaacaucagaagaaacaauucaucuggucauggcuacugcuaaucccguacuugggaaguagaggcaggaggaccuggaguucacagugacacagaugauucaaggcaagaaugaacaacaggaggguggagaugaaggagaaggaccaguuguuucaauuaggauuuuucaggguaaagaguaaaagccagaguuccucaaauacaaaagacagaaguuuacuuagcuguaacgcuuaaaaggaaggaaccgaacauuagucaauucaacaaaacaaagcaggaaaugaagacuuacagcugaaucaugaaaccaggaauuaaacuaccauccuuuuuaucaccaggaacaggcuacuggugucuacauguuaacaucgagggcaguaaugacuuuaccacccaugcagccacguucccaaacagcucaagugaaaacuuaccagaacacaagucagugcgguucaccugggaacaauuacuuaaugguucauuugcacaauaggucuuauuugcuaugaaaaagagagacagagagcaauuauucacuuauacuacaccuguggcuuugcuucuacgcuccagaacacgcuaaaacaaaacaaaacaaaacaaaaacaaaaaaacaagcccaauuaggcugguauacuucugcgaccaugacccuagcacucuggaagggauggaugcacaaggaucucaaggucucaagcugaaaccgcuuuagugcauaguaggacuuuuguuuuuuuuaaagacuaaaaaaacaauaaaaacuguuauuccuuucccauugucuuagagacaaauucaaaagucacuugaauauacugaacagacuaaccagcuaaaaucuacaaggguauguagucaaacuguuucaacagagguaguagggagaggguccgcagaagcagucccugaaguuccuacauauugcacaugagcaggagagagcacacccugaaguucuacugcauagcuuaacacacuuguacuacgaaaaagcuaacucccaaccaauagucuaaugaguguucugaacucuaugugcuacuuccaauauucacagaguaaaggaacuuaacacgggacucuuguuuuuacugaaacaaacaaacaaacaaaccaaaaauaugauuucuauaccuccagggaagccaaagccaauccuaacaaaucuuuaauagaagguuuuucagauagagaaagcugcaaguaccuuaccuuaagggaaacagaguaaucuauguuauauuaaaauucuaagagaaaucuuauauuucaacagacuucuaucuagcucacagccuucaaauauugcuaaguuacugaacuuaacucacaaaagcacagaaagcaacucucccuucuuauugcuccuucacagcuaagcauucaacagcucuccacaaggucuacaauuuaucucccaaaacaaaugacuccauuuccaaaggaacuguaauccuucugaggcucugaaaucucucuuccuuuaaaagcuacuaaaucucagcagucgaguuuaugaaaucaaaagggggaggggagagauuuccaaggaaaauguuaagaaacuauggaaguccugaauuuagaaaauaaauacuucacacuaccuuaaauauucuacagaauauucaagaauauagagcuugugaccacaaaguuucuuaccuucuuggcaauguaaccaaaagcagguaauauuauuaguaaagguggcauuaacacaggaaacacagcuguugaagcucgcacagguuucugaggggaaauuaugaaaucaaugaauugacauuucauuaguuugcucuacaucuauuuucaacaguaagcguuagauauaguuuuaaaaauuaauaauucuucaaaauagucaaacuuaauaaacugguauaagacauuucaagcaugguucaggaaauuaauauugacgaccugaguucaaucccccagacgcacaagguggaaggagagaaccaauguugucuucugaccuccauuugcaugcuggggcaggaaguguguucacauacauguacauacacacgaauauuaaacaauuauuuaagccugggguaguguaaucccagcacuucagagggagaagcagaagaucucugaguuccagacagaguggguuccacagcuggugggaguauacaguacuaggaagugacugucagccaauccuucacaagacugaagauacauucauggacucucaagauaaaacaguaaacacuagaacaucaacacagagaagccacugccuccaaacaccagagaaacaaguuuuaauaaagcgcguaagcuugaaaaaauucaacucgaacagaaacaagccaaucucaauagauuuugucuucaucggugauuugacuuccacagucuucucuacaaccuggaaaugcuccuaaaggggccacugucauauaugugcccgacagcaauccaaaccuguggguccugaccccucugggggugugggugaguggaacagcccuuucacaggggccugcuaagaccaucugccuaucauauuuacauuaggauucaaaacaagcaacacaauuaguuacaaaguggcaacaaaacaacuguaugguuggggcuucgggaacacuaaaccaaacaauccagaaauuagaauuuagcaggccagaauggagcuaaguuccuuucuuuucuagaaacuagucgccugcaccauucuccuuugcugaagcccuggaucucaacacguauuuacugcaaacaggacacgaagaaccauucauaaaguacucguucuuaagacacgcuguucacaacaguguagccugauaauggaugcagccuucggaaugcugcagcuaaccccguaauugccagaaaacacaaguuaucuccucugugggcauuucaauuauacaaggcaauuaacuuguauuuccaggcuucucuuaaaacaauaugaagaacccacacauuacaagucugggaggaaauugucaaguagguaggagucaaacaauauuuuacuuuaucacuuuaaccgugauagagauucccagaacuguucuguaauuuacuuuguucauuuaaaaauaucuguuacccuagcauccuucuaacaaaaaaucgggaacuacuuaguuuuauucauauuaaaaaaaaaaaaaaaaaaaaaaaaccaaaacccuagagaaggcacuaggacaagucaaucuuuagguugagaagcgcaguuacuagauuaagagcaauaaccaacuuaaagcacgucguguuuucaccucauuacuucaaauuuaccuucugucucauuugcgucgucacggccuaugccaauuuguacaagccuuaacgaacccuagaguugaacaaaaggcguguuccuugaucggauuucagaaaaacggacagacugaauuucaaccuaacuccacagccuuaaaacacaggcccccgggagaucacaucuugcucuuuauaugucccuagguuucacuucucaucauccgccacaagccucguucuucccuuaccacucaaaucucagauacagccaacaccgcucagcuaagucaacgugaaguuacaggaggcucgcuggugggagggggcaaagggacacccaacucaucucuaaaugucccccaccuaucccgaacuccuucauuagaaacuuccggagaaguuucgaggggaggacaagagucugucccacgagcccaaaguuugcgcaccccgccgaccgcggggcgcgucgccucguccaauuacuccuaacugccaccgcggaagcaagccacgucgccgucccgagcugcggcgcggaguuaccaggcgcuuggggggauggcgccucugagggcaacgcucgcggccuagcucgccugucgccuucgccccccaccccgucgggccgccguccuccggccgggcggccauguugcgcgaguccccaccggcucggcgcgugcggcgggcgcccaccugguagcacggugggcauuugcgucgucgggaccacuuugguggucguggucggcaccucggucacguugggagccaggguggugauguugggcugcgcggccgagacgcagagcacggcgaggcagguggcggcccagagcagucggcgggaggagcccgacauugugucuucagcccaggcguccgggagaaaagcugcggcaaagcaggcuccgucuagcacugcgucccugcggcgccgccccccgagaagcccgccccgcgggagcgcgcgccggucacgug

SEQ ID NO: 5481 - RNA, 2936 nt, Mus musculus
uuuaugucuuuuuuuuuuuuuuuuuaaaucucaguauuauuuaaugagaacgccccacccugccauguacagggugccccgcacucgcuacucacccaccauguuaaggaaaagcaccaggaaguacagaggguccucauggcugcucuccagaguuauaauuuaaagguauuucuccaugguaaaacuacaauaguuacauaccaaggcaauacuacaugcuuuacauagucccaugaaaaagaauucaauugauucuaaucccugaugcaaggcacuucaaagcacccgcauaaaaugcccauguaaacagcagugcagugcaccuuccaaauaacaugacuugugcacaaccugacccagacagaaggaaaaagaaagcccaucacugccacagcuaaaggcauguuaaaauuuccaccaagaaacugcuucccucauuauucacagaacaggcuacauaaccuuugugagauacaaaacccucgugggcauuucauacugccaaaccagcacgcgccaggggugggcaccaagucagagugcucaggagugagagcgcuaggcaucgcugaacacgcacguuuccuagccaccagcccgggcaggcugucuguagcaccauggaaaaugcaugagcagccacaaagguacaaauuccaaucagcucuuucacgaggcucacuuaguccacaguaaucaacaguagugacaauaauuuuuaaaucauugacaaaugauuagcuuucccuagaagagaaguucuguaucaguacaucccauguacacagcaccaguuuaaacaggguuaucaaacaccugcagcagcgcguggcuaacuggaaaguucauuucuuagcgcuuuccaugucgggauaaaaucacaacagugaugaacacugacgggggauucaguaaaacagagggguggcaauuguccagguucuacugccuucucaggaaccacaagaggcagaggccaacggcagggcucaggccccaccagguuucuacuaccaagcaacugccacacacacuacugggagaguaagggggucugcgugugacugcaacccagaggguucugaguccaccuccagcuucgaguccacggagggcggaggguuagucggcuuccaacagagauaggcacaucugccuuucaccagcuugauucuuaguagcaugcccuacuuaggcauuuaaagggauaagggcauauauagguaugcacagugaagaaucaacuauaaauauuccgacuguugcuuuuuuaaaauuacagacugaagugacuccucagagaaaaccaguuucuucauaaaugaaauauaguauauaaaaagcuggaaugauggguaguuaaaauacaaaacucaaguacaaaacacccuauuuuuccuuuccaaacuacacagauucauacaguugacucuaccauauaacugcuccauauauaauuacaccacuagcguaaaggaccauuaacacuaaagccccucaguuagcacacugaggcucuccguccugaggucugcauuagaacugcagcccugagcccgagcugagaggcacccuuccuaagcguggcucucuucuuccugcucucgggucccacaauuauuaaaagaagggaucugcucugcaaacgacugugccauccacugcccauuuggaacaucgccgggggucgcuucuccucucggcuccgcacugugggcuguuagcccauuugaagcaaugccacaagguuccccauuacauggguuuuccccauaggcgccgccguaagcugccucauagccuggaucauacuuuucuuccuuaacagccaucuucuuugcguccucuugcgcaagcugcaggucaaauguauacugcacuuccugaacgucgguguugcguucaaugccuuucagcuggucucucaaguccuucagcuuaauguaguaaugaacuuuguccugggcccggggaaacugagcacaucuggcgcuggacgacggcaugacguagcacagaguuucugugucugggaucuugugggguugaagcccaaauuccaaguucuuaaccuuuacuccaaaaacuucuuuacugaaaauuucauaaauacauuuuccauuaaacaccgcuauucguggcugauauuucugcaguuucugcaccaggaugcgcccuccuucccggaacucuuuacuagacagauccuugcugcccggcgucguccguuccaccauguuggugaauccgaugccguacuugccggguaagguguggucauccaugugauucagcugcaccucacucagccccgacaugaacagacacuuccagaagugauuuccaggcccaggguagugauguccuuuguaagcagccauuaaucccggguuaaugccaaugaucacaauauccagauugaaggucaaaaugucaggaagagucuuggucagaagcucagcuucagagacgccguugaagcgguccacuuuccuuuucacuuuaaacgcgucugugauuuucuccugcuuuuccuuugauuuuguagacuugccggauuucuucgacguagcagguuuuuugggcuccacugguuccuggggcucugcugcucuggguuuccuuuuccuucucuuuggagcuucuggugcagguuccuggacaggagcgucugcgggcaccugcuguucugucacgguugccauguuaggagcuacugcuggcaccugcuguccagucgugacugccauguuaggaacuucugccaucauuuguugaaauggaaaugaauacaaagcuugaacuugcuccagagaauagcacaggaucggggcggccgguggauggacggcgcuggccucggccccucccacgcugcuacaucaccgcggcgaguccccagcgcacuuccgucccccuccgaggaggccggc

SEQ ID NO: 5482 - RNA, 2296 nt, Mus musculus
ucuacaaaugaguguuccauaagcccacuccacugucuuauacaaccaaguguucauuuagcucuguucagaaucauuggaaaaaccacaggcaagagcaggugaauuuuaacugauauuuaguauauaacagcaacuguugacauaaauauaauagaaaccuuugccucuaaggguaaggguccaugauuugcugaagaaugaugccacaguaugcaaaugcaaaagguguuuuacugugcauaaguccagcaugcucuaccaucuacaaagauggagagaccccaaagugagcucacaggccugauuucaagcacaucaggggaauucuauggagggguaagugaccucucucuuaaucuuggcuuuaucucuauggacauuccagaacccuugcuggggggacuggaaacuguuguugaggaagucuggaaacugcugcuggcaaugguccuugccucaggacuagugguggagaagcuucugaguccugcacuugcccaguucuuggaagcggagauguaggccuaguuuccugaacagccagcuugaagccugucauggaaucagccuagcccuucuuauaagaaagucaauacuaaaugugaaaaacuuuguagcuaaauaacauuucaggagauggaucuauuguauugcaauuagcauaauauuugagcugcagagaaacucucauugugaugauuacagccccucuuccauuacgugguccauaaaagccugaagauuuucaagcuacccgauuucugcuuaggauucuguuuagaaaaugccucucgggcccguuggacacgcaaacuuuauaugccccaguacaggguaacgccagggccaaaaagggggaguggguggguaggggagugggggggguggguaugggggacuuuugguauagcauuggaaauguaaaugagcuaaauaccuaauaaaaaauggaaaagaaaaaaaaaaaaaagaaaaugccucucggagcauagcauuuugaaucacaugcuuuuguaaaggcacaguuuuaaagacuuugagacauuaagccuguaagacuuaacagccauugucguuuucccuuuaacuuugcugaugagggggacucuuuuacucaagaacaagcgagccuccacugcugucacuggcuucaacauuccaaagcaccacagcauuaacaaaagauaaagcagauguggcggugcacacuuuaaucccagcacugcucaggcagaggcaggcagaucucugugaguuuaggccagcuugguuugcguggugaauuccaggauagucagccagggccguauagauagacccugucuuggaaagaaaaaaagaaaaaaaaagcaaaaacaaaaguaccuuaaaacuacaccugggcuuugcucuagucuguugugcucauagauauucaugaaugcuggguauguuuuuauaauggauuucuaguauauaauagaagcguguugcccugcuaauuaagguugaaguguaccauugucaggacaaugcucagcacaauacggcagggauuccccaucucugaccuugucuggggaguuauaaaacaccucucugccucuaccugcagaaugucccauagccuagaguaagauuacagguucagcuuccuuucuccugauaagaaccuguuuagcuagaaccugagacuccugaagugcuuccccaugcuacugaggcauuucugcaccuuaagccuucagccaaugaccuuugcccauccuggauauucugacucuaguccuguguccuuuugucauagaugggcuuguguuugcuguaguuuuauaucaagagagcuaccaguauauauuguuuggggucuaguuccuuuugagauuugccuguuguacacauaguuugucuguuuaauugcagaauaguauuucauugugcagucccccaugcuucuccuuuggauugccuccagguuggggguguuacaacugaagcuuagaaaguuguuuguuuugcuucuucauuuaugaaacugcuacaauaugggcugaguuuuaaaaauucuuacuuuuccuuuuccuuacuuccugucaaucucucuguuauuucauuuuuugugaguggggucuggggauugaaccugggccucugcauguuaggaaaacacuuuaccacugagacagcccccaguccccgcuauauuuuuaugcaccuucuccagcagcguuugcaguuggugaaaacugugggaauacuuaauuuuaaacccauuuuuugcauuucauccuuguauaggucuggacuauaguaa

SEQ ID NO: 5483 - RNA, 71032 nt, Mus musculus
uguggaggagacggccggggagggaacagccgcguggggcgggaacuagcuccucucgcgagaguuggcgacggccgcggcggcggcggcggcguguccgugagagcggcgugggggcggggaggagagcggcggcggcggcggcggcggcggcgguagcggcguccgagcuacgccacacggggccggggcgcugggagccgggagccggagcgcagcgcggggucguggcgacggcggugaggggagcgcggcggaggaggcggagccauggcgggccagcaguuccaguacgaugacagcgggaacaccuucuucuacuuccucaccuccuucguggggcucaucgugauccccgccaccuacuaccucuggccgcgagaccagaacgcgggugagucccgucggcggcccgcucuggcgcgcucgggcggacgcuccgcuccgcucuucuccgcuccgcuccgggccgcgccguccugcccgccggugcugcuccgcgucccagggacgccgccugggcggcggggccugagggccgcuguccacggggccggagcucggcggcgauuuccggggcuguccgcccgccugcgugguccgcgggaguuuggcggggauccgauccgcauuguucuggacgccccucgccugccgccucuuugucuccccagccucggcuuuguuggguguucuuucuggagggagcgggcugggcugggacggggggcgagagaagaguuggccgagggggaauaagagcgugugggcacaacuccgcauccuucgcucccgucacccuuucucccucuugucccgguguccccgcugcagcuguugguacagauguuugggggcaccccuaagcugggugucauguuugggacuuccaagugagcucaccagcagcccaccccgucacuuccuccgguugcuuuuuucauuuguucaaucacaucguggggguuggagagcgcugccguuauuccuuuuauaaaagcacaaauaggauuuucuccguuuccuuuccucuggaguuuccuguuuacaacggaaaagugcaggcaugaaggauuaagcgggauucguugauggaaggagguaguugguggggucgcaagcuccuuugcuuuuaguucucgagucuuuccacauuaaaggucgcgucagaacgcaacccagugcaguuuccggggauguuagguuuaagauuguaauguuggauucuguguugcacuuuacuaagacauauggcaccgguuauucuuaaagcugauggcacuuacagcaagcgccuaauggguuauuucugguggugguaaccauaauuaguagguuucgaguauaacagcggcucugggggagagcguucugugucugcuaaguugcuuuuagguuggguguggugaugaucuaaguugucuagguugugcacugcagcuugggaagaauuguuagcagugaagcucaggacuuguuacacuuugaagagagaguucaauguccuauaaaauuaucuaguuucauaauagaacucaaguaaauuuaagauaaagagcaagcaacacuugcaucucuuuuguacauuucacaauaagcggaguagcaacaauuuacccaaaguuacuagccuccgucguuucucauucuggguugcuuuaugaaauuuucacuucggacucuugaguucuguguuuccaaguuuguuuagauauauauauauauauuuuuaaaucaguggcuguauguacuuuuggugucauaauacagaaaauguuuuuuuuuuuuccuugacugcucgcccacuuaagccaauuuuuucaguauuuuaaguuaaaugcccagugugauggcucacaaauauuauuccaggccuuugagagguggaggcaggaugauuaauaagaguucaaggccacugacauaggcugcauagugaguucaaagucagucuggcaaccugagagauguccucucagaaauaggccggcaagauggcccagcagguaaagggcccuggcgcuuaccuggcaacuugauucagcuccuuggaacuacagguugaaaggaaaaacugacucuuaaguaguccucugacgaccucagaggacuacauccacucccauacuuagugauuaaauaaaaagaaaaaaagaaacaaaagcaacaaggagggagggcccacuuuucaguagucauuuguucacugcuuuuagaagauaaagggguguugggaugguggguugaauauaaggucuucuuuaaaagguggugaggaacuugguaugggacggcacauuucuuuaaucucaguacuugggagacacaggcaggcaaaacugaguuuagagucuuugccauauuugauauggcaacugaacuuauuuugugaacauuauuaguggaaucuuuuugucuugguuuuaauguuuugaguggggcuaaguauacuuaauucauacuccuuuuaauagcaaaagguccucugggcucuuugcauauuggcugauaaacuggaucuauagaaugacaugaaggguauagauuuccuuauaagagugauucucaggagaggcuacacgguaaaggaacucaggaacucagggagcucguauguauauacgguacuuuccguacuuuguaacaaaaggucuaaauuguaacuaaacuugagagggcugcccugagaacuuucuuggaauuggcuuuugcuggaguuaguuggguaguacauuuguuuuggugugagcuuuuugcuaaaaaacaaaacaaacaaccccccccaaccaaacuaccccucccaaaccaaaaccaacagaaaaccagaaauuaggaccagagaguuggcuuaguggguuaaaagcauuuccccuauaaaccugaccaucugaguuugauccuggacccuuuugggagaaccaaaacuagaaacuuguccucuaaccucacacauagauacuggucuacauggauauuaccaucauagaauaaaaacaagaauuaaugcccuaaccuuuuugauuuccauagcuuaaagaaucacuuauagagcagugcuuaaagcucugguaguugaaaguaauacuuugugucaagacaacucagauuuugauuuugauuuauguguaugaguguuuugccuacuugucuguagguguaccaugugagugccuggugccugaggagacagaagaugguaucagauccucaggaagucaagauagaguuauguaugguugugagccacucugugggugcuggaaacagagucccagguccucugugggagcagaaagugcucccuaauuuauaaaccaucucuccauucccaaagacaaguuuaaaugcaguuuauaagcaguauauuguaguuauccauucauagauuccaaaguaguuacugugaucugagucuuuaguauuuuagacauucuuaaaauucugaaauaguugcaguucccucagccacuuccuacacauauacaguucccaccaauacuguacugugacuuuguaugugcauugccauuuuauucuuucuguaagccuacauuucugguuugauuuaguuuggccucccaaaugcugugaucaaaggcaugugccaccaccuaugcacagccuauuuauuuauaccuuaaaaaauaacguuugaauggugugugugugugggggaguguguguggugggggaaggguaguacgaauaugugagggugcguuccuguggaguccaguacaagguuucagauuccccuacagcaggaauuaucuaccagguaguggugaccugucugguaugggugauaggaaccaaacagagauuuucuggaaaagugagcacaaaugcucuuuuuuguuuuguuuuuguuuguuuguuuguuuguuuugagguaggauuucuuuguguaguccuugcuguccuagaacuuaauuuauaggccaggcuacaaacuuugcagaaaucugccuacuagucuaaugagcacugggguuaaaggugugugccaccaccacccagccugggugcaaauacucuuaaucugugugugccaucuuucagaugucuguuuaguuucagauucccugaccuuuuucaaaacugccugauuuugaaaccuggccuggcagguuacuguguggauuuuguauuucagcaugguccucuguaaauuagggauagagaagucucuuuuuauagaguuagaauggagauuaaacugggcuuuaugguaaguguugagaacaguguuugacgugcagugauacuguuaucacacaguuuugauuuauuacuuagguacucaaguuuuuuuauuguuugaaagguuagugaaauguuuuaaaauguuacuuguuuucucaacuagcauauaagucaaucaccuuuuauuugaggaugugaguaguuccauuuauauccuuuaguacuauaauaggaaaaucccaguuuaaaaagguuucagaucuagccuagucucuauuuuaguuaacucugaacuucaagcuuccucuccuagggguuaaaauaauagcuugccauaaggaaucaagaacugggugcuggggacauggguaagagcacugacugcucuuccgaaguuccugaguucaaaucccagcaaccacaugguggcucacagccauccguaaugagaucauccucuucuggugagucugaagacagcuacgguguacuuauguauaauaauaaauaaaucuuugggcuggaucgagcagggacugagcgagcagaguugaccagagcaaguagagguccuaaaaauucaauucccaacagccacaugaagacucacaaccaucuguacagcuacaguguacucauauacauaaaauaaaauaaauaaaucuuaaaaaaaaaaagacccucuuaaaaaaggaaucaggaacugguuaugaggcuggcuuguggugcacaccuguaaagccagcauuugggauggaggcugagguaaaaggauugugagauugcaggucauucugggcuauuaaaugagacguuaucucaaaaacagaaaaccucgaaccaaccaggucucccaagguguuuagaggagggggaaaaaaaggguauguguaaauaugccugcaaaacuacaauagaaguucuuccauuuggcaaauaauguuuucaguuuuuuuuuuuguuuuguuuuuuuuguuuuuuuuuuuucuucgagacaggguuucucuguguagcccuggcugucuuggaacucacucaccuuguagaccaggcuggccucgaacucagaaauccaccugccucugccucucaagugcugugauuaaaggcgugugccaccacgcccaacauguuuucaguuuuuguagaugcugcugcuaggugauagauagauuguuuccagucuuaguguuuuuuucuuaagcuguaaauacccagugcagaaaaacacaaaggggcuagagacaucucuacuaguacaagcugcuaagcuugauagcuuagauuccauauuuggagcccacgugguagaaagagagaacugacuccugcagguuauccacaaaagcugcauauucaccaugguuccuacacacacacacaccauuuuuuuuuuuuuuuuuuuuagggauggauguucagcaguucuugcagaggaccacaguucaguucccagagaggguccaacacauucuucuggccucacuguguaccuguaugagugaacaaauaaaugaaugaagacaugaugcuagagaguuuaggauagggagcaggguaugcuagccagggugguucugaaacagguacuggugauacugagagaggcugguggacagcaucagcuuggcuguauucaccucagcaauuuguccucugaguuugagguaugaugccacauaugugccccuucaaaaaaugaaauacaccuuuaaaaacuaaaaagcaugaaggaaugaacagaacaaaagcugaucuuuuuucucuuauagccaugaucuuauuguauuuaaacuaugaauccuuccacugaauauuccugcugugcccccaaaauuuuugguaugugcuguuuucuuuuuuucuuuuuucuuuucuuuuuuuuuuuuuugguuuuucgagacaggguuucucuguguagcccuggcuguccucgaacucacucuguagaccaggcuggccucgaacucagaaaucugccugccucugccucccaagugcugggauuaaaggcgugcgccaccacgccgcccggcuguuuuauuuucauucaucuuuaaagcuuuccaaguucucugauguguuagauucuugauuauaguucuauuaaauuuuacuuuuguugucauuuuacuugucacuuuuuaaaaaugucaucacauguagucacaugaaagauaauuuguggccuaacauacaggccagucccagaaaauacuauguaugggguaacugaauguuucugcuguugguuugugcaugacuggagagaacuuguuuuguuuuguuguuuuuuaaauauugggucucuauuuguuguuagcagcaagcuacuccagaaacaccugaagagugacuugcuccauggacuuggaguaguguccaaggccaaaauuggcaaguuuaucacaguuuaauuugaaguccuccuucaaaagauguaagccuucaaaacaguucaugagauagauccugccaguguagucguauagcugagggagacagauccuaccaguguagucguauugcgagggagacagcuucugccaguguaguuguacagcugagggagacagauucuucuguugcgucuccaucuuccugaauucucugugaggaucauuuuagaaauagucuuacuugggcuguccccacuugccccuccaaggaagaguuauagaacuacagcccuuuucaccucaucuguuuauuagucuuaaggugaggugugcuuaaugcucuuugaauagcacuugaggaaaugugcuaccuauauuagaaaacugagaccucagggaggugagagguauucaacuugccucaagccauuagcuguaagauuggauguuggacccaaauuagucuuauuccaaagcuucucuuuuaguugcuacuuuguacuccuuucuguaauuaaguaaacauugcauguuauaauaauaucaauacagcaaguggaaagugcugaaggagaacggaauuucuguuuuggggcuugggcaaaugcuucaugcaaaggugauuuaagauggaucuugaaaagaaggacauucuuaacuaggggaaacacugcaaaagcaugggugcucuguacauaagugaugaggacuugaaauguaacgggcacuuuggaucaagugagcaguuuggaguugauucuuuguccuauuauugacuugaacaguagagcaaugacaccuggcugguguggguuuugugaaucuaguggagaaugguuuggaaguugggggacccuaaguauaacugagaguccaucucagcuuauuucauugagauguuaggauuuagaaguauaacuagauuuaaaaaauucugagauaguuuggacuguuuauuucuuauauauuuauuuccccuuaacugauuucuguucccuuuaaaguuauuuggugauugcaguuauaguuugggaacugaguguagugaaaaagauugggaugaacauuaaaaaaaagaaaagaaaagaagucaggggcuggagagagauggcucagcgaguaagagcacugacugcucuucugaagguccugaguucaauucccagcaaccacaugguggcucacaaccaucuauaaagagaucugacucccucuucuggagugucugaagacagcuacacuguacucacauauaauaaauaaauaaaucuuuaaaaaaaaaagaaaguuuuacacacacacacacacauacacgguguggggagggcggacaaggacgcucugccuccuccuccuuccgugcucagccuuuagaugccacuuuaaaaauuuccuggauuuagcuaggcugugguggcagagaucucauugguucaaaacugaaacacauggcuuaaagucacaaagagcaugguggugguagugugugccuuuaaucccugcacuugggaggcagaaguaggugggucuccgaguucaagaucagcccaguuuacugagggaguuacaggacaggguugcauagagaaacucuugaaaacaauauuuucugggucuagugagauggcucaacaaguuuuaugauuggaauuugaauucuggaacccauaugcuagaaggugagagcugaguucugcagguuuaucccaacuucacaugcauauuccugugccacccccuuccguaaauacaaauguaaaaaccaaaccgaaacagaccaaaaaaccaaaaaccaaaccaaaacaaaacaagaagcaaaacaccauuucccaucauuacccagacccuuucuuuuggcuuuuuugagacaggguuucucuguauagccccgacuguccugggguucacucuguagaccaggcuggccucgaacucagaaaucaccugccucugccucccaagugcugaaauuaaaggcaugugccaccacugcugggucagacucuaucaaugagaaguguuauaccaugccugccaaggccacacuguuuccuugaaaguucauguucauacucuugaaaaaaaauacuccuuacuguuuguaauuguguuuugucauggaugaaggaauuuugucauauagauuccaaaauuuuuucagcuuuggacuuuugaucauguaguucaaucuaauaguuguugauuaguaguauucacugguugacauucgcagguacagaaaacaauaaaauguugaauacaguaaacauggucuuguuuggguaacuugcaugagguauaguuuuagaugccugaauuaacucuauccagaguacucuaaagagaggguaagaggaaugaaaacaaaugcuguggagguuagcuggauagaguauuagcaucuaguugagguaauaguggcaaacuaaagguuagaaaaguuuugucuuguuuuguuuuguuuguuuguuugguuuugguuuucuuucucuguguagcccuggcuguccuggaacucacuuuguagaccaggcuggccuugaacucagaaaucugccuuccucugccucccaagugcugugauuaaaggugugcgcgaccaccgccuggugguuaggaaaguuuaaaauauuuguauuuguuuuucugaucuauuuuuguguauauguauauugccugcauguauguauauacacuguguaugugcaugcaguuagaagagagcauuguauuuauaggcaagugugugccaugugggucuugguaaucaaaccugggucaacugggagagcagucaguaugcuaacugcugcccccagagaagguuuuaugaaguugguggauuuuguggggcaggauuugauacagguuuucacuauguaucccaggcuggucuugaacuuggcaguccuucugccuuagaauuaagacuggagagauaauccagugauaaagaacacuguuuguucuuccagaggacccauguuugaucucagcacccacaaggcaacuuauaaccaaccauaacuccaguuccagaggaucugauauucacuucuagccucugcagguaucaggaugcaagugguauacagacagacaugcaggcuugaauaauagugauaaaaaaauaguaugaacaaaugugggauguguucaaaagguacaucagauccauugggaccuggcuucaugaagugaaaaaaaugugaaaaacacaacugaagucauaaagccccuuguaucaagcccagcugaagaguuuaugucacuuuugcaccgugugccagucaguagacucuuccauaaugagagcaaacagaaucuaagaagcugaucuaaacagcugugccagacaugcugcuuugaaguacaaccucuccuggcauauaugucucuuacaauccuaggugauuuccucccccccccccccccccccuccggggucaggguuucucuguguagcccuggcuguccuggaacucacucuguagaccaggcuggccuggaacucagaaaucugccugucucugccuccugagugcugggauuaaaggcaugcgcuaccaacgcccggcccuaggugauuuuuauaucugacuuguuucacuugagcuuuaagcuuuuacauuccuguuauuaaaacuaaguuguuuuuaugacagaauaauauuuuaccagaauauucuauauguuguacaucuguugaagaguacaugaaacuguccacucuuagguuacugcaaauagugcagugagcagugguauguaucaggguguuuggacguguuuuuuuuuccccuaacauaauauuuuuauugauuauuugggaauuucacauccuacacucugaucacacucacuuugcaguccucccaggugucccuguaugucuccacucuacaaaaaguccaauuuguguugcuuauauacuuacucaguggagcugccccuuacagcaaaaugaguccuucccucucuccacuccccaccucucccaagccaucauuuggauucuuaugagcacuuucgagaagguuuuuaggaguggaauugcuggucaaaccccguguuuaccuuuuggaggaacugucagacuuguccacaauggcugcaucgcuuuagauucuugccagcaguuuuuacauagcugcacuaaugaaugccucuucccuccucccuuuuguaaucguggcuaucuucauggauuugaagugauauaguuuucccuaauucuuaauaauacugagaggguuuguuuguuuguuuguuuguuuuguuugcuuuuguuuugaguuuuuguuguuguugcuuuuuuguacacucuagccauuuguaugucuauucagauccuaugcccauuuuuuguuuguuuuuuauuuuuguguuaauuuguaagaauuauuuauguauucuuguuagauaaauaauugcaaguauuuugucucauuuucuuuguacuuucuuucuugguaaugaccuuuaaugaaccuuaaacccaaaagcuuuaauuuuguuaaguccaauuuauuuuauuuguuuauauuauuggaauaacacugccaauuucaagguuauacaaauuuaaucauuuuuuucuaagaaauguaauggcuuuaauucuugaaacuuuugaauauuuggaauuaauuuuugguucaaaaucagaugaaaaaugaguucaagguuuucuguuacaacugaccugcauugugccccugagcuucccuggagcccugguucugaacacaguuuugguauauacugccugaaacacugcagcucauucaaaacuccuguaaaugcuguguuguuauaguacauauuuucuguuuuuagaggcccauaaugauuuaguuuuggaaaaaagaguuaauauuucuguuauuccuuggcauguuaaguacaagauuagcauauguuuguauuguauuguuagaauauuuuuaaagaauuuacuauuuuuaugugguauauauaagugcuuauaugcauguguguuugugccuguggaguucagaagagcauuggaucuggaguucuggauaguugugagccaccaugugguuguuggaaacugaauuuguguucucuggaagagugcucuucccugcuaaaccauuuaucuagcccagaauguuugauuuaaaauuuauuuauuuauuuauuuauuuuuuaaaagauuuauuuauuuaucauauguaaguacacuguagcugucuucagacacuccagaagagggcaucagauuucguuacggaugguugugagccaccaugugguugcugggauuugaacuccggaccuucggaagagcagucggcgcucuuaaccacugagccaucucgccagcccccuaaaauuuauucuauuuuauuuagauguauguguguguauauguuucuacagaggccagaagagagugucugaaccucuggagcuagaguuagguguaauugugagcaguuugaaaugagugguaggaauugaacucaggucugcuagaagagcaggcagugcucuuaacuccugagccaucucuccugauccuggaauguuuggcuuuuacaguugcuguguggugaguugacuugaguuucaaucgaaaaaauaaaaccauuaaaugaauuuugguuugggauuaggacaaauuuccaauaauuucugaaauggccuuaaguacuuaguaaauguguaguauguaugcaaaguauaguuaucagccuugaggguuauaaaacucaagguuucaaguaacauugaaaaugcucuauauucuguaguauuaaauauucaaccaagacuaaaaauaaacaagcaaaucuaucuuauuaguaugcaaauguuaaaaacaauauguaugccaagaaguauuuuuaauuuuauaauuuaucaauaaauacuugaccaguguauguacuuauuuuauacacauauguccaggguuguguaaaaauuuaucuggaaaggggucaugagccuucccuguguuuaugaauccuuccuuucucaguagaaucuucacuaacuucucugugaagaccacucuucccucacgucccuugcauguuacuguuugcuuugccugcagugcuuuuccucugguaccaccuccucuaucccuauuuucuuugcucaaaugucaucuucacagcaguaucuucuuugagcucccuuugucaaauuuagaugcucugccuacccucaauuuccucugcuguguuuacuuguuuguuguuauuucuuuaauccucuagacuauauaguguguagaguuuugagucucaucccaggagaacccccagcucuucuaacuaauggaggaugaccauaaacuugucauucuaacucgaucucccauugaucuuccuguauaugucucagaaaugcuguuacagacaagugccaucaugccugguuuauuauacuguacuaaguuuggaacuuauggccucacaugcugggcaaacauccuaccagcugaacuauaugucuggaccaagaauguuuuuguuguaucuuuuguguccuaaaggguccugguacauaguagauguucucucuaagcacuauuuuaaaagaguuuaucauuuuuuacauauuuauauaguacuuaauauacuccaggcagacagaagagacauuuauaauuaauggguaagauaaauuuucagccuucaacagccuugaguauagaagaguuaaaauuggcuuuaauauuggcugcuuaagaguggugguuccgggcuggugagauggcucaguggguaagagcaccugacugcucuuccgaagguccggaguucaaaucccagcaaccacaugguggcucacaaccaucuguaacgagaucugacuccuucuuuuggagugucugaagacagcuacaguguacuuacauauaauaaauaaauaaaucuuaaaaaaaaagaaaaaagaguggugguuccugccagucuguggugguacacgcuuuuaauccuagcacuugggaagcagagacagguggaucuuagggaggccagcuuggacaacauacaguuucagggcaucuagggugcuggugaaacccuaucugcaaauaaacagaucagcuaauuauauaaaaugaaaauaguuguggaguggugguucugggaguuggagaugauuuuacagcuaaguaugcuuacugcuuuuguucaaguuugguuccuagcaccacauccagcaaguagcucacagccaccuauauccagcugaugcccuuuccuggcuucuuuggguucauguacauaccuacacauaaacacaaaaauaaaguccuuuaaaaaaauagugguucaugcauguuuuguuguuauuccuuuauuauuugucauacaguauaacacaauuuuccuuuguguguuuguuugucuuuuuaugucagggucucauauaacccgggcuaaguguuuuggaggcugaaaaccaaacagcauagugcugacugauaagagcucuaugguaguucucugaguguucguagaggaaggaucacaucuuggaacuagaagccagagugauacaggugccaccaucucuuccuaagccaugccccuagugguuuaaggaucucucagcaggcucuccucuuagaucucauaucacuucccaguauugaugcucagaagaucaaguuuugauacucuugccaaacuuaauuuaguauuuugccuuuucacucuucagcacaaaaucgguuuacuauuuuauucuaguacuuuuuuuuuuuuuuguaaacuuuguuucaccugacuuuuuuuuagagauagcauauaaucagcuguuuuaaauuccuuuuuguuccuggauuuuauuuaugaauucauacaaaauacuauagacuaaugcaucuuaauucucuuccuccccuuagucuugguuaaucggaaagucacauaucuaauagcucuuuuuguuauuggcaacaauaugaaacuagucuuaauucuuuuucaaguuuuuuuuuuuuuggugcauacuuuuuggacaaaguuaucucagaagugacaguaaucuugcucuguuugauggucacaaacccuccaucgagauuucuagcuuuucuguccaucuugaugcuuuccuggaggaaugaacuaacuguucaaaauuggcaacauccacagcauuuacaacagaauguacuuacaugcuuaaugcuauagacuucauugaaagucuaaaugaaaauuauauacuuaacaaauacuaaauaccaaacuguuaguagaauagaggagugaacaauacagacauccuuguacugaugguuacuuccugggaguuuugagggaguaauuggcauuuuacauauaaaccauuaaauugcccuauaacaaguguuguguauuaguguucucugaaggccauccugaagcauucucaaugguugagaaauugaaugucaaagaggagccuaaucauuuacuguucuauguuggcuugagaaaauccuauuuuaggcugagggaacaauuguguaugaaagcuuuugagacagaaaaguguuugacauguucuaagaaaaaagauuaaaguggcagagcuguggcagaugaggaaaauagucugggauuaagagucagagagcugcucucguucacagaugugucuauaagaagcuuggauuucaucuuaagagcaauagggagcuauugaagaguuuuaggaagugaagccauaggaggucagauuugcaauuucuuuuuauuaaacacaaggauuuuuuaaaaaguuauuuacucaacuuuuaugugucuguguuaguguauaucacauaugugugggugccuuuggaggucagagguuggcuuugguuccccuccagauggaguuauaggugguuaugagcugcuuaccuucaagggcuagaaacaaacuuggguccucuuggaagagcaguaaguacacugcuuugucuagcccugauuuucuguuucuuaauaagaugggaaaaaaaguucugauaagcuugauugcccuuuuauggauaaagucguauuuucauaaaauguuuaauuuauaaacuugucuauuuaaaaccauacacuauaaaguauauuacauuaaaauacauuuuuguuccuuuacauuuuaagaaacaguuaccaguuuuagauuuauuucgugaguguuuuugcuuuaugcaugcaugucuggugcuaauggagacccaaaagaggguguuggauccucuggaguuagaguuggguauugagaacugaacccagguccucugcaggagcaguaagagcucuuuaacuacugagccaucuuuuuggccucucaagaaguaauuauuuccaaguucccuguauauucaauguuacugucagcaaagguauuuuuuguuuguauauggguguuuugccugcauguaugcacugcgugugcacuacaugcauguguaguacuggaagagaccagaaaagaagauccgauauuuuggaacugguauuacauacagaugguugcuugcugccauauugauguuagacauugaaccugggucuucuagaagagcaggcagugcucucaauugagccaucucucugacccuagucuuuuuuuuuuuuuaauccaagucuagguuggccucaaacuccuagguuuaagugaucauugugucugagucuccugcuuaguugggguucuaggcaaauagcccagugccugucucauuaaagcuauuuugagucaccuaacaguuuuuuuuuagaaaacucuuuuauucagacauguuggcacauaacuauagcucacuuuauagaccagacugaccuggaacucacagagaucugccugccucugccuccagaguacugagauuaaaggcaugugcuaccaugccuggcucaaaugauuucauuuguauuagggauguagugcuuuuggguuugaaugugaucuuagaaauuuuccuauaagugcuaaauacaacauauuacauuaaguauauguacuaaaaccacacacugcauuuuuuaaagauuuuuauuuuauguguagcuuauguguuaugugugugcacauguaugugcacauguguuugggggccuccaggaaaagguauuaggucuccuggagcuggaaugacagguccuugugaacacucuguuguagguacugggaacugaucucaggucugcgguaagagcagcagaugcucuuaacugaugagucgucucuccugcuccagccaugguauuuuuaaagugguuuuuaaacaaaauuugcuuacaguggcaaccaauacuuccaguugagaauauaccccuagggauaauuaugucuuuuauugauuugccuuuagaugacaugcaaaaaauggcagacaaacauuaacuaagaucauucugaguuuuuucacaggucuuuuguuguugauguuuggcuuuuuaaauguuuuaaaauaaaauucucauuguaucuaaaggauacuuuuagaugauuguuguagaaaaacuugcuuguuuguuauauugaucacuucuauugcugaaaugaaacacugugcucaagauaauuuauagaaggaaggguuuauuuggcguaugguuccagaggaauaagagucuguuuguuggggaagcaugggaacaagcagcaggcuagagcaaaaggcugagccuuuaccucuucaacuccaaguucaagaagcgagaguaaacuccacaauggugugagagucuuuagauuuucauagccuacuuccagugacauaccuccuccaacaaggccacaccuucuaaaccucuccaaauagugccaucacuuggggaccaaguaucaagacaucacccauuuuacuuuuuaaucgauuuaaaaaacuguagacaaugaacagguauuguccaagugaguugaaacacugucagcgagaugccgagaggcgucagguaacuagaaaacuaacauucucgaacuucucagaauguugaauauaaucuuuaauucuuauuacuguuuucuggacacuagaagauuuagggaaugcuuaaggacuuacuacuuuagaaaaaaguggcacauuuuugaucuuuuaauuguaauuaaauaaauugcaucuaucauuaucuuauuaagguuaguaacuugaguacagguauguucuaagaauuauuucucuguuuuuauggucuuuaaacuaucaaauuauguacugauauaccuguuuaacugaaaacuuaaaucagaucucuuugagagucuuauuuauuaggugauggcuuuugcuaguuagguuauaaccuauaugauuccuuauauuuaauuuuagaaacuauauuauaaaaaacccuuguaaaugaauaaaaaauauauaucaaaauuaaccagaccaaaaguuuauacaauguagugaauuucuauaguaggcauuugaaauguaaccuguggaguuuuacauuaaguuuuacacuuuaaguaucaaauauauuuuauauacuuauccaccaccaaaccuagcaaauccaggcagaauuagaacuagaaaaacaauuaguuuuguauccucuuucauaacauguaucuguaaagggaaaacuugcuuccuuuucuguaaauguauaauuucuuuaaaaagcaugucuuagggucuggagagauggcucagagauuaagagcacuuauguucuugcagaggacucagggcucaguucccagcauccacaugauugcucauaaccacaugugaccuaauauguaacagucuucuauaauauucauugauugauguaaacauucuuucaaaaguguaaguuacuauuuuuaggguccaagggcauggcuuguaagguauguauuuugcacagcugaagaccaugugcauguucuuuugaccagggacauuaggagaaacuuccuuugauuagauuaagcugucugguucauaucauagacuuuagcauuauuauuauuauuauuauuauuauuauuauuauuauuauuauuauuauacagucuuauaaggggauuuuuagguuuauacuagaaaaugggaguccauugaaacuuagugaaaagcagauuaaaacuuuacaauggcauuacuuuuuaaaguucauuauuuaaccaugaaagccagaaaauuuaacauuacuguaucuuacugucagaccucauugagguuuuaucauuggucucagugaugucuuuuguagcaaaaauucaaguucugaacuauacaugacauuuaguugacauguuucuuuagucuuccuuuuagucuggaauaguucuuuaucuuucccugacuuuaaauauuauaggccaauuauuuaauagaaugaacuuaaauuuggguugucuggugcuuuuccaugauuggauucagauuuuaugugaugagccugucuuuucauugcauuuuugucagauggcauaugauuucaguuugcucuuuuacuggcauuauucauuggucacuuaauauguugucugucagauuuuucuguauuaaauuuuuguugcuguuguaacaguucaucacauacaguggcuuaaaacagcacagauuuaaucuugcauaguuuuggaugcuacaaguacaaugggucuuacuagaaaguaaugauguuccugggggcgaggggaccuugaaguagaauuugcugacuguuuccugcuucuagagacagucuauauuccuugacuuguggccccuugcucaucuucaaaagagcaucagucaaaccuuugguuucuuuuuuucuaucauuuucugucuuuagcugccaugucucucugagaagcacuauuugauuauaguugagccuacuccaauaacuuccccauuuuaagauccuuaauucgcuuaucugaaaauccauuugucauuuuaagauuacuugcuaguuccuugcgugaggauguugccaucuuggacugcuugcuuccacuuuggauaguuacccuuuuccucugugguaauuaauauuuggugggaagguagagagauguuugguuucuggguauugagauuucugguuccaguuguuuagaggccaaacucuguauaccauguucacugcuacugggauuuugcugcuuaguucuacuuaguuuacagagguagagaauacauaggaauuuauagagagagcaguaccuguacaaauauaguacuucauauagguacuuucaauuccagacuaauaguccaggcuuaguauccuaucuuuucauauuugucauuaucuucucugacauggaaaaguagacuuuagcuuuugauauauuaacuuuuuuggucagucuaccugcguauauaaaacuccuucucuguuaccaccucuucuucuauuuggauccuucuucauuacauugauacuccugcuagguaacauguggauacuucuauuacacuauuuaguuaguaauagggcaaugaacuuccuaccugguggcuuuuguuuuuguuuuuguuuuuguuuguguaaggguguuuguuguuguuuuuguuuguuuuguuuuuugagacagagcuucucuauuuagcccugacuguuuaggagcuagcucuguaguccagguugcuggccucagauucacagagaucugccugucuaugucugccuuccccucccaagugcugguauuaaagguguaugcuaccacuucugucuuauaaaaguauuugccugaguauguuuuacaagccacgugugggcaguucccacagaggacugaagaaggugucagcuggaguuacagacaguugugaacugccaugugggugcugggaauuggaagaacagccaguacucuuaacccugagucaucacucuaacccccucccccccauugguauuuuaagaauucaaaaauaugcgagagauauaugugauucauauccaugccuugguauacacguggacauuaggagaaccugccagagauacuucucuacuucuaccauauggauaccagggauggaacagguuggcauuguugguggucagugccuuuacccagugaaugccucacuggcccugugugccaaauugcuuuacuuacuugguaucucauguaaagaguucaguuuuguauauauuuuaaaaauaugguaaacagcaacaacaccaccccuagaaaacaaaacaaaaaacagaauuagcccagcuacacgauccuaccuuuguugggaacauuccaggcaucauagcuaggagcuguggaauuuuuaagcauguacuuuuuuucccccuaaagaugguuuggcuugcugaccuuagcugcacuucauucauagagcuucuucccagcccguucgaaugcugcagcuaugcccacagcuauguccacagcuauguccacagcuaugcccacagcuaugcccacagcuaugcucugcacugcugagccaucuuuccagcccuguggacuuuuuuuuuuuuuuuuuuuuuaaaucuagggaggaauuauuuaauacaagauuaguaaaacagagcaugacauuuuuaggauugguuaaaauuuuuaauugaauugcaguuuuucuuuuuuuuuuuuaauuagguauuuuccucguuuacauuuucaaugcuaucccaaagaucccccauacccacccccccaauccccuacccacccacucccccuuuuuggcccuggcguuccccuguacuggggcauauaaaguuugcaaguccaaugggccucucuuugaauugcaguuuuucauagugaugaaaauaacuuuugucacaacucuuacacaaaucugucuuaaguucuuacagauugggccuacuuccccaauaaaacaaaauaauuaaaacuugugauacugaauuuuacuguccaauaggacuuuggcugucaguugauuuucacauuaaaacuauaaguucuguuaguuuuauauuuucaguagauacaauucugaaccuucuugguuaaaauauaucuuaccagguaauuauuucuauacuugaagaauguuguuuuauccuugguuccuaaauaaccauauuuuaacuacuuuauacuuuuuguucaguacaaggagagaauaggagugaaaugcucagacaacugauuauaugaccaagacauucuauguuuaaauuaguuucuaaaguuucagagaaguuucacgugaaaaaauacuuguuuuuuaguuaaaaauuucuagguauuacuuguuuuacagacaacuuagcauaguuuaugaauuuuuauagggauuauauaaauaggcagggcauauguuucgacaagaaguuaggguaauaaugaagguuaguaugauauuaacucugguucagcuuucauuguaaaaaauaauuuaacucgucuuuucucucuugacagagcaaauucgauuaaagaauaucagaaaaguauauggaagauguaugugguaucguuuacgguuauuaaaaccccagccaaauauuauuccuacaguaaaguaaguaauggauuucaauaacaacacauacugaguacuuauucuuuucuagguuucauagggaauuggaggauggcuuacauguguggcuguaaagaaauuguggccugugagagaggugagguuugaauaguaagcuugagagcugugaauagauuagaagucaaaugaaaagguauguagucagcucuuaucugaagacuguaugccauguguuagaauuggaguuuuauguugaggucuauauggaaauaaagauuuuagcaugaucagaugugcauuucaagggauaacugaaguuuauuagcacauguguuuccaggugcuuacgauguuuauuugauucuguauuuaccuucagggugugaugguuuuccuuaggcugaggcuaagaagugaacugauguggccaagaucaugcaguaaacagugguggagcagagccuccuccccuuuauuuuggcagguuauuugcuuagagcagucacugggauguguuuaacucugugaggcuuuacaucaagucuggaauucagagucaccagauuaucuaggacagaaacuggaaguugcuacugcugaagagugucugguaaauuacuggucuaccugcucaaaagagagacauguaguaguuucaaguaugauuuuaaaugaugaggauuauuuuaaauacaguuguguuacuucagggguuugaaauaagaugauuuuuuuugaggguuuuugcauagagagagaaucuuagcuuugguggucuuacucagugauguaaagcuaaaggcaaaguuagcuuugagaccaauagcacuuuuugcucacuuuuaauugcuguucauuuucauuuuaaguuaagauuuuacacacacacacacacacacacacacacacacacacuuuuugagauagguccucaccauguagcccugacuggccugaaacuaauagaucagacaggccucaaacucuuaggaguccaucugcugcugucuucccagcuccugaguggaaguuuggaccacuacuccuagcuuuaggccaaucuuuuuauuucuaagcccccaccuugcuuuugcucaauacuugaggcacuuaaaccuccacucaauuuuuauuuuuguuuuauuuacuguguguauaugauguguaugugggcauacgugugccacucacuaccuuauuguggaggacaaaggacagcuuuguggguuauuucuuuucuucuacaccugucugaggguucugggaauugagcucagguugucaggcuugugaagcaggugccauccugucagccuugaaccucagcuuucaaggaaaaaauguugaaggcauuuucaguaauaaauaaucuuuaauuccaaaugaagauuagggcaugacauuuaaauaaaguuagaaguuaugaaaccuuuugcuauuuuaugcuauauauugcuucuuuucugacaguaucuuugaaacaaagccauguaauuucuggaaguuacuuccaaauuacauuuaaaauauggcuaaaaaacagacaauuuucuaaguuaauuuaccgaaucuaaauguagggaaauauuugucuuuuuggagaaaccauauagucuuuuagaaaauuggacacauagcauaaauaugguuuucuucuuugcuuuggcgcucugaaaauuagaaugugguuuuauggacugggauaguuuuugucagcucgggaucccgccaugagccuucucuucucuucuuggcuuugauaauagaugccaaaugugaagaguuuaauagaguuuagcauaucuggcauauuuuguucuuuuccuuaugugugcuuugccuuuugugguuuuucauuauuaucuuugcuuuaugauguuuguuuugaugacgagucauugugugugaaaaaacauuuucaaguguucuuuaaagauuauugggagcacuaguaaacuucagcuuuauguuuagauuuuucuaauuuaaauuaucuuuauuaauuuuauauguaauuguugugugccuucaugcaucagguauagaagguguugaugcacugugauuaacaacauagauaugguucagagacgugacucuuaggagggauugcaaaaaaacaauuuuaacuuuaguaaauauguuaguucauucuuuucuuuguuacuauaaagaaacaagacuuauuuggccuauuucaguuuuagaggcugaaagccccauucauuuguguccuuggaguagcacuacaacuugguagaugucagaagggccugucugucugucugucuguccauccauccaucuauacauucacacauauauucauacacaugcauacauacauauuugauauuuagaagagggugucauccccuguaacuggaguuacaggcaguugugagccaccugauguaggugcuggaaacucaacuugguccuuuguaagagcaauaugugcucuuaaccacuaagccauuucucugguccccuagaccuuaucucuuaaagauccacuacaucuuuuuguguauggugugcaggugcauguguguucaaaugugaguagguucauaacuacaguuaaacauggauaugucuuuguauggaagccagagguugacaucugguauugauuacucucuaauuuauuuacugagguguagggaguuuuagggguuuuuuguuuuguuuuguuuuguuuuccuguugccaguuacagucaucaagggcagagagaaauauaccuguuuuuucuucuucuaacuagcuuucaucuagauuucuucuguuuuuauguagcucaggacuuucugccuagggaaugguacuugccuacaguaaagcugugucuuccuuugucaguuaauaaucaagaugauucccagacauguucauaggccaaucugaucuaggcauuuccucaaucgaagcucuccuuuuaggugaucuagauugugauaagguaacauuucaaccuauuauacauaguugucccuaaacauggaguuugccuagauagucuagccauuuugucccagggaucucaucucugccucccaagcacugggcguuuggugggccgucauaccugcuugguuuuuaugaggguguauagagauaugaauucugauucucagccuuguccacugaacugacaccccaacccugguucuaccaccuuuuuccacucuuuuucuaaaccauagcaguaaagacugggagaagacuugcuaagagcagaagggcuccuuucuuggcccaagacagagaaguccuuuuaagugggcuauaaguauggguaaggguuuuuuuguuguuguucuagugggguugaaccuuguuaaugcuagguaaguguucuguuguugaucuauaucccuagccuuugagauuuggggaagaguuacuaauaauagccuauagcuaccaugaauugauuauuguuuacugucuaugagucacuuucaaaguccuuaacauucuaaaccucauuuaauugucagaccuaucauagaagaugaauuugagauguauaaggcuuaggcagcuugccaaacuuucuuuauuugauguguaauaguggugggaguuaagcuagugaguuuugcuuuguggcuuauuccuugccuguacauggccaggaaagagauggggaacauaggguucucucuccucuuugggcauauauguaggcauuuagauaggcuagaaaacagcuugaaguuauauauucuuuuucuuuuuucuuuuucuuuuuuuuuuuuuuuugguuuuucgagacaggguuucucuguguagcccuggcuguccuggaacucacuuuguagaccaggcuguccuggaacucagagauccaccugccucugccucccaagugcugggauuaaaggcaugcgccaccacgcccagcgaaguuauauacucuuauaagguuuaaaauaugucuggggaugguacuuauuauuguagaguguuggccaacuaugcuggaagccuuugguuggucccuagcauucuauaaaacagguacaauggccaugucuucaugauuaguacuugcauggcuugucaagucgggagaagccagaaguucaagaucaucuuccuuuauauagcagcuggggcuacaugugugugagagagagagagagagagagagagagagagagagagugagagagagagagagagagugagugagagagagagcaagagcgugcauuugguuuagaaguuguuguucagguacacaaggaauuugcagcaaguuaaagguuguuugugcugcuuuguggcuguaacuguguucucuucaucuuuggugaaggauugcuuuugaaggauagaucauuuuagcugaguugaaggacaaauauagaguuuguguagguagacacacauacauggggacugagaauuugacaaagauccaagagugcaaauucaugauuguggggaaagcuuaugaaacacugaaguauaaaaaguguuuuuguugaaaaucagguaaguagaaaaauuuaagaagugccuagaugauuccagauguaaaggccuauuuccaaaugaaugauaagugcauucaugcuagguuccugccaaagagcagaagcacaggcugaaaguguaacuaagaguucuugccuagcauggaugggaacacccuagaugugcacucucagugcagugauagaaaccaagagcacagaggauuuuuuccuuuguucuuaaaacuagucauucuaauauuuaucuuauauuuauaucuaacaaauccuauuaauuauaacaaauugugauacaaagggucuaaaauaacaucucuaaagguaaugacuacuucauacucuuauuucuaauguuucuuauagauauuggauuauguuuuaccuagcuugaagcuguuuuuccuuucaaauuuaauguuaaaaaaaucuuucucuuucaugccaaauuuuacugucaguaaauucacugugguugaaugaucaaaauuaauuuuuuuugucuaguaauucauugauagacauuuuaagauguuuguauuugguuuauauguauuauauuacauauauaauauauguguacacacacacacacauaacauuaagccgggugguggugagcaccuuuaaucccagcacucagggcaggcagaucucuguguuugaggcccucugaucuacauagugaguuccaggauaaccaaggcaguacagagagaaaaugugcuagcuauaaaguguucuuuuguguggcuacaucacgguuugacuagucccucuaaaguaguuauugcugauggacauuagaauauuuuuaagcuugcaguuuaaagaaggcuauuuaauuccuuuguaugccugaccaauuuuuuaaaauccaucuuacuaaauguaguuuguaggucaggaguaaucuuuuuacacuaagugguuucuugacugcuuaccuuuuacauaguuuaucuaauuuaaugagucuacuauuaauuucaguauuuaauucugcaaauagcaacuaauaguauaguuuuaauguaauaaaugguaguauuuauuacaugggagacauucuagauucuagagaauucaagugaaaaagauacuucucacuccuugcuguaacaggaguuuacagagcugaguagucaguaguguagcauagugauguggaaucacuuuaaacuguucuaguccuuagcuugcagagagccauacagauggauuuguuuaugucauuugucuuuucguuuuuguuuuuuucuaaacaggaaaauaguucugcuugcaggaugggcacuguucuuauuucuugcauacaaaguuuccaaaacagaccgagaauaucaagaguacaauccuuaugaaguacuaaauuuggauccuguaaguaguauucuuguguaauaaucauuaauucaacaguuccuuaaacaccaaaggucuaugcucuaaaacaaauuagauauuuccaaaagaagucagacuucgucuguuaccccaccccccuuuuucauuuauuugugucuguguuguguguguucuugggugucaugaguccagaagaggggguugggucccuuggaguuuacaggugguuagaagcugccuaaugugggugcugggaauggaacucaggaccucaaggagaguaguacauacaguuuuuauguaccaagccauuucuucagcccugucaguaaauuaauucuuuuauuaaaauaagaucucauucauuaucauuugaauauauuuguucuauuguugguugcuacuaguaaguauuaguuuauaacugguaaaauguaaagaccuugaugagaaguuacuauaguuuuaaaacauuuuuguugauugaugcaugaaauaucuuaagucuguguuggggguuccuguaagaaacuguuaucauuaucauugaaauuauauaauucuugauauguucuuuggugagauuuugguugauaaaccucuacagaaugaagugagaacugaaguuaaugaagagagagaaggaggucuggagaacagcuuaguagccagauugaaucugauaauucacuguggucuuuugggguggggggguagggguaggguagggugggggcuagggguggggugggguggguuucgaggcagggcuucucuguauaguccugacuguccuggaacucacuuuguagaccaggcuggccucgaacucagaaauccgccugccucugccucccaagugcugggauuaaaggcgugcgccaccacugcccggcucauugugguuuuaaacaucuuauuucuucaauggauugcuugauuuuaucuugauauaauucagauuaaggagcaugcucauuuuuguagguuucugcuuuguagaaaaguuugcauauagucggauuucuguuuauuacaaacaccuuuuuuuuuuuuagauuuuauuuuauuuuuaauugugaauguguauguguucaagugggaauacagaagccagcagaggacauuggauuccuugaagcugcccacccuugguguugggaacuagacuugugcauccuuuuuaagagcagugugagcuuuuaaccacugagcuauaucuucuucccaguaucucucuuuuuuuuuuauaacugugaucaucaugguuauuaagaguauaaaauaaaaagauguggggaaauaaaaugaucuaaaaauuauugauaaaaagugagauugagaagcaaggucaguucauuuuuaaaaauauuuacuuaauuuuaaaauacuggcaagcagaugaaaugagauauugcuuagauuguaaaggaggcuaaucuuugguuuguugguuuuugaacugcacuuaguuuguuuauucuugauuaucuuuguauacguaaaaccaguguacuucuacuuaaauguggaguucuccggcuucaccgccauuaucaucagugacuaguauauuccaugccauauaguuaagugcuugauaaaaauaaauauaaugaacaaaagaaguauauacgagaugaaauuugagagacaaaauguauaggaaagcuguuagcuucuuuugucagaauauuaaaugguucaugguuuaagauaaaauuuguauccuuccuuauugcauugugcucuuauguauuaacaaagcuuuucuuuuagggagcaacaguggcagaaauuaagaaacaguaucgcuuguugucacuuaaauaucauccagauaaaggaggugaugaagucauguucaugaggauagcaaaagcauaugcagcgugaguaccacaggccugcugcacucuagaaaggaaauguaaagacacauuucuguuuuaagaaaguaguaaguaaaaugagugacauacuuuuauuacauguuaaccagguauauuugaaccugacauugaugguccuacucagcagccucaaagugguaguuaauuaacccugaaguaacucgaacuggcacugaagagacaccaugaccaaacaugguucacauaaucaauucuaggcagggacauguaguaauucccuuccucaaaggaaaaagaaaacuaacaccacaguaguuagaugacucucauuucccacauacaguuaucuaucucuuuaacuaguagguaacacaguaaacguccuuuugaacauuuuauacagugguuuccaaauuuuuggcauucacaucacuuacacagcuugcuguuacaucuuuauuuacuuuguaaaaaaauuaguucacaaacuauacaacacuuaaguccucccucccucauauauuaucuucaacauguauuacuaugaaguauccagguaacucuucucuuagaaucaauacccaaggaacaguuuuaauuuuccuauuuccuagaagguaugcauggcuauguuacucaugcugggucuuagcguugaauccaacuacagcacucaggaggcuuaaauucauggccagccugaucuacaaaguggaaccuaucauauuaauuguuuuuaaggggaagggcucauguuuggagagagagcucagaaauuaagggcaguugcaggucuuccagaggacucaaguucaguuccuagcacuucucagggagaucacagcugccuauaacuccagcuccuggggaucuaauaccccuuucugguuucuguagauaugcacauagcgcacacaugcacauacagaaauaccauaaacaaacaaaaacuucuaagucagacaugguugugucuaucuuuaaucuuagaaggcagaggcaggaagauauuugaguuugaggacauacugauauacauguugaguuccugggcagccagggcuacauagugagauccuguguuugagaaaagaaagaaaaaagcuuauaaaugugcaaauaucugugcauauuuuugugaauaauauagcugucccccauccccagcuuuguguacacuuggcaggcacucuguugagcuauacucuuagcccaugagcuuucuuaacaauaacaauguaucuuaucuaugucuacaucuaggucaacaagaaaauaauaauaauaauguaccacauuuuuauuauccauucuucuuuugauggcagucuaagcucauucuauauccuuguuauugugaagaaaaaaauucuuauaacugguaaacaugacuacaaguaucugugugguauuagaauguagagccuuccaggagugcuaguuucuaguuuuagauuuuugagaagccuccauccugauuucgauaguggcugcauuaguuuauauccuaguggugguuggauuuccucucugcuucuguucuuuguuuuucugauaugcauucugaaaaggguaagaugaaaucccaaauguuuuauucauuuuuuauuuuuggagacaaagucuuacuaagaagcccuagagccuggaacuuucagauugucugccuuugccucugaguucugggauuaaagguaugcaccauugugucugacuagagauguugaacacuuuaaaagaaaaaaaaucuuaauuggcuauugcauuuuuuccuuuuuuucuuucuuagucuggugggcagagaaggagcaacaaaaaccccaaguguuaggguauaggauugguagaaggugaaauauaaacucuuucuauugcagugugugugugugugggaaccuaucuuuuuucuuuccucccaguuagcuuucauccugcucucuuccucucuucaaaucugauauaguuguagugggaaagaccaaaugguauggaggacaaaggggacauaucuuacccuguucucuauauagucuagaaguuaacuucuuguguggaguguaguugguaaagauuuuucucucauucuguaaacucuguccaucagucaguaguuucuuucgcuguacagaagcccuucugguuucauuugaucgcauuugagauuacauuuguuaguuccguggccuguuuccuauucguggaaguucuguucagaagucuguugccugcaccugcuguacugaaguguuguccuuguccuuucagcauagucagcauuucugauuuuuaaauaagaucuuugauucagggguuuguuugcuuguuuguuuauuuuggugcagacugugagacguggaucuaaucucauucuucaggaagagauccucuuuugcuagcaccauuuguugaaaagaauucuccccccuaguguaugucuuugacauuuuuauuaaaacugagguguucagaacucuggguucaaaucuauuuucuguucuguacaugucaguuuuuguaccauacuaucuuuaucaccaugauuaacaauauuauuagugugcucauuggagaaauuuuacaaauaggcuguagagaaauaaauaaaagccacuuaaaaacauuucuuacauucuuagaaaauguaguaaguagccuuugaaauucaucugacuucacugguuaaauugagguaaucaagaauuuguaucaaagucuaugaauuaguagcauauucugacaguagggcacgcacacacacacacacacacacacacacacacacacacacacacauacacacaccuucuuugacuucaaagcgauuuuguuuuugauucuuugauuuauugaucccuuuuggggaggguauauaucauaucuauguggugugguguguguguuacacaggugggagugaaugcauguugaggcagguuggugugggguguuucccuagaucacacuccaucuuauugauugagaaagccucacucacuuaaaucacacagcagcuagccaguuugcuccaggcauauccuguuuuugccacuuuagugauggguuagugggcuaccauaccuuugucagauuuauauggguacuguggagucuaaacuccaggcuucauuccuacauagcaagcccuucgugagugagccaaaaccucagccuugcugcagauggggagaguuuggacacugaacaguuaagugcuuagcacucuuccaaagaaccuaagagcucaguuccuagcacccaguuuggguagcucacaaccuccuguaacaguaacuccacuuccagggucuuucagagucuuuguggguacuuguguguggguguacauaugcacacacacacacacacacacacacacacacacacucacaaugaaauaaaauaaaucuaaaacaaucaauugguuaauacaauuauugcauuugaauauuuauuuuuggggguauggcuuucuaauuuuuauacuuuuuuucuucaugcuaguuuaacagaugaagagucucggaaaaauugggaagaauuuggaaauccagaugggccucaagguguggugaauauaaaaguguuauauauuaugaaaauauuaacuauagagucagaggaauauugauuuuucucaguuuguggguaugaaaauuacaaccauggauuagaugaauaaaucaaaccuuuccuguuuaaagagauuuuaaaaauauuuuguauuuguauaaguauucugcuuguauuuauguuugugcaccacauguguuacuggugcccauagagaucagaaaggguggggguggguuucagauuuccuauaacuggaguuguggacuuuugugagccaucuuguaggacuagaaacugaauauggguccuaaaagagcaacaagcccuccuuuuucuuuuuaucaaauuuauuuuauuuauguguuuugcuuauguguauauaauaagguuagaaaaggauauuggaucccauggauaguugugagcccuagaaacugacucagguucucuacaagagcaacaaguacucugacccagugagcuagcugagacuggagagauggcucuuauguuaaaguggaggcucacaaccaaaaaggcagcaaaccuauucacagauacaaacacaagcauguaguuuaaaaauaauuuuaaaaaaaaucuaagaaaaaucuguuuuccuuuuguuugagugcuggggagcuggcucagugagaaaaaaaggcuggauuucagaucccuggcaccuaccuaaaauuuuuguaccuacucauaaucccagcauucagcagacacaggugaucccuugggcgagcuggcuacuuagauucugcaaauuauuuagaccuagguaucuaagagcuuuugaggaagacaacagauguugaccuuuuucuccauagacauagcauuugcauguaagcauauuccuucacacaugaacaugcauauacacauauguguacauaccaugagacauguaagaaguuuuuucuuuacuaaguucuugcaucuucauguuuauauguauucaagcuaugaaagaauuuguguuuucuaggaaaaagaaacugagaaaaguuuuccauugagaacuaugaauuuucauaugcacacuauuuuguaacauacaugcaugcaugcauacauacauacauacauuacauacacacauagauaaauuuauuuauuuugagacaugccuacagugaucuugaacuugcagugauccucaugccucagucucucaaaaguuugagacgccugggugcauuuuauuaaguuuguauaauagagauacauguaacggagucuuaaagguuuuggggggaaaugggagggaacauaaguuugagauacagguaaauaaaguuaguuuauuucaaagucuuuugaaauaaugguuuauuuuuauuucagcuacaagcuuuggaauugcuuugccagcuuggauaguugaccagaaaaauucaauucugguaagugcauuuaaaucaagccuauucuaauguguuuguauacuugugcuauaugcuguuuauaggguguaauauaaugaaagcucgcacaaacaaaaucuggcaugcaguucacauuuuuacuguguuuugaaagguaauuuuuagcaaaagaaaaagaauugguuccauuauuauacugcuggcuuagaacaauguauucuaaggauaagcuugaaaccuucaagguuuacuaacuuauuuugaaaguauuuuuggauagugucuuacuuuuggcuugagaacuacuagauuuauauaauuaugcauuuaucuaaagugaauucauaauuucacuuacuuuuuucaccuuuacucaugccaagauauuuuaugcuaaauuaaagaucuguuccauacuaggaggagcauugggacauugggcagauuugcuacaucagugauaguuacuauaaaucaggauuugucuuaauauauuguuuaaaaauugacgauuuucuacuugugguuucaugaaaguaguuauuuaggaguuguuuuauuuuaauauaauuuuccuuauuacucuuaaauguauuuucccccuauguuuaugucuguguguggguguucccaugcuacaaccuaaguguggaggucggagaauaacuugcuggaguugguuauuuccuaucauaugggucuggggauggaacucagguuguuagguuuggugacaggugccuuuagcuacuaagcuauuuugcugaucugaggaguguuuuuuuuuuuaaaucuucaaaguagacuauauacaguuuagcucuaauacguuuugaaaauugcuauuuugugacauuaaaauugauaaucuucagagcucugugcuugcugcuuuaacugcaucugccaugcuuaggguuacugugggaauaauagaaaagagaaagauaguugacagauuucagaugaagcuguagauggaaauucaauaguucaauaguuacuaucaaauacaaauaauaaaauggcacauuuguaguuaggcacaggagguaguuuguaagggcuuacaguuuauuuccuagcacuauuuuugcaagauuugaauagagaagaaagugcuugacuggaagggaaacaaaauuuauaaaaguucugcaguuaucuauauuauaucuguaaauaguaaauuaaacuaugauuuguuauagcagauaaaaacgaguuugaauguaguaacucuguuguuugugugacauaggacaagcucuguuuauacuucagcuaugcugucugcagaauuaaaggaaaaaaauggcaccuccauuauauagaaccaaauaacagagugcuuuuaauagugggucuucuuuguaagucugaacauuguuauaauuuaccugaccaaggcauagcuguuuucucuugaauucuagguuuuacuuguguauggauuggcuuuuaugguuauucuuccuguuguggugguaaguuuuaccucuuuuuacuauuuuuuuugguaguugcuugauaagauuuugauuauuagaauuuaguccauucaacuucauguuuuaaaagguacaauuauugcuugagacagggucuuuccacuuaacucuggcugcacugggacuugauagguaguccagguuggccuccagaucugccuaccucugcuuccugauugcugauauuaaagguacuaccacacccagccuauuuuuauuuuuuuauuuuuauguauguaucuauguuuguguauagaguaucugcaaaugagaguaggugucugaggaguugagaagagaguguuugaguacccggagcuagagugauuguggguuaguugcuaugguugcugggaacagacuguggcuucucuagaagaguagaacauggucuuaaccacuaaggcauauccccagacccuaguaaccucuaacuguguaguaauuuaguugcagagcuacuaaaaaguuuaugacuacauaguuuauuucuuuugugccuuguguucuuuuugauccuggaguuuguguggguccaugaguccuguuaugcaucugucuugaccucuuucuucauaggauuguuguguaagauccaaucucauaagaaaauaaucgugucagcuauaaaauggcuccuaaauguauuaaauauuuauuagaaaauucuguguuagaagcuacuuuguuugcuuauagcaaugggugguuuuauuacuguuuuauauuguaaacaauuucuaaauuguuucugccuaaaaccuaaaguauuuuaaucaugccugaugauuuguguugguguuuggguuucugacaauuuaaguauuuguuaacuaaauuauuugaaauauagaccaagcucaaacacuuugcucuugauaaauuuuuggaaaauucacacacacacacacacacacacugcacugcaucaggcuugacguuuaucauuuuucaugcuuuauaucuugucugauucuauuuguguuuagggcucuuggugguaucggucaauacgauauaguggagaccagauucuaauacguacaacacagauuuauacauacuuuguuuauaaaacucgaaauauggauaugaaacguaaguaaacuuaaguaacugcuguucguugcauugcuuuccgagucauuuauauguugcuauauauuuuuuaaacucuauaguagauucaguuuuauaguuuaucagauugaaccagaaaccaggaggaccauugcugacuggcucccucucaagccucacauucagugacuuaggcccccugccuaggaaugguaccucuuccaccagcaguuaagaaaaugcccucacagucaugcccacaggcgaagcugauguagauauuuccucaguuaagguucccucuugucaggugacuaguuuaugugacugaugagaguguauaaaauuaccaaguuucugcauagcaaaggcaacaauuaaaugaguaaaaaaguggagaaaguguuugguaacuauagagcugagagaggauccaugucuagaacacauaaagaguuagagagucuuguguaauuguauacaccuguaauccuaguacucgaagaggcagggguauuaggauugucacaaguuugaugccagccuggucuacauagugaguuacagccuggccuaggagucagugucucaaaaggaagaagucuaucuaauucuaguaagacuugcuguuuuacaaaugcuggcaaggaugcaguuguuggugagaauguacguuaguccaacagcuauagaagucagcauacgauaagcuauacuacuucugggaauguaccuaaaggucucagguaccuccacauacaugcuuacugugguguuguuuacaauggccaaguuacagaacaaguguaggugucugucaacugauaaauggacaaggaagaugugguguauaagaaugaacuuaggacaguugcaagaaaguugaugaaacaggagauaacuauauuguguaaaauaaaugagauucaaaacaguauuguaggaaaucagcaucucagaaacccaaagagcaaggucucagcacaaagacagagaacaggggauagagacaaagacaagagauggggaugaagaugaggagguaggggaggggcuuuuguuccugaggggcagaggacugccuugggauagagaggagacugaugugcuccauaggcagauggcaguuucugaagguacaaggggaaaccccguguaaggaugagcuguugaguuuuaguugggcauguuaauuaaucaaaagggggcuuuugauugcuggacuuuaaaucuuugauagccggaccuuuguaaucagccucaggaggaauaaguggccaaauaagggaauaggccuuggugguuagcuuuaggaauguaaucuaaauguuuuuuagaaaggcagagggacuuagggagaagggcaaggccuaccagagcuauguuuacaagcuggcuagugucccuucaaauauuacaugauuucuuucaaguauauacuagauuuuuauguguacacauaaaauccuaaauaugcauauauaaaucuacccauacauacacacacacacacacacacacacacacacacacacacacaaauucacagacacauacauauggcaugaaaguuaaagcaagacuaucugggaaaagaaagaauacuagcugaaaagggagggacagauacgguccaaaucuaggauauaauugaguacgaaugugaaauccuucacuguguauaguaaauagacuguagaaaagaaugaauaucacuuucuguuauguuggacuaguauaggaacuaguacuacuauagaaacuuaguuccuuacaagaacauuucauggucuuuguuuuccccugggauacuacugacuuaagagaaugguaacuagucucaugucauucugucacaaagcacuuuucagcugguggauuuauuuauacauccuucaucugucuuuggaacaguucuuuucuuuucuucuuuuuuuuugacccacaugaaaauauuugagcccuguguagugguauacaccuuuaaccccaguacuugggagacuggggcgggcagaucuuggugaguuucaggccagccuggacuacauaccaaguuccaggccaaaguuacguggugagacuaucucccccuccaaaaaaaaaaaaauuuccaguaguacauacauuugcuaugccugcuaguuuuggggcacagcugaagaaacuaaaaguacaaggagaaaugugaagacuauugccuaggucauuuagccaggaagugacagaccuauagucuucgcuuuucagcacugcugcagucccacuuuccuuuuguuauguagauauguucugcuguguuaaagguaagacuggugcuuaaaaugagauuggcgaucacagugcuggcccuuaaagagcuuuuuaggauaauacuguggcaaugaaaucaugugugccaagguuccagaauuuucauuuacucgacagucugaaaagucauggaauaaggagaaucucucacucuugguaauacuuaaacuggaggucacucucugacaugcaacacucuaacaucacaugacacacuagugcucuccagcaggcuuuucuggaacacaugcuuaguuuagaagcaugccauuuuaaugaccgguugcuuuuguguccuuaguuugaugaacacuuguguguauuuuuaaaaguaaagguuuuuuuguuggguuuuuguuguuguuguuguuuuuagugggacauguuaauuuacuuagaugauuuucagcauuuugcaugauuaggaagaaaaaucaauaaacaaaucacuauuuaccauuauauugguuuuguucccauaggucucaucaugguuuuagcuggagcuucugaauuugacccucaguauaauaaagauuccacaagcaggccaacagauaauauuuuaauaccacagguuaggcucaucuuacaaauuccucaaugagcaauaaaguucaaaagugaaugauucauguuauguuucugaauaauucuuuuauuugucuuagcuaaucagggaaauuggcagcauaaauuuaaagaagaaugaaccuccacucaccuguccauacagccugaaggccagaguucuuuuacugucucaucuugcuagaaugaaaauuccugagacacuggaagaagguauuugugacuaacauuugaaggguuuuaagggaccgaagcaacagauauaagugguccuggugacccaacauuuagaugcuggucuuuuuuuuuuuuuucaaucaaauaguuguuuauauuucuuuuuaaaaaaaacuauaugguauauaauuacuuugcaaauaguugaaauucugcauuagaugcuuuggcaaauacaaaauacguuauuugaagaugagaguauuuuguaugaaauguuuaauaguugcagguuagcagaagcguuugcaguggcuuugcuuucugagacaggguccgcaauagucugucugcuauccuuggucuuucucagcuccucuggacuaagaauguagauguggagcaucauguuugacuccuacuguuucuuaaaaaaagaaccugaaagccuucuagagggacaaaaguauauuuuacagcaaauaucugacccucuuaauccaacaugauuccccccauuucucaguaguagcuacagagauauggguuugugauugaaguuaucuacuuuuacucuuuaaaacaaaggccuuggcuugagauggaaguauuuccagagagaccaucgaugaaugucaucuccuuuucaguuggaacuuagaaacuugucauccuaaaaacaaauguucuuuuugaaugaaaucuuccuacugcaucacuguugaacuagugacguaaucuaggacuugugaaaauaaggccauccagugcuuagugcuuggugcuagaaagggugcuuagggugggaggaagggacaguuuuaggcaucaucauuggaauuacuuugaaauacauuaguaguuuuguuacugauauucuguguacauauauaggcauuuuuacuagucauuucuuacacauagguggcuugcuuuuuagguagaauacaaaauuuaauggauuucauuuugaaagauaguuuuaucuaucuggguauucuuuucugcauguauauacugguaccagaaaagccugaagagggcauuguguccccuuggaacugcaguuacaaguugugaaccacuguguggguguuggaaguugaacucaagucaucuagaagaguagccagugcucauaacucuugagacaucucuccagcccccucaaauggaaaauuaaaacacauuuauuuuucuguauugcugauacuuggacucaggaccuaauaugcuaugcaaaucucuacugccuagcuauguuuccaggcuguuagauuuuuuuaaauauauuuuuuauuuuaauguguaugagcauuuugcuuacaauauguguuuagugccugaggaggccaccugguacuauaguacuguugucagccaccauguuggugcuaggacuugaaucuagguccucuggaagagcagucagugcucuuacccacugaguuaucuuugccagcccauuguuuuuguuuauauuuguuucuggaaauuggacucagguugucagacuugcaucacaagcugagcacaagcuaagcacaagaagugcuuagcuaucccccuuaauuaacuucuuuccuucccuuucuguauuuauugauuuuuauucucaucacaguuauaggaauguagcggagcagcacagauagaacauucucaaagacagcaagauuggaauugaauuuaugauuaggacuguuauaaagaaaaaacaggauguauaauaaauaguaccccauuauguuagaauuuuggcuuugccaaaucuuaugcuagugauggcuuucugucuuuuguuugcaguaauguugagaaauauucucuuaaacauuaagauucugagacuggguaaaauauauaagggccugcacauuuuguguuagccuugggcuucaagugggaaagauauuuugacuauaagauuagaauaguuuauuucaguuucuuuuguuuuguuuuuuucagaucaacaguucaugcugaaaaaauguccugcucugcuucaagaaaugguuaauguaaucugccagcuaauaauaauggcccggagccgugaaggugaggaggaaauguaacuauacuuuguccugaaaucauuugcuuacaauacuucacaguguaaagauuuaugaguguuuaauuacaacuuuguaucccagaucagucaggcucucagauuugcuuauggucucauucuuuucauugcuuuauuuuuagugcaucuuccuccucugaauacuuuugaguuauuuuuguauuuucacagugaguuuaaaauaauucuuuaauuggcauauuuuuuguuuguuuuguuuuuuugugugaaaagaaaaggaauuuuuggucauuaauggaaagggaggggcuaaaaaauggagacuuuaaaauuuguuguugugggugauuuuaauucuuggcaguguuacaguaccuuuggaauguugcaacaucuacuuguugguguuaacgcuagagguuuuagcaaggcgugacuuaaaccuguaacuucagcacugcuuaggccgagguaggaguccugguugaagccagucuggacuucacacaacaauuucauuguuuuaaaaaguaaacguaaaaauacaucuaaaacuacaaaaucuuucuuacucuucuauuuuuugagguaggcucuugcaguguagccaaaucuggcucugcacuccaucuuucugccucagcuucuuaagcaauagguuuccgcuguggcuccaccaugccuggcucagaacauuuuggugauuuguguguuuguggcugcaucuuacuacaucauccaggcuggucuuaaaagcacuguccucuugccucagcaaccugagugcuaggauugcuauccaagggcugagauuauaggugcccuccaaauuaagucauguuauauuguuagugccugauacuuuaugauuauuggaguugauauagaggucuuuguuaaauuaguaguuguugcuggguaauacacauuugaccaauuuuauguauuuuuagcauuuuuuucaguagcuuuuaaaggaaaaucaauaucuggaucuugaauuuuagguguuaaauguuagugugauuuuauuccuugcaaugaaaguauaaaaaauacagcucuuuuguuucuuuuuucccuauucuuucuaagaaagggaguuucgugcuccaacuuuggcauccuuagaaaacuguaugaagcuuucccagauggcuguucaggggcuccagcaguuuaagucuccccuucugcagcucccucauauugaagaggacaaucuuaggagaguuucgaaucauaaaaagguuuguggacugcuuucuacucagaguuuagcaacuuguaucacaagggaaugugaggaaaaaaguuuucuagacuuuguuguguggguuucuuagacuuagaauaucuuuuuuguucguauuucuugauuaggugguuuuauaguauuuuacuacuauaggauuacuguuuugcguugaguaaauuuuaguacuuuguuauuuuugcauugcaaagauuuauauaucaaguaauaauacaccauauacuuuucauuucauuuuugacuuaaaguugggcaguuguuauaguugaguaugaaccaaaacaaacaaacaaaaaaaugaagcauucacaaaaauacaguuggacuaacgcugaagcucugcaguagagugcuugcgugcguggucugcguggguucagcaugcccuggguucaguaccaccuaguuacagggugugggaggauacauugaugaagaaaacugcuuuuuuagaaacuuuaauaaacacuugaauaucucggaaguauguagaaaugaaaaaguuugggaaauaaaagaaaccaaaguuauaguugugguagguaauuuuaaucauuacuuuugggcguggucauaugagcuuguaugcucagcauuuugggaggcagguugaagcaugaggguuguagaaaauuugaggccuaggcuaaguagugaacaggaggccaaccggggccauagggugagccccuguuuuaagagaaaaagagaaaaagauaaaaguaaaagaagaaagcagaagauagcuuuggauuuggucguauuaaaggaaauaaauguauaagaaaucaguauccaaguucugcucauuaaucauauugccauuauauuaagcaacaguuuacaacagaauccuagaguugaaauucaccuaccucaugauuuaaucucugugaaaauaaaaauuaaguacuuaguacuuaaguagaggccaccuguacuuagaagguuucuuucugaggcugaaaguaaacuuaagacaauaguuacugauuggaucaggauucuguaugaacauguuuuuauuuuuaugcucuuuguuuuuuuguuuuuuuuuguuuugauuaaaaacaaacccuguaaugaauuuauuaaaaacaaaaaacaaaaaccuaguuuuaauggucuugcuuugaaauacccauaaugauaacuuuuuaugaaguugcuggauuuuauuuggucagcaugccaguaguuuucauuugacgaaacuauuuauucauuccaucauucauucauucauauauuuauuuuucuuuuuuaguacaaaauuaaaacuauccaggauuugguuaguuuaaaagaaucagaucgucauagucugcuacacuuccuugaagaugaaaaguaugaagaggucauggcgguccuugggaguuucccguaugugaccauggacauaaaaucacagggugaguggagcuucccuuugcacauugaugacuugcucucuuuuauuugacucaacucguccuuugucccuucaucucacuacauuguccuaucuagccugcauuuacuuuuaggucaggcuccuucaaacguggagaaaucucccucugcccucuuagugcugauauagucaggcaugcuccaauguguccuucuuuacagcaccuuaauaaugugauuugcaacuggacuuugcagagcuguaguuuucuugucaaaacccuguuuuuauuuuugucacaguugugcugaguacgaggauacugcuuuauaguuggacauuggauuuuuauuuuguguguguauuaaucaccuauagagugaggauaugggaauuuuaaccuuaguugaauucuucacacauggagcuggacaggagguuaugcccagaguguagaauguagaaccccuuuccugugguuccugcuuuauuucaugucaugucauaggcugccauuuuugucuuaauccugccuaugcuguggagucuuucuucaagcugauggacuuaaaauaccaguuacaaucucuaaagugccuuugggugcauuggcagcuucuucagugcuuuuucaguggagucgugguagcuguccucuugugcuagcucaacuucccaaagaauccaagagauguccacgugugaugaaaggaggagaugucucacguacauuauuaaacgaaauaguuaucuagugcugagaauaacaucuauaguaagcuuugaaaauuacugugccugugcuucguguguuuuucuaaacuuuguaucuguuuaauugaaacgacuuauuuccuaccaauauaauugcccugucacaauuuucauagcugaauaauaucuuugaacacagaaauacagauuauuaguuuagucugucuuaugguauaguuccgaguuauagcauucaucaacucacuguugagaggacaaagaugcagggacauauuaggaauaauuucuguccauaaagaguucaccaucuagcugauuauagaauuaacagcagagcauaauggaugcuuaguguuaggugaugacagacauugcaccuuauauucauguuaaaaauagugagugcucuguacuuuuacuagcuggagagcuaugcuuacagcacguugccuuacugaauuuguaaccuaacauaaaugagaaguaaaugauuuucuaaaauugcuuggaacagggaagcaaauagugucaucugguuuugguuuauguaguauauaggacauuugcagaguauuuacauauaguaaauacuuuagacaacuuuuucugggauuugggaguuuucuucuagauuagugaguuuuuagacuuuaaagucacuaaucuaaaugcugcauuuaggggcuggagagauaccucagauguuaagugugucaggugguggcucacaccuuuaaucccagguguugggaggcagagguagguggauccugugaguuucaaaccagccugguuuacaaagcaaauuccaggacagccaggacuacacauggaaacccugucuugaaaaaaccaaaccaaaccaaaacaagaaaacaccucccucccaaaaaaaccccaccuacugcuuuagcaagggacacagguucaauucacagccucuaccuaguggcucacacccacauauaacucacguuguguucaugcauaccugugggcacccacacauacguauacaaauaaaucuuaaaaacugcauuuacaauuuuaccuuugaaccaaaucuaguuggggguuuaagaauaaucuuuguuauggucaauuauuguaaaacucaugauuagaaaaaaauguuagaagaggcugucuucaaggaaguaagaguuuauuucacuauguuauuuguauaugucaugggagucacagaguuugaaggacgaguagcaaauauaggaccaagucuuaauauggugcuggagauaauuguucucccuuuaucacucgaggcuacauagcaucucauggcaagcuguuuccccaccagauacaugaacacauugauacagcagaugucacagguacugccaagugaaagucuagaugauaugugggccagguuugaguucugacaauggaggcuuguagggugagccacacauucaaacuuaacaaccaugguggagguagguagcaguuacaaguuguuggagacugcuguuuugcacguguuggugugucagaaaggucagaacgaugugcugaacuaaauuuguaaggcaguauaaacaguaaaaacaaaaauucucaguguagaaauuucuuacagauaaaaucuuguagaaaaugaauaucauuugaguagacgguauaaaaaguaaucuuucucauugcuuugauaaaaaaauaaugccugccgggcagugauggugcacgccuuuaaucccagcacuugggaggcagaggcagguggauuuccgaguuugaggccagccuggucuacagagugaguuccaggacagccagggcuacacagagaaacccuguuucgaaaaaccaagaagaagaaaaaagaaaugucuuacaagcaauuuuaagaggaaaaugggagaaacguuuauuuugacacauguuuugaaaaguauaguccaucaugugaggaagucuugguguacaggagggguguaugugugagugugugugugugugugagaguauguguauguguguugcgugcaugagaauauacauguggauaaacaagcaugcagagacuagagcaagauguuuggucauuuucccuauccuuuuccugcuacauugcaguaaaaggucucucagugagccagaagcuagcucuuuugacuaguuuggacagccaacuagcucucagauuccaccagucuccaccgccaaugcugguacuacacauacauuacaugccuggcuuuucauguaggcacugacaaguaacacuguggacccgaagcuuguagaacaagcccuuuuacuccugagccaucuucucugcucuuuuaguuaauuuccuauugcugggaugacacuaugaucaaggcaacuuacaauagaaaucauuuaauugggacuuacaguuucagagggugaguccaugaccaucaugauggggagccugacaucaggcaggcagguguggcacuggaggaguaauugagagcuugcauccugaucugggaguuggaggcagagagagugagcaugcaagacugggccugguaugggcuuugaaacuucgaagaucauugccuaaguugggguuuuacugcuguaaaaagacaccaugaccaaggcaacucuuauaaaggacaauauuuaauuggggcuggcuuacugguuaagacguucaguuuuuaucaaggcaggaagcauggcagcguuuaggcagacauggugcugaagaagagcugagaguucuauaucuugauccagcugcagccaggagaggacugacucacucuggcagcuagaagggucucauugcccagccccucagugacacaccucuuccaacaaggcuccuaauucuuaccaaaauagugcuacagcuggggaccaaacauucagacaugagccuaugggcgccacccucauuuaaaccaccacaucugcuggacaguguucuuuuauagaaauauggaauucuacacaaacgugcauguaugucauucuuguacacaggcagugcuaaucguccugccugccuguucuaguuguaacauguuuuuccaaagcuagccgcucuuuuacuauaaagacaauauauugaaguuacugcuuuaaauguugcuuuuuaaauguuuaaggucauuggaauguuggauuuuacuauuuuauucuuuuacucaggcauuggucagagaaguaaaauuauacuguaucuacaaaguugguuuugaaggcagugcuagugcagcugugaaccuugguuucuuaaaguggaaaugguaauaaaucauaauaguucuuuaagaauuaaaugaaacaauuguugaagaugaccuggagaauuauuuuaauacucuuuuaaaaauauguucaaaauacugaaguaccaaguuguuuugggcaagguaaauauuucuguuugcauugacugagaacuucuuuuucucuuuuguucuguuccuccugucucacagucuuggaugaugaagauagcaacaacaucacaguaggaucccuaguuacaguguugguuaaguugacgaggcagaccauggcugugaguaguuauuuguauuacucauguagcuauacuuacuuacguagaguuauuacuauggagacuuguuuguguaucuguugguuugugugagaaugcacauguauuugcacaugguacacauggauguguguggagacugcaggucaguaucugauguugcagugguguuguuuagauggugucucucacuuaccuuguguuugccaauuuagugaggcugccuguccagcucauuccagaggcccacuuuccuagaacugggauuguaagcaugugcuauccaucauguauggcuuuaauuuauuuuuaagauuuagucauuuuguguguaugaauguuuugccuguuuguaugcauuuacaccacaugaguaccugguaaacagaggugagaagagggcauaggaugcccuggaacuauaccuauggagguuaugagccaccauauggguucuuagaauugaacccaggaccuauuucuguuacauauuucuguuaccuuucaaauuaauuaauaaaguuaucacucaggcuuuuuauuuugucuauguguguuuguggaaaaucccuugggcuguuuggccagccaguccagccaagucuauaagucagugagcgaacuugccucaaaaacuaaugugaaugaaaauaagccuuuugacaccaaccucuggcuccacaugugcacccuugcacacacaguguugguaguguugugcuaggcuuuuuacccaucacugcagacaaacugagaaagcaauacuuuacaguucuaguguaguggcacaugccuauaaucccagcaacuugggcucaggaggcugagagggggcgauugugaauuuagggcagcuggguuacaugaucccugucaaaacuauaaaaacaaacaaaauaguagugccaucuugacuucuuaauaagacuagccugucucuuagagcuuaauaauuauguuugcuuuaauuuauuugcuuuaauaauucuaaagauauuuauuacacauaaucucuaccacuugucauauuucaguaugcauuuuuacuagguucuaauugagcuuuaaauuguaugauaagugguuauacuuuuaggauauguggauuuucuuggcaaucugauaauaauaaauuuacaguacucccuugauggugaaaauuagaauaguguuauauauucaaauuuccacuauaauauucuugcuugauuaguauuagaauaagugauauuuuaaauugaaguauuuuugacuuuaaaacgaguaagcauauauuaagucaucgaguuuguuaacuuaaguagauucugcuuuugaagucuauuuacaauagcugugagauacuucugaagguuacuaccuggguauguacagacuuauaacugccaagccuacucacccucccaauugcaacugauuaacaaaagcuuuauggacaaacauuuugaaagauuuuauuuuccaucugaaagacaacuaugggcuaauaguauuguucuuguugcccuaggaaguguuugaaaaggagcaguccaucugcgccgcugaggagcagcccacagaagacgggguaacuaacaaccugaacucucuuaccuucuugaugaagaaauguucucuuuacuucugugguugacuuacauuacugcggggcauaaugcagauuaugaaaacacuuauuuucaucagucuccucuaaagaugacuguucagccuuaauugucauaugugguuugcagcagagugaugccaacaagaucaaggcaaaaggaggauggcagcagaagaacaaaggacccaagaaaaugcccaaauccaaaaaaaagaagccuuuaaaaaagaaacccacaacuguacccuuaccucaggcaaagcagcagaagcaaaagcaagcaaauggaguuguugggagugugagucugcagucucuguuacuguuguuacuaagauguacucuguguauguguguguguguguguuaaacuguucaaauguacauaccguuccuacauuucacacacgaacaucuacauuaaguccaagccaagauuugccauccuuucuuuauuuucucccuuccaaaugcuggaauugaauccaguaccucauguguaguaggauaguacccuauuguugagcuguacccaaguaaagauuucaaagcucugggcuugggaguaguucagaggaucuauguuccugcauagaaccugaauucuauuccuagcaccuggaucagguggcucacaacucccuggaacucuaucuccagggcaucugucauccccaaugucuauaggcacucacaugugcacauaccacauagagauacaggcauguacacacaaaaauaaauaccuaaaagguauguugaacauuguuagcauucaggagagcuccugugagucccuucauagucaguggcucuuccauucaguauucaucucucacuacugggacuuagucacugugauuuuacuuacuaauaaauccauauaagugaaaucauucuuuaagguuuauuuuuauguggaagauuguuuuuaaucugucuauauaaauggcuguguaccauauauauacagugcccuaguuagccagauaccuaaccuauuagguucucuagagggcacuugguacucuggaacuggaauuacacauggauguuagcugccacacgggugcuaggagucaaauuuggguucucuagaaaaaaagccagugccccuuaaccucuaugccaucucuccaguccugccccuuccucucuucuuucauuuuuugagacagaauccuacuaugcagcccuggcuggccuggaauuuaguauguagaccaagauggccagagauaaaccugcgucugccucugccuccucagugcugagauuaaacauguguauucucuuuucucuucuuuuucuuuccuuuucuuuucuuuccauucauccuuccuucguucccgccuuccuuucuguuuuuguuuguguguuuguuuguuugugcuaagcauguugaugcacaucuuuaagaaggcaggggcaauuggaggcuacccuggucuacagagcaaguucuagagcagccaggguuauacagagaaaaacuuucucaaaaaacaagcaaaaaaaccccccaaaaacuuauuauuuauguguuugugaauguauguuguguguaggugugcaugcaugugaguggguguguguaaguguguguguguguguguguguauuuguucaugagugcaaccugugaauucauuuaaauauuaucuucagcucugugaucuaccuuaaaugaauuuucccugacaauguaaauucugagauauuuauuccagucuuuauugaaaauacaacccuuuucuugcugaauuacauuggcauuuuguuuagaacaaguggccauagugcuuguaaugugucccuccaucaccauaacccacugcaugugcuucuccuuaagccagugucacgcuagcucuacugcggcucucggccuuuccacaugauaguguaaauucccuagaugguaauuuuacugauuuucuuaacuauuuugcauccagcuaaacauuuagagugaguaauuuucucuaaaaaauaauuacuaaauuuagacauaauugggucucugguuugaacggggaauuaacauaguacuguuaccgagucuuuguucacccucuuuggcugucuucguuaacuuagagcuucuuuauauuuucucagcaguaaaugacagguguggacauuuguauugcugugcacuugauaacauuuauugguuauuuuaaaugaaagaaauaaaauuuguuucaguggcuuuuacugcuuugcaggcauguaauagcuuuuucuuaaaacauugaccuuguaucaagcaucuuaaugacuugacauugauuuuaaccauuuauagauguucuaauuacuccacauaugcaguugcagcuguugugagggaagacaauuuuucuuuuaaccuuuaugcccuccauuucugccuuuugccuuucuaaucccgagcuaguuuaguuuuguggacagugaauuagcuucagagacucaaaacgauaaauacugacugggaugcucagaacuuuuguuuuugauuuugccuuguaggaagcugcaauaaaggaggaagaagacgacauuucugacaagggcagugauucugaagaggaagaaaccaauagagauucucagagugagaaagaagaugguagugacagggagucugauagagagcaagaugagaaacaaagcaaagaugaugaagcaguaagaccugguguccuuauccaugucccccuuacccucuuaugcugagagcagagccagugcacaccccagguccagauguguuaguuacaucacuugaauccuguuucugaugacugcuggagcuggggguucauuuguuuaauuguuugcuugccuuaacucauccauuuuagaaucucauuacuuuacaaauguguuuguuuugagguauucucaaggaaaauuguuucagacaaggauuagaaaucccaguuuucuuaaguuuguugaaauuacaaagcagaagcagguccugugucugagugacacuagucuggucucuuaaggaaaagugcagugauggaaagugucucuggagauagcaguaagggaaggcaggagcagcccuuagaggaccuuccaugccuuccagagcauauuuagaaguaacccugguacuagauaaucaggaaaggggaaagcuuugauuaguugcuagaucuugagugcuuuuagacucggagaauuucagaaauuauuuucccagcuccacucuaagaaagguuugucguguuguuuucuguaucuaguauucucagaugcaaaucaagguuuuacagaugaguuucuuucuugcucucuuuuucuuuuuacuuuguauuauuucuuuuucuuuucuuugucuuugaacaugcuagauaucagggccagcagauuuaaaguaaauuaauauauguuaugaaagcugaaguaauggcauaaagaugugaucagcuaaguucugaggcagagggauauuucuuguaggcuucucucagaaguuuauacauuaggguuuuacuguccugaaggaguuagaaguuuaaaagacugggaacaugcauuuaagaguuuagggugagugaaauaguuugguaacuugagaggaguguagguagagaugaagacaagaaggagagggaaggaagcuguguugcaggcucauuaaggucagaucuggagcagucuugucgugugcuguagggcuuagaggcauaguuacaugagguuuguggaaaugaacuucaaauccuuuguagcuaguuggcauugugaagaguaaaagcuaaaaacgcaucuaaaugaucucugagagauaucaaaugucacauauugauguuuucuucucccaggaguggcaagaguuacaacagaguauacagaggaaagagagagcucuucuggagaccaagucaaagauaacacacccugucuauagucucuacuuuccugaggugaguuucgcucagcccaguguugcuguuauuccauuucugcuuucuguagauuucucacuagcugugcacugcuuugugggaugcuuacugcuccaaggugugauaacuaguuuauuuuugauaggucacccucauaacaaagaauauauuguagcaugaauuauuuuccaugaauauguugcugacaggggauuaguuuuuaagucuguaugguuuccuauucuucugucaucucugguccuguuacugaguauugugcuuaauggcuguuucauuuagaagugagaggaggcuuauaagauagaugaaugcauuaguuuuacuuugguuacuuggcuguucugagucuuccacccacauggaguuuuaaguaggaugaaaaaauucuuccgaggguucuuuacauaguuacuugguacucuugugccaggaaguguucguggaccccaaaagaccaccaaggagcugacugauguaaucacguaaggaucucuuuaguacaaauucgagguuggguuuacucaccgcagacaccgcagaccuucaggaaggucuggugaaacagccucaaccucucaucgggacaagguuuuacaaaaaaguaggagaaggugagggggugggguccaaccggcaagcaucuaauugaaugucuaucauaagcugucugguggguguucugaagcaagaccguauacaauuauagucugaaaguacaucugaaacaaucagacuaaucuuugaauaacugaugcuagggaguagcuagggaguaacucuggccaaggacaagcugagggguccuuccuggugcuugaauuuauagcugcaggucagauucucagccuuuuuucuuuuucuuuuucuuuucuuuuucuuuuaccuuuuuuuaagaugggagucuggucccaagauggaguaggccuagccucuuauuccccccuuucucugguaacuagaagguuaaugagacuuccugaagcuuauaggcuguguuauggagaggcugacagugaauuauugucucagucuaucaucauguuuguuugugacaucagggcagucaucucagugccagugucagcuaugucuaaucucaugaaaacagcuaguaacagggcuaugucuuuaugacucagcuaauucaggccaaguuguguuggugaccugaaaagacuggaccaucauauuuuagagggggucagguuugucauuguccaguucucauggugucccuauagcuuggauaggggccccaacagugggagacagaagggagucuugaggcugaguuucuuccuguuggucagggucaucuucaacuguaaacguguauguguuggauccaugcuguaauccugucgaccuucccagugauggauguggucaagaugacaucauagggaccuuuuaacgaggcucuuaauaaccccuggcuggagggggaccuguuucauagauaacaugaaguuuaggccaaaccuguuugugaauucauuggacaccuuugagauagucuagcaauuggcacuccucgaacucagugaugaccucugccugguauguuaagaaccauguggagugguaucccgaacauuauuuuaaaaggggugaguuccaucugguaaggggaguuucaugcccuauagagaguaaagggaaggagaguuauucagucaucacuagucucuuaggucaguuuaguuaaggucucuuaggauuuuguuuauuuuuucuaccuguccugaacucuggggucuauauauacaaguuuuuaaucaaucuccagaauauugacuagucucugacuuaccuggggcacaagagcugguccauugucugacuaucaucugaggaagcccauaccuuggcaguauguccucuaagagcuucuuugucacuaugaauguggugucauguuugguggggaaagccucaguccaaccugaaaagguaucuguaaacaucaguaaauauuuauaucuaaauuuuucugguuuuaccucuaugaauuauguuucuuaaacucugggcuuugugccucuaaaccuauuacugggucuaauuucuuuaacagguaggccacuggccagaucuuucguccaugaagagauggaagggcuuagucacaucuggcaaccccaaagcuguguagaaauuucugucuggucucagugagccaccucugaccuuucuuaauauguaucucccagaucugggaaaaucaccuguaguuggcagaauggggccuuuuuagcagaggcuugauaaucugaacuuuccagggccuccaagaggucuuagucuccuuuaaacauuuuuguuugauuucuggugccaccaggaagucauucacaaacuguaggagagucagcuuaggaugcuggguucucaggucuucgcucuugggugccaaggguaagccaaagaaagcuucuuuuaaaucuagcaccauauaccauuggcgcuuaggaggaacagcauucaaagggggggggggagguguagggauuaggggcuguuggguggauaaugaauggguuacccuguucacucccaaguccacuguucuuuggguagguaggccaugaguguuauuuaauuccuguugcuccuuggaccuaggauuuuuuuuuuuuuuugaagagacuucauuuucagguuuuaguaagacagaguagaauguuaagcucuauuagcaacaaggaagcuggugcuuugcuuugcuuugcuuugcuuuuuucuuuuuuuuuuucuuucuuuuuuuuuaauuuuuaggguuaccaugggcaucuuuuaaggccaugguuugaauaggcuuuuuuuuccuugguguauuuucuggcccaguggcccucuuuuuuuauaauaaguacauugguucuuucccauguugcacuuuagggccccccagcuccccuuagcucuuucuuagaagucauuuguuucaggcaucuccuauaguccucugggauuggccguggcugccaacaggaucucugucagaucaccagucuuuuguuuucauucuuagaccuuuuucuagucccuaaaccccuugucauuuuuuuucuuaauauuuggugcugccugauaaaggguagagcuaccacuacuuucaucuuuggccaaauuagucguuuugauaccugccaguagagacuggugacuuaagaauccuuucuuacaggcuggagagauggcucagugcauaagagcacugacugcucuuccagagguccugaguucaacucccagcaaccacacaauggcucacaaccaucuguaaugggaucugaugucuuuuucuggugugucugaagauagcaacacaguguauuaaaugcauaaaauaaauaaauaaaucuuuaauuauuaaagaacaaaaaagaaacccuccuuacuuuaucaggacuggagucccaaucuggguggguucagggaaagccagcacagauagcugcuuggugaaguuuccuggccucugucugaggugaagacaaccugccagagcuguugguaauuaucucaagugggcuugugggugaagaggacugucucuaggaaauuaauuaaaucuugaggguuuaauuaaucucugaaaagcgggaguucugaauucuccaguaaaagucacuaguggcaaggggccaauaggaugaaguuguuuuccuugaucaccgacuagcccagcugcacacaagggcaggacagacaauagacuugggcucagaagaccaaucucaacuuuuaaucuuugggcagagggcguugggggcagagccucuaagaauucagucugaagccguccuggguugccaccuuaacauagcagcauauugucuuguuuauucuagcucugaguagguaggugacugcacagaguacccuaaggcacguggaagggagugguuguuguuucuaggugggcuaaguguggcaggauggugucaauggagacccucucauuacaacucagaggcuacaucuacagccuacaucugcaucuuguucagacagggagugagcacuucuccuggcaggaaggguagcagccacucacugaacaaaaugagugaccaggagucuauucuacguuccgguguggaaggagacaucugccaaauuggggucucuccgguccaggcuguccuugcuuggagcccuguucucugggaacucaucuuccauuuggggagaucuucauuagggccacaggaggcccuagucucagaccuuucuaggggcccaaggacgcuuccccaccccugccugugcucagcugaguugccugcuugcagcuugccaccccaccaggccaagggaagcccuugacaccccugugcgaauugucagggagcuggccagguucuaugugucccacagccagugggaagcaggugggaagcagcagggagggccccgcaagcagcacugagaaggggcacagagcccuccacacaccgcuggggugcaacacagugccacuauggugggcccugucuccccaaagauuugucugccucugccucccuauuccugagauuaaagacaugugccaccacgccugcuuucauaauuaagcuauauuguaaacaugagcacagcuucacucauucuuuucaugcugcaacagcaaaucugaacaccugccgaggucuccauugacacugcauguugagaguguuugguuuguauaaacuuuguauacuuuguauacgaaacaaacguugcaggauaugugaucacacacuuuacagugugauauuuacugauaaaaccuguuucuaguugugguguggcuugccacuuagcacacaccuuuaaucucuuuggcuggaauacagacaugcccuuaguacacacuuuuaauccuaaacaaugaagguaaaguuaguuuauagaagaaagccauguuugaaagugaugucuaauugaguggcaaauuaauugaguacaagauuugacaggauagguuauguccaacucucacgagaaaauguuacuuaaagcagugcagagaaaaagauuuuaccaggacgguuguacagagacagguugcagagagaacaagccagggaaugaggcgccagaagauuugaacagauagaguuaguuugaggccaagcagggaggccaagaaaagagggauuuguaaggguggggcugggaagagaggagagaggggcugcuguggucaagauagaaaagcaauuuaagagaggaaaaaagaagccagauugaaucagucagcuuggagaggaguuuuggaccagaacaguugaguugaccagccagcaagaaaacuagaaauggugagcuuauuuagcaguaagucucagaggcugaaaacauucuaggccuggauuagauuguacagaggcuagguuaguggagacaguaagccucugaggcaacaauuaauucuggcaaauaaaagauauuucucucucucccucccucccucucccuuccucucccuuccucccucccucccucccucccucccucucccuuccucucccucccucccucccucucccuuccucucccucccucccucccucccucucccuuccucucccucccucccucccucucccuuccucucccucccucccucccucccucucccuuccucucccucccucccucucccuuccucucccuccgucucuuucuuucucccucucuccacacauacagagagagacaaucauucuccugcucuaaucagugcacaugugugauuuacuuauuagccuugcucauucuaagagugcuguaaccuauugcacuuaacaaaagagcucuuuguugaguuaaaguagcauuguuaaaaagauacacaaaaguaauaaugaaaaagccagugaggugggucguagauaaggaaccuccugcugaccugaguuucaacaugauggaaggagaggacugcuuccacugguuguccugaccucugcacaugugucauagcauacuugcaccagcaugcauauaaacacacacaaauaaauacacacaaaaccacaaacauuuaaaaaugaaaaagaucgucaagcaaaaauguuucuaagcgaccuuuuaaggguaaaauaaauggaaaagguauugauacugguuuaaauauuuuccaaagaaauuauuucaauagaauuuuucucucucucuuuuuuuuucuuuuuuuaaaaacaggaccucuucuaaguguuggaaaauugagaguuucggauagugcucuuuugacuaauauauauuuagcacauccuggaguuuacuuuuagcuucuaacauuuuccuuuaaaccacuuaagaagguaucuuuccugcucagucccuacuuaaaagaagugauguaagcagacaccuagcauuaguucacuauugcagcacagugaugguuucgggcacauggaggcuuguguuuauuaauaaaagcauuuucugcccuuuguucuaucauuucuaauucccagcucucucucauugugcauucuaguggcaguuuccuaaugagcuuuuuguuguucugaucuucugaaguucagcuagaaaugcugaacuuucuaaaauaguagugugcaauuaaagauggauagaagcccuucgaaucugaggugcucucuuuuaagauguugccagguagugguggcggaugcuuuuaauccaacaaucaggaggcagaggcagguggaucucugagguugagccagccuggucuacaagggaguuccagggcaggcagcuacacagagaaaccugucaaaaauaaauuagauagauagauagauagauagauagauagauagauagauagauauagaugacagauacaauguuuaauguauuacgcugcccaagucccuucuacuuauacguuaugauguuguuuaauauaaaguguuucccuuuuuuagaauaccuuuugucauuuuaaaauaaacuguggggcuggugagauggcucagcugguaagagugccgacugcucuuccaaagguccugaguucaaaucccagcaaccacaugguggcucacaaccauucauaacaagaucugaugcccuuuucuggagugucugaagacagcugcaguguacuuacauauaauaaauaaauaaauaaauaaauaaaucuuuuuuaaaaaaacuguggauuuuuaagauugagaucuauuaguagccuuuaugggguuguugaaacuccaaaaauuauuuggggaguaaugaaugaaugaaugaaugaauguaucuugcagucguuguugauacagugccuggaucaguauuaagauuguaacaaggauagcauuuucaaaaucaagacaaauuuaaacuguuucuccaguucuuucugauaacucauacucuuuuuuuuuuuuuuucuuucuuucuuuccccuuugcaggaaaaacaagaguggugguggcuuuauauugcagauaggaaagaacaaacauuaauauccaugccauaucaugugugcacacugaaggauacagaagagguaauuagccaacaauauuuguuuuaauaucuuaccuuuaugauguuucauuaaaauuuuaauaauguggcuuacuguauuuugcucauugcauuuucuuuguuuuuguuggggccagcccguaacauuaguucugggguacaugauggucucuccagauaccugcacuuauguguauguacacacacacaucuaauuuagaaugaaaauaguuuuguuuuguuuuguuuuaaggaagggaggauuaaucucagaagggucauccauguuugacaaauaguccuuuacuuuuacuuucaugacaagguuaagacacagaaguaaacuuguucuuauagcagucgggaagcagagagaauagggaaaggauaggagacaagauagacccuucauaggcacaccccuucuguggcccacuuccucuagccagggucugccuccuauugcccaucaccuuucaauaugucaucaaauuauguugccaucaaaggguuaaucauagauuguauuguagcucucaaguuugugaugaagggucauuuacucaauaaguuguuuacucauggaagcuguauucuguucuacuguaucuugggguauauggauguguguguggauguguguaugagugguuugcaggcugugguccagcuaguacaacaauggcugucucucaacaguccacaaaacuggaugucucagauggucuucaguguauguuggaaucccaaagcaguaggauauaugaacuugccaauaagagugagggcaagcagauaaagagcaaaagcugcugucuuccaugucuuuuauauaagcuaccacuagaagguguggcccagguuuagggugggucuucugaccuuaaaugauccagauuuaaaguugaucuuucuuaauuacuguucuuuuucugugaagagacaucauaaccaaggcagcuuuuacauaggaaggaauucagugggggggucuuacuuacaguuucaggagcuuagaccauuagcauaauggcagggagcaugacagcagacagguauggugcuggagaaguauuugaaagcuguaucuugauuuguuggcagagaaagggagacuaggccuagcaugagcuuuugaaauuucaaagcccacccccaguaacacaguuccucccccaaagccacaccuccuuauccuucucaaauagagccacucccugaugccuaaacauucaauaaauauaugagcauaugaggccauucuuauucaaaccaccacacuucacucucuacccccauauauagccauaucauaauauaaaaauggguucagcacaacuucaaaauuccccauaaucugacacagucucaacauuguuuuaaaguucaaauucucuucugaaauucauggcaguuuccuuaacuguaucccccuauaaggucaaaaucaaaaagcagaucauauacuuccaacauacaauggcacaggauaaacauugucauuucaaaaggaaggaagagaacauagugaagaaauaaugggccagggcaagucuuaaaaccagaagggcaaacuuuaaauucuguaucuccaugccaaaacacucuuuagaucuucaauuccuuucaacuuuguugacugcaacacacuucucucagucuguuuccacucccagucugcaauucuccuugucaggcaagugcucggcucgccuacacaguucaugucaucuauuuuguuguuacuggggcucccucaccaacaggauuucucuaugugguccugggugcucuggaucuagcucuguagaucaggcuggccucgaacucacagagauccaccugccccugcuuccugggagcugggauuaaaggcgugugccacuacugcccagcacuccauuuuuaauguauuuuccuugugguauuuauguagauaauauacagauuauuugcccuccccaaauuuuuacacaaaaguuggcaaauacugugcuucacaaccgaccuuuuuucuucuaacaauaaaacuugggccuggaucuccugaguuacagucucuugccacaaguguaaugcaguuguuaagagugagcacugaugugaugcagcgucacaguucaguucauggcccugcauaucugccacaggcucugcuuccucuucaaguucacaagcaaaaggaaggucacuugguuuuuguucucaguccuuuuuucucuggguacauacacgccagccaagcguggcgaucacuggagucagaacuugcagcuccuuuuuuguuucuucauacaauccuuugcaagacuccgccaggcuguuuuguuagaguaucaguguaacuugucucacugcuuacucacuacauuucuuacuggucacauauuucaugugucacacguuguguguguuuguccccauuuguagugauaagguuuccuuacuuccagaguguuuggugaaccucaucugugguauguuauuugggcaucguacuguucucuggauauuuuuaccaaauguuuagcaugcagugaugguuuggcuguaaaucacuuuuuauucuauagucugaauuuguuuuaacagugaaaguagacacucagugaggucgggcauauuuuuguguguacguuuguucccuuguuuuuauuuaucucuuaacuuggaugucuuucuuuuauugugaggaagugagucuuuaaacaugaacaugaguauucccccuauuuguuucgggccccaauuuuccaaggucugggguuacagauucucaccacaaugaccuauauuaauuuauaauauuggcuacaaaaaucuggaauuuggagacuggaggcagauaacuagaguauagaaauguuauuuuaaauaugcauuuuuacucucauauggaauugaaaucucuaaagcuauguuacuguuuguauuuguuuaugacuugauuggaaauuuaauauccuuuugggcuuguuuuuauauaguuuuauguaauuuauacuuuauuuuucugcuauggauagauguuaggguaguaaagggccuuauuaaaacuaacaaaucauuuauugaaauauaauggaguaaaaauauguaauucuuuuuaaauuuguuuucauaauuuugaguuucauauaugaauauagugauuuuuaguuguuuuguaucuauucuucccucugauuucuucuucccuugcccuuugaagcccuuuuucccaacaaguaaguguguguguguguguguguguguguguguguguguauuuguauguuuccuacugaguuucauuuggaugcucgcaugaacgugggugaaaagcuguuuacuggaaagugggcaccuucguccccagcaacuguuaacugccagcagcagucccuugggagucuugggucuugcuggcuuaugugguauaaccaccgcugcagugaguugggaguucagcggcccugucauguccucaagacucuuuucugcagcagaucccugcuccagcucuuacauucuuucugcaccuuccucccugagucuugaaguguucuuuuuggauuuuuaaggcauaaauaauuuauuauggaaauagaauuuggcaaaaauuacuuuuuaucuagccaagucuauuuaaccuuucauuuauucauacuuucauucuuuauugcauuucuuuugaguguuaagguggcagcauagaauuuaauaugcuuucuugagcuguguacauagaaaugaaccccaguaguucugcuuaauuugauuuccuuuuuguuuagaguuuauaauagaugagauggaacucacacgugcuguuuguuauuaugacagugugugcaaaucaucugcuccacccucugaggcaggaaguuuaaaggcauucucuuggucuuuaaaguguugauuuuuaucuucuuagguagaacugaaguuucccgcacccggcaagccuggaaauuaucaguauacaguguuccugagaucagacuccuauaugggcuuggaucagauuaaaccacugaagguaggacaagugagcagucacugagggcacauggagugggcccugagcaaaugccugaggcaggcuggagacagagaaagaccaccucauacgccuucaguaauagcuagauuuuuagggagcccugaacuuagauuguacguugcuuuaguggucguuuuaaugcacuguaacaugugauacaucucagggcuuuaaaaaggcuggugggggucagauggagacaggacucauuuuuccuuagacuuuacuggaguguuuguugauuucugaaaugaagauuuuuuuuguacuuuuggguuuuuuuguuuuguuuuguuuuuguuuuuuuuuaaaucaucuuagaacauaaacuuuguguaugguuugaaacacacuuuacucauuucccuugagcuuuucauacacgucaucucuuagauuagugagauugugcuaaaugauugugacacuguugagaguaaaggagacaggaaaggugagucugucuuuccuccugaaagcucuguauuucuuguguuggccauagaauuuuacuuccuagaagucuuuggaaggcauacuugaauuuuucuuucuucagccaaagacuucuaauuagagaccacucaguguuauugcuuaggaaucaugguugcuaguaguuugugccauagaaauacuuucuuaaaugcuugaacuuccacagagucaaaauguugaacuauauuagaaauugaauuacauuacuaaguauauuuagcguuuuuauuugcagaaugaagaaucuuuguaaugaaugugcugaauguagaguugcagcuacaaaguucacucucugugauugccacagucagagaaaaccuucacuagauaguguuuucauuauucuucuccaaauuucugacauacguauuuaauuguuuauaguuggaaguucaugaggccaagccugugccagaaaaccacccacagugggacacagcgauagaaggugacgaagaccaggaagacagugaaggauuugaagacagcuuugaggaagaggaggaggaagaggaagguggagacuaacccgagugaguggacuacagcguuugcacauccuugcaaacauugcugcucugugagaggucauaaagcagcagcagugagggcugauauggagggaaggguugccgacuuuacuagaaacggaugcaaaaaagaggccgcuggugccaggguacaaucugaaaaggguuuuuaaagccuuucagguaugggguggugcguuuaucucaucugcaaaugauaauaaauccuuugauguuccaacuguccagaagugugggcugugcauuaccugauagauuaugcucucaguaaaagucaaggcacaugaaaacaaucuauaaaugaggagcucuucuuuguucagcuuuaguuuuaguaaacauuaaaauaugauaagcaucacacauguuuuaaguaaugucugcucaaguuuuuaaucuguuaguaagcucuauuauucauuuaucaauauuuuacaaaugguaagauuguaacaguuccauauguaaguugaaaccauaauuuucaucuaucuuggccauaacuuagcauucucacacauuccacauaauacagagggcuacauuuuagaauuuuccauucuuaauugcccagaguuagcagacguuauaaaaguggcuuuuauuggcuuacagccucuuaaagccucugguggugucagugcaggaucgaauuaauccgauaagcuucagggccaaaaguuacuccgggaccacacguucucugacgcucgguugaugucauucagccuuuuggaaaagguucacuagaaaagcugcacuacauucguaguuuaaccuaccugacucuguccgaagccuucugaagacaguaacuacagcauacaaaggaggcacuuuuguauucauuuggacuccuguuaauaaaauagaaguuugacucauuuuauguuuguaaucgugugugucuuuuuacuccuagagaaagggcauaaauaggguaauguuuuauuuuucaacucuaaaguuuaauauuguaccucacuguggaagugacugcuaucucugucuacucuuggaaagcccaggaggaagaacucuucucucucauuuaguacaaccuaaaagauagugcucaacacagaguagaaaugugugugugaugagucacugaggucagaggaauauuuuuauuacuagacauagaggacacacacgucuacaguacuauaagacugacugcaauaauccuaucaaacucuccauaggccaaaguacuguugcaauacuaacuuaucaccuguuuauuuaaaagguugcuacucuuccugcagaauuaucgcugguauuuuguuacuacaguaguuggaaauaaaauuuaaaaauuaccaaaaaugaauuuuuuguuauuguucuaaauuuaagauguaacauguaauaguuguucucacuggaacccugcuuccuuccucugcaggcccggggguguggcuuugccuucagaucgagacuggcugggaagcuccaggguuggcuggcgcuguuagacgcaggcgggagggagggagggagggagucagcugugucaggugagcagagaugaacagccagagcugugcuggucacauuuccuaguuuuccugagggagccaggcucaaggaccgcuucucuaguggcucuuugcccucugaaagguauacagacuguucaaacaacuggcuucucuggcuugagagucucuggugaggauuuuacacccugauaacagcaccaugcuuacaaaacagcaugucuuccaugauuggaaauuccaacaacuugauucuguuugccuauguugugauguguagcaacaucucaaccuaaaggaccaguuuuccucuuaacaagugcuuuggggaaagacuccagcuagggugcucgucucucuacucagucacuuaacuccacaucccuauuuuucucuggauuaauaauuugucugaguuugcauuuaguugaagggagauacagagugaaauugauuaugaaauuaaguaguuuacauuguguaaaaguuuuaaucucuagaucugcagaaugucugucaaaauagagcuuuccacaaggggucuuccugcuaguggaaaguguggcaggugcgaaggcugacaucgggccaccugacugaggucucagacccaaaagcagauguucgcagucucuaaacuguugggauuuuugagaagacucgagacauugaauuaagauucuguguguggagcaaucucguucuuugcucugccuuucccagcaugcccuagggguggagaagaacaggcuguugagugguacuguccugcugugcugggacguucgggccuguccgacaccaguuccugccauguggaaugaggcaguguacugaggcuuucuuugugugacuugauuuguguuuuguuuuugagacucacuauauagccuuggcuggccuugacccacaguguagccuaggauguggaccuuguaauccuccucuggccuccgucuccggaguaauaggauuacaagcaagagccaccacgccugguguuaacguaucugcuacauguauucagguauccgcuccagcugccuccuaccauacacuggaguguuguuuaguaauaauguguauuucaaaugcacuacauguuuuugagggauuguuuaucauguauuuacugaauuuccauguccgggcucugucauuaggcacuguagcuauauggacacucucuguguuaaggacuuaacuuggacuuuuagucagcacauggugggaauuucuccuuucuccacuggcacaguggccaauaccuccccuuuccuuuccuuuccuuuccuuuccuuuccuuuccuuuccuuuccuuuccuuuccuuuccuguuguuguuuguuuguuuguuugcuugagcuugucacuaggcagaggaauucuguuugaaggaacuagcuauuaaguuagguggccuuugccuagccccuuaucccuuuugaauaaagcaacaugcaucuuuuguuguuaaaugcuucuuuuuugaagcauuuucucgacucuaugaauccccuauuuagucugccuuaaagugaaacaacgaccagugaaccgaagcaugacauuuuaccagcugugcagugguuagcuaagugugucuugagauguuagcaucaucaugcacuuaaacuugacacuagggcuauuuuacaaaccuuaacaaacaaaacagaugccaccuuguacauuauccuguuacugagcuaaaaauccaaauagcaaucaugggcaugcuuuagaacugugguuucaggcagggguauacauccuggggguaugcagauacuaaguccauugagaaaauguuaaaauaaugauucuuuguauuuaaucucauccuuuuaaauuucuauuuuuauguguuuuauaauguacauaauauauuguacaguuguacacuuauauaauuuauaaauaaauaauacauuuauuggugcauuauuuuuucccuga

SEQ ID NO: 5484 - RNA, 1869 nt, Mus musculus
cguuguagacgcggaugcugcgcggcuccgggggcugcuggcggccgccugcuccugggcggcgggcaccggcccuacucggagccgccaccuccccgcgacgaccccuccugcucccgagcuccgugacgugggcuccggugggcucagaguuggcuucugaggaugaccuagaggccgcugaggcaaaacauagcggggugaaggguggagguggagcgcugaaagggcgcagggaccugaaggcagagcgagaacucggcuccgggguugcagcgcccgggagcggagggaaacacagaccggacccaccgcucaggcaccaguguccugcuccgaagacuacggcaggcuguguggaggcugaaugucgcuuagaggggucuccagcacagcgcgccgucagacuguuugccaggaagcuuuugccuuccugagaaggacuucgaaguaggacaacucagccuccagcucccugauuuucuuucucuuucugucucccuucccccucugccccaaacgcaagcuuaugcucuguuacaaaguagcaucuuuacccggugacccggcuugcacccucaccgugcccugugcuuaaugggaaggguugggcuuaguggguacuguugugcgcucaggaucccuccccccagaagccccacgcccucgccacgcacgacaggacccucuccucuccaucagguuccacacucuuccaccagacucgcaucugcugguuccaaagcccagcucauccuccaugcgcucacguguuuccucuugggccgccucuguccacgcccuggaccaaggucggcugcgccugucccugucuuuuggguugagguaucagcgugaaccguuugaugaggcuccagagacaacacacagcucugaaaaucuccuacacacacugcaaaggaacgacaccuagacguucccaguucagcuuucccgcgccgcuccacuuuguaauuaccugacacaaugugauauggggguguccauuguuccccggcuuguuauuacggaguguucauuaugacagugguggaauuuaaaauuacacauuuuuaaguccuuaagagauagaaugaauucgguguggggguaugaguaagcuuuucauuaaaaucucaguucggccuaucaagugggguucauucugaguguugccuugccuaauuugcauuuuagcaugguuuugucucuuuaagcauagaauuacagauaucugggagcguacucugcagggcugaacaacccuaugaggccuguuuuugcauuuuagcauaauguguuucguacaaauauuugggaggguacccuggaaagcaucuucucuuucgugugcugggggugcgagggaaaguaccuguguacccgaagccaugcagaaggccugugggaacuucuaaaagccagcuuuugccuuuuaggggucauagugaaaagccagggggucgugucaaggauuuaagaaaagggguagaugaaaaccaaggagaugugcauccagcuucagagccccaaguccucuggcugggucauauguauuugcagaagacguugguaaaccuccagcgacccaguaguuaaggaggcugagagaagcccggacuccuccccaucacuaaggaaugugauccuuauauaugguuacaccauucauaguauguaugguuacacuauauauagagggugucuccaucauccuauuguugguaggcuuguuuuuuucuguucuguccucuugguguuuagcuaaaaaaaaaaaaaaaaaaaaaaaaaaaaagugguaggaaaacuuuuucccccuuacuuuguaaaacuacagacucauguuguaaaauaaacuaugcaauaaga

SEQ ID NO: 5485 - RNA, 1869 nt, Mus musculus
ucuuauugcauaguuuauuuuacaacaugagucuguaguuuuacaaaguaagggggaaaaaguuuuccuaccacuuuuuuuuuuuuuuuuuuuuuuuuuuuuuagcuaaacaccaagaggacagaacagaaaaaaacaagccuaccaacaauaggaugauggagacacccucuauauauaguguaaccauacauacuaugaaugguguaaccauauauaaggaucacauuccuuagugauggggaggaguccgggcuucucucagccuccuuaacuacugggucgcuggagguuuaccaacgucuucugcaaauacauaugacccagccagaggacuuggggcucugaagcuggaugcacaucuccuugguuuucaucuaccccuuuucuuaaauccuugacacgacccccuggcuuuucacuaugaccccuaaaaggcaaaagcuggcuuuuagaaguucccacaggccuucugcauggcuucggguacacagguacuuucccucgcacccccagcacacgaaagagaagaugcuuuccaggguacccucccaaauauuuguacgaaacacauuaugcuaaaaugcaaaaacaggccucauaggguuguucagcccugcagaguacgcucccagauaucuguaauucuaugcuuaaagagacaaaaccaugcuaaaaugcaaauuaggcaaggcaacacucagaaugaaccccacuugauaggccgaacugagauuuuaaugaaaagcuuacucauacccccacaccgaauucauucuaucucuuaaggacuuaaaaauguguaauuuuaaauuccaccacugucauaaugaacacuccguaauaacaagccggggaacaauggacacccccauaucacauugugucagguaauuacaaaguggagcggcgcgggaaagcugaacugggaacgucuaggugucguuccuuugcaguguguguaggagauuuucagagcuguguguugucucuggagccucaucaaacgguucacgcugauaccucaacccaaaagacagggacaggcgcagccgaccuugguccagggcguggacagaggcggcccaagaggaaacacgugagcgcauggaggaugagcugggcuuuggaaccagcagaugcgagucugguggaagaguguggaaccugauggagaggagaggguccugucgugcguggcgagggcguggggcuucuggggggagggauccugagcgcacaacaguacccacuaagcccaacccuucccauuaagcacagggcacggugagggugcaagccgggucaccggguaaagaugcuacuuuguaacagagcauaagcuugcguuuggggcagagggggaagggagacagaaagagaaagaaaaucagggagcuggaggcugaguuguccuacuucgaaguccuucucaggaaggcaaaagcuuccuggcaaacagucugacggcgcgcugugcuggagaccccucuaagcgacauucagccuccacacagccugccguagucuucggagcaggacacuggugccugagcgguggguccggucuguguuucccuccgcucccgggcgcugcaaccccggagccgaguucucgcucugccuucaggucccugcgcccuuucagcgcuccaccuccacccuucaccccgcuauguuuugccucagcggccucuaggucauccucagaagccaacucugagcccaccggagcccacgucacggagcucgggagcaggaggggucgucgcggggagguggcggcuccgaguagggccggugcccgccgcccaggagcaggcggccgccagcagcccccggagccgcgcagcauccgcgucuacaacg
